United States Patent 10,870,889 (IMMUNOGLOBULIN EXPRESSION LEVELS AS BIOMARKER FOR PROTEASOME INHIBITOR RESPONSE) - sequence listing, part 11

SEQ ID NO: 720 - DNA, 225324 bp, Homo sapiens
cgggaacggatggcggcctgggccccgtagcagcggcggctctacggcccggggccccgggcgggcggaggtggcggctcccgggaccggccgcgcggtgagtccggagctttgtgtggagccgggactgggggaggaaagaggcggcggcaccgatggggcgcggggctgaggggatctgatgggggccgggggcggcggcgctgcctgacggaggaagtgggggttgggggggctggggcggagcgaggggaaggtgtgtagggggggtcgttgcgtgggtgggggagggggcgtcgaggggcgcggggtgaagttcaaagcgtggccacggccggttcaggctgagggtaggggtgcccgggaggggattagggtctggctaggttatgggagcaggccagagagtttctgaggcgagtctgggtatgttgagggcgctcggggcgactggggccagtcagggagttggcgggggagggggggcgggggcggtggtggttgttcagagcatagggtcggaagcaggacgtgtgcgtgacctaggagtggggagcaaggtggctgggatcctgcagtaagtaggttgtgggtgtgtgcccctaacagtcttcaggtcacatttactcctgtccttttcttcaagatggagggatccctgggcctggacctcaactgctatccttgtacccccgggagggtttgtgaccctatcctgtttggaaaacccatgctgccctcttttccctttatgtgtaattacggttggatcatctctgtgctttgctcagattctccttcctccctctggggttgaggaggaggagacacatctgaccaattaatgtgtgtttgtgaaacaggcagcagcaaacagtcatttcagcttcgaggaattaggctcacacagggtggagagatcagagcccttcagggggaatatttctgaacaaatcacggatgattaaattctctaagaaacagctccctacctaaatgagagtgagaaagatagggaagaaagcctgtctgtttccagccatgtgtccagagcctaaggggttgaggagagtccccaagcccctacaggcctcccttttctgtattaggctttgctctgcagccttgagttaatttcacccctgctgctttgtcttgggggagggagtgctggtttaggctgttgtgaggagatgactgttctgctgccacacacaatagtcgtgtcattttatcgggagcgctaccccagggctgagaactgctgcagcagagataaaccggtccctctcacccgcctattgtgtacacagtgaaggtcataggttcaagtcttgtctgagagctttggatatgctccatctcccaggctcctcagtgccattttcttccttttccagactggggcttgccattggaggaggccagagagaaaggctcttctttttgagtgaggaacaatgcagagctcattggcacacatttttcagaagaataagggatgccagccatgttgtgcctgcctctttggctagcctgtactaagttgtgaaggaatagtgtctggtagactcaactacgatgtttgtttcagacccttaaggaagaagacttcaagggaaggttctactcttagttgaatcatcatatttaattcttttatatgaatggaacactcatgcagtgatttttgtttgtttccgaataccactaaaaacctgtgcagtgttaagatggggagtcaagcccaggtgtggtggctcatgcttgtaatcttggcactttgggagaatgaagccagaggatggctggagcccaggagtttaagaccagcctgggcaacaaagcaagaccctgtttctttaaaaataaaaaataaaaaagtcaagaaccaagtacctttttaatggtggcttcctggtcaataataatagcacaacaaaaaagccacagaatttgcctatctgggcaagggctgtgggaacaaacctttcaatatttattttaactctaatgaaaggacatgagttgctcattgtgcaaaagtctatatctgcctctgtattaagaaatttgccaaagaaataaacatttttgaaaaaatgtatgggtcttagggattattagtgagagaaggatgagaacaaactagaaggaatcctattgtacatatctgatagaagtgctcaaataatatttatgtactattagttgtgtaaaaaattatttgggaccaggcatggtgctcacacctgtaatcccagcactttgggaggctgaggcaggaggatcacttgagcctaggagtttgagagtggcctgggcaacatagtgagaactcatctctacaaaaatttaaaaaaatacagctagctgggcatagtggcacatgccagtggtcccagctactcaggaggctgaggtgggaagatcgcttgagttcaggagttcgagaccagcttgggcaacatggcaaaaccccatctcaacaaaaaatataaaaaatgttagctgggtgtagtggcatacgcctgtggtcccagcttcttgggaggctgaggtagaaagatctcgttgagcccaggaggttgaggctgcagtgagctgtgattgcaccgctgtactccagcctgggtgatagagcaggaccttgtctttaaaaaaaaaaaaaaaaaatttggggcctggaaaagaggtttccatttaggacattaaatacaacttttctttaaaaagagattagaagtaaaactcattgtgagtggggaattgtatataatgtgctgtgtacacaatagccaatcatttcccataggatagtgttgaataagaactttagcctttggttttggtaaaggtctttctgaggcaattagtctgtctatggtgcctcccttatccttttatttcagtgagtttctttaaatgatggcctgccactgaggtgttgggcctttgataggagggaacaggttgttctgacctttatatattttttgataacagaactgtcttcaggccttactggaggtgttgtctgtctttagactatttccaactctgtgtcctaggaatatttgagtgaagcctcagctaaactgagtccaaagctttttgctcttgggctcttggcatttatttctgaatgctgtcaggtgacagtgaaggcagaagcctcagattaaatttgtcctgattagatttagtggcttcagagttgggcccttgccacaaggaatctcatgtgagtcttctgattgtgaccatcattcaaagagtgctttggattcccccccaactacccgtcccagcttcttggtagaaaaaaatttccttgtgatagaagtctagaaagttggacagattagtgcttattttgtgaggatatggaggcataattttggctcctggtagcaattatgttgcaattagcatatagcaactaaatgactggaacacgataatttgttgaggggtttactgattgctctgtcaagtggaagtgccactccttatttattttatttatttgactcagaacactattgcctgagcttagccatggaggctaagtatagcaatgatatgtgttctccagaagttcccactctgcttcctctttgtagttacttcttttccaggtaccttagtacttgtactgcccttttctcctactctgaaggtagctaagcaattgttatttccctcatggaaaactggtcatggatgggaatactgccaggcagatgggattagcctgagatgaggcagccttatattgtgtgggaagttttcttttcagtctcttaattctctcttctacttgatttttcaaaatcagtttcctttaaagaaaacaaacaaaaaccccacaaaatgcaaaatatcgtaatgtattaaatatgccttcatgatacctctgttataaaagttgtctgtgacagacaaaatgaagataggtgatgttgattggcaggttctgggtccactaagtgtcagtgaaggactcttttcgctagggaacaggtaattcaccaaagcacctgcctagctgggcatgtggaattggcagcagctgtgtagctgaagagggattactgagcaggtggttgaagaatcacatgccacagtgacaagaaaatacttggtcttccgtgggttagattcagtttgtatgtgtgaaattgcactttgtttcacatttcttaatgcttgttgatttgttagtaagatggtaatagaatagagaaagagattcttctgtaactgtggttttttagatcactcagtagcatgccctagacatggccctacacggctctattgtatttatgggagttctggctttatgctttgtgcatgggagggaaatagtggtaattcagtgtttctagtacttgtttattaaagggaaatgggaaggagaaaatttcttgctttcagtatggtgaaaaagatttagcctactgggtggatacctaataggttttatgcaaatgatgtaattgactttttgtggaagtctacctgacatgccttactcaagtgattttgcatgtgtttttatattatgtttttatattatgaatatatttccccacatgaagtttgcatctcttcggttgtttatttgtttgtttgtttgtttttcttttttgagacggagtttcgctcctgtggcccaggctggagtgtaatggtgcgatctcggctcactgcaacctctgcctcccaggttcaagcaattgcttgcgtcagcctcctgaatggctgggtctacaggcgcccaccaccatgcccagctaattttagtatttttagtagagatggggtttcattatgttggccaggctgctgtagagctcctgacctcaggtgatccacccacctcggcctcccaaagtgctgggattacaggtgtgagccatcatgccctgccagttgtttttttcaatttttagtttctcccagcacctttgtaactcttttccctgacattgacattaacatcacttgttagaaccaagtcatcaccagaagaaatgatgttaaggaacatcaccactaaatatttatcttaaaaacggatataggccgggcgcagtggctcatgcctgtaatcccagcactttgggaggctgaggcgggcagatcacctgaggtcaggagtttgagaccagcctggctgacatggtgaaactccatctctactaataatacaaaaattagccaggcttggtggtgcactcctgtaattccagctactcgggaggctgaggcaggagaatcgcttgaacccgggaggtggaggttgcagtgagctgagattgcgccatcgcactccagcctggtcaacaagaatgaaaccctgtctcaaaaaaaaaaaaaaaaaaaaaaagttagcggggggtatagcatttcctataacttgggaaaagactatttgaggttttctgaaaattcagattttttaatagattatcatcttctgttaatatgattttctctttcatatgtttgtgccactataataggaatgccatagagcctaaaacttgtaagcaagtaactttgtgtttattttctgacctttttagtgccttccattcattttctatattaggccaacaggttgtgtgccccttctcttgaaacacatacacacacgacctaatggaattcacagggtactaattaacggatgattgaagagaaatgagccatatgaactgttttaaagttcagaaatctctttcccacagcccaagtggagtgaaggctctttgagggaaagtgaggccagactatgactcaggtcagggcctatggagcactgcatagatggggacatttgcagtgatctacctaaagctaagctagctttaagtggaagtctagcgacagcagttaattgtttagtattcacttctaggaaagaatgtcaagttcttgatttcctcatacgaagctatggcagttttttatgtttgttttattaaaactgttcacaaaccacttatgctttcctagcactctcagtagtttgcttccttttacctttcccccacccccatctcttatcccacttccctaccctgaagacttctctagcagcttggaaacactctaattactgtagctattatagtcacaacccagatcctccacctccttctctctcacccctttctttcttcccccctccccttgctctagcagcaggagttgaactgcagtctcatgagcacagtcagatctatgaatgagctttatatcttgtcaaggcagaactccagatccaacagggctaatttttcatggttctcttgctgtttgttcttggatcagagtcccagaaataagagatggcaaatacctgtcaggtcatatctagtccatcactcaggggcaaacctaggatttttctcttgtctctgtgagaaatttttccttctttcttttgcaggtgagagctgtctgatgccagacaagctctgaaactgccttctttttattgtgttctctggtcattagtgtctggccaacttctttggggtttttttcttttttaattccatttttcaggaatacttcctcccagcaatatctctaccccttcttcagtcctttcttcttgattgtgggcatcacctttgtggattccttttgtaccatcagttatctatgccagaagtatcacttttctgacctttgccacaagtgtcactgtggcctgcttttaaggaggtacatttgatgaaaacacaggacataaattctagcaggtggtaattaataaaatactttagaaaacatgtgccttagcccggtgcggtggcttacgcctctaatctaagcactttgggaggccgagacgggcggatcatgaggtcaagagatcgagaccatcctggccaacatggtgaaatcctgtctctactaaaaatacaaaaattagctgggcatggtggcgcacgtctgtagtcccagctactcgggaggctgaggaaggatgattgcttgaatctgagagatggaggttgcagtgagtggagatcgtgccactgcattccagtctggcaacagagcaaggctctgtcaaaaagaaaaaagaaaatatgtgccttaagtaacccctgtactatatgaacaaatgttgcttcttctgttctaacacttctctttatgtggatgaaattttatttttctgtgtctttgttacagttaagatattgtctaagagtgttatgttttctttactagtatgctttttttttttttcttttttgaggcagggccttgctctgtcaccaggctggagcatagtgacacaatcacgatcacagctcactgcaggctcaacctcctgagctcaagcaattctcctacctcagcctcccaagcagttggaagtacaggcaggcgccaccacacccagctaatttttttttcctccctccctccccttcctctccttcctctctttccttccttccttcctcctttcctttcctttcctttcttttcttttcttttccttccttccttccttcattttctcctctctcctcctccttctgcttctccttccttaagacagggtctcactctgttgcctaggctggagtgcaatggtgcaatcacagctcattccagcctcaatgccaccacacctggctaatttttttgtgtgtttttttttgtttcgctgcattgcccaggcttgtcttgaactcctgggctcaagccatcctcccaccttggcctcccaaagtgctgggattataggcatgagccactgtgaccagcccaatttttaaattgtttttgtagagatggagtctcactatgttgtgtgccactgcactccagtctggttgcccaggctggtctcaaattcctggactcaagcagtcctccttccatggtttcccaaagtgctgggactacagacatgagccacaatgcctggctagtatagcttttcaaagaatagaggggaaaaaatcatagaattgagagtcataaaacccagattctgatcattactgtgcctctaattagctgtttgtccttgtgcaagtcatgcccctgttttcatgtgcctcatctgtgaaatgaacacattagacaggatgatcactgcggttccatttagctgtagaatatcatgataccaagattgagagtcaggttgacacttgtagtcctagcactttgggaggctgaggcaggaggatcacttgagcccaggagttggagaccagcctgggcaacagagaggcctcatatcttaaaaaaaaaaaaaaaaaaaacaacacaattcagcctggccaacatggtgaaaccttgtctctactaaaagtacaaaattagccgtgtgtggtggcacatgcctgtaatcccagctacttgggaggctgaggcaggagaatcgcttaaacttgggaggtagaagttgcagtgagccgagatcaagccattgcactccagcctgggcaacaagagataaattccatttcaataaatacgtaaataattagccaggtggtgtgcactgtggtcccagctcttcaggaagcagagatgggaggatcgcttgagcccaggaggtcgaggctgcagtgagctgtgatctcaccactgcaattcagccttcactcgcacagagcaagaccctatttccaaaaaaaaaaaaaaaaaaaaaaaaagattatggtggaagaacaggacaaaaatatttaacataagtgagcatcttttttttttttattgctggtcaaaaatatagccggtattcagaagggctaatgagtgcaatttcagttccctggggcttgactctcatactctttgatttgtttggaaggctgtacttttattaggccatctttttttggagggttttgtagcctcattctgcaggctcaccaacttgccgcatatatctttttctagtgtgcttaaaacataggagtggaaatcagaaagctgcaaaaaaggctggcctggcttggtggctcacgcctgtaatcctagcactttgggaggccgaggcgggtggatcagcttgaggtcaggagttgagaaagctgcagaaaaggaaccttagcttgtgagaaggaagttgtacctggaaggatttgccatctatcaataagaagtaactttgtaaattcagtcaaggatctaataatctattatatctgaaatctgggagctaaattggactgattatggaggttagttggatatttttccacttttgactagtcagtagaaattccactttgaattaacttcttgggactgagtacaagttgagttgcccacagtgttttgttcggaaaataaaattatgttgttatttatttatttttgacagggtcttacccagccttgacctagtgggttcacctcagccttccaagtagctgggactacaaaagtgtgccaccatgcttggttaatttttgtaattttttttgtagagatgatggtttgccatgttgctcaggctagtcttgagctcctaggctcaagccatcctcctgcttcagcctcccaaagtggtgggattacaggtttgagccactgcacccagccaattacgttatttttaatgctgaaaatgcacgttgatgacatttgccgaagtatgacgaacaagggggtatctctgaaataccctcctaaaagagacgagaaatgaaaagctggttggtaagtgtttcaggaactttcagattgagagtaatgttaggaagtatttgctttcaagcagttttttttttctttttgagatgaagtcgctctgttgcccaggctggagtgcgttggcgtgatcttggttcactgcaacctccacctccagagttcaggcgattctcctgcctcagcctcctgagtagctgggattacaggcgtgtgccaccatgcctggctaatttttgtatttttagtagagatggggtttcaccatgttgttcaggctggtctcgaactcctgacctcatgatccacccgccttggcctcccaaagtgttgggattacaggcgtgagccactgcacccggcctctttcaagcagttttaaggaaataaaattacacagccaagttgttaattccccatattaggatttttatcagcatttttcagttaattatttgatctgggacttcgagtagcagctattaatacttattgaatagtaagaggatgctggtcttttagtcttctgttgttgttaacatagcaaaatcataggtttaatctacctttgaacattggaaataatgttcactgttttcagatttgtacttaaaacatctgttggtccaggcacggtggctcacacctgtaattcccgcactttgagaggccaaggctggcggatcagttgaggccaggaagagaccagcctggtgaacatggtgaaagcccgtctctactaaaaatacaaaaaaataagttaggcgtggtggcatatgcctgtaatcccagctactcaggaggctgaggcattagaatcatttgaacctgggaggcagaggttgcagtgagctgagattgcccccctgtactctagcctgggtgacagagcaaaattgtgtctttaaaaaaaaaaaaaaattctattggtctggagtagaaaaatttggtaggcaaaacttgtttgttttggatcattaaaaagtcctgagagtgccttgctttattcccagccatctatagcacattactaatttttagttcatctaaaggttatttggggaagtgttccacttgaatgtgagattttagaatgatttatattagaaatataagtagtttgttttttgttttttttgtccccccaagatggagtttctctttgttgcccaggctggagtgcagtggcacagtcttggctcaccgcaacttccgcctcccggtttcaggcgattctcctgcctcagcctcctgagtaggtggcattacaggcatgcggcaccacgcctggctaattttttatttttagtggagatggggtttctccatgttggtctggctggtctcgaactcccaaacttaggtgatccgccaacctcggcctcccaaagtgctgggattacaggcatgagccaccatacccggccaatataagtagctttttctttgtttttgtttttgttttgtttgtttgagatggagtcttgctctgtcacccaggcaggagtgcaatggcacaatctcagctaactgcatcctcagcctcctgggttcaagtgattctcctgcctcagcctcccgagtagctggtattataggtgtctgccaccacgcccagctaatttttgtattttttagtagagatggggtttccccatgttggtcaggcttggtctcaaactcccaacctcaggtgatccacccgcctcggcctcccaaagtgctgggattacagccgtgagccaccacacccggcctataagtagtttttatagatggtttaaaaaaagtgtgaagtgcagcatgggggttggattgcaaagtagccaaagtgggtaccacgaaacctttggctatcataccacagcatgaaatccagatgaggcagttagtccatattgcatgctggtaccacatttcatgctggtacctatagtttcttagactgtagttcagtatttgtggagaaagacagcagtgtctgctctatcctgtgtacaaagtacagctagtgtggtcttgggatattatcagcagcatacctagcaacattcctaggtgggcactttgtgtctggttgagatgaattttcattcatatgaatagaagtgaatgttcatgaatataagacgggtgcggtggctcttccttgtaatcccaacactttgggaggccgaggctggaggatcacgtgagcccaggagttcaaggccaacctggacaacatagaccccatctctacaaaaaatttgaaaacctgccatggtggcacactcctgtagttccagctacatgggaagtggatcacttgagcttgggaggttgaggctgccgtgaactgtgatcatgccactttactccagcctgggcagcagtgagaccctgtctcaaaaataataaaaaaaataaagaccaagaatataccttgtaaatttcagctacaaattctgaaattcggtgtaaagctcagcatttatctgttttggaacagatgcttctagagcagagttctaaagaatggtatcaaaaatgaaactataagaaaagacatggaattgtaaagcttatgacatatatatctgaagggtaaggaagggaagaaatttgtttctacttggcatatgctttcagatgtacttcccgttcataatttgaaacccgcctatgcttttctccttgaagcattgctgttcttccagttgctttggcttaaaacttttgactcatatttggttcttttttttttttttttttttttttggagacagagtcttgctctgtcgcccaggctggagtccagtggtgtggtctcggctcactgcaacctctgcctcctgggttcaagcgattctcctgcctcagcctcccaagtagctgggattacagatgcccaccaccatgcttggctaatttttgtatttttagtagagacaggatttcaccatgttggccaggctggtctcgaactgctgacctcgtgatctgcctacctcggcctcccaaagtgctgggattacaggcatgagccaccgcgcctggcctcatatttggttctttttttcgtcctcaccacctcatctgaatcattcaccaaattacgtatctaagcattcactaattggatagcctgacatttagcctcactagttagcctttttctttttttttgagacagagtcttgctctgtcacccagactggagtgcagtggtgcgatatcggcttactgcaacctccacctcctgggttcaagcgattctcctgtctcagcctcccaaagagctgcgattacaggtgcatttcactacgcccagctaatttttgtatttttttgagatggagtctcagtctgtcgcccacaccccgtctcagtgcagtggcgtgatctcggctcactgcaacctctgccgcccaggttcaagcaattctcctgcctcagcctcccgagtagctgtgattacaggcgcctgtcattgcactcggctaatttttgtatttttagtagagatggggtttcaccatcttggccaggctggtcttgaactcctgaccttgtgatccacctgcctcggcctcccaaagtgcggagattacaggcgtgagctaccgtgcctggccaatttttatatttttagtagagacggggtttcaccatcttggccaggctggtctcgaactcctgacctcaggtgatcctcccgcctcggcctcccaaagtgctgggattacaggcgtgagccaccacacctggcctagcctcacttttttttttttttgagactgagttttgctcttgttgcccaggctggagtgcaatggcacaatctcggctcactgcaacctctgcctcccaggttcaagcaattctcctgcctcagcctcccgagtagctgggattacaggcgtacgccaccatgcctggctaattttgtatttttagtagcgacggggtttctccatgttgttcatgctggtctcgaactcccgacctcaggtgatccgcctgcctcagcctcccaaagtgctgggattacaggtgtgagcctggcctcactttttaatctgacctagttcaggtcttcatcttctatatattattgcaataacctcatggttattgcctttttttgtattgcatactacatacaactgctgtattataatttttatttactcatttaggtaatatttactgggcacttatatgccaggccacacatagtcttgtcctgtttggacttgtagtctagtgggagagacaattaatgaatttatgattatgaactaaagtgctctgaaagataagaattttgttctagaagagtgtgtgcaaataaagccagcgtagacctttaaaattacaattttgatcattttgcttctttctataaaatcttcgatggttcccattgcctacataggtcaatattcaaggttctttatgatttgaccaaacctggccttcctcaaccttatttcatatttttcattttatccatatcttttttgttgtttgtttttaagatacgggctcttgctatgtttccctggctggcctcaaactcctgggctcaagtgacctcctacctcagcctcccaaatagctgagattacaggcctgtgctagcatacccagtttatcctttttttttttttttttttttttacagctattcctctaagttaccctgcatttttcagtctccatttcttagggtttttttttctcttctgttctgttggaatgcactaccttgctcccaggacagttaactcccaaatctaaccattccttcaacttagcaaaaaaatttccttcctgaagcctttcttatcccacttcttcctatccacctatctccagaattgatttcatcctcctctttatctctaactttttgctgggatctctgttgtagtactttatcacatgttgtctttttttttttttttttttgagacggagtcttactctgtcacccaggctagagtgcagcgatcttggctcactgcaacctccacctcccaggttcaagcgattctcctgcctcagcctcccgagtaactgggattacagttgcccgccaccgcgcctggctaatttttgtattttagtagagacggggttgagtttcaccatcttggccaggctggtctcgaactcctgacctcgtgatccacctgccttggcctccgaaagtgcttggattacaggcatgagccaccgcgcccagcccgcatgttgtctttaactgtaattatttgtgaatatattttcttcatccctcattttaagctcgtgagatacctgtgtctcctctgttccgtaaactcttagcccagtgcttctttgaatataactttatgcttaattaatgcttgatgaattgaattagaacttgattcttgaaaaaagaaattgtgatttttttagacttctttttatgcaaaagtaacgtaacttccattcaacacattttatcccaaattgaataaactagggaaaaggcagacggtgaatgccttgagaaattgttcagattcaaggacaagcatttgttgcctttactgcatatgactgtactgtggttccatacatccgagctgatagaaaacttgcagcaagggtctagtggtgatgcatggcaggtggaggtgagataaatttagtcacaggaaccaaattggttctgctagggcaatataggcattgttgggccatctgggtgtggttgacttctgggaggtctttttagtttttctttctcacttcattccataaatatttattggatgccctgttctagttgtttaagatcaatgaacaaaatagaccaaaaaaaaaaaatcaacctcatggatattatctttgaataggagatagaaataaacataataatatataaaattagaaaggtaatatatgatatggggaaaagtacagcaggataaggagaattgggagtggaaaagagggttaggtaggagaggtgggaggggttgcaaccctaaataagatggttaaagtagagatctttgagaaatgttgtgttactgggttgttaggcacttccctgagattagtggattctcttctgcccagcagagagaaaggcaatgtctacagttgttccagagtccagctgacactgaggagaaatagctactccttatgttcttttctcctgtctgctcctcttgctggcatcactggaagttaactggggtgaaaattgcagtcagtcttgtctggaagacagcaggggtggaactagagaccttctaacccagttccctgaggggtgggatttacccttctgctgactgagccttggttgcctggagtgatgggtgaggtaggcctctgacttttttccttcctcaaagggagaagcccagtatcataaccttctctcttcttagtgaggcctcagcaactttatttcaggtagctctttaaaaataagctttcaaagagtgtgtgctatgcgcctggcctaaagcgtgaattttcaggtttttggtgctttgacttcctctcaacacattagctgtgttttggaagtctcagtacctaatttcagcagcctaaagatgaagttttcttatgtctagatgctctcttgtttgaattgcacattgtaaatttatttgtttattcccttgcttactcttctctttcttttttttttttttttttttttgagacggtgtcttgctttgttgcctaggctggagtgcagtggcgtgatcttggctcactgcaagctctgcctccccggttcaggccattctcctgcctcagccttccaagtagctgggactacaggcgcctgcccccacacccagctaattttttgtatttttagtagagatggggtttcaccgtgttagccaggatggtctcgatctcctgacctcgtgatccgccggcctcagcctcccaaagtgctgagattacaggcgtgagccaccacgcctggcctgctttacttacccttttctaactcttctacttcattatttttcttgttaccctttcccttttctcctttcatgaagctgataggaaacagaagtcccttaggccagacagctatttaggtaattggctagaagctaaaatgtatacctaatatgcaagcaatggaatggaatgtcttatttccttttttttttttttcttttttttgaaacagagtctcgctctgtcacccaggctggagtgcagtggcgcgatctcagctcactgcaacatctaactcccaggttcaagcaagtctcccacctcagcctcccgactggctgggattacaggcatgcgccaccgcgcccagctaattgttatggttttggtagaaacggggttttaccatgttggccaggctggtcttggaactcctgacatcaggtgatccacccacctcagcctcccaaagtgctgggattataggcatgagccactgtgcctggctgcatatcttatttctgtccacatgttatattggattcagcttgtggacatcaagctctcagcctgttacactatatgccatttgatgtagctgaggatatattgggacccatttactctgtttttggttatttataccaccagcttgtgtagtttcagtacacaagaagacctatttgccattttgtaaaaatgtggtctttttcatatttaattttagaataaaggtgtgtgtgtgtgtgtgtgtgtgtgtgtgtgtgtgtgtgtgtctgtttaaagaggtggggtcttgctgtgttgcccaggttggaggacagtggctattcacaggtgtgatcataagtgtgccatggcctcaaactcataggcttgagctgtcttcctacctcagcctcccaggtagctgggactacaggcacatggcactgcacctggcagaataaatgaactttttttttttgagacggagtctcactctgttgcccaggctgtggtgcattgttgcgatctcggctcactgcaacctctgcctcctgggttcaagtgagtctcctgcctcagccttccaagtagctgggattacaggtgcctgccaccaagcccggctaatttttgtatttttagtttttagtagagacagggtttcaccatgttggccaggctggactcaaactcctgacctcaagtgatcccccacttcccagactcccaaagcactgggattacaagtatgagccaccacatggccagaataaatgaattttgtggtgaactcagatccatactaaggaaaaatctattacttttaagcagacagagttctaatattgggtggtcttctgggcagattttatattacctttctctgggagggtttgctgtatatcaaacttgaagtcatacattctccctacctatgcttaagtagtacataacatattactgatattgtgaattttaaagccagcagctgttaatccaagtgtatgttgttgttttctttagtggttgaaaggatatcagtttaactgaccaaactgtattgcttttattagtaagagaacttgaacatagcttgtttgctgctgtttacttaataatgtttctgtggtttgtgttagtaggcccttccagttgcagagctagaaatctaggcaatgtggatttcagatgagtttcgtaacactatctgacacagtgggaagttcaaggaagtatctggcaatattatttttcttatggagcctttccataagaaagaaattcagttataacaaggtcacatttgggtaggtgacataatggtgaaatgacattttctgccaataacaaaacctatatattgtacctgtgtgatttttttttttttttttttttttttgagacagagtctcgccctgttgcccaggctggagtgcagtggcgcaatctcggctcactgcaagctctgcctcccggattcacaccattctcctgcctcagcctgccaagtagctgagactacaggtgcccaccaccacgcctggctaattttttgtatttttagtggagatggggtttcactgtgttagccaggatggtctctatctcctgaccttgtgatccgcccatctcgacctcccaaagtgctgggattacaggcatgagccaccgcgcctggcccgtacctgtgtgatcttaagcatttgatttatttaaaagttaccagggctgggtgtggtggttcacgcctgtaatcccagcgctttgggaagccgaggtgggcggatcacttgaggtcaggagttcgagactagcctagccaatgtggtgaaaccccgtctctactaaaaatacaaacattagctgggcatggtggtgcacacctgtaatcccagctactcaggaggctgaggcaggagaatggcttgaacccgggaggcagaggttgtagtgagccaagattgcaccactgtactccagcctgggcgacagactgagactctgtctcaaatttaaaaaaaattaaaaatgaaagtgttattggccaggagcagtggctcacgcctttaatcctaacactttgggaggcttgaggtgggcagatcaccctgaagtcagaagctcgaaaccagcctggcgaacgtggcaaaaccccgtctctactaaaaatacaaaaaattagcctggcatggtggcaggtgcctgtaatcccagctcctcagggggtctgaggcaggagaatcgcttgaacctgggaggcagaggttgcagtgagccgatatcgtgccactgcactccagcctgggcaacagagcaagactccatctccaaaaaaaaggtgtgctgggcgcagtggctcacgcctgtaatcccagcactttgggaggctgaggcaggtggatcacctgaggtcaggagttcgagaccagcctgaccaacatggtgaaaccccgtctactaaaatacaaaaattagctgggcgtagtggcgggtgcctgtaatctcagctacttgggaggctaaggcgggagaataggttgaacccaggaggcggaagttgcagtgagccgagattccaccactgcactccagcctgcacaacaagagtgagactccatctcaaaaaaaaaaacaaaaaaagtgttaccaataatttaattctcatctcatatgcttgatggaaggagactaactgttcaggtgtagtactgctctgggctatatacctcataggaatgatagaggcagcaagtgattattataaggaataacaagcaatagtaatgttaattttttccctataaccagggaagtagcatggaagtttgaaaggtttaaatccttgcttaaataaaaatgtcagtcctaatcagaataatgggactgaacttgaaatgttaaaggaattggagaagctgcaaaattaggtcagatagtaatagaaggtttatttatacatagattgattaaattcttcattgagagcaaatgtggttttgactaagataagctactcccgacaattggcagttttagaacatacaaagcaaataaataacctgaattttacccggaggaacaaataagaattgattcaggtttctgtaggtcaggcattatttcataataattataccgtgattaagttcagcattcttcagaaaggagaacaaaatctgtcatgcgaggattcatttttaggaaattgagctgtgatcatgtatatattagggtgagtggagaggaagattttaaagagaaacctactggaaatttaaagacttaaaaatcatcatatttgaaatacatgttaaaagaatgcaagagatcaaaaggaccatacaaaacagttggttatttggcataggcttagaggctgtggagagaagaaaggcatctttcttttttcttttttttttttttttttgagacggagtttcactcttgttgcccaggctggagtgcaatggcgcgatctcggctcaccgcaacctctgcctcccaggttcaagcgattcttctgcctcagcctccctagtagctaggattacaggcatgtgacaccacgcctagctaattctgtatttttagtagaggcggggtttcttcatgttggtcaggctggtctcgaactcccgacctcaggtgatccgcctgcctcggcctcccaaagtgctgggattacaggcatgagccaccgtgaagaaaggcatctttctaagaagaaggcatttctaaaatattggaaacgttttcagtcaaggccagagaagcccacagactgattaggaacaacctagaaattaggtgaataaaagatgaattcaataagcctctttgtagaaatgattaggtaagagattttgtgttttttgtttatttgtttgtttttgagatgaagtcttgctctgtcgcctaggctggagtacagtggcacgatctcggctcacttcaacctccacctcctgggttcaagtgattctcctgcctcagcctcctgagtagctgggattatagtcacacgccaccacacctggctaatttttatatttttagcagagatggggtttcaccatgttgatcaggctggtctcgaactcctgactttgtgatccgcctgccttggcctcccaaggctgggataacaggtgtcagccaccgtgcccagccttgtttttgtttttaaaaaagatatgttataatgaaaaggtcagctagagaattggtaagactacttaatcatggtgtgaaagatccatttaagaatgaaaacattagagaatttccactatttctttccaaccagattaaagtttctagtacaaatgatgatagatgcttaactttttttaaaagtttttttctgattggaacgtgaataaatcctctagaaagtacagaaaaatatctagaagtcccaggaattatcccagaaatgttaacatttatttaatatttcctatacgttttttttttctggctgcctaggcttttcttgattaaatcagtaaacttgatgagctcaaatttatctacccaagaatttaggaagaattcagagttagcctgtggaatgcttagtgaaagtatagtaccttaaattgtaagtggcatggttactatactaaggaactggtgtagatttcagatgtggttctgtccataagaagggttcagagtgaagggactaaaaactacaccatattagaaagctggaaaatgtagattaaagattgagatgatttggtgccagtcatgtaatttgttggcgtcaaggcaatgggttagtttacataaggaaaaatcacatatgacagatcattaatacttttatgtgaacacagttgttaccagtagacattgtttagtttgaaaagacttatggtaaggaaggtcagaccaaagactgcttgaaaactttagtcatggagtgtcagaaaattgttttgttgtgaattagcaaactgattttctgacggtaaatacttgcctaggtctacagtcccttcggttctaaaaacctccaaaagctctgaaaactgaaagatttttgaaaagatatgcacaaatctgacttcaactaataaaaggctatttatagtctttttatgtaaagtaaatattcatattgctggaggaatattaacgaatttgattacagtgtgctgtttcagttttttctttctttttttttttccccctgagatggagtttcactcttatcacccaggctggagtgcaatggtgctatctcagctccctgcaacctccaccttccgggttcaagtgattcttctgcctcagcctcctgagttgctggaattacaggcatgtgccaccacgctcagctaattttgtatttttagtggagacggggttctccatgttggtcaggctggtctcgaactcccagccttaggtgatctgcccgcctcagcctcccaaagtgctgggattacaggcgtgagccaccaagcctggcctctttttttttgaggcaagttcttaccctgtcagccaggctggagtgcagtggcagaatcatggctcactgcttcatcgacctcctgggctccagttatcatcctgtctcaaccttctgagtagctgggactacagatgcataccaccacgcctggctacatttcttattttagtagagacaaggtctggctatgttgcccaggctggtcttgaactcctgagctcagatgaccctcccaccttggcctcccaaagtgctgagattacaggtgtgagccaccatgcccagcactgtttcagtgtctactgacagcattacactctactatataaggtgtattaattatctgagctggccttgaactcctgggctcaaaaatcatcctcttgcctcaacctccagaatagccaggactgtaagcacacatcatcacacctggctatttcagcttctcacagatgaaataactgaggcccaaatagctgtagtgacttcccaatgttattacacatctagggagagtaaatagtagaattgagtttttctgcctgcttacttggttttgtgtttttttttcccccattgcactgtgctgcttccttgttaatcaaatattaacaagtttgatcagagggtgctgtttcagtttctttccttttttttttttttgtcctggtgacattgcctccaaagaccatcttgatgataaataagttctatgtggaagagtttagtgacattcatcttatttgacattttaataaatgtttcacataagtgaaatattgagattttcctatgacattaaactcttccaggtagttaggtccccaaattgttgagattatgcttcaggaatatcttgactgaggtgaaaagtaaatgagcttcagtgtggataagaattgcatttaaaaagagggagaaagtctaaactactttcttaggatgtgtaatttttagctaacaattgcagcccccagtagaaattaagaatcttggccgggcacagtggctcacgcctgtaatcccagcactttgggaggcagaggtgggcggatcacgaggtcaggagttccgggccagcctggccaacatggtgaaaccccgtctctactaaaaatacaaaaattagctgggcgtggtggcgcgtgcctgtaatcccagctgttcgggaggctgaggcaggagaatcgtttgaacctgggaggtggaggttgcagtgagccaagattgcgccattgcactccagcctgggcaacagggtgagactctgtctcaaaaaaaaaaaaaaaaaaagctggatgcggtggcttatgcctgtaatcccagcactttgggaggccgaggcgggcggatcatgaggtcatgagatcgagaccatcctggccaacatggtgaaaccccatctctactaaaaatacaaaaattagctgggcatggtggcgcttgcctgtagtcccagctattcaggaggctgaggcaggagaaccgcttgaacccgggaggcggaggttgcagtgagccgagattgcgccactgcactccagcttgggcgacagcgagactccgtctcaaaaaaaaagtgaaagaaactaggaatcttggtaagatattcctcgcaaaattaacttagtgtactgccacggaaatgctgggcatcattaggaagagaatcagtaccaaataaacaaagataaaaataaacttccatctgtgtaaaaccaaggtttgtttatatttgtgatactgtgtattctgttgaccccgaagaagtatttatcaaagctgatgaccaaagaaggtgaaggctttaatgaatacatgcaaagaaaaaaaaaattcagcttttaaagacaaagggaatataatgtcaagtgatgaaaagaacatatagacttgatcaccagttcttaggatcctgtattagatatggaacactcaggttagaagtgattttagcttaatgattgggctactcttataaatagtaaataaataaaatatgtttaacggcggtagaaatttaaaaatggaagataaagtgtttgcatgttttttaaattacactttttattttgagataattatagagtcttacgcagttgtaagaataatgcagtggggttgggtgcagtggctcatgcctataaccccaacactttgggaggttgaggtgggaggatcacttaagcccaaaagttcaagaccagcctgggcaacatagtgagaccctgtctacaaaatttttttttttaaattcactgggcatggtcatgcacctctgtagtcccagctattctggaagctgagaggattgcttgagcccaggaggtggaaaccgtagtgggccatgatagcgccactgtactctagcctggcaaaacagcaagactgtctcaaaaaatagtaataataatgcagagggatcctttgtacccttgacctagtttcctccagtggtaacatcttgctaaagtacaatatcataattttgacattgatataagccatctatcttgttcagacctccccattttactcataatcacttttgtatatatgtgttttcagttctgtgcagacttaatcacatgtagagtcatactattttcaccaccacagtcaagatacagacagctccatcaccacaaatgtccctcatgttgtccttttatagccacacccacatcctttctactgtccccttctcccatctcccacaataagatttttgataaattattggattggtacattatataataacctgttaagggaatacaggagtatttgaggaagtatatccttgacttttcctaaaattatttaaagtttattttatcggccaggcacgttgtctcacacctgtaatcccagcactttggaaggccaaggcaggcggatcacctgaggtcaggagttcgagacaagcctacccaacatagtgaaaccccgtctctactaaaaatacaaaaattagccgggtgtggcgacgtgcgcctgtagtcccggctattcaggagactgaggtaggagaatcacttgaacccgggaggtggaggtttcagtgagctgagatcgtgccactgcactccagcccaggtgacagagtgagactctgtctccaaaaaaaaaaaaaaaaaattgttttgtctatccaaataatagataaattatttttggtttcctatgaactttgtattaaaagtcaaatagtggggcagctttttttttcaagacacagtcttgctctgtcacccaggccagagtgcagtggcatgatctcaggtcaatgtagcctctgcttcccaggttcaagtgattctcatgcctcagcctcctgagtagctgggactataggcatgtgtcaccatgcgatgctaattttttgtatttttagtagaggcaggttttgccatttggccaagttgacctgaagtaatctgtccgccttggcctcccaagtgctggcattacaggtgtgagccactacgcctggcctttactcccatttttctaaataataatgtgttctcttactgcccttctcttcgtatcgaatcatcccaatatagttatgtcacaatttttggttaggtcgatattcattatttattgtgctgagtaaataatgtttattattgagccgtttgatatactactattacatttttggtgcaactttttccccccaggatttaatatcattacttaattttttttgatttgtttttatatccctatttctgattaatttttttcagactctccaacagatctataaatctcatagtcaaacatcaagtaatctgtaagttagtttcttactgtctccctccatccctcccatcctgttatctctctaaatagcctaatctgtggtgattaatggcatgattccctttacatataatactgctttaggatcaggactatgttatagcaagacaattctcttgttcataggtatttattttacttttttaaaaagtataatatgtatgtagtaaagtacagtaagtgcacgaatcttgtgcacaactcagtttttccatgtgtatacagatatgtaaccactatccagttcaagatatagaacatttatttccagcaccctgcaagattccctcgtgtttcttcccagttggtatccctctccccaagcatgaccacttttcatgactgcttttttcacctttgattcacaggtgttttttttttgttgtttgttttttgttttaattttttttttgagacggagtcttgctctgtcgccccggctggagtgcggtggcacaatctcggctcactgcaacctccgcctcctgggtttaagtgattcttctgcctcagcctcctgagtagctggaactacaagcgagcgccaccacgcccagctaaatttttttgtatttttagtagagatggggtttcaccatattggccaggctggtcttgaactcctgaccttgtgatccacccaccttggcctcccaaagtgctgggattacaggcgtgaaccaccgcacccagccaattcataggtgttttaagtgtgacacttggatggtttaagtctgatagaacttttacatttattatacatttaaatatatacctgggggctctcaggagtttgtggactagtccttttttgggaagcaactatgcatgaatgagactgttgcaaggctaggaatacgcagaaatggttaggaattttaagaaatatggaagctgctttgttttctaaactttcccttagattcttaatgaatctgaattcttttttctggagaaaggaatccacactctgatctagtagatttgacagctgactgctaattgagagagtttataactagtgacaaatcaaggtgaagtaagaatggagaggagaaatgccagcggggcattgatatgattctgctcattgaggagaacagtgttcattcactcatttgttgaccaaaatgcttaatgaaggtggactgtaaaccaaacactggttcttcaatggtgagcacaagagagacagcctctgccctcagggtgggtgcttgcagtgtagtgcaggaaacaaatgtgacatccttgaagcaaaatggtggcagttgtggccatacctcatggctggagaggtagtgttaggtatctttaaggatatttatgtgaatcccacccttttttgtggctagtctaacattatttatattttttgataagagaagttttctttgtcccctcagatttactctagggcttcttgtagaatagatctgggaagggagagataaggtctagaatataaaaaatgaaggcaattccttgtctgttctgaaaaatgctaaatgttttttcctttccctgagactatgaatttgaccatgtttagagatgaagaactaggcgtgatgtaattccagcactttgggaggccaaggtgagaggatctcttgaacgcaggagtttgagaccagtctgggtgacaaagagagactttgtttctacaaaaaaaagaaagaaagaaagaaagaaagaaagaaacaattagccgggtatggtggtggtgcatgcctgtggtcccagctacatgggagactgaagcaggaggaggatcccttgaacccaggaggtcaagactgcagtgagcttgtgtttgtttgcaccactgtattcccacctgggtggcagagtgagaccctgtctcaaaataaaaaaaaaggaaaattaatgattttacacaacagttctgtgtgcaagcctagttttgtgtttttttttttgtttttttgtttttcttttgagatggagtctcactctctctcccaggatggagtgcagtggcgcgatcttggctcactgcaacctccgccctccaagttcaagcaattctcctgcctcagcctcctgagtagctgggattacaggcacctgccaccgcgcccggctaatttttttttagtagagacagggttttaccatcttggccaggctggtcttgaactcctgaccttgtgatccacccgcctcggcctcccaaagtgctggaattacaggcaggagccactgtgcctggcacaagcctagttttttagatgttttgaatgctaccatctccattattcacttttttttttttttttttttagacggagtctcgctctgtcacccaggctggagtgcagaggcgtgatctcagctcactgcaacttctgcctcctggattcaagcgattctcctgcctcagcctcccaagtagctgggattacaggcacccgccaccatgcatggctaatttttgtatttttagtaaagacagtttccccatgttggctaggctggtcttgaactcctgacctcaggtgatctgcccgcctcggcctcccaaagtgctgggattacaggcatgagtcaccatgcccagccactttttttctaacaatttgacattaccacctccttagcacaaaaagtttatctctggggataagaacttctaaagagctacatagccatccaattatgaggggaagaggcatggcagagcttatttttaaatttttatttacttgtttgagacagcacctcgctctgtcacccaggcgggagtgcagtggcatgatcacagctcactgcagcctcaacctcttgggctcaacagataatcccatctcagcctaccaagtaactgagactacaggcatttgccaccatatctggctaattttttatttttatttttgtagagacagggtcccattatgttgcccaggctggtctcaaactcctgggctcgagtaatcctcccgcctcagtctcccaaagtactgggagtacaaaggcataagccactgcacccggccagtagttgtttttttttttttttttcgagacggagttttgctcccgttgcccaggctggagtgcaatggcacggtctcggctcactgcaacctccacctcgcgggttcaagtgattctcctgcctcagcctccctagtagctgggattacaggcatgtgtcaccacacctggctagtttttgtatttttagtagagacagggtttctccatgttggtcaggctggtctcgaactcccgacctcaggtgatccatccaccttggcctcccaaagtgctgggattacaggcatgagccaccgtgcccagcccccagctagtagtttttttttaattgtttacctcagataatctgcctctgctttttggcctagctatacacaggatttagtaagggttttctatgtggatcactttcaccaaatgaatctctaaagggtcaggactgaattatttacatattcaggataccatttagcctattgtgagatacatgctggcacagagcagtagtgacaaacaacaaggatctgaacttgagcccagttgaattgctatgtgctgatggaagagtcagttgcttatgtgaaatgaaacaggtcaagccttgtaatctttgttggagaatagcagcctttgaggactataaaactattgatgagttgcagcatataaagactcagggactaagagatgctgctgttttgctctcctgtccttaggtgacacatggtcagataagccctgttgaattggatctgtcttctcaaattggctcttttagtctgttctttatctaatctccattggagatataagctgaaagctatggtacttgaggagatgacacagttcctttgttacagtaattaatgtaataaattaagggagaggcccaaagggaaggtgattgtttctcattagagccctaggtggaaattcatttgattagcaagctcccatgaagtgtggcaggtagagagggagatgcctgtttttatagttgggtaagctgagagtcactgaggatggtttacatgttgtagtaaccatactgaagctggctaagtatgaattgatttcagggcaacatctagaattcagggaagatggtataatatggttaccttctcagcaactttgttgtatcccattagtttattgacagttccctgagacatcaaatcctgtaaacctcacacagtttatattcaaagacagtttatattgtcagtgggatcaacaaccttgtgggttagaacaactggcaaaagaggtagtacagatgttaaaaccatgagttttgccgggtgtggtggctcacgcctgtaatcccagcactttgggaggctgaggtgggcagatcactaggtcaggagtttgaggccagcttggccaacgtggtgaaaccccatccctctcaaaaataaaaaaattagccgagtatggtggcgcccctccaatcccagctactcgggaggctgaggcagaagaatcgcttgaacccaggaggtggaggttgcagtgagctgagactgtgccgttgcactccagcctgggcgacagagcaagattccgtctcaaaaataaataaataaaaccatgagtcttgagattggtaccttgtccctgagggatttctgaagcaagatggagtctgtcagtcacgacagtatatggctttaggagccacatcgagccaggcgtggtggctcatgcctgtaatcctagcactttagaaggccaacacaggcagatcacctgagatcaggagttcgagaccagcatggccaacatggcgaaaccccatctctactaaaagtacaaaaaattagccaggagtggtggcacatgcctgtaatcccagctacttgggaggctgaggcaggagaattgcttgaagccaggaggtggaggttgcagtgagccgagatcacgccactgcactccagcctgggtgacagagtgagactctgtctcaaagaaaagaagaagaaaaaaagccacatgtgaaggtaggcatagcctaaaaggaaaaccctaatcactgagttcatggaagaagaaaagattgccatttcctttcatagaactcaaatgggtattggtacaacctgtaatttaatttgtaaaaaaaaattttttaaacattttcctttatttttcttaatactttagatgccttgtgaaaggtagaaccatgaaacagttctccctaagttcatacactagaaccttataagagtagttgggtcatatattttcgagttgtcttctttttatttttattttttaaataaatagagatggagtctcgctgtgttgcccaggctggtctagaactcctgggctcaagtgatcctctcacctcggcctcccaaagtgctgggattacagtcgtgaggtgctgtacccagctttgacttgtcttacatttttcagatttatatcctcatgatatgcttagaatgtgatagactcttcctccatcttataatgagaaaatacttaatgaagcagcttagctagtgtcaatggaaatttgagtccagaaatcacatctcctgactcagagttcattgttctttttactacaccatgctaccctcctcgaattgagtatagcattttttctttggcatgcaggttttggaggggaatacctagctagacagccctaatatccatattttgtgtgtgacctgtgtggtctcaagcagattataattcatatataactgtcacatgctcaggccaaagcctataagaggattgatccaaaatccataagaaaaagaggacagataaatttacagtagaacagtattagacaatttactgcttatactggattatctgtgggtagttaccaattaaaggaattggctctttgaagccttcttggatggatacagagatctctcgggggtgaaagagaaatgtagtgtttcttgttatgtttggatatgagtggggtccagttgctgtttttgccctctgagctgggacagaaacctcacatgaaaactctttttcattcttacccttgtcgaaggagaggccttgttcattcctgaggtagaagagttgtatggtctgtgacataagtccttaaaattgcaattaatgacctgaaatgtatgatttacaatgtacaagcctgtgggctgggagtcaaagagatggatgttattatgatatgttttttaagcaggagtgctttgggtaaatacagggtatggaaagtgattgtcatgacctatcttggtcccttaaacatatccatgtagcaaggaatttcttaatgatcaggtgtaggaacaaaacacagatagtactgacaactcatggtggacaagtgattccagaggctgttgagttgcagtcctaaagaaggaagtggagtacacttaggcagaaggagagaaaagaaaggaaaataatcacagaaacttgtgcaagttgttaaatgccttgtggtctctgtaagatattggttctcctgattccgcactttctctgccatgaaagcaagaggtcagtgcttttcgtttcccactagcatgttggttaccccacctcttggggttaaacatctctgcaatgacctgtcaaagagttgattattagctgcataaagccagggatgctgtagggagcagatgggaagtggtttggctgctgcagccaggctgattgaagaatccttggcaattttacagtgtatctttggaaatgtaccaccaaagttactatgaagcctgctgggtttggaaacctagatttctgaaaagtcacctggttgaaaagtagtacttacgaaaactcttcactctcaaaaataggaatatagggacttcctaaaagaacatcaggaccaccaaagatcagtccttgggatatgttttctttgcatcctggtcattcagaaattttggagtagctttctagtagggaaagcactttttgatgggtatattaatagaattataaatttgaaaaaggccttaggcatgtctagactaaccctaccacacacaggagaatcttttatgtatttgcttcacaggtgattatgctttttctgcttaaatactttcagtaaaatagacattaaacattgtgggtcattgttgggaatcaggatattaaattttttcctgagttaaatatctgtctttctgtaacttctactcactgactctctttctaccctcagagtcacagagttactttcttccacactgcacacatcatatacatatatatatgtttttgtttttgttttttctttttgagacagagtcttactctgtcacctatgctggagtgcaatggtgcaatctcagctcactgcctcccagccattatcctacctcagcctcccaagtagctgggattacaggctcccgctaccatgcctggctaattttttgtatttttagtacagacggggtttcatcatgttggccaggctggtcttaaactctgacctcaggtaatccacccgtctaggcctcccaaagtgctgggagaacaggcatgagccaccttgcctggcatcatcatatatttgaagctaacagcctgtcttccttcagtgttctcctttccagaccaaagaatcccagtttctaaggtctttcctcttaagaaatggcttcccagtcttgtaccatactgtgctctgtagtacatcctttcagtttattaatatcacacttaagatgtggaatctggaaatgagcatagatcatcagatgtttttttcgcctccagctaccgtttcagaaaaagtacaatttttaaaaagtgtaatggcagtatcacttgcttactagaaaaaaatcccaaaaaacaaaacaatttgccatggcatatggaattggaacaagaggaatttgaaaaaatatcagctttataacttacggtttgtctttccttattgttaaggctttttgaggtacattatcaaagtactggttttccctcacatattattcagggataattgttaatatctgaattgagttttcagcttacaaagtgcagttgatatttgtatttataggaattatttaaatttatgctacattgaactgattttagtatttcaggtagttttttttgtttgctggttgaattttttcagatggcatctcgctctgtcgcccagtctagagtatagtggcacaatcttggctcactgcaacctctgcctcccaggttcaagcaattctcctgcctcagcctcccaagtagctgagattataagatgtactgtcacacctggttaattttcgtatttttgtatttttagtagagaaagggtttcgtcatgctggctaggctgatctcaaactcctgatcctcaagcgatccacccacctgggcctccaggtggaggcccagaagtgctgggattagccactgtggactactttctttatgaattttaattgatactgcattttttgtttccttgtatcttttttttttttagtgttaaatccttttgtcctttcaactaagttacacattttcattttaacctgttatcttttttttttttttgagacacaatttcattctgtcacccagactggagtgtagtggcgtgatcttggctcactgcaacttcttcttcccagattcaagtgattctcatgcctcagcctcccaagtaagtgggattacaggcacatgccaccacacccagctaatttttgtattattagtagagatgaggtttcaccatgttggccaggctggtcttgaactcctgacctcaagtgatcctcctgcctctgcctcccaaagtgctgggattacaggcatgagcctgtgcctggcctctgttatctttttaatgctctcttccttactggcatactttgtttatcatgcatcctgcagcagggcaggcagtacagtagactgagaactgtcagaagctctcagtgagcactaacatttttctgtttcatacgctttccttactcctccagagtctctcttccgttaccattctattttctagaggaaggtcttttgaaactaaggaaagttttattgtttttctagggataaaacaaggtggggttgttttaatggttaaattacatactgaggatagtgagtaacccttagattaatgtaggttacactctaagcctagccacaattgcaaagattagagaactaaaaaattatgatttggggaagaactgtgctttaagaattctctatcatggaaattcagttggcatctcctttcctagagatgccctctgcccctcataatagaaaaattattttcagtaccatgttccattgccttactcactgtcttacttgctgctgtattttcagcacctagtttagtgcctggcacgttgaaggcaataaataaaagattttctaacaaatgaataggtatctactatgctatttcatggaggccaagtcttcttgtgtagtgttgagaattccaaacaggttactaatttcttcagaatcctagatcattttcagagtttcatttctttttttctttcttttttttttttgagacagcgtctcgctctgtcacccaggctggagtgaagtggcacaatctcaggtcactgcagtctcgacctcccaggctcaagccatcctcccacctttcagctccctgagtagcgggggctacaagcattaccatcatacccggctaatttttgtattttttatagagacagggttttgccatgttgcccagactggtctcaaactcctgggctcaagtgattctcccgccttggcctcccaaagtggtgggattacaggcatgagccaccatgcctggcctagagttatcatttcataagagattatgtttcctttaccttgtgagtaacttttttcatagtttgtacatcatatcatccacccccactttttgctcatctcttataaagtaggatctatgtagacttggcatttactaataaatagtggttggttgctgttaacactaagatctccacttgggtaatggatatattttcttcccacatctacagctaaatggcagataaatgtgcacacctctcccccttaaattcctgttgctagcaggcattcacctggctcccctcctttgctcttctactgtgacatcttttcttgcccctacaccctagttctttgacattgctctgagggaataggtaaaaaagtacaatttgtcttgtctgtgtcctatctgtggcatttacagatctctacaaagttagagatccactttgcagaattcactgtgacactactggcttgttctttctactcaattaccttataaaaattactttttggctggacacggtggctcatacctgtaatcccaacactttgggaggtcgaggcaggcagctcacatgaggtccaggaggttgagaccagcctggccaacatggtgaaaccccgtctctactaagaatacaagttagtcagtcattgtggtgcacgcctgtaatcccaacctcttgggaggctgaggtgggagaattgcttgaacccgggaggcagaggttgcagtgagccgagatcacgccactgcacttgagcctgggcaacagaacaaggctctgactcaaaaaaaaaaaattttttttttaatggatagagaaaggtggtggacagaggaataagcaagaacagaactctttggctttatcataaaataatactggatggtatatgttgactgccaggttttctagatggcacactcctcaagtcttgttagtcaggagatagtggagacagagtcttactctgtcacccaggctggagtgcagtggtgtgatttcagctcactacaacctctgcctcccaggttcaaatgattcttctgcctcagcctcccgagtagctgggattacaggtgcctgacaccacatctggctaatttttgtatttttagtagagacggggtttcaccacattggccaggctgatcttgaactcctgacctcaggtgattagcctgcctctgcctcccaaagtgctgggattacatatgtgagccactgcacctggccataaattgcacttttaataccccatcaccaccacccccttttgtagccaatctctgtttcctatggtgtgaggcctggtgtttgtcaatacagtgccatcagtattacatgagaaagtgaagagttattctacatcctggtgttaggatttttagtagtgtccagtttttcatagagtaaacatttttctttatttgtgtgtcgtcctattttagtgggaagtgggaaaggccactttgaatcctgctattgagataataatttgaaacctggagttttagaaggctgtttcagcttctctgaacttaagctgattggttgagtcccctctgagattgtctcctctagttcaagtcttagccccctgtcctgaagttgcattttccccagttctgcttgtttttctctttcattcttaaccataagacttttccttcccaatagtaggaggaatctatactatttgtactagagatagaccctgttagagagtttttaaagcttttgctagatcatgttctgcgtctctgataatgtaagaaaaagcaaggagaaatgggggtataagtaaagttgtgctagagcttgcatctgtgatatgccaggacctgtattgattgaggaagggttgccagctgacagtggtagtagaaataggtctcttaggagtgggaaattaactctagaggactcctagttaagacttaccatggaatctctgggcaattggaaatactgtactttcccctagggagatggagtgggaattgatttttccttaggtccaatgtaacttggttagaaatacaattgaacctgtttgtcatgtctgttgtgatatgatagccccataggaagggtctgtttttgtgtgggagtttatttcaggcgtctcttgcctgtattgtttcttttaacagctttttaaattttctttttccagcaatgatgttgtccactgggcatgtactgaccaatgtggcaggtctgagaacatagctgaagctgaaaataggaaagctgggggcaaggaagagccttgaatcttgaggtgggacgttgactctaagatgtccttgagcagtggagcctccggagggaaaggagtggatgcaaacccggttgagacatacgacagtggggatgaatgggacattggagtagggaatctcatcattgacctggacgccgatctggaaaaggaccagcagaaactggaaatgtcaggctcaaaggaggtggggataccggctcccaatgctgtggccacactaccagacaacatcaagtttgtgaccccagtgccaggtcctcaagggaaggaaggcaaatcaaaatccaaaaggagtaagagtggcaaagacactagcaaacccactccagggacttccctgttcactccaagtgagggggcagctagcaagaaagaggtgcaggggcgctcaggagatggtgccaatgctggaggcctggttgctgctattgctcccaagggctcagagaaggcggctaaggcatcccgcagtgtagccggttccaaaaaggagaaggagaacagctcatctaagagcaagaaggagagaagcgaaggagtggggacttgttcagaaaaggatcctggggtcctccagccagttcccttgggaggacggggtggtcagtatgatggaagtgcaggggtggatacaggagctgtggagccacttgggagtatagctattgagcctggggcagcgctcaatcctttgggaactaaaccggagccagaggaaggggagaatgagtgtcgcctgctaaagaaagtcaagtctgaaaaggtaagaggtggccagatatggctgcccactgactgccagtcagaactgccctggactaactgccaaatactatgtgtactctgtgggaggctcattagtgtgtgggtaatgaccaattacaaggtcagagcagctggtaatgataatgtggttttcttccaaattagaggattcccctacagactcatttacagcaggcctggacattgtggaacaggatatttgttgttgggggcagctactttgtagaatgaactttctgtagtctgagttgagaccttcccaccttgtctttgcccacctcagacacttgttggtagagattggcatcagacctttatttgtttcccagcttgactggcatttcatcatcagactcataatagttgataaacaatacgcctttggtgataatgtagattgagtacggttcttgatgggataaatggtgctgttgggtctctggtagaacaaagggctaaatttcatggcatatctacgaagtgttctattgccggctaccaaagagcgaaggggcacattttgagggcaagaggtactcattgtactttgaggtacttagatcttatgagttattgttgtggttatgacagtttggcctaggaagagattggccattaaaggtgtagcttcatgccaggtatctcccacaactattaggaatcaaagtctcctcgtggtttaatagctgccaacagtgtaatgataccttgccttctgcttgacttggaaggacaggtgcctgcagccccaggaggggttagaactgagtccctcctctgggaagatgatcttagttcatgctttaggaaatggaacttgcagggctggaggagaatgggtgtgagtctagggtcagctcaggcagcattaaacttcagcagcttattcctgcaaaacagtggccttgtggtgagctgttcattggctcttgattttctgctctgtgctctgctcatcctgtgctttcagctgatcccagcagatgcagtataaattgatttctctgtaattagatcagctgcagcagggaatacctatttccatatgtaagtgttaataaataaaggctggatgtgtatgtttgggtggtggtgccctcttagtgcctgtattccagtggtagctcatgctttctttgctgtcggtattttggtctttgcctctggcacatctgtagctcttagcaacatctgggcttctccagtagcaggtctgtgagtttcttccactaataatacagtggctcattcccttttaccagtggcagctgccagagaggctgcctgtgtttaggtggcagatgctatagtccacttcagcagagtcaggttccagctggttactagcttggctcatcctgtgctggctgtgatttgctattttctctcgggtacagatggataatactgttttaaagaggcttaggagtactagcagttgttgcttctgttccaggcccattagactgttccctacatctggcttcaagaaactcttgccatatatccatattcataatcattattcttcctgtgctaaaaagtacttctgaggatgaccttcattctcctatctaaattttagagtacttatgttgcaaccttctaagcccagtgatagtctgtggatgaaaggattaatattgcttagctttatgttggatttaagtgtaaatgtccatgattgtctctaacagagaagcaaatggaacccattttctcacatagaggtgcagggactgattgggtggctgcccttcagattataattgggctgaaagatgcagtatgttcagctaagaatacatcctggtgccagggagttttgtcccttaataatgttgctttgccatataagctttgcctcccagggagactctgagaatggggcagcagaatgagaaagaaaagggaaagagactgtgcttcagtttttgaaagatagagaaaattgctggcaattacttttagaagcagaaaatttgctatacagtttcatgtaaccataagcaagaacctgctttctcaattccttcccctgttccctcaacccttttggacagtctggtcctgagggtgcctttccatattacctttggctattgaaataaataattatttaaataaatgtttggaagttgctaggagattaaaacatgctgtgcagggagagaacatttctggactgggaggagcagaagaggcaagttaaaggaaaggaagttaggaaccatgcagaggagcggtttttgagaaacaacaatctccggtttggggcataataggtgctcagtgagtatttgatgattagtactataatttataagcaaagtctttgaaaacttctttaaaattttctctctgagaaatgggcttgcctgtggtttgggacgtttctatgtagggataacaaacagaaccaaaatagcaaaacagatgttttgatataatctaagaattgcatcctctcaactgggaactgtcatgaagaggaagaactcataaaatttgggaagtttcttgactgaattctgtggtgcagagtagcagtgttgactactagccaatgaggaagatttgaatattgaaattactggctgggcctggtgattcatgcctgtaatcccagcactttgggaggcctaggtgggcagattgcttaagctcaggagtttgagaccagcctaggcaacatggtgaaaccctgtctctacaaaaattagccgggcattggtggtgtgcacccgtaatcccagctactggggaggctgaggtggaaggatagcttgagcctgcgaggtggaggttgcattgagctgagacggcaccactggactccagcctaggcaatagagccagaccttgtctcaaaaaaaaaaaaaaagaaagagagaaattatctatctcatgttcttctttgtgaaggtagatatctcaggctatggcctgggaaattttctgtcagacaaggatgtggatttcccttcatgggatcccacttttgctcgaccataccttcctctgacagagtgagctctgtgctgtttcccagagttctaggagagaccagagatggctcttagcaactgctgctgctctgaattgttattgaacacttctgcctcatacttcctgccagctgaagagatgggggagggaatgttgaggaataaacaagacagagccttccagctcttgcctgttcccttgcctttagtttgattgatggattgttaagttagggatggaaggggaggtagggaggagggcaggcgcctgtctgagtgtcctgagcttagtgcttatgtcgccactctgacaggcaagaaaaaaggaatttacaaaccacagatggcaacgatctatctgtgctgactttgtcagggcttacgaccaggagtttaaggtgagactccttcttttcccccaaatcatataaaatagccaagtaggctctagtagttaaagaaaggatctagaagtttctaaccagaagctccccctcacatgtctttagctgctgcttttgatcttgcaaggtaggaacactgcactttgcttttcccgtgtttgaatgtcagcttctgctgctttcagaatgctgcatatatttaccacttcccccattagtttaggatacaaagaaaaccataaagtgtgctctttgctctttcaacttctgatcatgcatgctatcatatcctgtgttcttaagagcatcttcctttgccattggttttgtattcctgccctaatttgtgccttctagcttagttctcttgtattgtagtccctcattgcctaaccaaggtcaggtctcttttattccttctgatccaaggctttcttaacgccttcttccactagctgttatttctcagctattgatggcagagcagtcagctttgcttcctgaaaccaaatgccctcaagattttccttcatggaaaacattaaaaagaagttgatatttatgtgggacagagttgcattctgtaactacaagcttaatttattttttcattcagaaactctgttttccttctaggtgttgtaattcaaggcagttccagagaaagattatcttgtccaatttcctcattttatagaagaaactaagaccagtgaagtcctgtgacttgcccagcatctcacaggtagtcactggcaaagccagatttgtagacaccaaattcttatggcatgttgttactctgggattcttaacaaatctttaactgtcaggaaggattctcaattttcccactttatttgttattttcttagtattattattttcgagatggagactcactctgtcacccaggctggagtgcagtggcacgatctcggctcattgcagcctctgcctctgattcaagcgattctcctgccttagctccccgagtagctgggattacaagtgcataccaccatgcctggctagttttttttttttttttttaattttagtagggataggggttcaccatgttggccaggctggtctcaaattcctgacttcaagtgatccacctgcttcggcctcccagagtgctgagattacaggcatgagccaccacacccagcctatttgcttatttttaaggcagggtctcgctatgttgccaatgctgatcttgaactcctgggcttatgcacttctgccttggcctcacttatgcacttctgccttggtctcacttatgcacttctgccttggcctcgcaagtagctgggactacaagtgtgtgccaccacacccagccattttttcaatgtaaagactaccttgaaacattagatgaaaatgcttacatactccaaaattgcttttaccccaaaactgctttcacttgtttttcacagtgactttaacattgtagacactcaataaacaaaggatctttgagtttaggattttaggtaaggtaatgaatgatgtttgcaaagaataaccattacagctggcactgaacctatcctgttatttataaagaaggaaagttactttaaaactgctactttgagcttgactacttatgatatatgtgtgtgtgttctggaatatttcatccagccaaattttcattataataattgaggaatagttctttctttacttggcaattgcaggtaagaaaaaaaaccctgttctagtgcttcttccttggacacatcactaataggcagaccttcaaatgtattgtggatattactaagtattttgtagagaagatatactgttggctaattgttatcacttttcattcagtcagtacattaattgaatgcattttagatactaggttttctacttggtattgggtatacactggtaaataaaacagagatggtctctgctttttgaggagcttacagtttaccgtctacagcagagttcctaaaagtgtgtcccataaaaccatgtacatcaccagagtatcaaaaatgcacattcttggaccctaccctagatatgccgaataagtttttggggtaagggcccagaaatctgtacttccagaagtctctccagataattgctatatacatcaaagtttgagaattttcctttcaaggtaagtattcggggccacttctcatttaaaacaccagccttctaaacttgaatttcacatcaactcttatgtataatttagtggctaaaagcgtaaactctagccaggcctcctggcttgagcctgggaggttgaggctgcagtagtgagctgtgatcgcactagtgcactccagcctgggcaacagagtgagactccgtctcaaaaaaataataataataaattttttaaaaagtgtgaactctggagccagactacctggctttgtttcctacctttgcacttatttactgagtgatcttgaccaagtttcttaattgttcttcctcagttttcttatctgcaaaatgagagaaatagcacctacataagtttgtatttatttatttatttatgagagggagtctcactctgccgcccaggctggagtgcagtggtgcagtctctgctcattgcaacctctgccttaacctccagagtagctgggattacaggcatgcaccaccatgcctggctaatttttgtatttttagtagagacagggtttcgttgtgttggccaggctggtgtcgagctcctgggctcaagtgatccacccgccttggcctcccaaagtgctgggattacaggcatgagccgtcacacccagcctttaagtttgtctttaggccgggcgcggtggctcacgcctataatcccagcactttgggaggccaaggcgggtggatcacctgaggtcgggagttcgagaccagcctgaccaacatggagaaaccctgtctctactaaaaatacaaaattagtcgggcgtggtggtgcatgcctgtagtcccagctactcaggatgctgaggcaggagaatcacttgaacccgggaggcagaggttgcagtgagctgagattgtgctgttgcactccagcctgggcaacaagagcaaaactctgtctcaagaaaaaaaaaaaagtttgtctttagattaagttagctaattcatataaaacacttagtgcctggcacgtaggaagcattcaataaatattagaaaaaagaaaaatacagtttgagtggaaattggtcttagtctctcctaggcaataatgtactgaaatacaacaacattccactttacaggaatcccagtatgaatagatatacatgttagctaagactttttagcactatggtctgaagaagttccaaatctaggctgggaaattttcatggtggtgatgtgttctaaagcccctgataattatagttggaggtggggggaagaccaaaaattagcttagggcatattgaagtggcctgttgaatttcagacttcatatgaatcgagcttcttttctggccatatccctggcatggggttgggtatgttggatagatgttactgtggttttgccggaatatgcaatctcacggacactggagtagtgctaagtgtttttgtttctacacaagactgcatggaaaaaatctaagtcttagcccttaatcttcctcccccagtgtgaacttgtatttttgccatttgggtataagagcttttaccagcagagctcatccagggaggcagcagggcttgggatgtggcagtaacatacacagctgagatcctgccactgctggctgtctgagccctctctctgtggttttcactcttcaagccatgcttgagtaacccgcctccagagctgctgacagggctgtgttcagaggccttggaaattacactgttcatttccttatcatcccctgacctgcagtgcagagccttctggtgcaggaacaaggcagaaaaaatccagacggctcccagccagcatgtgtcaagagctacaaagaaggaaattggacttgctcacttaaaaaccatggggttaggctttgattttcagttcctgtggagagttatttgtgtgtatgagcatgttgtatctctgtgtatatgtatagaatgagtctgtgcgtggcaaagctgtggaggaggaccatttgaaatagagagcagagggaagatggcttttctcttcacttaatttcccagttgtgccattggggtgggcctggaaccattagcatcaggaaggtgccagaccatattaatattttaaaatatatttctctcggtacagtttagtcatggttcagagcacccacagaagaacctttcctggctgaccgaggagacatttttaacaaatcctattccctaaagtcattcatcctagatgacattgacatagtcaatatttaagctgcctaagaaagtgtagactttgggtcagtcctgggtaagagcaatagctcttttgagatgaaggatagtgtgataaaagagagacctttgtgatagctaaggtgaactaaggaggaatttggagcattttgagattttctgttcacagggcaaagttctattatattttaagagcccatccttgttttgggggttggtattacaaagcaatctacttttcttttggcatctgttgctcaaggaggcccaaaggaaggacttcaggctgaagtaaaatgtgagcagtaagaagttcttagcaaagtttataaatattctgtccttaattttcctttttctggatttcatgtgccttcatgttagtggtgccattgaagcctttgtgaagtggggagaaaaaaaataaatctttaagctgtcagaccctggaggtgttttaaaccctaagtgtctgtcttgttgaaagtactctgtagagaagtgtcttcacataaggtgatagctaaggtgagaggggactactttcttttcccttcatataaattagtgggccctgtatcagcagcaaatgagaattcgataaaaatttggatctcagacctcctcccagtccctaaagttagaaactctaggcttgagacccagaaaattttttttttttttttttttttgagacagggtctcactttgttgcccaggctggaatacagtggcacaatcaaggctcactgcagcctcaacctcccatgctcaagtgattctcctacctcacttcctacctccccagtagctgggactacaggtgtgtgccatcacgcccaactaatttttaaatttttttagagacggggtcttactatgttgttcaggctagtcttgaactcctaacttcaagcgatcctcctgccttggcctcccaaagtgttgggattacaggtgtaagccactgtgcccagctgagacccaacaatttgcgttttaacattagctgtcctgttgattgtgatacacactaaagtttgatatctactattgtagagcacccttccctcttaatagtgaaattgaaattaccaaaaactttaaaatgtaacgctgggcagtaggtatgatttttttcttttaaaaatatccttatatatctttaactctttgtggacaaactgacaggaacctaaaattggaatgaatatctaagggcttaggactttcagagcagaagagcagaaaagatattcaaaaaagacccacttttctcatctgaatggaggaagtaaataatagtactgacctcatagggttattgtgaggattaaatgagatgaaaagagttaagcattcagcacagtgcctagcattatagtaagtaaccaataaatgttagctgttgctgatgttactgttcttagctttgaggtgcaaggtcattgtgaaattaaggagaaaggatatccttagagactttgaagaattaatcccctgaaggctttggaaaacaatgaatttatgatagctaatattccagctcctactgatttccaagaaggcttcagggagagattgattcagagcatttggaggcattgaagtttggggttttgttgtttgattggtcagtttggaagtgtgtgttggacttcttttggcagagggctgatctcaggttgagaaccatggcttttgtttattctccattaaggtcagtttctttggtatataaccaacttcttctgaattattttcctaagaattgaaatgaagataacatgattgttttcatacaggaagtttctttcctctctctgctaatccttgtaaggtacagactagtcttttgaagggattagcagaggtagccagaacagtcaagagaagaatgaggattgaagtactgtagtccccccaaccttatccttgtttttgctctctgtgatttcagttaccctcagacaaccaagatgtgaaaatattaaatggaaaattccagagataaataaatcactaagttttaaacactacattattcaccccatttcatctcatcccataggcattttatcatctcacatcatcacaaagagggtgagtacagtacaatattttgatagaaagaaaaagacaccatattcacataactttcatcacaacacattgttataatttttttttctttttttttttttttaacagacagggtctccctctgttgcctaggctgcagtgcagtagtatgatcacagctcagtgcagcctcaaactcctggcctcaagtggtcttcctgcctcagcctcccgagtagcagggactgcaggcatatatcaccacatcgggctaatttttaattttttttatacagttgggatcttactggttgtccaggctggtctgaaactcctgggctcaagtgattccccctgcctcagcctcccaaagtgctgggattacaggtgtgagtcaccatgctcacaacctgtgtcttactgctcacacctgctcttactgtgtctaatttataaattaaactttatcataggtacgtacgtagaggaaaaaacctagtatatgtagggttcgataatatctgccatttcagacatctactgggggtttttgaatgtatgtcttgtgcttaaaaggaggctactacttttttgtgaggaaataaaaaagacagtttttagatgttttgaggtggtcaggttttaccctaaaatgtttgttgtccattgggatgtgacaatttgactgtgcacctgtgaaatactctaattgctttttaaatttaagactgctgggttacagccctagtggcaaatactagattatgttttgatgagccagacctgggcattaaatcctttcttgggctctgttttcatttggtaatgagttcttttttatttttatatttatcttttattgttttattttacaagtttccacatagcattgattttttttttttttttggttccttcattttaaaaagtttttataaactggtacctaactcacccagctcagagttgatatttcctggcttatgtgttgctttttttttcttttttgtttcttcagaagtcaggtacttagttctgcactgaatcaaaccttagtgaaagacaacagagtgttgtagaaaggaggtataggggccaggctcggtggctcacacctgtaatcccagcactttggaaggccgaggcaggtggatcatctgaggtcaggagtttgaaaccagcctggccaacatggtgaaactctatcactactaaaaatacaaaaatttagccaggcatggtggcgtggtggagtgtgcctgtaatcccagctacttgggaggttgaggcaggagaattgcttgaacctggaaggaggaggttgcagtgagctgagaacacgccactgcactccagcctgggcaacaagagtgaaactttgtctcaaaaaaaaaaaaaaaaaaggaggtatatatagtcgtcatacttagaccaaccaaatcagcatactgaatgtatcctataacatctgaatgttacagaaattaacattcaggttgcagagtttcttggtcgtgagacagcttagggtacgtatcagagtcacttctggaggttttacaaagtataagtgtcctactggataaaatctttgtggctggagactccaagcatgtaattttttttttttttttttgagactgagtctcgctctgtcgcccaggctggagtgcagtggcgcgatctaggctcactgcaacctctgcctcctgggttcaagtgattctcctgcctcagcctctcgagtagctgggattacaggcacactccaccacgcccagctaatttttgtatttttagtagaggcgggatttcaccatgttggccaggatggtcttgatctcctgacctcgtgatccaaccacctcagcctcccaaagtgctgggattacaggcatgagccaccgcaccctgcctacttttttttttttaagttcaacaggtgcttgtaatgttcttcttggttaaaaatcactatcatgtgaaaaggactctcctttttcattgctcagtgtacaggatgcttatgttggggtcaggcatttcggaattcaactataatgaacctgatttctcattatcaccttaattaggagaattaattattgaatttctgacagcctttaaggtagagcatccatatttgtgttactaattcagttttaaattattgttccagaatttttaaggcaaatttaagcaaaattcttatgagtagatatatttgccacatataggctatttgagcttttttttctatgtagattagaaaggggcagaagacagatttggataatcaaaatttatggctaatccaaaaccagtctcttttctcattggtttgtgaatgtatttctgtgcttatattggataataggtgttcctaattttctggaaattcatgacatttgaaaataaaataatgtagcaatacaaaaaagaccttattcctgagtctgcttctggatgcattcaaagtaaacatgctgttttaggaagaggaaatatcgcatcacagaaatagaacaagcaccttatatcatagttctttgttgttgattttttttaaaataaatacaatttatttgaaatcaaaaagagcattaatgttttggggtataaagtatttccttgctgagatttttaagtcttatgcctgaagaagagtaattagaatgctaattgttatcaaagatgaacacatacctaattgtgcagcaaactcatacttttttaaaaaaaacttttaggtttagggatatgtgttgcaggtttgttagatgggtaaattgtgtgtcacatgggtttggcgtgcagattatttcctcatccaggtaataagcaagcaaactcatactagaaaacattgtggtatgtcaaattttagccaaaataataattacgtaaccttaaattctcataataaaattttaataataaattaatataaaaatttaaaattttaagtgtggtttttagtactggtacatgcattacctatctatcttctcagaagttatattaatctgtactttagatggatctttttttaggttttggagtatctcaaattcatataccactgtgagtaggaggagaaaaaattggcaaatgtggggaaaaactcatcatacaaagtgactacacatttatatacaccatattagactagatcttaatttcatcactatgcagattcctaaacatctggtagagtgtctgttttagataaaatatgccataaggcatttttcattttgcttgtacatatgtgcttggattgagaatgtagggatttgaaatcaaacaagctgattgcttattacaatttcagaaggagactgagaaattctttcatttttgtttgcttctagtatctctcctgtcctttcccatctcttaaaaggattaggttctaaagtcaaagtgtgaggcactcagtcagaagttacctacagaatttcttaggatgatttcttgaagcttgacatactggctccatgaattcaacacaatcagttttttctttagcattgagacaagccattatttcttcagctgaggtccccacataagagctgacttgtgtgagagctagactatattaatgaaaaatatgtatttgtaaatactagaatcaccctaagcctagtaaaatgcttatattatgagaggcacatgggagtggaaaccagattaaggaacagccagctggctgggcaaggtggcttacacctgtaatcccagcacttcaggaggccaaggtgggaggactgcttgagcttagaagttcaagaccagcctgagcaacatagggagggcctgtctgtacaaaaaactaaaaaattagctgggtgtgttgatacatgcctgtggtcccagctacttgagaggctgaggcggaaggatcacttgagcccgggaggtcgaggctgcagtgaaccatgatcatgccactgcactccagcctgggcagcagagcaagaccctcaaaaaaaaaaaaaaaaaccaccagttcaaatctcctatctctggcttcctccagagcatatgctcaataagcagaacagctgtgaggcccaaaccattcaaattggtttttgttcctttctttctttttttgccagttacatacagttgattttataatgttaaatattatccatttagtatacaaaggtattttatgacaatagagcaaatcttaggatccagattctctatgtagtggaaactttgggtccatggaatgaatatagcttaatgtaatgattattgtaatatttacatttcagttccaaccttcatgttcttcacagtgtccacaaattccttccctttatttctgtatagtaacctcagatcttatcgttgaattgaacaagaactatcatgtagcagagctgttctcctcttaccaacataaatatttctgagcctagtttcgctttcttaggcccagtgcctttggtaggtcctttgaggtatacctttcaccttctagcctcttctcactttcacctttagattctatctaaactatgcttttttttttttttgagacggagtctcactctgtcatcccaggctagagtgcagtggcgcgatctggattcactgcaacctctgcctccccgattcaagcaattctcctgccttagccaccccagtagctggaattacaagtgtgcaccaccacacctggctagttgttgtattttttgtagagatgggtttcacccacacttgaggctggccccaaactcctagtctcaagtgatccttccgccttagcctcccaaagtgctgggattagaggtgtgagccactgcgcccacccttttttttaaaattttttaatcctgctttaattttttgttgttgttgttatttctgaaataacattttacatttgttgttggtcttgtcttaagcaaatgggattatatttagttatgcagatttaggaagggctcttccttccttctcaaataaaaataaccaggaaaaagcagtcgttttcatatgttctacctgggacattcattatagtctgggtacagcattgtatgtatcttgaaaactactgtactacctttgacagtgaggtgttttacccatagttcaaaattgctgttactgcctagagatgacactgctgtgaatagtataccttattcgaaggcttggtgcttttaggcatggactggtggcatctcttggacaaggcattgcaattgccctggaggactggccaaacaagttttcatgttgaaaagctgagtaaaaatgactctgggtgtaggccaatatagtatcactcgggaaaaagaaaagcacaatatgcctctccctgggaagcagtttggccagggcaaagctcccagaaatggaaatttaagcttgttgatttgggaaactcttggtatttgcccctcagcctttgtgaaatggatcttctttttaaaggggggaggggtaggatagaggagacttaaaggcttaaaataatgtcccctctgaaccatctaatcacctccttagaactaagcaggtaaggctgggcgcagtggctcacatctgtaatcccagcactttgggaggccgaggcaggcgaataacctgaggtcaggagttcgagaccagcctagataacatggtgaaaccccatttctactaaaaatacaaaaaattagccggtcgtggtggcacacgcctgtaatcccagctactcgggaggccgaggcaggataattgctcgaacctgggaggcgggggttgcagtgagctgagatcgcgccattgcactccagcttgggcagcaaaggcgaaactccgtctcaaaaaaaaaaaaaaaaagaactaagcaggtaaatgtcctcatgtcacagaagaaaagatcgacttgtttagaaaccaagttaggtagggctgtctgtagttggtagtaaattatcaacctgaagtggcattcaggccagagaaaagtcagggaagatagttggaaaataaaaccccaatgactttttcatatttgactaaaattttcagatctcttattgttcttattccttagtcatatttcaccctccttcctgttttatatctaataacctgaagcagaaaagggccaggccaatcctactttaatctcttccattcccctgcccccctggagtatattttttaatttttaaaatttatttgtatttgtttttcgtttattcagtcttgctgagttaagcagaaacctcatagaggtggggtttttttgtttgtttttgctttgttttgagacagagtcttgctctgttgcccaggctggagtgcaatggcacgatctcgtctcactgcaagctctccgcctcctgagttcaagagattctcctgccacagcctcccaagtagttgggatgacaggcatgcgccaccacccacacccggctaatttttgtatttttggtagagatggggtttcaccatgtcgcccaggctggtctcaaactcttaagctcaaatgatcctcctgcctcaatcctccaaagtgttggattacaggtgtgagccaccatgcccacccaaataatacttttaaagaaaacttagattttattgtggtgccactatatactgggcatttattaagaatatatatatatttttaatcttgtattgatcttatcttagggatggttccttataattgcatttatccttcttatgtgtttctgtatctttcagaaccatttccagaattaatcaggctaccgaacaataagtccagtcttagcttatcaactctcaggatgattctgattttaaaaattttcaccaggttccagcagtcccttatactatatcaatttcttctctccttaacccctactccggaaactttttacttgataatgtttgtctggctcttccttatttaattgcgagttttaagcttcttgctttaaaaatatagcattagctgattttaaaattacctctgggctgggtacgctggctcactcctataaacccagcactttgggaggccaaagcacgtggatcacctgaggtcaggagttcaagaccagcctggtcaacatggtgaaactccatgtctactaaaaaatacaaaaattagctgggtgtagtggtgcatgcctgtagtccaagcttctcaggaagctgaggcaggagaatcacttgaacccgggaagtggaggctgcagtgagccgagatcatgccactgcattccagcctaggtgacagagggggattctgtctcaaacaaaacaaaacaaaattccctgtgattcaacagatcctatatgggatgctttataacaaaattaatgtttttctggacttacaggttggagggctatcctagtcaagcagttcaaatttatggatactcattcagttcatccaacaaataattattaaataactaccatgtgctatacagtgtgctggcacttaggataaagagttgaagccaggcatggtggctcacacctgtagtcccagctacttggaaggctgaggtgggaagttcctgtgagcccaggagttcaagtccagctgggacaacatagcaagatcccatctaaaaaaataaaagttaaatggatgtggtctctgctctgtggagtgtgtgtatatatatgatatataaataaaaattatacatatatattattattattatttttagacactctgtcacccaggctggagtacagtggcacaatcttggcccactataacctctgcctcctgggctcaagtgatcctcccaactcagcctcccaagtatctaggactacaggtgcgtgccaccacacctgaccaattttggattttttgtcgagacagggtttcaccatgttgcccaggctcaccacgttgaacccctgggctcaagtgatccacccgccatggcctcccaaagtgctgggattacaagcgtgagccatcgtgctgggttcctggagtttatattctaatgtgggagacagataaattggttattataacaaactttgatgagtaatgataacatagggtattgtgggtgcacagtggtggccagagtatagtgtaggatcaaggaagatctctgctcaaaagaggtgatggagatctctaacctctctgatagttaaacagagacccaaagggataagcaggaattagacaggtgatgggagagagggcaaaaggcttgtgccaggtgagagaatagcataatcaaaggctaagtggtaagactaatcttgaggcatgagaagaactggaagaagttcactatgactggaggaggaggaatagaatggtaagatgaggctggagtgctatggggtcagatagtagaaggccttaaaagccttgttaaaggatttggatttcatcctaacatctgcagaaaactattgttagactttttagtggattacagtgattgatttttgagtttttgaagaattactcttgatgtcatctgcagagtggattggagaacaagattggaggcatttaggaagctgttagcatagttagcaagacagctggaccagaatagtattaataggaaaggagcaaagtgggtagatttgagagaatagaagttcaattgatagcatcttggtaattgataccatgttgggaagagattgaagaagaagtcgagagtcatgtccagattttgggcatgaaccaagctgttcatggaaccacttactcataggagggaacactgaaaaggggcaagtttgcagggaatgataatgagtttaacttgggacatgttttgaggtgcttgcactgcctgtgctggggataatgtaagcaaaatagatttggtcctgctctttctagggcatacggtttagtaggggagatagaatggaatcaaacaatcatatgcacatctatcattttacactattaaaattataaaagtgaaagttataggatgctgagagcctataattaggaactgaaccattcttggcgggtgcagggcggggggcggggggcgggggcgggtcagggaaaatatccgtgaagaagtttgagtaaatatctgaaggataaatggtagttaatttggaagagggagttgaatgaatgaacaaccaagtagaaatgtctcttgaggactggatgtgtgagagagagaactggaaatctaaagatttaagagtttattaatgtgaacacataaatggtaattgatgccatagaagtgagtgcacttacccaggaagaatgtgtctgtattgaatgaaaggggctcagtatgggtcactgaggaacaccaagaaggtagctaccttagttggcatattgggaactgcttccttgtgtcctagagagaatacaaaacccacagctgggaacatatgtctatacaaacattttaaaatccactgaaagaggttatagaacttgcttggttctgtagttagaattggttttattggattgaggcacactttgaggaaaagttcgtttctcatgccacttatgaacaatggaagagtgatctttgctttttattttaaccatttgccatattttccctgcctggcatcatcactctcaacttttttagttttccttttttcttttttgacctaattttcagttatttaaactctcaacttctaatagtattaaagtgaaagcatagatattgtaatcaggcctatgtttgaatcccagcactgactgccatttaatatatataggatcttctgcaaattacctctccgtatctcattttccttagattttatatggttttaatttaaaagatctaaaagtacactgtaaatgcacagtatatggaggttatagtataatagttacaggtcagcaacaaatgtttgttctattttcctttctccttgcagcctctcttgtctttccaggcaggtgagtagtttcatctgtgatcatttatgctctgtaccacctcctcatggcagtatgttacagcagcttttctaccagagcataaggagtcttgcatttttgtggtaaaagtcctttctggagaagcagtacaggaaggtttctgggttgctataaccaggatttttcaacaacaacactattggtatttggggctagggtaattctttgttgttggggtggtccagtttattgtaggatgtttcacagcatccatacctttatcatattcgctccaaggtaagacaaccaaaaatgtccccagacactgccaaatatcccctggagggcaaagtttttatttgagcactatttgctaaaatattgttgtggatgctatttacataactgtgtgttcagtttatgaaaatgcagagttgtacatatatgatatatgtagttttctgttgtgaatgttgtttccgtagaaagtagaaaaccaaaggcagttagagagccaggctccctaacctgtgtctcagtttttattatccccaaatctctatttttctttttgtttttttattctcgttttcttaaatttttggctaatattttttttcccacacgttctggtattctccccaaatctctaaaaggtgaggtgaaattaagggagaaaagggttcacaatagaatgggaagacaacaaaaagtaaccgagaaactgacttccaaatgtctcttcaattcctagctgttaggatatggaattcaacctagggaaatttctattacaagatttcagaaataagctctgagtacgggacagaattaaattatcagccgaagagattattttattatctttcttcccaccttctctgctacactgacagcaaaggagaggctcacctgattttcgtcacttcagctgttacctttacctgatggccactgaagttatttctgaaagtgttcgcttttacttttaatttaaaatctttccgttcttctttactttgtacaggtgggtagaaagtccttccatattagataatgttgactaccccctgagaatgtagtccccagagaaatccttggatagcactcaagctggaagcaataggttaagtaacccacgtccatgtcttaagaggagtccaagataagatcccattttgaagtttgaaagatcctgtaaagggaaggcagaccttgggccaagcagcctttgaggtggtaaccagctcataaacaagagctggcatgtgccaacaaagtctctcatcctggctccagagttggctgaggagagaaatttgtggaagcctctgtaagtggaggattgttcttggctttggcttttgtgtggctggatatggagtagggagggagcttggacctggtctctggggtgtaggcatttccctgagaggaggattttttttcctttccttgttttattttttcctccctgtccttcccttagtgttaacatttcaaggtacaggaaatgattggatactgattgttttataactctcttaggacagcctattaatattctgctgccaagacgacagtcaggaggaatttaggtagaatcaaggctcataacctttatgaaaataccctaagcagggaaccttcaatttattttgaagtgtttgagttttactaaaagcccatcattgccagtgtggttttttaaaatggacagccatagtggctaaggagaccagtaagacctggagttggcagcagagtgagccttctgaggaaaaaaggaagaggaatattggtgtgggaaagaggtgcagctgtgccactggatccctgtcccttcattattctttactggccctggcagctgtcaaagtttgcttaatagagttgtgggctggagattgtttcttaatccctgtataggagtaccaagctccagctgtgttatctaggctctggggccctagcacttggccaactaatgctgaggcatctggtgactcgagacaaaagcctattatgtcagagagaagattgggcaaagcacaagcattgttatctctaatgcccccggggcaaactctgtacttggcaagtgagaatgccttgaccttgtgagtttacagcaacctgtccactcggttttctgtttctttgagattattttctactaacgaggtttcagcattctggcattgaaatctataagtgctttattgtaaagaatttggaaaattcagaaaagtaaaaggaagaacataaaaattgtacttcattctaccagattcttaagagaagaatttctttaatgttgtggaactggctgagattattggttcaggactggcttgggcatgatctatacctcatgaatctcaactctgtccctttaagcatctttaattttcccattagagatctgaactggtttggccctgcttggctagattttattacaattgatgtgatctcaccctggagtatgaaactcatcttctttgtttagctttttataacttatctcaaaccaattttttatcttcatttgtgattgtcttcagaagtctgggtgtttgttttttttaaactgatggtggtgagtatgtagggagagagtagttttgcaatttttaaagacttaatgttgacctgctttcttctctttggaaagaggtgtctgtgatgtcagttaacataatttgctttcgttgatgagcttgctcaagacataagcttatgagatttctagttgtataaaaagaaaagggctgtctttcatgttttcttttccttgctggagtagcattttagttaaggaagttgcacaaaaagaaacccatcttttttctgtgtaattttctatatggatttctatgttgaccagtctagaccttttgtctattcgatgtttacatagatgtttagatttaacttttaatacattgtggttaaaaaaaaaaaaaaaggaaattttggtgcaatagagaaaagtattttggatttatttattgttccttttaaatgttaaaatgaggcaggaatacagtacttgcagcctattgtctaagagtactctttgacatttataatatcaggtataagcatttccaaaagagatcttccttaacataccatacccttaatgatcttttgacaggacagaaatggggagagatgttagcagggtatattttaatttatattctccaaaagtatacatcctatactatgatgaattattatagattttattttcatgtaatatggactcccttgcataactggagagaaacagcttccaattaaagtaattatgctagcagctctgagactactctttggaactgttgtcagcactttggtttgaagaaatcagaccaggattgactgcctaatagtaggcttttaccaagagcctgacataagaatttcaggaaatctaggaaaatctttgaaaatctgctatattataggccgggcacagtggctcaaatctgtaatcccagcacttcgggaggctgaggcgggaggatcaggagttcgacaccagcctggccaacatcgtgaaaccctgtctctaaaaatacaaaaattagccagatgtggtgatgcacacttgtaatcccagctacttgggaagctgaggtgggaggatcgcttgaacctgggaggcagagattgaagtgagcagagatcacgccactgcactccagcctgggcaacagagcaagactccatctcaaaaaaaaaaaagaaaagaaaatcttctatgttataaacttaaatttcatgtgaatggaagattgagaaatgatggctgatggcctaagctctgggtagaatttcaactttttgcatgtttatcaaatggctttaatgttcctgccttttcctggttattatttaaaaaaaagtaatgtttccagaaaccatttaacaactgataactggaaaattttttggaagaggttagctagacaggttatacgggttttttttttttcctcatacagtttttttaaaaattgagaaataattcatgttttctttttttttttcagtatacaattcagtggtttatactatattcacaaactgtgtacccatcacatcactaattccagaatattttcatctcctcaaaaagaaaccctgtacccatcagcagtcaccctaattcttcattttacttagccccgggcagtctacttctgtctctctagaaatttcatgtaaatggaatcatacaatctgtggcctttggccgggcgcagtggctcacgcctgtaatcccagcactttgggaggccaaggcaggcagatcacaaggtcaggagttcgataccagcctgaccaacatggtgaaaccctgtctctactaaaaatacaaaaattagctgggcgtggtggcacatgcctgtagtcccagctacttgggaggctgaggcaggagaattgcttgaacccgggaggtggaggttgcaatgaggcaagattgcgtcattgcactccagtctgggagacagagcaagactccatctcaaaaaaaaaaaaaaaggggggggccttttgtgtctgactcctttcacttagcataatctattgtagcatgtatcagtactccattcctttttatggttgaataatattccattatataaatataccacatttgtttatccatttcatcaggtgagggatatttgggttttttccttattttgactgttaatggataatgctgctatgaacattcatatacaagtttttgtatggacatatgtcttcagttttttttattatatacctagggatagaattgctggattatgtggtaactctttgtttaactttgtttggagctggcaaactgtttgccagaatgtaaatggctgtgccattttacattcccgctagcagtgtacaaggattccaatttccccacactttcaacaatacttgttattgttcatttgtttaataatagccatcctggtgggtgtaaagtggtatcttgtggttttgacttggatttctttaatgactaatgattcagaacatcttttcatgtgcttatgtgcttgtatatcttctttgaagatatctgattctttgtcaatattttaattaggttctttgtaagaatatattctggatactagtgttttctaagatttttatggttatagctcttacatttaggtatttgatccattttgagttaatttttctatatggtgtgaagtagggatccagctttagtcttttacatgtacatatgcggttttcctagcaccaatcgttgaaaagactattcttaccccacattgaattttcttgacacccttgttgaaaattaattgaccataaatgtatgggtttttatctagactctcagttttgttccgttgatcaacatatctatccttatggcagtattacaatcttgattactcatctttgtagtaagtgttgagaattgtgagtctttcaactttattcttctttttgagatcgttttggctattctgagtcctttgcatttccatacaaattttaggatcagcttgtcaatttctgcaagaagcaggctaggattttgatggagattgtattgaatctgtcagtcagtttggagagttctgcaatcttaacaataaaaaatcttccaatccatgaacatgagatgtctttccatttatttataacttctttaatttccatcaatgatgttttgtggttttagtgtacaaatcttgccctttttcttttttttttttgagacagagtctcactctgtccaccaggcaggggtacagtggcacagtcttggcttggatcactgcaacctccacccaccagtttcaagcgattctcctgtttcagcctcccaaataactgggactacaggtgcacgccactaagcccagctaattttttgtatttttagtagagctcgggtttcaccatgttggccaggctggtttccaactcctggcctcgagtgatctgcctgcctaggcctcccaaagtgccgggattacaagcatgagctaccacgctcagccctgttttttcttttctttttttttttttttttaagccagtcaaatttaggggttgtacaccaaaatcttgcacttcttttgttaaatttattcctgaggattttattcttttagatgttattttaaatggaattgttttcttgatttcatatttggattattcattgctagagtacagaaatactattgttttatatgtactgatcttgtatctcaccaccttgtggaattcgtttgttggctctgatatgatttttgtgcattccttaggattttctatatatgagatcatgttatctgcaaattgagatccttttacttcttacttacaacctcgatgtcttttttctttatttcttgtctaatttttctagctataacctccagtacaatgttgaatagaagtggcaagaacagacatccttaacttcttcactgattttagggagtaactttcagtcttaattattaaatatgatgttaattaactgtggacttttttatagatgacttctatgaatatgggatttttttttttcttagagatggggtcttgccctgtcacccaggctggagtgcagtggcacaatcacagcttactgcaatggcataatcacagcccactgcatccttgacctcccaggctcaagcaatcctcctgcctcagccttgcaagtagctgggactacagacacatgccaccacatgtggctatttttgttgttgttttttgtagacacagggtttcactatgttgcccaggctgcccagtctagtctcaaactcttgggctcaaatgatcatcccacctcggcaatcccaaagtgctgggattacaggcataaagcaccgtacccagcccaatatgagattttgaagggaacatttatactgtagttagagattttaaattatgttgatatttttcagaacaagataattcttgaggaacaggtgaggaaggaggctggagaaacctctggaatgtaaagcacacaagattgagagcacctagcttctagtgtccattcccctacttaagctgaataacattggaaattctgtttaattctttgggcttccttcattcatgctttctgttcatcacatatttattgatcatctagtttgccaggtattttgaggatgcagggttaaaagactaacggctatctgagtcgttgtcgtcagatatcagctacactccatttccaacgtcttttttttttttttcttctgtaaagatggaggtgatgggcatatttgatttgtggggacatgttacggccctgcttattttcagagttcagtatattctcagtgttaagaccagccttacacataagatggcatgagtgctacctatgtgtcagtctcttacacaattattatttcaaagtactgtagttatagcagtgactcccaaatatccattccctgccctgacatctttactaaatttgaccatgatttccagttgcctaacagatttccttgcttagttgtcccaaatgtacttcaaattcacaaagttcaaagaaaaatcataatttgtccctaaagtccacctctctccattcctttctccagtactttctcagtgttagtactgggaatacttctgcccagtcacccaaactagaaacttgtgagtcatctttgatgcctttccctcactgctcacatctggtacatcacaaaggttctttaagagactatctcctgcttatctcttgtaacttcccctctttatacttgttgccacttcctttgttcagaccctcatcatttttaacctggaccaaactctactcttaccccctttctttcccacttgtcattcaggatccaacttaaatatcactttctctttacagcatattcttgttagccagttgctcagacttccgaatgaagttaaacacctattaattttatagaaatattgaatattatataggggttaatagcacaaattatagaattatgcaggcttgagtttgaatcctggctcctttttttttttgagttggagtctcgctctgttgcccaggctggagtgcagtgacgcgatctcggctcactgcaacctccacctcctgggttcaagcgattctgctgcctcagcctcctgagtaggtgggactacaggtgcgtgccaccacgcccagctaatttttgaattttttagtagagatggggtttcaccatattagccaggctggtctcgaactcctgacctcttgatccagaatcctggctcttttttattggtgggggttttaaaaaaatttattattattattattattattatttttaattttttgtgggtttttttattgtttaatttcttgtttgtttgttttttgtttttttggctgagcacaaggcactttattgatggtacatgacaaggtggggcaccctaggcccctccctctccaaggggtctgcatggaaactgtgaggaggggagattcagcttggtgggggactgattatggcagggactccccagcagtaagagcttctgtcttcctctcatgctgtcgctgggctggtggtccaggggtcttactccttggaggcattgtgggccatgaggtgcaccaccctgttgctgtagccaaattcattgtcataccaggaaattagcttgacagagtggtccttgaggacaatggctgccccagcatcgaaggtagaagagtgggtgttgctgttgaagtcgaaggagaccatctggtgctcattgtagcccaggatgctcttgagggggccctccgatgcctacttcaccaccttcttgatgtcatcatattggcaggtttttccagacgacaggtcaggtccgccactgacacattggcagtggggacatggaaggccatgccagtgagcttcccgttcagctcagggatgaccttacccacaggcttggcagcgccagtagagacagggatgatgtcctggagagccctgcagccatcacgtgacagtttcccggaggggccatttatagtctgggtggcagtgatggtgtgaactgtggtcatgaatccttctatgataccaaagttgtcatggatgaccttggctggggcgctaagcagttggtgatgcaggaggcattgctgacgatcttgaggctgttgtcatacttctcatggttcacgcccatcacaaacatgggggcatcaacagagaggacagagatgttgacccttttggctcccccctgcaagtgagccccagccttctccatggtggtgaagacaccagtgaactctacgacgtactcagcgccagcatcaccccatttgattttggagggatcttggtcctggaaaatgggtgatggggtttccattgatgacaagcgtcccgttctcagccttgacggtgccatggaatttgccatgtgtagaatcatacaggaacatgtagaccatgtagttgaggtcaatgaaggggtcattgatggcaacaatatccactttaccagagttaaaagcagtcatggtgcaccaggcacccagtacgaccaaatctgttgactctgaccttcaccttacccatggtgtctcagggatgcagctgccaatgcgagagaatatgtggctgtctgtcgaacaggaggagcagagacttttttgagacggagtttcactcttgttacccaggctggagtgcaatggtgcaacctcggctcaccacaacctctgcctcctgggtttgagtgattctcctgcctcagcctcctgcgtagctgggattacaggcatgcgtcaccacgcctggctaattttgtatttttagtagagacggggtttttccatgttggtcaggctggtcttgaactgccgacctcaggtgatccacccacctcggcctcccaaagtgctgggattacaaggcgtgagccactgcacctggccttggtttttttttaaactctgtcaccctgtctggagtgcagtggtgtgatctcggctcactgcaacctctgcctcccagggtcaagtgattctcccatctcagcctcccgactagctgggactacaggcccatgccaccacgcctggctaatttttgtattttttggtagagatggggtttcatcatgttggccaggctggtctcaaactcctgacctcaagtgatccgcttgcctctcaaagtgctgggattacaggcatgagccaccgtgctgggcctgaatcctagctcctaatagctgtgtgactttgagcatattacctagcctctgggcctcagtttccttttatctgtaaagtaacactgataactactttatagagcagaagtgaagattaaatgcaattacaaaggttataattatactatcacggctacaatatattgaacatacattatttgctaatcactgtgctaagtataatacttgatacttattgcccatggaaagtagttagctcaatgcttaatattagtagggattcaataaacaaaagctagtattttctgtgtggtcttcttccattcttagcatcttaagggcaagaacgatgtcttatctttgtgactgacagtatggtagataacaataaacagttgttgagtttgaatttatttaatgggatttgagtaactgccaagaggtcttcagtataatattccctgctaacttgactgcagttcctttggaattgaaggttttgagttttctattaaagtatacatacccctagagagaagtaatactttgagctattatcaacagccatcttaaggaaattagttgtttatcagctgctttcaaatctgagaaagaccttgcaggatgagacttgggtaggaaagaaagaagatgggaaagagacctgagctcacaatatcatgtgtaacaaaatcactttttcctatttgcctcagaattactctttttcctaatttgtaatgtatatcattccacttaacatacatgtactgcatttaatacctatagctctcctgtgggaccatggaattagatcagcagaaatgagtcatttccattacttgaattacttaggttatttagcactttgtgatattatgggcaagatggcagattcactccctatgtagttaatagctttatattgagtactgagaggatattctagacctggtccctaattttggccagctattttggccaaattaatgtcagttatcagctgccctatgaactgcccagaggattgctgaatacaagatgagatgataaacctaaaaacactgaaaaagctacacaaatgcaaagtggattattccagacattattattattattatttgggacagtctcgctctgtcacccaggctgcagtgcagtggcgacaatcatggctcactgcaacttccgccttctgggttcaagtgatccttccacctcagcctaccaagtagctgggactacaaatgtgagccaccatgcccagctaattttttatattttttgtggagacggggtctccctatgttgcccaggcgggtcttgaactcctgagctcaagaacttcccacctcagcctcccaaagtgctgggattagaaatttgagccattgtgcccagccttatttcagactttaacacatgaccttggaaaacgcaatgttgtgggcctcagtttcctcatctctaaaatgaaagacttgggaaaaaaaattacttccaacacccttgtcaactctaacattcttagaaattccattctctctctttctaacctatgtcccttgcttccatatagtctgttcttagcacagcagccaaaatgattctttgaaacttgtccattcattatcacttctttgctcagaaccctccattggctcttaatttcattcagagaaaaagtcaatgatccacatgatctgtgcttctctctgccatacctctatggccttatctcctatttctccctactagcatgcccctccagccctactggattctgctgttccttgaaatgcagctcctcttgccttaggtctcttacatcgaaggttctggctactagaattcttttatcacagagaagtacgtagcatggccaactccctcatctctctcaagtcttcactcaaatgtcaacctatttgaaatttgcaaccacctctgtaccctccttttatcctatcccattattttttctcgaagcactaatctttttaatttactatgtgtatactttattatgcttattgtttattatctatctgctagaatgtaaactctaccaaggcagagattttgttttcttttgttttgctttgtgaatctttgtttctcaagcacctataatagtacctggcccaataaatatttattaaacatatgaatgaaatgtgcagtatggtaaatactaatctcatttttagctgatgtgagcctcagttgactgatttatgaaatgctggttttgttctctgtcttttttgttagaggcattcctcagatatctggtagtacttggttgtctgctcacgttttaaacatctttaagatggagcgctgaaagttatatttgaagctgtgagtgcatttgcaggacatctttatggtgagcttcacagcgagatgactgttaagttgggaaaccccagatgtcaagatcgttaggtgtttccttataggcttaccagatttcttagaaaaataacaagccccttccaatcctcctggagagtaaagatttctttgagctaggtgaaaaagaggactggggcttcagccttcagcattcagtatgtttaaatccacatttaatctccttattttaggtacggtactcatgtcctccactattcctggagcaccctggtccagagatcctctatttgagctttctctatttgagaaactagcctctctagtttttttgggtcgggggtggtatgtgagtgagaaaaggaattaaataaataattgctgcttttttttttttgagacagagtctgctctgtcaccaaggctggagtgcagtggcgcaatcttggctgactgcaacctctacctcccacgtttaagcgatcttcctgcctcagcctcctgagtagctggggccacaagtgtttgccaccacgcctggctaatgtttgtatttttagtagagatggggttccatcatgttgtccaggctggtctcgaactcatgggctcaagccatctgcccgtctcagccctcccaaagtactgggattacaggcatgagccactgtgcccagccataattgcttcttatatagttttcaatcagtgttattcatcctaaatcattgatttcacatcatctggtactgccagttactgagcttttaggggaagattctgtagtgttgattggtatagttcaaagttttttctgttgcatgcttattattcaatatagcgttcttaggtttgcttagtcagttatcattccttcatttgctttccacgttccaaaatattgttgtctcctctctagttcatccccctccttgtgggtttaagtcttttaaaattctttattgtttcagtgtggtttttgtctactctatttattgcaactattttcttgtttcccatttttcttgtttgctttcaattgacagttttattgagataactagaatcacatgtagtttcataaaataatacagagagatcccttgtacattttacccaatttcctccaatagcagcattttccaaaactagtgtaacagccaggtaatgggcattgatacagtccatcaatcttactcagatttgccttgttttgcttgttcatgtctgcgtatgtgtcgttatttccatacaattttatatcacgtgtaggtttctctttccacaccactgtcaagattttgaacagttccatcaacacagcaatcactgttattaacctttttttttttttttgagatggagtttcactcttgttgcccaggctggagtgcaatggcacaacctcagctcaccgcaacctctgcctcccgggttgaagcgattatcctccctcagcctcccgagtagctgggattacaggcatgcactgccacacccggctaattttatatttttagtagagacggggtttctccatgttggtcaggctggtcttgaactcccgacctcaggtgatccacccacctcggcctcccaaagtggtggtattacaggcgtgagccaccacacccagcattatttattttttttttttaagatagagtctcgctctgtcgcccaggctggagtgcagtggtgtgatctgggcccactgctgcaacctccgcctcccgggttcaagcgattctcctgcctcagcctcccaagtagctgggattgtaggcatgcgccaccatgcctggctactttttgtatttttagtaaagatggggtttcaccgtgttggccaggctggcctcgaactcctgaccttaggtgatctgcccaccttggcctcccaaagtgctgggatcataggcatgagccaccgcgcctggccgtgttaacttttttataccatacccactttccctgcacatgtgaacacagtatattcccacctccatccctaatctcttgtaaccactaacctgttctccatttcaaaaattttgttatataaaaactgttatttaggcccggtgcagtggctcacacctgtaatcccagcactttgggaggccaaggtgggtggatgacttgaggtcatgagattgagaccagtctgcccaacgtggtgaaaccctatctccactaaaaatacaaaaattagacgggcatggtggcatgagcctgtaatcccagctactcaggaggctaagtcaggagaattgcttgaacctgggaggcagaggttgcagtgagccgagatcatgccattgtactctgcacttcagcttgggcgacagagtgaaactccgtctccaaaaaaaaaaaactgttatttatataaatatgtaaagtgaaacagggtctctgtcacccaggcttgagtgcagtgatgtgatcatagtttacagtaaccttgaactcctagcctcaaactatcctcctgcctcaacctcccaagtagctaggcgcatgccaccacccctgattaatttttaaaattttttgtagatatgaggtcttgctatgttgcccgggctggtctggaactcctggcctcaaatgattatcctgcctctacctctcatagcactgggattacagtcatgagcctggacaaaaatgttatataaattgaatcgtaccatatgtaaccttctgggattggctttttcaatcagcataattttctggagattcatccaggttgttgcgtgtatcaatagttcattcctttttgttgctgaacggtagtattccatggtatagatataccacagtttgttttaccatatacgtgttggaggtgagctgggctgtttctagtttgggactattatgaaaaaaaatggctatgcacatttatatacagttttttgtgtgtgtgtgaacataagttttcatttctctgggacaagtgcccaagagtgcagttgctgggtcatatggtaattgtgtttagttttttaagaaactggttttcagagtgactataccattttacattaccaccagcaaatgtgtgagaaatctagtttctttgcatccttgccaatatttactgttatctctattttttattttagctatcctggcaggtatgtaatggtacctcaatgtggttttaatttgcatttctctaatgataacagtgttcaagttattttcgtgtgcttgtttatcacctgtgtattctcttcagtgaatcatctggatgtcttttgcccactttctttttttttcatttttattattttcattaatttttttctttggccactggaataaagactcaccattttctaactgagtgatgttttttaaatatatattttttagagacagggtctcactctgtggcacagagtgccattgtagctttgaactcctcagctcaagctgtcctcccgcctcagcctcatgagtagctagtactacaggcacatgccactacacctggctaatttttttatttgtttgtggagacagggtcttactatgttgctgaggctggtgtttaactcctggactgcagtgaccctctcatctcagcctcccaaagtgttgggattacaggcatgcgcccctgtgcccagcctatggcatgattttagaagtggtttatgactgtatagcctcttcctgttcttgcttgttttctgagcctgattctccagacttcctgggaattcagtgagtcacccactactaacctttcatcttttgcttgaatcaactagggttcgtttctgtatgcaactagggaccttgagttatatagtttctgaattttgagagtaaaaaccacaatacatattaaagaagtgcaccatctaaccagggagatgggacttaatgaaatactagaactggccgggctcagtggcacatgtctgtaatcccagcactttgggaggccgaggcaggaggatcactagagctaaggagttcgagatcagcctgggcaacctagcaagacctcgtctctactaaaattccacccccccccccaaaaaaaaaattagctggcaggcaaggtggcatgcaggcctgtcccatttactcagtgccagctactctgggggctgaggtgcaaggactgcttgagcctggaaggttgaggctgcagtgagccggaattgtgccactgcactccagcctgggcgacagagagagaccctgtctcaaaaaagaaaaaaaaaaaaaaaaaaaaaaaaggccgggcacggtggctcacacctgtaatcccagcactttgggaggccatggtgggcggatcacctgaggtcaggagtttgagaccagcctggccaacatggcgaaaccccgtctctactaaaaatacaaaaattagccaggtgtggtggtgggcagttgtaatcccagctactcgggaggctgaggcaggagaatcacttgaacctgggaggtggagattacagtgagtcgagatcgtgccactgcactccagcctgggtaacagagtgagactcgctgggtgcggtggttcacacctgtaatcccagcactttgggaggccgaagcgggtggatcacctgaggttgggagttcgagaccaccctaaccaacatggagaaaccccatctctactaaaaatacatacaaaattagccgggtgtggtggcacatgcctgtaatcccagctactcgggaggctgagccaggagaatggcttgaacccaggaggcggagcttgcggtgagccggggatcatgccattgcactccagcctgggcaacaagagtgaaactctgtctcaaaaaaaaaaaaagaaaaagaaaaaaaagagcagagtgagactccatcaaaaaaaagaaaaaagaaaaaaaatactagagctgtattacacagaaatgtgatagcttatctaacacagacaagtgatataaataaaggggaaattaatggctggagcatgtggaacaggtttatagaaaaactggatgcaaaaatttacatagaaagaagaagtgtttatatactgtggccctttggcagaacacaaactgtaatatgattgttttgcccccttaggggcactatcttcttcattgaaaatgtatatcctagggctgggcgcggtggctctcgcctgtaatcccagcactttgcaaaggaggctgaggtgggcggatcacctgaggccaggagttggagaccagccttaccaacatggagaaaccccgtctctactaaaaatacaaaaaaaaaattagccaggcatggtggcgcatgcctgtaatcccagctactcgggaggctgaggtgggagaattgcttgaacctgggaggcggaagttgcggtgagccgagatcgcgccattgcactccagcctgggcaacaggagcaaaactccatctcaaaaaaaaaaaagaaagaaagaaaatgtatatcctaggatgttctagttaggttaatctctttcctttgttgcattaggaggtgaaaaaaatttttagatgggttagatttccctcaaaaatatttctagtgataagatgttcaaatagtatattgaggtctaatgctagatcaaaaagtcagttgctaagacacttgatgtcacaaactgttaaccatcctggcattttaagcttttgagaaatgtaaaataattcttctccactaaaatgtttgaggcttttgctttagtttatagactggtttattatacagtttatttgtaaatttggctcatcatagaatgtattagtaaatttgtccataggcagaagccagagagtttagtttttaaaagttttatctgtaaagtgtggatttttgtttggttttatttattatttatttttatttttttgagagagagtttcactcttgttgcacaggctggggtgcagtggggcgatcttggctcaccgcaacctccgcctcctgggttcaagcgattctcttgcctcagcctcctgagtagctgggattacaggcatgcacaatcacgcctggctaattttgtatttttagtagagacggggtttctccatgttagtcaggctggtcttgaactcccgacctcaagtgatccactgcctcgacctcccaaagtgctgggattacagacgtgagccactgtgctggactggttttattttttatagagataaaataaaacccaggctagagtgcagtggtgtgatcatagttcactgcagcctggaattcctgggctcacgcaatcgtcccgcttcagcctcctgagtagctggggctacatgcatgcaccaccatgcctgactggtttttgtacatttttcttttgagatggagtcttgttctgtcacccaggctggagtgcagtggcgcgatcttggctcactgcaacctccgcctcccaggttcaagtgattctcctgcctcaacctcccaagtagctgagactgcaggcgcctgccaccatgccttatttatttatttatttatttatttatttatttatttatttattattttttattttgttttgagatggagtctcactctgttgcccaggctggagtgcagtggcgcgatctcggctcactgcaagctccacctcccaggttcaccccattctcctgcctcagcctcccaagtagctgggaccacaggcacccgccaccacgcccggctaattttttgtatttttagtagagacggggtttcaccatgttagccaggatggtctcgatctcctgaccgcgtgatccacccgccttggcctccccaagtgctgggattacaggcgtgagccactgcgcctggccaatttttttatttttgagacagagtctcactctgtcacccaggctggagtgcagtggcacaatctcagctcactgcaacctccgactccccggttcaagcgattctcctgcctcagccttcggagtagctgggattacaggcgcctgccaccattcccggctaatttttgtatttttagtagagacagtgtttcactatgttgtccaggctggtctcgaactcctgaccatgtgcctcagtctcccaaagtgctgggattacaggcctgagccactacgcccagcctacctgcctaatttttgtatttttagtagtgacagggtttcgccatgttggccaggctggtctcaaactcctgaccccagatgatcagcccgccctggcctcccaaagtgctgggattacgggcctgagccactgcgcccagccttttttccttatttttgtagagatagggtcccaccatcttgcccaggctggtctcgcactcttgggctcacgtgatcctcttgccacacacctcccaaagtggtgggattacaggtgtgaaccagcttacctggccaagagttttattactagctggattatgatgttagcccgttgtgtatcttctatatcttatgttaggattcttttctcccatcttcccgcatcttcatcttttcttccccacagcatattcttggagagaaaggagtaggcaggagtttgctatttgaaggcaagtagggagagagatgtggggaggctggtcaaaagaggaaactcaagtttaaagcaatgaaacaccaacactaacttctttttcgaagttgctgatggctttgtgtttagtaatccagattaggtcatgaatcttttgatacagataggtttttttgtgtgttttgttttttatttttgtttttgtttggtacggagtctcactctgtcacctcggctggagtgcagtggtgcaatcttgactcattgcaacctccgcctcctgggttcaagtgattctcctgctttagcctcccaagtagctgggactacaggtgcgtgccactgtgcccagctaatttttgtattttttagtagagacggggtttcaccatgttggccagcgtggtcttgaaccctttacctcgtgatccgcacgcctcggcctgccaaagtgctgggattacaggtgtgagataccgtgtccggccacagataggtttttaaaatgtagattaaaaaaacctttgtgtctggctgggcgcggtggctcacgcctgtaatcccagcactttgggaggctgaggtgggcggatcacgaggtcaagagatcgagaccattctggccaacatggtgaaaccctgtctctactaaaaatacaaaaattagctgggcatggtggcatgcacctgtagtcccagctacttgggaggctgaggcaggagaatcgcttgaacccgggaggcggagcttgcagtgagccgggatcgcgccactgcactccagcctgggcgacagagtaagactctgtctcaaaaaaaaaaaaaaaaaaaacttttgtgtctaacagcaaaacaaaatccatctttgtttccttcctcttctccatcatataggaaatatggaaaagcagaaaagaattgcgtttttctggccgggcgcggtggctcacgcctgtaatcccagcactttgggaggctgaggccggcggatcacgaggtcaggagatcgagaccatcctggctaacacggtgaaaccccgtctctactaaaaatacaaaacattggccgggcgtggtgtcgggcgcctgtagtccccgctactcgggaggctgaggcaggagaatggcgtgaacccgggaggcggagctcgcagtgagccgagatcgcgccactgcactccagcctgggcgacagagcgagactccgtctcaaaaaaaaaaaaaaaaaaagaattgcatttttctgaaaagagaataattggcagagtggtacacttgctagtgaattacagtgggactataactgattctagagaaaagagattgttgtttaagtagaattccgccgggtgccgtggctcatgcctgtaatcccaacactttgggaggccagggcgggcagatcacgaggtcaggagatcgagaccatcctggctaacacagtgaaaccccgtctctactaaaaatacaaacaattagccgggcctcgtggtgggcgcctgtagtcccagctactcaggaggctgaggcaggagaatggcgtgaacccgggaggcagagcttgcagtgagccgagatcgtgccactgcacgccagcctgggcgacagagcgagactccaactcaaaaaaaaaaaaaaaaaaaaaaaaagtagaatttcttctcttgcccttcccttttggcttctactatttacttaactgaaacttaacgagtccattttttcctttctcttccttccctttctcttcagtggatctgtttcttccctttaaaaaataggttgagttgggcatggtagtatagacctgtaattccagctattcagggaggctgaagcaggaggatcacttgatgccaggagtttgagaccagtctgggcaacatagggagacccccatctctctcacacacacacacacagacagagtaggtatttctgagaaagttgaacctaaaacctactccccagtagatattttttatgctgtgtgagagtaaggaagcttagaaaatggcctaaaaccactttttctcaaacttggaactttgcatacaatatttatgggcctcttgggcaaaactatagacgtaattttgcctgaatctatttggattatttttcaagtagttaatgtgagggagaaaggcagaaatggtcatctcttccaaggccaattttttctagaacttccttcctgacttaagatttctctgtgttattttctctcatcatcatatggaacttcagctctgtaacactgaaataggatttaaatattgtcacctttcaaatttctgtgcactacactatatttttatattttacattcattatattttaatcagtgcatccaaagttttcattgttcaacctaaacttgattgtctagtgatattccgtatcttgctgatgcttaatgcaccaaccactcaaatgctgaggctgaaacagagaatcatcttagactctccttttcacttattcagaagtcccatgtcctgtggatgattcttctttttaacaatatccaccctccttctctccatccccactttctctgccttagttggaccttaacactttttacctgcatcattccaggttggtcccctggcttctggtctagcatctctccagtccattctctacattgctgccaggtgatctttctaaacattctggattaaattcatataacattgtaaattaaattccagttccagtgagaacacatggacacagggaggggaacatcacacactggggcctgtcagcgggtggggggcaaggggagggagagcattaggacaattacctaatccatctgaggcttaaaacctagatgacgggttgataggtgcagcaaaccaccgtgggacgtgtatacctatgtaacaaacctgcacgttctgcacatgtatcccagaacttaaagtaaaatttaaaaaatttaaaaataaatttaaaaattccagtctcttaattttaagacacacagctcttcagaattccatcccagtctgttttttgttgttgctttttttttttttttttttctaatttcatctaccattccttctttatttcagccataccaaagtatggcagttccctagacatgccatgggggttcatactttctgttgtttcatataattgtacctttgtgtatatatacttttttctctgcttaaaacacctttccctgcctttttgtttgttttttgcttttttttttttttttaaacggagcctccctctgttgcccaggctgaagtgcagtggcgtgatctcggctcactgcaacctccacctctgggttcaaacgtttctcctgcttcagcctcctgagtagctgggattacaggcgccctgccaccatgcccggctaatttttgtattgttagtagagacggggtttcactgtattggccaggctggtcttgaactcctgaccttgagtgatccacccacctcagcctcccaaagtgctaggattacaggcgtaagccaccacgctcagcctctctgcctttttaaatcaaaaactagttctattttaagaagcaatcaaagttttactctgatgagtttttgtttcccagaacctcatatatgtttgtgtcatagtatttatcacaccatacaatatgatcgaattcttttccacctagattggaagatctttttgaaggcaagtcttgtgttgtctttgccttaggctacacgttacttagcacaacccctggtagtagctgttccataagtgctccttgactgactctcatttatgttaaaaagaaaaaaaatccatacagcagaaaatttttcaactttgaggccaggcatgatagcttacagctataattccagcactttggaggccaaggacggcggatcaccttaggtcaggagtttgagaccagcctggccaacatggtgaaaccccatctctattaaaaaatacaaaaattagccgggcgtggtggcatgcatctgtaatccctgctactcaggaggctgaggcaggagaatcgcttgaacttgggaggcggaggttgcagtgagctgagatcatgccactgccctcagcctgggtgacagagtgagactctgtcctaagaaaagttctcaacttgagcactggactcatttaagtaataatcgttaaaaccaaagcccagcaaaataaaataatttgaaaggacttcagggctgtaatataatttgatgtgctttataggtttgaaagtttttgctaagcagatttatgcagaatgtgattaaaataattttttggctcacagtgtcaaccagacaaatgatgttgaggttagttgctaggctggttctccttcctttatgttgaaacaacaggcagcattcattttagctgatgatgaagacctggtttctcctacagccttatctgaaatgcctttccaaagccagcagtgactgtcaggctgtccagagttctttcaacaggaaaaccaggactcatcccttctcttaactcctctaagctgtcagcaagcgaacccctttttaccaatctagcatgaaagccatgagccaggaatacagggcaggtacattgattgttaaagggcgtttggttttcagtctctggattccaagtcagtgctttctcctctgctgtcagaccatcaagttgtaggtaggtgttgtgctgcatgtttcaagatggcccatagatgctggacaattccagaaagcaatggtttccctattatgagaaaactgtgtacctgtcatttctgccattctgttaagcaggtaaaagagattaagacttgctatttagcaagattaaatgagactagtaccccacttctttcttgaagccgttgtgtctctcctgtctgtacatttagacctttcttttgcaaccagatctacttgttaaaaggtggggaatggggttggcatgatgagaagagtatgcagtatacaggatttttttttttttctttgagacagggtctagctctgtaacccaagcttggagtgcagtggcgtgaccttggctcattgcaaccttcgtctcctgggctcaagccaatctcccacctcaccctcccgagtagctggaactataggctcacgctaccatgcccagctaatgtttgtactttttgtagagatggggtttcaccgtgttgcccaggctggacttgaactcctgagctcaaggaattcacctgcctcagccacccaaagtgctgggattacgggcattagccaacacacttcgccaggatttttaataatccattcatcaaagcatatatctgtataataaaaatcactgattatgagtgtacagattgatgacttttgtgaaatggatgcatctgtttaaccacccccaaaaccaagatgtagaacgttttaatttccccaagttcctttgtgtccctttacagttttctctccctgcccccattgcaatcaaccactaatcttacttccatcattagttttgcctgttctagaatatgtataagagaaatcatacagtgagtacttttttgtgtccagcttctttcacttaatataatctccttggaagttgtctatgttgttgcatttatcagcagtttttttctttttattgctgagtactatttcattgtatagatataccacatttgcttacctgcttaccaccagttggatcatttccaacttctggctattataaataaaggtgtgaacattcatgtacacaaagttttttgtggatagagggttttatttttcttagataaatacatacacatgaaattactggttcacatggtaagtatatatttaactttatgagaaagtggcaaaatgttttcctaagtggttacacgattttatactcttaccagctatgtatgagagttctagttgctgcaaatccttgtcagtacttgatactgtctgttgttttcttttcaagtggctatacatcttagtcactgtgaaggagtacatctctcattgtgattttaatttttcttttttgctttgagacagggcctcactgtgttgcccacatgggaatgcagtggcatgatcactgctcactgcagccttgacctcccaggctcaagtgatcctcccacttcagcctcccaagtagctgggactacaggcatgcaccaccatgcctggctaagattttaatgttccatgtttctttctttttttttttttggagatggtgccttgttctgtcaccagtggtgaccagtggcgaccagtggtgagccctgattgcacaggttggagtgcggtggtgcgatcagggctcaccacagccccaacctcccaggctcaagcaatctttctactttagcctgctgagtagctgggacaacaggtgcatgccactatgcccagctaatttttaaatttttttgtagtgatggggtcttcctacattgcctaagctgttcttgagctcctagactcaagcaatccacctgcctatgtctctcaaagtgctgggattacaggcatgagccacaacaacccagccagtttttcatgtttctttttttttttttttttttgagacagagtctcgccctgtcgcccaggctggagtgcagtggcgtgatcccggctcactgcaagctctgcctcccaggttcacatcattctcctgcctcagcttcccgagtagctgggaccacaggcgcacgccaccacacctggctaaatttttgtatttttagtagagatggggtttcactgtgctagccaggatggtctggatctcctgacctcgtgatccacccacctcggcctcccaaagtgctgggattacaggcatgagccaccacgcctggcccagtttttcatgtttcttgatgcaaatggtaatttttaaaatttcatttttcatttgtttgctgctagtgtatagaaatgcagttgatttctgtgtatgaccttatatcaatgtcaattagcccttatttctagcagttgttttattttagatttcctaggctttttggagatagtcatggtgttaatattggacttactcaactttagacagtgagaataagatccacatgatctagatgtttggattttttggttttctggatatttgagagccttatctttgtaggtctctgcatgcatgttaggatgacataattgaagtaaaccatgaatataaagtggatgaatacagttgcaataataattctatgtagaattgacatggcagatgggaaacaaggctgctttgccctctgggcttttgaaaaattggaaagtaggccctgtgctctaaagaatgataaaatctggctctggctcataagaagtacttcctaaaaccaggttactcaggaggatgatggaattacctctagccatttgtaaagccacttaccacttttttttttttggacaggtattttgttagtgagtccccaccagtgtaccaggcactgttttagtgcttgggatacatcagtgaacaaaacagtaaaacaaataaacaaacaaaaaaactccctgtttaaattacattctagtggggggaatacataataaatattaagcatgaaaatactgattttttattagtggtgagaagggctctggagaaaaatgaggcaaagcaggaggacgggggtgtagagaaatatattgattttaatacccttgtagattactttttgattaacactggaaagtcatcataaaccaaatagcaggaaaaagtactaattcataattaattattcaatgatgaccctttgatgaggattatctcaagtttacatatgtattccccagtgattcttttctccaactgaattgtctaatttgcaaggaattttttagaagaaatggttccaagcaagctatgctgcgatccctcaaccacaaaagatctaattttcatagaaaaatatttgaattttttcaacagttacaaacacaaagtaggaaacaaaggtcctagccttaccaagttgcataatttctcattttaccatctcacttaggaatggtcaatattatgtttgagaacagtaaagcaaaggaaataaaaaaggtgccacttttgaataattttactcgtgtacactctaacaaaatgtgagatgccaaagaaacaacactacaccagatggctattaaatcaaatgcttttctttacaagtcgatgaatcaatagactctagtgaatgtgctcagttaatagaactgcttaggctgggctaggtggctcatgtctgtaatcctaacactttgggagcctctggtaggcagattgctggagcctaggaattcaagaccagcctggacaacatggcaaaacccatctctacaaaagacaaacaaaaacaaaaattacttgggcatagtagtatgtgcctatattcccagctacttgggaggctaaagtaggacttgagctcaggaggttgaggctgcagtgagctgtgatcttgtcactgcactttagcctgggcaacagaacaagatcctgtctttaaaaaaaagaaagaaagaataataaactgcttacagcccttgaagagaaattcttagagagttatttgttctgcatatatgtcaaaacaacctacttgagatgaaatattcaaaattataaatgaaatcttttaaaaaagatgatacagaaatctttcttctgttcatgtagtggtaatgctggtgcaaagatgggtatatggatataaaggcttcatgtcaagagttcacctgaaaaccctgaaatttaggcacatgaattttttttattccgttttgcataggagaaattcagttttgcctgtaggtctaaattccacattaaattttattttcaaaatggtgaatctaataataataagtacttaaaaataaaatagtacccactgtgtttcaagactgtttttgtttgtttgttttggttttggtttggtttggtttttttgagacggagtttagctcttgtagtccaagctggagtgcaatggcgcaatcttggcttaccacaacctccgcctcccgggttcaagcaattctcctgcctcagcctccagagtagctgggattacaggtgcacaccacctcgcccggctaatctttttttgtatttttagtagaaacagggtttcaccatgtttcaacagctaggctgatccacccaccaaggcctcccaaagtgctgggattacaggcatgagccaccgtgccaagactgttgtaagaagtgtatgtatatttactaatttaatcctcacagttaatgatgtaggtactattaatatcatccccatctacagctgaggaaactgagacatagagcagttaggttattttcccaaggttacattggcagagccaaaattcaaagccaggtaatctggcttcagagtctgtactcgtgtgtgtgtgtgtgagtgagagagagagggagacagggagaaagaaagaaaacacaaataacataaaatttaccatcttaaccattgatttttggtccatgttttttatttttcatttttgggcttaatttaatttatttttgagatgggatctcactctgtcatccaggttggagagcagtggtgcaatcacagctcattgcagcttcagtctcctgtacccaagtgatcctcctacattagtcgcccaagtagttgaaactacaggtatctgtcaccacgccaaactaatttttttcttttcttcatgtttttttaagagacaagggtcttgctatattgcccaggctggagtgccatcacagctcactgcagcctctacttccctcaatggatcctctcacctcagcctcccaagtagctagggctacaggcatgcaccaccacacccagctaatttttttctgtttttttgtagaaatggggtctcacagtgttgtctaggttggtcttgaaatccttggctcaagtgatccacccacctcagcctcccaaagtgctgggattacaggcatgagctgctgtgcccagctgtgtatcttctttgtagaaatatctattcaagtgttttgcccaggtttgaattggggtttgttgttgttattgttgttgttgttgttgttgttgttaaattgtgggagttctttatatattttggatattaatctcttattagatgtatgatttgcaggccaggtatggtggctcatgcctctaatcccagcactctgggaagccaaggcaggaagattgcttgatgccaggagtttaaaaccagcctgggcaacatagcaagaccctgtttttaaaaataaataattaaaaaaaaaaagaggaatagatgaccaggcacagtgactcatgcctgtaatcccagcactttgggaggccaaggtgggcggatcacctgaggtcaccagcctgaccaacatgacgaaaccctgtctctactaaaaatacaaaaattagctgggtgtggtggcacatgcctgtaatcccagctacttgagaggccgagacaggagaatcgcttgaacccaggcagtggaaattgcagtgagccgatgatcgtgccactgcactccagcctgggtgacacagtgagactctgtctcgggaaaaaaaaaaaaaaaaagaaacatgatttgcaaatattttctcccattctgtaggttgtcttcttagtcttctcatgcataagttttcagttttgatgaagtccagtttatctattttaacatttgttacctgtactttttggtgtcttagtcaagaaatcactgccaatccaatgtcaggaagcttttcctgtatgtttttctctaagagttttataattttagcttctacatttaggatggtcccttttttttgtttgttttgaggtgaagtctcactatgttgcccaggctggactcacaactcctaggctcaagcagtactcccacctcggactcctgaatatctgggactataggcatgcactctgcccagctggttcattttgaattaatttttgttatggtataaggtaagggtccagcttttatcttatgacttcttttcatttctgacccattgtttttacctccaagggtacttataccttaattcaaagagttagcataaaggatttagaaaagtagatgtcttgcttggcgcggtggctcacgcctgtaatcccagcactttgggaggccgaggcaggcggataacctgaggtcaggagttcgagaccagcctcaacatggagacaccccgtctctactaaaaatacaaaattagctgggcgtggtagtgcatgcctgtaatcccagctactcgggaggctgaggcaggggaattgcttgaacctgggaagcggaggttatggtgagccgagatcgcgccactgcactccagcctgggcaacaagagtgaaactctgtctcaaaaaaaaaaaaaaaagagagaaaagtagatgtctcagggaagggatgaccatggagagggagaaagacaagagaacagctgatcaatggggcagtgagaacttacacatttattgattaagcttaccttcttatatcgcacgttttgtggcaactaccaaacgtctctactaaaaatacaaaaattagccaggcgtggtggcaggtgcttgtatttccagctactcaggaggctgaggcaggagaatcgcttaaaccaggaggcagaggttgcagtgagccgaggtcgcaccactgcactccagcctgggtgacagagtaagactctgtctcaaaaaaaaaaaaaaaaagttttttcttattttaaattgagttgtttgttttcttattattgtgttttgagagttcttgatacgttgtgcatgtaagtcctttatcagatgtgattagcaaatattttcttccagtctgtggcttgtcttttcattatcagtgataagagaacataagttcttaatttggaagtttagtttatcattgctttcgttaatgggtcatgctttccatatctaaaatctttgtctaacctaaggttacaaaggtattctattttattcctgaagttttgtagttgcaggttatatatttagatctatcatccaactttagttaatttttatatatgttgcaaggtatggattaaaatggttttgttgttgttttggttttttgtttttgagacagagtcttgctctgttgcccagactggagtgcagtgacgcgatcttggctcactgaaacctccgcttctcaggttcaagcagttctgctgcctcagcctcctacaggcacgcaccacgcctggctaatttttctgtttttagtagggacgggattttgctatgttgtcagagtggtctggaactcctgacctcaagcaatccacctgcttcggcctcccaaaatgctggaattacatgcttgagccactgctcccagccattgttgtttttttgaaacaaggtcttgctgtgtggctcaggctggagtgcagtgatgggatcatagctcactgcagccccaaactgctgggcttaagtgatggttggcctcaggctcccaagtagctgggactacaggcacatgcaaccgtgcctgactaatttttttcttttgtagagatggggtttcactatgttgaccaggcaggtctcaaactcctggcctcaagcagtcctcccacctctgcctccccagagtgctgggattacagggcataaggcattgcactcagccaaaatgagtttttaaaatttttggttttgtttatgggtatccagtggtccagcactgtttaaaaaactattctttttctcctgagctgcattttcactttatgaaaaatcagttgaccatttatcatagatgtgtggttctatttctggactctctgatttgtctatcttagttggcattactacatgtcttgattactataactttataataaatgttgaagtcatatgatttaaatctttcaactttgttctttcaaagttatttggctgttatagattatttgtcataaacattttagattcagcttgtccatgccttaaaaaaaaaaaaaaagcctactgggactttaattggaattgcattgaatctatcaataaatatggagagaattgccatcttaacaatattgccctccaatctatgaacacaggttatctctctttcattttaggtctttaagttctctttacaatattttgttttcagtgtgtatattttacacatttttaagtatttcatactttactattttatgttttgaggctattgtaaatggtatttttaaaattcagtttctgaatgtttacgtaataattttttaattttaatttattttttaattttattttttatttttatttttattttattttattttatcttgtgagacagagtctcactctgttgcccaggctggagtgcagtggcgcaatcttggctcactgcaagctccgccttctgggttcacgccattctcctgcctcagcctcccgagtagctgggactacaggcacctgacaccatgcctggctaattttttgtatttttagtagagacggggtttcatcatgttggccaggaaggtctcgatctcctgacctcgtgatccacctgcctcagcctcccaaagtgctgagattacaggcatgagccaccacgcctggcctataaaatttattttcataaagtgatcttatacgctgcaaccatgctaaactgatatatcagttcttagtagcttcttttaagattccatagaatttgctagctagacaatcatgtcattttcagattaggaaagtttaacttcctttccatttagatgccttttatttatttttcttgcctttattgaactcaatagaacctctattactatgctccatagaagtgctaagagtagacatccttaccttattcctgattttaaggggaaagcattccgtttttaccattaaatatgacgttagctgtagttttttcatagattttctttttcggattgagaaagtcctcttctattcctggcgtgttgagtgttttatcaggaatggatgttagattttgccaaatgctctttctgggttatccagataaatacatatacttttaaaaattttagtctcttggcctagcacagtggctcacacctctaatcccagtacttgggaggccaaggcaggcagattgcttgagcccaggagttcaagaccagcctggacaacaagacaaaaccccatctctacaaacaaaacaaaacaaaaccacaaaaattagccgggcagttagactacaggcatgcacctgtagtcccagctactctggaggctgaggggagatcagttgagcccaggaggtccaggctacagtgaaccatgatagtgccactgcattccagactgggcaacagatcaagaccttgcctcaaaaaaaaatctagtctcttactatggtgaattacattgattaaatttcaggtgttcaaacaaatttacattcctggtataaacctcacttgatcatgatttattaacctttttatatattcttggatttgatttgctaatctttaaagaattttccggccaggtgtggtggctcacacctgtaatcccagcactttgggaggccgagacgagtgtatcacctgaggtcaggagttcaagaccagcctggccaacatgctgaaaccccatctccactaaaaatacaaaaattagctgacacagtgatgtgcgcctgtaattccagctacttgggaggctgaggcaggagaatcacttgaacctgggaggcggaggttacggtgagccaagatcacgccattgcactccaacctgagcaacagaacaagacaccatctcaaaaaaaaaaaaagaattttccaccctgggagaccaaggtgggaggatcgtttgagcccaggagttcaagactggcctaggcaacctagtgatacctcatctctacaaaaaataaaacaaaattagccagctgtggtgacacatgcctgtagtcccagctactccagaggctgagatgggaggatcgcttgagcccaggaggttgaggctgtagtgagccgagatcacgccactgcactccagccttggtgacagagcaacaccctgtctcaaaaatgaataaattgggctgggtgcagtggcgcacgcctgtaatcccagcactttggaggccaaggcgtgtggatcacttgaggccaggagttcgaggccagcctgggcagcatggtgaaacctcgtctctactaaaaatacaaaaattagccgggcatggtgttgcacaactgttgtaatcccagttacttgggaggccgttaagcgaaattctgtctcaaaaaaaaaaaaatagccagatgcagtgctttacgcctgtaatcccagcactttgggaggccaaggcgggcagatcacaaggtcaagtgttcgagaccagcctggccaacatggtgaaaccctgtctctactaagaatacaaaaattagccgggcatggtggtgtgtgcctgtaatcccagctacttgggtggctgaggcaggagaattgcattgcttgaacccaggaggcagaagttgcagtgagccgagattgggccactgcattccagcctgggtgacagagcaagactctgtctcaaaaaaaaaaaaaaaaaaaaaaaaagaaaacctgaagattcagtgaagtatagaaaacagaaatcacccataatcctacatgtagcaataacgcaataactaccttttttttttttttagttggagacagggtctctctctgttgcccaggctgagtacagtggcatgatcacagctcactgcagcttcagcttcccaggctcaagtaatcctcctttcttagcctcccaagtagctgggaccacaggcacacacaccacacctggccaatttttttttttttattatttgtagagaaaatgtcttgctatgttgctcaggctggtctcaaactcctgggctcaaacagtcctcttgccttggtctcccaaagtgctgggagtacaggcgtgagccactactcttgggtaattttaaaatttttttatagagactggagcctggcaatgttgcccaggctggtctcgaacacctggtctcaagtgatcttcccgcctcagcttccccaagtgctaggattacaggcatgaaccactgctcctggccagcacttattttaaatgccagccattattctaaatgcttcatatatatatattagtttatttaaccctcatgacaatcagatattatctatttgcattttatagatgaagaaaccaaatgaaaggttaaataagtgatcagtttcccaaccctaattaaaaatttaacagaaattattgcccttccctcctagccactaaatacttagcactgctttactagtctttcacataatgccagtgtatttagtctgtttgtaatctgttaacaccatgttgaccagttcttggttgttatatacagtgtttaccttccgatttttagcctctgtaatacagttacagcattacctaggtttattgagtttttttatagttactagatttagtgtatacttagttatcagtatttgagggaatttcaaaatattatttatatcctatctgctttttaaaaggatttaatgccatttataataaataagtcatacaatgaacttttcaacattaaagattaaaaaccgtaaagaggaaccaggataattatatccaaaatgtaagctcatttagtaataacaagttaatattaaatttagttcttctttctgacatttttggtaagaatgagattcttggttttggagatagcacagactattagtttgaaattatgggatttggtatgtcacatattattcagaatgctaaaatatctgccactgagcaaacctgaaatgtaattcttttttcttattcttcttttttttttttttgacaacttctgataccaaaaaaatgtgtaattctttacataccttctaatagtagatggtcagattttttgtacgtgcagtgatttcagagaacattgaaaaataatcaggaactggttcagtttgcacaaatttactcttctactccttcttctgcacccactaaaaattgtgaaactgtgcagatgtaataaatatattgtgtgtaggctgaagtatgatacagagtgtgaaactgaaatatttagtccaaatttttattcagcaatgaataaaaattcccagggcaatgaataattctatcgagggctgaaattagtggtggggattggtggaaagagagatggagctcattttatgaagtctcataaatttggcatgaatcttataatcagtgaagagctattaaagactttttgatcagggtagtgtcatgaaattgaattttaggaattttttaggaagctgaatactgttagtggtatatagaaagattttctggttttttttgggacggagtctcgctctgtcgcccaggctggagtgcagtggcgcgatctcggcccagtgcaagctgcgcctcccaggttcacgccgttctcctgcctcagcctcccgagtagctgggactacaggcgcccaccaccgcacctggctaattttttgtattttcagtagagacggggttttactgtggtctcgatctcctgacctcgtgatccgcccgcctcggcctcccaaagtgctgggattacaggcgtgagccaccgcgcccggccgaaagattttcttaaaggaggagataccaggaaatcactttatagtctattggtgtatatcatacatagactattgctttttggtttgttatttactactgtaattcaaggtgtaagtagccccagcttaatatagtttctcataaattttcattcttaacctctcccaagaagctcaccatacttaactctccattattgctgtaccttttttgttctccaaattgtaatacgtacatttctctacctgtcaccctttgatttccccttcccttgccatctcttgccacccctacccccacctcctacctgggttccaatcctggttctgcttaccatgtaactgtggcagtttactttatctctcaaagcctcaatttcctcatctatacaatgtgaataatagtttcagcttcatagggtggttgggagagttattaggtaaatatatggaatactcttaaaataatgcttggcacttaataagtactatgtaagtattgttactgttgtctggctcatatttatttttctgatcttagcttagagtttatatcttccttctgggaagtcctttctgcccaaagctgagttacatattcctctttgtgttgccacagattcctgtgcctcccttgccatgttgtattgtcatagcctaattgtttcattgccacaagttctttttctgcttccatcacatcatcacatccttcttgattggcaaatagtaactactcaataaatatttgttgtctagcacatacatacagttcaaacagaaaactaaaatagactaaagtatgaggaaatcttggtattggaacttaactattgaggtttatttcaaagaattttattttgcagcttcttttgtatagctttgaaactctaaaatatttcctttttttttttttagttgccatttcctttgagtcagcaggcctttcatctggaccttgacccaagaagttatgatttttctcactgtttcactctatctcccagtctgaaatagagcattgcactttttagtgtctgagagatatcatgcctttgcagttaaattctcttctgtggctttggctggaatgtgagtaaatttccagagaggatacataattcccaggctgaactctaaccttgtgaactattttaatgtgtggcctcataaatgtaaattttttaaattttagaccaaggaggtgcttgttgttctgccttaattgcaacttctatttagaaagaaaggatctcttggctttaagatagaatcaagaggtgatagtagtgagactcaagtcctgaagataaaaacagaaagggccaaaagctcacctcttggttaatcaggcaggtgtggaggttatggaaatcctcaaagataaaaagtgcctgatggcagcaaccaaggggaaaggaagattggctgagcccctggggtgtgtagcaaggagaccattggtagccaagttggaatctgagaagcggccctgtagctgaacactagaaaagcctttgcgtgaggtattcccaattctaacatttatttatcaccttctgtgtaccaggttctgtgatcattgttaggaggaatgaaataatgacatagccttctagagaacctcagtatccagcaggaaagatgggcatataatgaataattatattaataactttaataagatcccctaccacctataaactccatgagaacatagaacatgtctgttttgtgtctagcactgagtggtcgctcaataagtatttattgaataaatgaatttgtttagccctttctagtttactatgtgccttcacagatatctcgtttaatattctaccttccttttctattcacccactttgtgatgtaagcaagataaataatagtatccgtagcaataatagtataagacaataaactgagttaaatagaagttaaaatgataaacagagaagggagtaaaataggagcttttgtagctacatcttaatcagatgagttgttatacctctgtccagtatctagagtaattacatacttaccacccttcctcttgtctctctgggttttttttgagactgagtctcgctctgtcaccacgctagagtgcagtggcacaatctcagctcactgaaaactccacctcccaggttcaagtgattctcctgcctcagcctcccgagtagctgggactacaggtgcatgccaccacacctggctaatttttttgtatttttagtagagatggggtttcaccatgttggcctggatggtcttgatctcttgacctcgtgatctgcccgcctcggcctcccaaagtgctgggactacaggtgtgagccaccacacccagcgtctctctggttttttaatttgtttttttttttccccccgcagaagatcctttggttttctactagatgttattccatctagatagtgtttatttattgttcatagtcatctcttacccagggaattccttattttgtattcctgaaatcgaaatattctttcatactcattatttagatgctaagagaaaacttggggaccgctcttcccaacaagattgtctcaaattttgtgcccatctgtgtgcattcacgcacatgagcatgtgtgtggaggagaagaggaaaagaacagagatggaaaagattttgaagtgggatgcttggcaagaggagtaaatagatgataattatgaagaagaaattggcaggatttcttaactgactagattatgggaacaaggagtagagaaacaggtcaaagttggctgaagtccatagaatgtatattttaatttaagtgctaaatttcctccatacatttttcatgaactttgaaaaatttgttggctttatacgaacctgtgaacttcagtgagaaaaacagcatctttatatttttgagcatagtctcaatgtcattaattcttctgcttaaaaatcctcaaatgacttgccaaattaggataaaatctaaattctgttaccaaggccccaaatttctacgtatctgactgcaactgcctacttaaactgatcttaccattattcccattcatataccacccacataggctttatatctgctcttacttaagagtttttatacttcctggtccctcatcctggttgttcctccccagtactcagcttattcagttatcagctcttccatactcctttatctaacgtggtaccctcagtgacttgttatctaacctattactttgttttgttttatttttataacagcacttactactttctgatattgtcatcttgtttgtcagtttttctcttctagagaaatctttgtgagggcaggttcttggctctctactgattacttgagtctccattgcccagccttcttgttgtatcagttttaatatagcaaaccaaaataggatcttaattttaaaaaatagtaatgctacttaagatttgattactcttaagacctagtgtttctgtatgctaactccctttttataatgtaaaatgaattattctctcataatatttttctttcttttcttttctttttcttttttttttttttttttaaatgatttagatggggtctgcctgtgttggcccaggctagccacgaactcctgggcacaggcaatcctcttgcctcagcctcctaaagtgctgggattacaggtgtgagccaccatgcctgggcagtctcataataattttcattcctgactttttttcagatctagtctctagaaagaaacttgtgcataccaagacagtatggccaaaaacctatcctggcaagtgttaatgctatgtttccactcctgaacaccaggaactgaacattgttgtgtttgggtattgtgagtatggaagtcattcaattatttttcaaagcgggcttagtacatgatgttttgttaagctaccttgagaactggagtttgtgtttaagtttcagtgagataagggtagacctcctaatgcctgtgaaaattttgatatattttataatgtaccacctgacatcataatgtactgcctgacatccaaatcatctttttgagttttataaatctccaaacttcaaaactagtagatgctggtataaaacctaataatttcagttcaatctttacattctccagggtccacttttcattctcttaagtacaagcctatttctcagtttggcatagtgccaagaacattgataaatgttggccccaaaatgattgtcaaagttctgttcacttaaattcactgtaattagtaagaatagttatcatttattttgggtgccttcaaagtagactatgctaggcaacaatttctcttgataatctcacaatagccttggcatttgaagaaactttggcctagaaacatttatgcccccaagatcacacaactagaaagaagcagaagttgatttatctcctaaatctatgtgacttcaaagctggtcatcctaccactatgcctggttgcctatatcatttaatgtgatgaaggcactaatgtgacacccacaccgggctcaatttattagtaatccttctatatcacagccacacaagtgcttagagttcctggctgagatcagtctatataattatattacacttctcaagtttagtagtgctagacaaataggaagggagttttacattctttgtttatttgcaataatttcatgattgtcgtaattaaactatagcccgagtttaaagaagaagccagccaaaaaaaaaaaattaactcatacattcatccctaaacaatcaaatctcagtaaaaattttaatattagcagcaagttctttttattttctagcagcagcttcttaagagagaggaaaagagggtaagcgtgagtgtgtgtgtgtgtgtgtgtgtgtgtgtgtgtgtgtgtctaggagagggggagagcacatatgtcaactaagaggtgagtttacttctgaagtccaattgtctaacgtatggagggaggataacctccaggcttggtggtgcacacctgtagttccagctacttgggaggctgaagtggaaagatcacttgagcctgggggtcaaggctgcagtgagccatgatcacgccactgcactccagcctgggcaatggagcaagaccctgtctcaaaaaataaaaactaaaaaattttagtctgggcatggtggctcacacctgtaatcccagcactttgggaggccaaggtaggaggatcacgtgagcctaagagttcaagacaagcctggggaacatggtaaaatcccatctctacaaaatatacagaaattagccaggtgtggtggcatatgcctgtagtcccagctccctcgggaggctgaggtgggaggattgatggaacccagcaaatcgaggctgcagtgagccatgatcgcatcactgcactccagcctgggtggtggaacaaaaccctgcctcaaaaaaaaaaaaataattgaaaataactgaaaatttaaaagattggcggggcgcagtagctcacgcctgtaatcccggcacttggggaggccgaggtgggtggattacctgaaggtcgggagttcgaggccagcctgaccaacatggagaaaccctgtctctatgaaaaacaaaatttagccgggcatggtggcgcatgcctgtaatcccagctactcaggaggctgaggcaggagaatagcttgaacctaggaggcagaagttgcggtgagccaagatcgcgccattgttccagcctgggcaacgagagcgaaactctgtctcaaaacaaaacaaaacaaaacaaaacaaaacaaaaaaacccatatatatataatatatatgtaatccctcccaaagtggtgggattacaggcgtgagtcgccgtgcccggcctatttatttattttttgagacggagtctcgctctgtcacccaggctggagcgcagtgacacgatctctgctcactgcagcctccacctcctgggttcaagcgattctcctgccttagcctcccgagtagctgggactgcagacaggagccaccacacccggcctaaattttaaattgtgcctcattctgagtagcatgatgaaatcttgcaccatcccaccctgtcccacccaggatgtaaactgttagcctttatctagtatatgcatgttgtatgcgctggctgctacaaagttaggcacttcgtagctgtgttggttatcagatcaaaaaaacagtttatgtaaggttaggtactattcgtggtttcaggtacccaccgggggtcttggaatgtatcctccaaggttaagggtaggggggactactgtaattgcctgaatggctcagaagggagagctgttgtggccagagaagctgcttgttatgtaatccacattagtacaagataatcataagatgagctgtaagtatagtgggtgttagatcactgctgggtcttatttaaggtggcaggggtgttagggtaacatttagaagttgagagcaaagagtaaggtttgttttgactttatacaacacttgaagtaaaaagcagtttgttttgttttcaggcataaagatatccatccatgtgtttgttgtgttgtttttgttttttgtggggttttttttttgtcatattcacaagggaaaccagaatctgtatgttcctctggaaaattaggtgaagagaagtataacctatttcagtgtggcttcagtctatggtctgggttttattaaaccagatacgtataagagcatgtcaaatttaaccacctcccttcatccactagattacagtgaatgatagtaatgtcactgatacattgttatacacattgctcactaactgtttttttttttttttctttttagaaacggagtctcgctctgttgcccaggctggagtgcagtggtgcgatctccgctcactgcaagctccacctcccaggttcacgccattctcctgtctcagcctccctagtagctgggactacaggtgcctgccaccacgcctggctaatttttttgtatttttagtagagacggggttttctttttttttctttttttttttttgagacggagtcttgattctcggtctgtcacccaggctggagtgcagtggcgtgatctctgtttactgcaacctctgcctcctgggttcaagcaattctcctgcctcagcctctcgagtagctgggactacaggcaggtgccaccatgcctggctaatttttgtattattattattattattactatttttagtagagacggagtttcaccatgttggccaggctggtcttgaacacctaacctcaggtgatccacccaccttgacctcccaaagtgctgggattataggcatgagccaccacacccagccactaacatcttttatccattaatagttcttaattttgttttgcttgtctttaagtgcttgtccctttactaggataaactaagtactattgataatttacaaaagtgctccatctttactgtttacatctactggctagaatgtctaccaagttatgtaagcatttttgtaaatgaatttattgcctttagttttagaaatattgagagcagaatggaacactgacaatcagatttggcaaaagcattcaaagtgattgttatggtgattctgatcatctctttaagataagggagttaggaagattactagaataagcatctttaatattgagctaagattcatttttgtgttccttaaaattcaccatagttttgactaaactaaggaggacagtgagtacttactttacactgacctatacattcatttaaaagcattctttaattgaagtactttattttattttattttattttattttttgagatagagtctcgttctgtcacccaggctagagtgcagtgatacagtaatggctcactggagcctcaacctcctgggctcaagcaacccttccacatcaacctcttgagtagctggaactaaaggtgtgcaccaccatgcccggctaattttgtttattttttgtagaaacaaggtctcactgtgtgggccaggctggtctcaaactcctgggctcaagcagttctcccgcctcaacctcccaaagtgttgggattacaggcttgagccaccatgcctggcccaattgaggtattttattttagatgcatcttctagccaggcaaggtggctcacacctgaaatcccagtgtcttgggagactgaggcaggaggattgcttgagcccacgagtttaagactgtagtgagccatgatcatgtgactacactccagctggggccacagatcgagaccttgtctctaaaatgaatgaatgaatgtatgcatgagcctcctgagaagccatggagaaagaagcaagcatgaccagtcagtgactgacatttaaactgtaagaaaaattgacttcattttatatgaactttaaaggagacactctgtgtaggtaggtacttcaaaatatgtgtaagtgtaattgtatcagaataggtggccatgatgtgatttgatgagactgccaagagctagacattctagccatttcttaaaaggccagttagctaaacactagttaggattcatttatttaattgattcacagcttaaaattaagtgtagtaaaggaaacagatatagaagagatagggaaaggtttagagttggagtgtcttcagctgcttgtggagggcgtggtagagacagtgttaactacttcccagttttaccttgggtgacccttgttacagatcactgcttctgagctgcttttgagagctagtggagagagattatattacgtcctaggagaatgtaactcagttctactggaggccaccattctcttccaggtcatgggtggtacctcttagtgtcactcagaggtgaggactatttgatggcaggcaaccttaagctgctgacaggacagaaacctttgtgataagcattgggaaatctgactcctggaaagagtgaagcatcaaaaactctgtagagtatatgagtttcgcctattaggcagttataaggaaatagctaaaaaggaactggctaattagagttgagagaaaatatttataaacagactttaaatactttaaaagcaggcttttattttatattctttcagtggggatagtgtgaactgccacctcctttaaaaagccttgcattccagctgggcgccatgactcacttctgtaatcccagcactttgggaggccgaggcgtgtggatcatgaggtcaagagatcgagaccatctggccaacatggtgaaacccatctctactaaaaatacaaaaattagctggacgtggtggtgcgcacctgtagtctcagctactctggaggctgaggcaggagaatcgtttgaacccgggaggtggaggttacagttgagccgagatcacaccactgcactctagcctggcgacagagcaagactctgtctcaaaaaaaaaacaaaaaacattccatctaaaaaaattaccatttacttgcagatgttttcttgtggaagaaataaagtttaaagaaaaagaaataaattaccaagacagctttccaaatatgatggattaattatctgtatattgtggcaagatattttccccctcccaacatttattttttatttatttatttattttgagacaggatctcgctcggtcacccaggctgaagtgcagtggcacgatctcggctcactgcgacctctgtctcccgggttcaagcgattctcctgcctcagcctcctgagtagctgggactacagacacgtgccaccacacccgactaattttttgtatttttagtagagacgggatttcagcgtattagccaggatggtctcgatctcctgacatcgtgatctgcccacctcagcctcccaaagtgctgggattacaggcattagccacggtacccggctgagatattttctccctcccaacattttattatgaataattttaaacatacagaaaagttaagtaaaatgatcacccaccacctagattcaataattgtcaaagttttgtcatatttgctttatctatatatgtgattgtatttgttttgctgaacagtttggaggttttaaacattatgacatttctctcccaaatactttatcatgactctccaaaaacatgaggacatttgcttatataactgtaataccattattatactacacagtacttcctactgtcatcttttatccatgtgtagcaagttatttagccacttttaaatttgtttctcctcactccagtaaccctacacccccgaaaaccttattgttccttgtcactttgtcatgtacctcatgcccagcagcaattggtgagatggctttttcatatggttttatatttgggaacctctagagcagtggttctcaacttgggctggacattagaataacttgaggagctcttgaaaatcccaatccccctacatcccagaccacatatatcagaatttctgatattctgatgatttccatgcgtcagtagttcttaaagtttcccaggtgattctggtgtgcatccatgattaagaatcacaactgtaggtcctattaatcttcagtaagagtattcagtgtttggataggtgcttgacagttttctgaccagaacagagatgaaaagtggtatgcctaggtatttaggctttttccttttctttcactgaacatttactgaacatctacaatgtgtaaaacactgagctaggttcccattcataaggatgaataagatatgttaactgtggtgttctagaaaggccatggacttagggttagacttctatggagttaaattctagctttgctgagaacaatttgtgtgatttttaactaagtcctaaacctctctggggctttaacatgatgtggtttgtttaccttgcagatattatcttaaccactcttactacctctgtactctagccacactggccttctttctttttctcaaacatatgaagcttgctctatgtatatatgtggctttttactaccttctttttccactccctctgatacccctctgggatacaaatgggcccttgctagtcattcaggtttcagttaaaatatcatcttctcattgaagcttcttctgaccatctaatctaaaataacttcctggatagtccatatcatatcatggtgtttgattttcattgtggcatttattcctcttagatagtttcttgtttgttatgggcttactttctcctctattatataagagtaccaggagagctagaacctcatctgtttggtttcccttattctcaggaactgtagaaaaatgcctgacacatagaggatgcctaataaatatttgttgaattaataaagtggtaacagtaattctacattatgtttgagatagtttaggaaaacctcctggggacaatttcctatcagttccctcatgctctttccccaaggagtatcttttctcttaaatgctaaaagccaaagcctttgttgtgcttagaaaatccaagcaggtagaagatacttctgaatatgtaaaaagtgtgccaattcagtagccccctccccagactggggttagagggctcccttttgctctcacagtgagtctccttgtgaaaaagaatcaatagttttatcatcttgtcttagcacttctccttctgaacagaaatttgttgttcaacctttgggtttatgctggagaaacagaatgcattgataaaccatccttttgtgtgtatcattgagagccaagatggaagcagtgttagacagctagttaagtttttttctgtagtgtcttttctgagttaaaaagcaaatgcaataaatgcccacagaatgttcttgacttttctttttctttctggtgtatttttttaagctttaatttattgctcttgcactgtgtgccaagaacggaattgcctagatcacatcttacaatatctctatgagataggaactctttctttcttactttttaaaatagagataggggtctcgctatattgcccaggcttgtctcaaactcctgtgctcaagtgatccccctgccttaacttcccaaagtgttgagattacaggcgtgagccactgtgcctgactggccgagagctctcttattcccactttatacatgagcatagtgagttttagcaagctaagaaacgtggcctggttggtggtttgtggagccaggattaaaatccaggtaatctgacttatatcttccacagttataactatactacctctcattatatctttttctcttctcatctttatcatttaaatacttttataaaaggcatttgagatggttaagcataaatatgtttctcaaagcaatagataccaggaaaacagttcctggtggccttgcttagaagccatgttctaatcaatcaagattcttaaggaagagtagcatcatcaattgttcatgtatattagtagatgagtctggaaagtggaaccaaggttctggacttctttgtttctttaagccttctaattatattttgatgattatggtcaagtatatggattctagtttgtctttagtgagagattcaaaaggagcattgtgtttaattctagaaactcgagatactaatattatcacgatgagttcactcctattattttcatgttatgtttttttggattagtaaaattagcttagttttggccaggcgcagtggctcacacctgttatcccagcactttgggaagccgaggcaggtggatcacctgaggtcaggagttcgagacgagcctggccaacatagcaaaacctcgtctctactaaaaatacaaaaattagccaggtgtggtggcacgcacctgtagtcccagctactcgggaggctgaggcaggagaatcacttgaacctgggaggcggaagttgcagtgagccgggatcatgccactgcactccagccggggcaacagagcgagactctgtctctaaatacataaataaagcatatgatctatatggacagtcatatctttttctttttaaaagtccatgctgatgctagacgtaagagatgatttgcacagagtaagtgctaaggttgataacaaattccttctgtagggtgtttatccaagaggggaaaataggaattctagaggggaagatatgaaacttttgggtatagatccctcagcagagcagaaacacagagggcttaggcacctcataagaagagctaataatactgccactgatcatggtgataataagaaagagagcaaacatttatttactgtttgctaaatatagtgctggcactttaaatgtattatatgaatagattaaatgggttaataaatgtagaatacatagaataatgcctggtgcatggtaaaaagttatataaacagctgctatttttattgtacttttatatttttatataatatatttttattttttaatttttattgttatccttttgggtggtgattgtaattattcttcacagcaaccgtataagttaagtactattattatccattttacatatgggtaaactggatgccagaggttaagccaggaaatagtagaacaggattcaaactctctagttttatgtagttgagtcttttttttcagtcagtctcactctgtcacccaggatcgcccaggctggagggcagtggtgagatcttcactcactgcagcctctgcctcctgggttcaagcagttctcctgcctcagcctcccaagtaggtggggttacaggtgcccaccaccacgcctggataatttttgtatttttttagtagagacaagatttcgccatgttggtcaggctggtctcaaactcctgacctcaagtgatctcacaaagtgctggtattacaggtgtgagcccggccttgagtctttgtttggttaggactgcctagggatatagatagctattctacttagtgttgctggaaagttgcccttaaggaagtgacatttaggctgatactgaaagataaaaagctaggtatgcaaaagttgagaaagggaaagaggaactttaggcaaagtacagcaagtgcaaaggcctgaggggaaatgggtttgacatggttctgtaaacaaaaatgtcaccttctgagtgagttcttccctgaatactgtatttaaaactggccaggtgtggtagctgatgactaattccaacactttgggaagccgaagtaggcagatcgtttgagtctgaaagttcaagaccagcctgggccccattgtgagacctcattctttacaaaaaataaattcgctgggcatggtggcatgtgcctgtagtcccaggtacttgggaggctgaggtgggaggatcacttgagccagggagattgatccctgttttattttctccataacacttattattgtcccacatagtatataatttattttggttgtctctcccacaatgggatataagcttcctgaggacagggatgtttgtctgatttgttcattgttattgccaggtcctcccttagcccatgggactttttccagtaaattagaaaagaatgccaggcacggtggctcacacctgtaaccccagcactttgggaggccaaggcaggcagttcacctgaggtcgggagtttgagaccagcctgaccaacatggagaaaccaccatctccactaaaaatacaaaattagccgggcatggtggcacatgcctgcatacctgtaatcccagctactcaggaagctgaggcaggagaattgcttgaaaccgggaggcggaagttgtggtgagccaagatggtgccattgcactccagcctggacaacaagagcaaaactccgtcttgagaaaaaaaagaaaagaaaagaaagtctcctttccaaaaggttgtggctccacgcgggacacgtagttcggctagaaaagcatggacctagattttggcctcctcttgcctcctcagccaattatacaagacataattgagcaaccattacatggcagtcctaggatgcattcatagtacctagaacagtgccaacgtgtagcagacatgaataaatatttgtagaatgatggaatagtttagagtgaagaagagtgattatgagatgagaaagtaagcagaaaccaggtcaagtaagacttctaaggagtttgatcttttttttttttttcctaaatagcagtcaactgacaagtcccatggaatactttccattaaatcataatctgtattttcaaaaagcagtgcaagtaattctgcagtagagttagtggcccaactttcttttttttttttttttttttttttttgagacggagtcttgctctgtcgcccaggctggagtgcagtggcgcaatcttggctcactgcaagctccgcctgccgggttcataccattctcctgcctcagcctcccgagtagctgggactacagacacccgccaccatgtctggctaatttaatttttttttttttgtatttttagtagagatggggtttcaccttgttgaggatggtcttgatctcctgacctcgtgatccgcccacctcggcctcccaaaatgctgggattacaggcgtcagccgctgtgcctggctagcaggccaactttcaatacttttggaccttcagggatccatctcctgcctatttcacccttgtctatttggcattttactttgcctgcatatgtgggtttaccatgttctttcaaactctgtgcaagggagtttgggatgaactatatgtaaaatattcatttttttccttgcaaccccaaatccaaacacagttggatggagtttttaatcagggttattgcagaaaacccaggacctcaggtccttgtgattgagtggtgaatgaaggggaaaatgaggccacttgaacattattctgtttaggaacttgctgtatgaattagtagagaccatcacatttttcatcaattcctgctctcaccacaccccgctcttgcccctgctaaaaaactaccagccttctctcatgttatgatttaggggcccctgttcactgaggggctaacagctggaattgtggcactgcattagccttttttgagcttttatttctctttcatgctggatttttttttttttttttttttttttggcacccacaccccatttgagaatttactttctctctgagaagtttttgtcagtagttttttgttttattgccttttctgtgataggttaaggatacagcttggtaaagaaggaacctgcaggggtttattgatggagttcctgtcccaccatgccctaggcctagtacatacatgcttctgatgaatcactgctgttagtatttagtatctcctgatcctcatagtccatattatgcaaagcatagaatctgcccaagggacttaatagctgaatcactcacttgatctgttgtctttcactctttcttccctttgttggtggctacaggcaagtatatgagagatataaaactgtaagcaagacaaaatctggactacatatctttattgctgcttgggaagtggcctgggagttcaaattcaaggatttgaagctttgtacagctgccccagataacctgctctcattgggatgaggatgaagtatttccacatgattgctcaagtcccttttctctttgccctgatgccccctccctcctctctatttcattaattgcttagcagttgctgatggaattaaaacgaaatgtgtctgcagcctctgtggtttgctgtcagaactctctttctaaggtctttatcttactgctagggatgggtgaacatctgattttgaagcaagaggagggagggacctgtggctgtagttaaatgcatttttctaaaagcagcagcttgcagagttggactcctcctgaagcactattcattttaccaagccatgccctagtcccttatgctgttcattaatggggcttgtatgtggcagcacagtatatagaaatgaatcctgctgaattgcttttgttggtgatgtggaaagtgcttttcatttttaactaagaacaagaaggaaacagcctcaaagtgtgaaagagtcaaaaccaaatcccggggtttctgtggaagacaagaatctggatatggctgaggcgggtggattacctgacatctggagttcaagaccagcctaaccaacatggagaaaccccgtctctactaaaaatacaaaattatctgggtgtggtggcacatgcctgtattcccagctactcaggaggctgaggcaggaaaatcacttgaacctgggaggcggaggttgcagtgagcctagatcgcaccattgcactccagcctgggcaacaagaactccatttcaaaaaaaaaaaaggaagaagaggggaaaaccagaggttatctataatcagtaggatttttttgcacatacagaatttctggcaataataatcttttggacacaggatgggaataacaaccatggaggaacttctgttttcttagggaggtcaacgtatttattttctcttaataccgaattctcttttcttattcatggttttggttttgtgtactattaattatataaattaatgggatcccaggtagtatttgtatatttacaaaaaggttatgaaatttaagcaaggtaaacttaaagatagccacttgaattttgccaaaatttggaacttaatctacattctaaccaagcaagctggttttatctgagaaaatataaataattacttgatatacttggccgggcaaggtggctcacgcctgtaatcccagcactttgggaggccgaggcaggtggatcacggggtcaggaaatcaagaccatcctggctaacgcagtgaaaccccgtctcttctaaaaatacaaaaaattagtcaggcgcggtggcgggcacctgtagtcccagctacttgggaggctgaggcaggagaatggcacgaacctgggaggcggagcttgcagtgagccgagatcgcgccgctgcactccagcctgggcgacagagcgagactcagtctcaaataataataataataattacttgatatacttgaaaaattaataaaaatgggggctaatcaggattaggcaccttgagaaaccaaaacccctggtttgccttcttttaggtcaaatttatctacttagtttatattataacttacaggtataaatgtggttgttgttattaataataatcttttattcagtgtctacttgctgccagtttcatgaggctttctttaaacattaatactgactttaggctagcttaaatatattataaattctgatacagatttctctagtcatgtgcttcttagttatgatgtcaattcagaattttttatcagaattttgttctagaaaaaaaaaaagtcaacacacgtcactgctataaattatatcccagaatgggggctaaaataaacttgcaatatctttaaaaaatctaacttccatgccctattctagaaagctactggatgtttctacgaaaaggaagatgtgatagaggaaagatgaaattcaataaacaagaaaggttaaaggaatcctcaaaatagtggatggagccaggcgtggtggctcaagcctgtaatcccagcactttgggagactgaagcgaatggatcactcgaggtcaggagttcgagaccagcctgggaggtggaggttgcagtgagctgagatcatgctactgcactccagcctgggagacagagcgagactccatctcaaaaaaaaaaaaaaaaaaaaaagaatgaactgaaggcccattttaagaatcatatatatacacatataaatatatacatatatatgtatatatacatatatgtgtatatatacatataaatatatacatatatgtatatatacacataaatatatatatgtatgtatacacataaatatatatatgtatgtatacacataaatatatatatgtatatatacacataaatatatacatatatgtatatatacacaaatatatacatatatgtatatatacacacaaatatatacatatatgtgtatatatacacacaaatatatacatatgtgtatatatacacacaatatatacatatatgtgtatatatacacacaaatacatatatatgtatatatatacacacaaatacatacatatatatgtatatatatacacacaaatatatacatatatgtatatatatacacacaaatatatacatatatgtatatatatacacacaaatatatacatatatatgtatatatatacacatatatgtatatatatacacatataaatatatacacatatatgtatatatatacacatataaatatatacacatatatgtatatatatacacatataaatatatacatatatatgtatatatatacacatataaatatatacatatatatgtatatatatacacatataaatatatacatatatatgtatatatatacacatataaatatatacatatatatgtgtatatatacacatataaatatatacatatatatgtgtatatatacacatataaatatatacatatatatgtgtatatatacacatataaatatatacatatatatgtgtatatatataaagaaaacaaggtcgggtatggggacacatgcctgtaatccccgctacttgggaggctgaggcaggagaatcgcttgaacccaggagtcagaggtttcagtgagcagagatcgcaccactgcactccagcctgggcaacaagagcgaaactccgtctcaaaaaaagaaagcaggcttagtgcagtggcttatgcctgtaacccaacactttaggaggtcaaggtgggaggattgcttgaggccaggagttcaagactagcctgggcaacatagtgaaacccaccccccttccctgcaagaaaacagaaaaaataaaatatagataattattttttatctgcttgttaggatatgaatgactttgtaagtgtgactgcatagggaaaaaaacataaaggaaaagattgatagatttttactaaataaaagtttaagatttatttatttatttttttatttttttgagacagtcttgcactgtcgcccagcctggagtgcaatggcatgatctcagcccactgcgcccagccaaggttttttttttatatcaaaaaaggttgtgaacattactgaatgatcttgcttcactgcagtcctaagtcttgtcattagtctattttagttatcttatagattttggagttgctccctctcattctttacttggaatgattcatttacaggaaaattaattatttaataaggtttatgagccgggcacagttgctcacgactgtaatcccagcaccttgggaggctgaggtgggcggatcacaaggccaggagttcgagatcagcctgaccaacatggtgaatccccgtctctactaaaaatacaaaaatcagccatgtgtggtggcgtgcacctgtagtcccagctactcaggaggctgaggcaggagaatagcttgaacccgggaggtggaggttgcagtagctgagatcgtgccattgcactctagcctgggcgacggaacaagactctgtctcaaaaaacaaacaaacaaaaaattatgaccagacatggtggctcaggcctgtaattctagcactttgggaggccaaggcgcatggattgcgtgagctcaggagtttaagaccagcctcagcaacatggcgaaatcccatctgtacaaaaaagtacaaaaactatatgggtatggtggcatgtgcgtgtagtcctggctactctagaggctgattggtgggtggattgcttgagcccaagaggttgaggctgcagtgagctttgatagggccactatattccagcctgggtgacagagagagaacttgtctcagaaaaaacaacaaaattgtgcaggatctggattttttaaaaattaaaaaaattttcattaaaaattataaaacaaaaaagatttgcatctacattttgctatttttttatgtcttttttgttcctctttccctccatcacagccctcttttgtgttaaatagatatgttctattgtgtatagtgtagggagacccatctctacaaaaaatttaagaattagctagaacagagaaaacaaaaagaagtgatggtacatgcaaagaagtgatggtacatgcatgcctatagtctcagctacttgggaggctgaggtgggaggatgagttgagcccaggaggtcaagctgcagtcagttgtgattgttccattgctctacagtctgggtgatagagcaagaccctgtctcaaaaaaaaaaaaaaaaaaagtagccagacctactggctcacacctgaaatcccaggtgcgggaggcctaggcaggtggatcatttgaagtcaggggttcgatactagcctggccaacatggtgaaaccctgtctctactaaaagtacaaaaaaaattaggtgtggtggtaggtgcctgtagtcccagctacttgggagggtgaggcaggagaatcacttaagcccaggaggcagaggtcgcagtgagctgtgatcttgctactgcactccagcctgggcgacacaggaaaacaaacaaacaaaaaaaaaaaacttgtgtttttgtatagctctgttcccttctttgtcctttgtgctattattgtcatacaaatgacgtatacccatcaacacatattataaatattgctttatgcagttgtcttttaagtcagatatgagaaaaaagttataaataaaaaatacatttatacagtcttttgtatttacctactatggcaggtaggcagaatactgcctcctccaaaaaaaatctatttcttattccctggaacctgtgaatatgttaccttacctggcaaaagagattttatagatgtgattaaattaaggattttgaggtggggggattagcttagattatccaatggttccaatgtaatcacaagggttcttgtaagggaagaagagggcaagagagtcagagtcagagagagatttaaaaatggtatactacttagtttgaagatggagggaggggatgagccaaggaatttagacagcctcctaaagcctagaaaaagcaagaaaaatggattatctcctagagcctccacaatgaaatgcagccctgctgacatcttaattttagttcagagagaaccattttagacttttgaactccagaactgtatgataataaatttgcattgttttaagccactgagtttatggtaatagtttcttattgctgctgtcatttaatacagctatgggggagttagctttactaacattctttctttgtgtggattcaagttattgcctagtgccctgtcatttcacttaaagattccctttagtatttcttgtagggcaggtctactagcaatgaactctctcagttcttttcttttcttttcttttcttttttttttttgagacagagtctcgttctgtcgcctaggctggagtgtagtggtgcagtctgcaacctctgcctcctgggttgaagtgattctcctgcctcagcctcccgagtaactgggactacaggcatacgccaccatgcctagctaatttttgtagagatggggttccaccttgttggccaggctggtctcgaactcctgacctgaagtgatcctcccaccgtggcctcccaaagtgctaggatgacaggcatgagccaccacgcccagcctctcagttcttttttatctgggaatatcttaatttttccttgttttttaatggatagttttgctggatatagaattaaatactcagcagttgacaactctgttttctagtcttcaatgtcttcttttttttttttttttttttttttttttgagacagtctcgctctgttgcccagacaattttatttttaaatttttttagagacgggggtctcaccatattgcccaggctggttcagtggctattcacagttacactcatagcacactgtgaccttgaactcctggcctcaagctgtcttcctgcttcctcctcctgagtagctgggactatatgcatgtcaccatcctggcctagccttcactttctgcttgtgcagagcttcaaggtcaaccggaggtgagagtttagggccttctcagtactttactgagcgtggcctcagccctgggcatgtatacgtccttgtgcatacatgtggcttgctttttttaaagattttcttctactctcagacaatctagaaaacatacggctttctagatttccaggaaagccctgtgaacatgtccttccccagcttttccttttaagtttttttggtcaggcagccacaaagttaagcacttccctatatttttcacaaatactcctacctcccagggaaaaggctttttatgctgggtaagctctgagtctggtcagatatagataaccttgcaagtggggccttccagggaaccaccggaaaggtcaaataatgataattccctgggaatgaagcttcacaggcacgccaaccctgttctgccccatctagtgattgtcaagctgctgctttttcactgtgattgcaggcttttgatttttcagagcaggagatgggagtagggcaagttaaggtgctaacaaagctcaatgtttcttactgatattcaggcgttttgcttgaataaatgctcttagattgttgtaagcctttggtgttaatttccagaattctgaaaaacttgattttgacaatttttgttttatggagaagagaattttcaaagatcctttactctgccaattttgccagtgtcctccctcattctttaaaggcttttttagttcctggctcagagtcaccctctccaacactattcctggcttaattcttggtaaattctatgtccatattaattatctttccaacatctttatttcttagttccttatccatgtctctcccaaagatttttgacctctatcctgtctcagctactactcccatagtcgtactctagaccagtgcaccaggaccaagctgtttttgtaaataaagtttgtttaaatatagccttactccttcatttatgtatcgtctatagcctctttcatactacaacagccaagttgagtaattgcaacagacaccattgactctcaaagcctaaggtatttattgtctaaccctttacagagtttactgactcctgccctagatctagtcaattagagctacatctcctctgttatttcagtatcaagcatgctattcttccatcactcatttctactttcacaacacccttcctctggaatctctgctccgtcaatcctttgacactgtgaatcaccactgtttgtactgagcattacactctttttcaagtacttccctactgaacttgtattcattataattactttcttcgctacattgttaaatttctcaccgacaaaaactcagtccaactttttgcttacttcatgcctgtatctgtgtgtctacatgtggctgaaaaaactgttctgcctgttctcacattaagttcacaatcattagccttaagcaatcctacatttccctatccattcactctttctttctttctttcttttttctttttttttttttttgagacagagtcttttttttttttttttttttgagacagagtctcgctttgtcacccaggatggagtgcagtggcgtaatctcgggtcactgcaacctccgcctcccaggttcatgccattctcctgcctcagcctcctgagtagctgggactacaggcgcccgccatcacgcccggctaattttttgtatttttagtagagacggggtttcaccgtgttagccaggatagtctcgatctcctgaccttgtgattcacctgcctcggccttccaaagtgctgggattacaggcatgagccaccacgccgggccaagacaagagtcttgctctgttgcccaggcttgagtgcagtggtgcgatctcgactcactgcaacctctgcctcccgggttcaagtaattctctgcgtcagcctccagagtagctgggattacaggcacccgccaccacacccagctaatttttgtatttttagtagagacggggtttcatcatcttggccaggaggcaggagaatggcgtgaacccaggaggcagagcttgcagtgagccaagattgcgccactgcactcctgcctgggtgacagagcaagagtccatctcaaaaaaataaaaaataaaaattaaattaaatttaaaaataaaaataaaagtgagatacgatagtcctgttttagaagctctgttttcattggtggggcttgtcatttggtggcccttactataggaaggagttgattgaccattgatgagggaccatccaccttccagcatctgtaggtcttttgtcttaggcaagtcatttttcccttagaggaatcaacccatcttttgcctgctttctcatagcccagaggagcaaaaaggggtttgtgtttgactgttgctgtgagtgtttcatttcatctctgttcttagttgtgcatggtgcgggtgagtacccagcctgtccaacatattctgagtaaatgttcagacttttgctagaatcgtgaatgtaggggaggtgggaggaggctgccttgggtagtggagatgatctagagctctgattgtatcttttaggactttgagcgatcttcctgttttgaaccctacgctcttttcagagtacctgatgccacaaattgctgatcttttcctgggttttgaatgtttgctaacagtttcttcacttccacctctaccaattttataagcttaggtttcatctttttttggtctctaggttaacgtttatccatctgctttccagttcccaaaatggttttcacatctcttgtctgctattctcttctctcttgctctttgtcctcaaggatttatgcctatttttatttggtttcattttattgaggttttaaaaaagaaaggaggggaatgtataagtagagcaactaaccctcagttgtacaggttgtgccttttaagagggttccctgctgatcagaactaggatctctgactcggcactttgggaggccgaggcaggtggattgtttgagtctaggagtttgacaccagcctgggcaacatggcgaaacccagtctgtattttaatttatttatttatctacttatttttatttatttatttattttttgagacagagccttgctctgtcacctggctgacagactggagtccagtggcgtgatctctactcactgccacctcagcctcccaagaagctggaattacagttatgcgccaccatccctggctcatttttgtatttttagtagagacagagtttcgccatgttagccaggctggtctcgaactcgtgacctcaagtaatccacccacccagcctctcaaagtgctgggattacaggaatgagccaccacacctggtcagccactgcacccagccccatctttatgtttatttttatttctttttttgagacggagtttcactcttgtccaggctggagtgcaatggtgcaagctcggctcactgcaacctctgcctcccaagttcaagtgattctcctgcctcagcctcccgagtagctgggactatgggtgcatgccaccacacccagctaatttttgtatttttagtagagatggggtttcaccatgttggccaggatggtctcgatctcttgacctcgtgatccacccgtctcagcctcccaaagtgctgggattacaggcatgagccaccacgcctgcctgctatttttaaaaatataaaaaataaataaggaactagactctctaagaaaaaagaaaaaaaaaaagagggggccctgcttaaggtatttgaaatgatgggttaaaatccatcctgggccgggtgtggtggctcatgcctataatcccagcactttgggaggccaaggcgggaggatcacttgaggtcaggagtttgagaccatcctggccaacatggcaaaaacttgtctctactaaaaatacaaaaattagtcaggcgtggtgatgcacgcctgtaattccagctactcgggaggctgaggcacaagaatcacttgaacctgagaggtggtggttgcagcgagccaagatcgtgtcactgcactccagcctgggtgacagagcgagactctggggaaaaaaaaaatccaacctgagcttgattcactgtgccttaaacttgtttagccccgaggaaggtagcttctctaattcacaatggtcttatgctgagggtagccttggatatatgtatttgttgctgttgtctttagctaataacttgaatctgaggtatatttctgctttgtttctttaaaattctgtagtaaattgttaatggtttttactgggttaagatatccattttttggaaaaggtccctatgtatttcttttgaatatagtaacaaattagtttcatctcttaatctctagactagtttccagtgtagctagctagttgacacctaattgagcactcagtaaccttagttaatgctcatttacttttgccctcatgccatccaaactcagattcaagcatgactttattacttcagcattctgcgtaataaaattcttgtcccataaacagtgactcacagaaggagactgattctaaaggattctgaaatatattttttactttttgtttttttgtttggttttgttttttgagacagagtcttcctctgtcgttcagactggagtgcggtggcatgatcatggctcattgccacctccactttccaagcttaggtgatcttcccacctcagcctcccgagtagcagggaccacagacatgtgacaccatacctggctaattgttatttttgtagaaatgggatcttgccggccgggtgcggtggctcatgcctgtaatcccagcactttgggaggctgaggagggcggatcacctgaggtcaggagttcgagaccagcctaaccaacatggagaaaccctgtctctactaaaaatacaaaaaattagccgggcgtggtggcacgcacctgtagtcccagctactcgggaggctgaggcaggagaattgcttgaacccgggaggcagaggttgcggtgagccgagatcgcgccattgcactctagcctgggcaacaagagtgaaactcggtctcaaaaaaaaaaaaaaaagaataacttgagctgataatgagtatcagcaacattttctactgtggccttgatagctgcagactggtactggtccatggcctgttaggaacctggtcgcacagcaggaggtgagcagtggctgagaaagtattagcacctgagctctgcctcctgtcagatcagcattagattctcataggagcgggaaccctattgtgaactgcacatgagagggacctaagtcatgcgttccttatgtgaatctaatgaatgcctgatgatctgaggtggaacagttatagccctgaaccatcccccgtcccgccaacccccctctgtctgtggaaaaattgtcttccaggaaactgggccctggtgccaaaaaggttggggaccactgctttataggaatactcggtagaatgatgattattacagtattggaacagagttaaagacagcaaaaatcttgagttcagtgaaacgaaatacttctcaaatttattagacccatcatatatgctttttaattagttgtctctagttttaacctttcccatatgtttcatacagagagacagctgtaatgtggcaacctgtggctcttgtcttttatctccagaatagtgatgtttttctttaagataataatttcttttcttttagcttttcttcctataagttgttatctctgcctgttgctttctagaagaggatccagaaggaaaatgctttgctgtttaatcaatattttaggagaggctactctacagaacaggaaatgacataatttaactcacaaggatggcgaaaactaaaataattagtttatctgtttagagtatctgaagaaaatagcagctcattgttctctaaagtggatcttgccacccaccagttgttgaaatctcagccttgtctttgtacatctcagtgtcgaaagaggtcgaggaaaaaatcctgtctttccatcttcctttatataaggaatggttattgtttagatgaaactgtatctaccctgaccgtgtcatatctgtagtacctagcagcacagtacctattaattagtagtagggcttcagtacattttttttcataaatcctgaagtaactattaagttctgggacagtggttcaaagggcataataaaaagggatgaaacatcaagtttctggaaaattgtggtgtatttgtgtattttcttgcatttgtggcgagactagtaaaagttaacctaattagattttcaaaagtgttcattgattatactcaaaaaacatttatggagtacttcctgtggtcaggcacagcactaacccctggtatagagtgttgaaggagacctttaggagatgtgaaagagggaataccctccttcatgaaacttccagtttattctggtagggaaacactataaaaatagctcttttgcctgagataagtgttacaaaggaaaattactcctgattgtctatggatgtggtgtctccaggttaatttttctgaaaatgagtgtggatagcagagtctctaaagaagttatcaggccaggcactgtggatcacttgaggccaggagtttgaaatgagcttggccagcaggggtttttccatgttggtcaggctggtcttgaactcccgaactcaggtgatctgcccgcctcagcctcccaaagtgctgagataacaggcatgagccactgcccagccagtaggaggatctcttaagcccgggaagttgagactgcagtgagctgctgcgatcaaaccactacactccagcctgggcagtggagtgagaccttaaaaagaaggggaaggccgggtgcggtggctcacgcctgtaatcccagcactttgggaggccgaggcgggcggatcacgaggtcagaagattgagaccacggtgaaacccccgtctctactaaaaatacaaaaaaaaaaaacaaaaattagccgggcgtggtggcgggcacctgtagtcccagctacttggaggctgaggcaggagaatggcatgaacccaggaggcggagcttgcagtgagccaagattgccctactgcactccagcctgcgtaacagagcgacactctgtctaaaaaaaaaaaaaaaaaagaagaggaagactgtacagactactagagattatggcaacctctttctcaatcttgttttcttgttttttgtttgttatttgtggagatggtatctcactttgttgcccacgctggtctcaaactcctgggctcaggtggtcctcccacctcagcctcccatagtgctggaattacaggcatgaaccaccatgcctggtctgtagtctttttttttttttttgagatggagtttcgcccttgttgcccaggctggaatgcaatggcaaatggcaaactctgcctccagggttcaagcaattctcctgcctcagcttcccaagtagctgggattacaggcatgtgtcactacgtctggctaattttgtatttttaatagagatggggtttcaccatattggtcaggctggtctcgaactcctgacctcgggttcgggttatccacctgcctcagccttccaaagtggtgggattataggcatgagccaccatgcctgtctgtggccctcagtcttaatagtgcaaccaagaaaatgtctcagctacccaaataggggagatggtttacacatcagaatgttatctggggactttatctcctgaatttggtcctgggttgctcaaatgaacactagctagttccattttagctcttctgatggagcccagtgtagactggtacaggaattgtggaggatgtccctgccttgtgtggacatgttccaacctgaaataagggtggtcttgagaagctaaaaaaggagaagaactcaactgatttttttaattgatggtttagtagccaacttctgacctgttcttagcctgaaaagacctactgatatcaggctaatcatagttctgagataaaggtcagtggatgaagccctttttggaggatccctagggcacatttaataacaacagaaacttcagcagcagcagcagcagcattttatcagactatgttccaggcagcaataccaaatgcttcttatatatttcctttaattattgcagtagctctatgcaatacacactagcataatttttattttactaacaagaaaattgtggcttaaagaagttaaataacttgcctaaagttgcacagccagtagtggaggctctatttaaagccaagatggctatcttcaaagtccatttgtcgtaatcattatctcctatttatcttcatcccctttacttctatttgaatagtatttctttccttatctcatctgttcttaaccaaggccctcctttacttcttcctaaagtagtccacatctgtggagcttctcaggaatatacttttttgtgagatttttctataagattaaaattataaattaaatggctaaaaatttttacatactgtaaacagacccagacagttaaagagattatagagatttggcaggaaaaactcgatgcttttggaaagctcttgatagtattcacagataagcgatagtgaaaattgagactaatggatactggtaaaaaattagatgtggtatggttgatcatacttgttgtgattaaagctaaaacattattcaagtttgctagaaagttgaagagctgaatttgggctggatggagaaggtaagaaaaaaacacactgcacatggtcctcatttatgaacttaaatctttcctggctgccaactacttgctgattagaaatctgaactcccaacctgtatactaggaaatctagccttttattgtcctggtttaagaaggatttaaattgtgctcagtattgaagtttttgggtcggaactattttaatattatctatgaataaatataaggtcatacatattagtaggggagagagcgtatgggataaattgatctctctctctcttttgctctttattttgagagaggggttcttgctctgttacccaggctagagtgcagtggcatgatatcagctcactgcaacctctgcttcctggtttcaagtgattctactgcctcagcttcctgagtagctgggattaaaggtgtgtgccaccacacccagctaatttttgtgttagtagagttggggttttgccatgttagccaggctggtcttgaactcctggcctcagatgatccatccaccttggcctcccaaagtgctggaattgcccacgtgagccacctggccttcatatatagaaaatatatatttattttacatacacataacacacacacacatatacatgcatatatatatatgtatatatatatgtatctgggtttagagtagtcatgtaacccaggaaaggaatccagaaatcaatatagacctccttaagataagagcagtagctttcaatgtcagtttacaaggtaatggttatactaaccataaccattttgtgtttgttggcattaaaaacaaacacaaaatgttatcccttgaagataaagacaaataggttcaaaagtagaaaactttgtacatttctgataataccttaaaaaggtcctgagaagagtaaataaactaccctggaaatgtaggcaataccatagagttttctttaagttccagaaagcctggaagttggttgagtagtatgtatcgaaaagccttaaaggccgggcatgctcgtttatgcatgtaatcccagcactttgggaggctgagcttgggaggattgcttgagcccaggagttcaagaccagcctccgaggccaagtgcagtggctcacgcctgcaatcccagcattttgggagaccaaggctggcggatcatgaggtcaagagatcgagaccatcctggccaacatggtgaaaccccgtatctactaaaaatacaaaaattagctgagtgtggtggcatgcacctgtagtcccagctactcaggaggctgaggcaggagaatcgcttgaacccaggagacagaggttgcagtgagccaagatcgcgccactgcactccagcctgggcgacagagacagactctatctcaaaaaacaaacaaacaaacaaacaaaaacagcctcctcaacaaagcgagaccctgtctctataaaaaatgttttaaaaaaagcctcaaaatgtgcatacccttttacttgcttatatgtaggacttcaccctatgaaactagtgaaacaggtgcaaagatatttctctcagccaggcatggtggctcatgcctataatcccagcactttgggaggctgaggtgggtagatcgcttgagcccatgagattgagaacagcctaggcaacatggtgaggtcctatctctactaaaaataatttttttttttttttgagacagagtcttggtctgtcactaggctggagtgcagtggcacgatctcgacctaccgtgcaccgggttcaagtgattctcttgcctcagcctcccaagtagctgggacgaccggcacacaccaccacgcccagctaatttttctattttcagtagagatggggtttcaccatgttggccaggctggtctcaaactgacctcaggtgatccgcccgccttggcctcccaaagtgctgggattgcgagtgtcagccaccacacccggcctttttttaatcagctggtggaatgtgcctgtggtctcagctacttggcagactgagatagatcactggatcactggagctctgggggtcaaggctgtagtgagccatgattacatcactgcactccagcctgtcagcagagggaagaccctgcctcaaagaaaaaaaaaaaaaagatatttctctcagccttgtttatacaagtgaaaattaggacaacctaaatatccatctatagttaattggttaaatgaatcgtggttggtttgttcaaaataattctattcagctgggcatggtggctcacgcctataatcccagcactttgggaggccaaggcagttggatcacttggggccaggaatttgagaccagtctggccaacttggtgaaaccccatctctactaaaaatatgaaaatttagccagctctggtggcaggtgcctgtaatcctagctacttgagaggctaaggcacgagaattgcttcaacccagaaggtggaggctgcagtgagctgggatctcgccactacaccccagcctgcatgacagagtgagactgtctcaaaaaaataataatggtaataattctgttcaagcatttaaaattatgttttaagttggccaggcatggtggttcacgaggcccgcaatcccagcattctgggaggccaaagcaggcagatcacctgtggtcaggagttcaagaccagactggccaacatgatgaaaccccatttctacttaaaaaaaaaaaaaaaaaaaattagcccggcatctgaaataccagctgcttgggaggctgaggcaggagaattgcttgaatctaggaggcaaaagttgcagtgagctgggatcgcgccactgcaccccagcctgggcaacagagcaagactcttgtctcaaaaaattacataaataaataaaataaaaataatgtttttgctctctccggtccgtgcctccaagatgacaaagaaaagaaggaacaatggtcgtgccaaaaagggccgcggccacatgcagcctattcgctgcactaactgtgcccgatgcgtgcccaaagacaaggccattaagaaattcgtcattcgaaacatagtggagtccgcagcagtcagggacatttctgaagcgagcgtcttcgatgcctatgtgcttcccaagctgtatgtgaagctgcattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggaggtgagttcttaaagactgaagacaggctattctctggagaaaaataaaatggaaattgtacttaaataaataaataaaaataatgttttaagttatagctaattgacacaaaaatgttcacgatgcagtgaaattctgataacctttcatagtctgaaaaatctagttgttctaggagaaataagtcatccagaatgttctcttgtttgtttttgagacagggtcttgttctctcgcccaggctggagtgcagtggtgcaatcacagctcactgcaacctccgcctcccagactcacgtaatcctcccacctcagcttccccagtagctgggactactggtgcgtgccaccatacctggctaatgttttatatattttttgtaggtacagggtttcaccatgttgcccaggctggtctcaaactcctagactcaagtgatccacctgcctacagtgctgggattacaggtgtaagccactgtacccagccattccagaacattctgatgattcaaccataactcatttcatagtataattgagtggataagaagggttggtgtttgctgtctcgccatattaatagttttgtgttggaactccttgactgtcaatcaagtattatgtttgaggaagatgtaaacatttaatacttttaagattaggagaggtttgaagggttttatgtcatgaacacacatattaaggaagaagcatggctctgccctcttgaaagactaaagaaatattccatcagcagtttactttagaagaactgaaagaataggttgatactgaacccactcccagagccaggtagctgaaagggcactgtgattgttatcttactaggaacacgtggagtgggagtaaggcagttttctgcagaaaagagggattctgggcagacaaaaactacatatgcactatgttttgttttgttttttttgtttgtttgttttaaattaaaaccagaaaaggcgaagacttggagaatgctcaaaatttttttttttttttgacacggggtctcactctgtcacccaggctggagtgcagtggtgtgatctcagctcactgcaacctccacctcctgagctcaggtgatcctctcacctcagccacctcagtagctgggactacaggctcttaacaccacatctggctaattttttttttgtattgttggtaaagaccgggtttcaccatgttgcccagcctggtctctaactcctgagctcaagcagtctgcctgcctcagcctcccaaagtgctgggattacaggcatgagccactgcacctggtcacaaaatgtaaagattttgagggccattgattttaaactccagaagctggtccaatcagaatgaacgtaaggatttttgttagtgtgattagaaaagaatgtgtctcggccgggcgcggtggctcacgcctgtaatcccagcactttgggaggccaaggcgggtggatcatgaggtcaggagatcgagaccatcctggctaacaaggtgaaacctcgtctctactaaaaatacaaaaaattagccgggcgcagtggcgggtgcctgtagtcccagctactcgggaggctgaggcaggagaatggcgtgaacccgggaagtggagcttacagtccggcctgggcaacagagcgaggctccgtctcaaaaaaaaaaaaaaagaaaaaagaaaagaatgtgtctctttctactgggtttggagctgtgagtttataaaatttgggccgggcgcggtggctcgtgcctgtaatctcagtactttgggaggctaagacaggtggatcacctgaggtcaggagtttgagaccaccctggccaacatggtgaaaccccgtctctactaaaaataccaaaaattagccgggcgtggtggtgggcatctgaaatgccagctacttgggaggctgaggcaggagaatcacttgaacccgggaggcagaggttgcagtaagctgagatcatgccactgcactccagcctgggcgacagaggaagattccgtctcaaaaaaaaaaaaaaaaaaatcgaagtgctacagccaccttgccacctaggaggagatcctggctgacaatgcagctgtgccagagaaaacaccaagagagggagggtttgaaattgggcccgaagacatcatttgagcccgtacatcaggtcatgtgtgatatagactttttcagttacacgagagccactaaattctctttttaagtcaggttggcagtggtttttctatcatttctagctgaacaagccctaatacaatatccttaggggtcataacatccaactacctcatgtcttgaagtttggagaagtgaagtgacttacttaaggttatacagataaatggtaaaaaactgggactaaaacctggccccttcccacctcctttgtaagataattactccaatgtgtaaatcactttaaggaggtttggggcaaagtcttaaatgggtttgaggatgccatttaagtaatggaaatcagtcctgctctcatagtaagtgtcatttggaatgacagtgactgctattgacagaaaactgaccccaccatcatagctcttatttttctcagactttggataagtgggctgtccatagtatcttcatgattggtagcttaataaataaattatttgtgaaatcactggataacatttggctagctgttttaatgttgcccattccctcagcctcttgagcttctagaatcagcagacttgtttttccatggtgtgtctagtaatatgaaatgaaatatggacctcaaatatataaatatatgccaagctctttctttttttcttttggagatggagtctcgctctgttgccccaggctaaagtgcagcggcgcgatctcagctcactgcaccctctgcctctcaggttcaagcacttctcctgactcagtctccagagtagctgggattacaggcatgcaccaccatgcccggctaatttttttgtatttttagcagagatggggtttcaccatattgtccaggctagtctcaaactcctgaccttgtgatctggccaactcagcctcccaaagtgctgagattacaggcgtgagccaccgtgctctatgccaagctctttcttgccttaggagtttgcatatgctgttccctctgcctatagtgcttatcccttggctcttcacatggatggctccttctcatcttttgggcctcagtttaaatccagccttagagatgccatctctgattacccaaggtagctcccttctcattgttctcttatcacatgacctatttgtctcctaatagcagtttctaatttatatctaatttgtatttacttaccagtccctttcgtttaccacctatactcagtgtgtatagcataggagccatacataagaagtactcaataattatttgttaaatggttgggttctgttatcctaggcttgaaaaacattaaaaagcactatttgtaccctttcaccaaccctgccccaagtaccttaattgcccttacacctctactgactgaaaatacggcacaaatcctgaagagaaagggaaactaaaagctgtacttaactgctatgctgatagttgtcttaggcagttttgaattaatattttattatctctgttcttcagcttgttgtgccttgttttttctcttctctgtgacttctcacctacccacttgactctgaccagattcctgacacttaaagggtatatccaagaaatgagatggccctgagcacaggggaggaaggatggaatgacaagggccaccagaaacctctttcaggactctaatcactctaaggtcacagtttagagtctagaatgagagggactttgagtgcctctttttcttgctcagtgccctcagcttgagtgcttagctggcagacgggcacttttcctcctcagttactgtcaaagcaacatgaaggtcaggcagagagagacaaatgagagcagctcagggaaaggaggttaccacggtaacaagcaggagggactgctatttggaaacagacctaatctttctcctccttctccctccttctcagcacaggaagatgggtattgtttagctgacctgcatccttggggtgggaaccataatccctttctgacagttcccaatgacactggagtgatctgctttgcattttaatttgataagcagcagcggcagttttctctgaagtgctgaaaacatggctttttctggccctgttccagataggattctggttgccacagagaggggtttgatattgttgtttatttctcaacaaagatcttgcatatttgcataaatgtggaagatgctgcttggttctagacaaccagaatcaaatgaatacaggctatctttaggttatgaatatctatctgctctaggaaggtcacagagatactgccccatccccagctcacaggaccacccagtgacctgtgcagtggatcttctgacttaatgtccttacccttctgcctcccccatctacttatatgtcacactattctcaatctcttcccttacctaccctacccttatagtaagccttcactatgtatataaatattccttccttttctttcaaaataaaaagagcattttaaactagaaaaataaattatcaatgtaatgaaaaattaaatgccaaaaaacataagagaaagtaaaaatcatctagaatattactatagacatgatggctagaacatccttccagatctaaacctctaattctatctgctttgttttgttttgagatagtctcgctctgtcacccaggctggagtgcagtggcacggtctcagctcactgcaaactctgcctcctgggttcaagcgattcttgtgcctcagccacccaaatacctgggattacaggtatgcaccaccacgcctggctaattttttgtatttttgatagagacaggttttcaccatgttgtccatgctggtctcagactcctggcctcaagtgatccacctgcttcaacctccaaaagtgctgggactacaggcatgagacaccacatccagcctctatctgctgatctacgcattttatgagttgtatatacttatgtatagatcagtttatttttatttatctttaattttttaattttctaacacttctcaaacaaaaagtagagttaaatttaacattaatgggccaatatagtacatgctccatcatactttttcctttaattcactaaaaaatatgttgtagatatgtcattgatgtagatagggatctatgctatgatggacctatagattgtttctggttttgtggttattttttggtttggctattaaaaacaacattgaagaaaactgtccatcatacatctttgtgtgtgtatatatatatatatatatatatatatatatatatatatatatatcctgttatcttcttgatacaaatcctagaaattgaattttgggacaaaagaacatgtgcattttatattttgatacatattgccaaactgccctctagagaaggcaccaaccaatactgcataaaagtccctattgtttttacatactcttaccaactgggatatgttcaactctctcatctttgccaaatagatgggaaatatactgtgtttttatttgtgtttatgtatattattgaatccttaaaaatactcacatgaccccttcagattttacactgaagacctatctacttcttttcccataatgtacttccaggcttctctttcctgtagtgctggcaactgagcaaagtaaaaaaaaaagttattttgtggtggttttttttttttttttttttttttttttggtttttgagaagatatcaaacaaaaaagtaaaaaattttaaaaacacctaattgcattaatctctgcaccctccctccaaaccaaaaccaaacctgttttttttctttttctttcagtgatggactgtcattcactcagatttaagctccaaagactgagatgtttgtctgtttgttcatagctgtattctcagtgcctagactggtgcctggcatgtatcagttgctcagtaaatatttgtgcagtaaatcatctctcagccatcttaatcagaaattctaatcatacctaattcctttactgattacctacatgtctgatgccttgcaaagtcaaattgcttaaaggtcctgaatgtctcttgggttcttccctttatccccctacttctgatcattcttacttatgtttttattcctaggagccctccttttcaatctctctagtttactcccctccttctattaattttacctttggatatacagatacaataacatcataccctttctttcattcctcagtggcttcttaatacctgcaaggttaagtcccaatttaactctccctgtactctttaaccaaaccaagcagcttgttgttctttaaatacattgtgtttgttcatgcctgtgtgcctttgaagaggctgttccttctgcctggaatatgctttcttcttttcttgggaaactactacttattctttaggtccactccagcattgagtcatccctattccctctggcagttattccctgggcaggatacttgcagtcctttgttcacttctgttatgattatttgtttgccaattaatctaatctaaaatgaaacttcgtggccaggcacggtggctcatgcctgtggtcccaacagtttgggaggccaaggtgggcagataagtccaggagttcaagacgagcctggccaacacagcgaaaccccatctctaaaaaatagaaaaattagccaggtgaggtggctcacgcctataatcccagcactttgggaggccaaggctggcggatcacgaggtcaggagatcgagaccatcctggctaacacggtgaaaccctgtctctactaaaaatacaaaaaattagctgagcatggtggcgggcacctgtagtcccagctactcaggaggctgaggcaggagaatggcatgaaccctggagtcggaggttgcagtgagcagagaatgcgccactgcactccagcctgggcgacagtgcgaggctgtgtctcaaaaaaaaaaaaaaaaagaaaaaaaaaaacagaaaaattagccaggtgtggtggcagcacgcctgtagtcccagctcctcgaaggctgaggcacaagaatcacttaaacccgggaggcagagtttgcagtgagccaagattgtgccactgtaccccagcttgggtaacagagcaagatcccatctctgaaagaaagaaagaaagcagggatggcgggggtgggggcgggagaagagggagggagggagggaggaaggaagaaaggaagggaaagaaagaaaaaaaagaaaaattaatggcctctcttaatttttataagctctatatgttaagtatgttctacaaaattctaaatttatatagtctttgttatttggtattttgggttttgttggtctgttttagaagaggtttgctctagggagttgttgtagagcgaaatttagtttatcaaggcttgactgctttatgatttcagttctgcttcagagtatatttgtactgaaaaatcagagccattttatgatgcaacttatgcagttcagccatcaccttctcccatttgttccccacactgcaaatctctgagtcctctgtgttatgcctcttccttacccaacaggttgccaagtcctgtgatttggccctcttgttcctgatgccaccactctagttgaacattgccattaattttttatgtaaaataattttattttacaataaagccctttcttcccatgaaacctagagcataaagtgggaggagagcagtgatggacgatgaggctgaggaaggagacaaataaattgttattgcatttactgagcatgaactgaagtggacagtatgctaagtggtctacgggtctcatctcttctattcctaacagccaggtaagatagttaaatccccatcttacagatgatgacacactcatgtggaaagtttaaatcacttgaggaaggtaatagagctaatgagggtagaactaagactcatacctaaggatttaccaaaattaatgtgcaaatcaagatctaaaaataaataaaattattgaacaacctttcattgtcctttttacaaaagatgaatgtgcttaagcagaggactactaaataataagtaccctcttttctgtctgacatagcaccttgagttttattgagctcaaacatttaagtccaaattaatcatatttgagaagaattttcacacagtgatcctattgtctagagtattctgctaaatgggagcataccagaagactacagataggcaaacgttcaaattttcaaaattgcagaccatacgtggtgcttaacagtgatcttcagcaaaatcctagaacaggatataaacaaatcacttgtgaactacttgttctctccttccttggccttctaagcttctttgcagtagcatagtatagtggaaaagagaataagcttcaaagtcagacatacattggttcaaatcctgaccctgtcacttaataactaggtaattgcaggcaagtcagttaaccttcctgcagctctgtttattttctatcaaaaaagctatcatttacttcaaaggagtgttatgagatttaataagataacatgtagaactcctggcacacagtaggcatacaataaattctaattatcttcccttcatctcatcatgctttcctttacccagtacagtttagcttttgggccctacttttttctgcaactagaacttcttgctaagtttatttaacactagcccattttcttctttaaacttcatttccccttgacttcttatgacagtgttcagttttggttcttaattctttagtactgtatgggttctggcaccaaattgtctgagcctgaatcccagtgtcatcacttagtagtaaccttggctaggttagttatctagcccctctagccttgataattcatctttaaaagcaggttactagtagtaattaccccagagggtagttttaaggaataagtgaaatgcacataaaatgctttgaaaagtgctgggacacacacaggaagcaataaattaaagtttgcttttatcgttatgatgattattattttcagacttctttgtggtcttttcttcctggatttactcatttaaatgttgatgttccttgggttctctcagattgccttcttttttctctccagtctcttcaggctgtcttacccagcaagctcatgactcatgacttctattaactactgccctgacttttcttttttctttcttttttttttttttttttttttttgagacggagtcttgctctgtcacccaggctggagtgcagtggcgtgatctcggctcactgcaagctctgcctcctgggttcacgccattctcctgactcagcctcccgagtagctgggactacaggtgcctgccaccactctgggctaatttttttttttttttttttttttttttttgtatttttagtagagacggggtttcactgtgttagccaggatggtctcgatctcctgaccttgtgatctgcccaccttggtctcccaaagtgctgggattacaggcgtgagctgccgtgcccggcactgccctgacttttcttctgagttcccatcctttgcatccagttgcctatttaaaactcatacctaaagttgaacttgctttctcgcttttattccaccaataatttgccattgttgctgttgctactgttgtgttcttgcatctcctgagataatggcgtcagaaatcttgaagtcagcccagatttttcttacctccttgacttgagtcagtcactgagtcctatttttttttttttttttgagatagagtcttgctcttgtcacccaggctggagtgcagtggcatgatcttggctcactgcaacctccacctcccaggttcaagcaattcttctgcctcagcccccagaagtagctgggattacaggctcccaccacacctggctaatttttatatttttagtagagattgggtttctccatgtcgcccaggctagtctcaaactcctgacctcaggtgatctgcctgcttcggcctcccaaagtactgggattacaggcgtgagccactgcacctggcccacagtgcctttctttatcatgacaagtaatctcccaccactccctccaacccctttatgccaaactattgtggcctctattgcacctgactaaaataatcaactcttttcttgttcctctgttgaatttatcccttaagatttagctgaggcggagcgtggtggctcacgcctgtaatcccagcactttgggaggccgaggcaggtggatcatgaggtcgggagtttgagaccagcctggccaagatggtgaaacccatctttactaaaaataaaaaaaaatagccaggcatgctggcgggcacctgtaatcccagctactcgggaggctgagacagagaattgcttgaacccgggaggtaaaggttgcagtaagccgagatcacaccactacagtccagcctgggagacagagtgagactccgtctcaaaaaaaaaaaaaaaaaaaaaaagattaggctgaaatgtcacctgcctctcccccaggtagacacaaatgattctgctccttttatacttacctcttttgcattctttatgacattactttaattacttgttcacatttgtttacctcacccaaccttgggacagggatcatattatatttctaacttagtatagtataatggttacaccatagtaagtatttaatgtcgctgaaaggaatccagaaaaagaatgcttactaggaaccaaattaagttctaaagcaaggcttgctaaactacttcctctctctcccctttttcccccaatagagttgttaggtgggtagattggagtgccttgatttcttcaaggtatttgaaaaagccttttatgatattcttgatgacatgttgatgaaatgtggactggatagtgatacagttgggtgattttatagctgactgaagagctatatttaaagattatagatgactagatgtttgtcagctaggatagaggtggtataccacaggactcttgcctttggtccattcttgttcagcatttgtattataacatcagtgactaaataaaatgtatgcatataaatttgtgggtaatgtagtggtcaggactttttcagttatgatagaaatctggctcaagctagtttaagcaaacaaagaatttatagattcccaggaatggagtttattagtttaggcagggtttcaaataatcccatcaggattctgtctttgcttacctccattctgctttcccctaatttggctttatttaatttaatttatttagttatttattcatttatttatttatttattttttgagatggagtctcgctctatcgcccaggctggagtgcagtggcatgatcttggctcactgcaaactccacctcccaccttcacgccattctcctgcctcagcctcctgagtagctgggattccaggtgcccgccaccacgcccggctaattttttgtattttcagtagagacagggtttcactgtgttagccaggatggtcttgatctcctgacctcgtgatccgcccacctcagcctaccaaagtgctgggattacaggcataagccaccgtgcccggcctaatttggctttattcttagggaagttttctttgtgagtctggcaaaatggcctctcgcagcttcagattttattagtccttctagcttaaggtaccaaaggaagaaagaaacagtataacctgtatataacctgtttcatgtagttttggtagatctgcccactcctatactgcagtgaggtgaaggaatgtatttcccaaaggtaatagagattcccctgctagaagaagggagggaaagcatgataaaaagccataactgtatctccatgaaccactacaggtggttatctcaagcctggaaatctgaatagagattaacaatgttgcaagacactagaaaggtggagttaagttaacaagatactaccattaccattattattgtctaatattttttgaacttttactgtatatagctaggcactgtacactgaacactttacattcagttaatcattacaatgaccttatgaaatataggtaactttgatggttttattttgcagaagaggaaactgaggctcagaaagattgcataatgttattagtggttaaccagctgttaaataatagagctgagatttttttttctttttctttcttttttttttttttttgagacggagtctcgctctgtcgcccaggcttgagtgcagtggcgcgatctcggctcactgcaacctccgactcccaggttcaagcgattctcctgcctcagtctcctggatagctgggattacaggcgcctgccaccacgcccggctaatcttttttttttttttttttttttttttgtatttttagtagagacggggtttcactgtattagccaggatggtctcgatctcctgacctcgtgatccacccgcctcggcctcccaaagtgctgggattacaggtgtgagccaccgcgcctggccttagagctgagatttcaaccagtctgtcttttagcaggattagcattttaaatgtatttatttatatatttattttggggatagagtctcactctgtcacccaggctggagtgcagtggcacagtcatggctcactgcagcctcaacctcctgggctcaagcagtcctcctgcctcagccttacgggtctgcaaggacccgccaccatgcctggctaatgttaaaactttctgtaggccgggcgcggtggctcatgcctgtaatctcagcactttgggaggctgaggcaagcgcaggagttcaagatcattttggccaacatggtgaaaccccgtctctactaaaaatacaaaaatttagttgggcatagtagcaggcgcctgtaatcccagctacttgggaggctgaggcacaagaatcgcttgaaccgggaggcagaggttgcagtgagccgagaccatgccactgcactccagcctgggcaacagagcaagactccatctcaaaaaaaaaaaaaaaaaaacagaaaaactttttatagaaacaggatctcactgtgttccccaggctagcctcaaattcctgagttcaagcagtcctccaaccttggcctaccaaagagctgggattataggcatgagctaccacttctgccaagatcagcatttatagtttaaaacggttacatcagtaataccagcactttgggaggccgaggcaggaggatcacctgaggtcaggagttcgagatcagtctggccaacatggtgaaaccctgtctccaaatacaaaaattagccaggcatgggctgggcgtggtggctcatgcctgtaatcccagcactttgggaggccgaggctggcggatcaccctgaggttgggagtttgagaccagcctgatcaacatggagaaaccccgtctctattagaaatacaaaattagccaggcgtggtggcacatgcctgtaatcccagctactcgggaggctgaggcaggagaatcgcttgaactcgggaggcggaggttgcagtaagctgagatcgcgccactgcacttcagcctgggcaataagagtgacactccataaaaaaaataaataaataaagtaaaaaataaataaataaagtaaaaaaaataaataaataatagaactatcatttactgaatttattggtgtcatatcaaggaataatatccacagttatctgaaaaggctattaaatacaaacattatatacattatctgtaaaacaacacacacatatacatatatctgtaccatatatattctatgtaaggctgattttctttgtatacttgaaccaaaacatttcaccaacagattgaatggagaatccagctgtcttctattaaaccagacattgaaaataatatgttaatatttaacaggttttttaatgttattttaactaacttaaggcatactttttttttttttttttttggagacagaatctcactgtgttgcccaggctggggtgcagtggcgcgatcttggctcactgcaacctccgcctcccaggttcaagtgattctgttgcttcagcctcccgagtagctggaattacaggcatctgccaccacacctggctaatttttgtatttttagtactgacggggtctcaccatgttggccaggctggtcttgaactcctgaacttaggtgatccaccctccttggccccccaaagtgctgggattacaggcgtcatctactgcacctggccttaaatgttttcttctttctttctttctttctttctttctttctttctttctttctttctttctttctttctttcttctttcttttctttctttttttttttttttttttttgagacagagtctcactctgttgcccgggctagagtagggtggcaggatctcggctcactgcaaccccctcctcctggattcaagcaattctcctgcctcagcttcctgagtagctgggattacaggcatgcgccaacatgcccggctaatttttgtatttttagaagagatgggttcaccatgttggtcaggctagtctcgaactcctgacctcaggcaatccgcccgccttggcctcccaaagtgctaggattacaagcctgagccaccatgcccagccaaattatttcttattttaattctagtctggtaaacatcagtcaatttatcccacataaataaaagttctttggggttcttaacttttttaaaatctttttgttttaatataattgtatttgtaatacagtactctcatgtaccatgtacccttttcctaggtttccccaatgataatatcttgcagaactctagcacaatattgcaactgggatggtaatattgatgcattcacctattgtgttcagatttcccccatttactcgtactcatttgtgtgtttttctgggtgtgtgtagttccatacagttttgtcccatgtataagttcatgtatccaccacccagtcaagatacagaacagttacatcaccacatcaccaaaaagatctcttgtgttgactatttacaactacatttacctttcttccaccttcccctgcccacccctaatccctggcagctgccaatctgttctctttgtctctaattttatttcaaaattgttatatgtgtgtatgcatgcatgcgtgtgtgtgtgtgtgtgtgtgtgtatttttttgatacagcatctcactttgtcccccaagctggaatgcagtggcatgatcatggcttactgcagcctcaacctcctgggcccaagcgatcctcccacctcagcctcctaagtagctgggacaacaggcatgtgcaaccatgcccagctaattttttttatttttaaagatggggtcttcctatgttgcccctgcagatctggaaatcctgggctaaagcattctacccacctcaggctcccaaagtgctgagatgataggcgtgagttaccacacccagccctgttacttgcatgttttagttttaatttttctttctttctttctttctttctttctttctttctttctttctttctttctttctttctttctttttttctttcttttttttctctctctctctttctttctttctgtctgtctgtctttcttgtcctttcttttactttctttcttatcactctgtcgcccaggctggagtgcagtggtgcagtctcggctcactgcaacctctgcttcctgggttcaagcaattgtcatgcctcagcctctcgaatatctaagaggctaatttttgtttttgtttgtttgtttgtttgttttttagtagagatggggtttcaccttgttagccaggatggtcttgatctcctgacctcatgatccaccctcctcggcctctcaaagtgctgggattacaggcatgagccaccgcgcccggccgtatttttttatagagacggggtttcatcatgttgtccaggctggtcttgaactcctgacctcaggtgatccacccgccttgggctcccaaagtgctgggattacaggcgtgagccacggtgcatggcctcattttaatttctaatatgttaaatatcaagggatatagcctacctaaaccaaggctctttaaggttctcattttttttttttatgggactaggtataagagggggaaaatatgttaagtatatgaaaaaaataaggccgggtgtggtggctcacacctgtaatcccagcactttgggaggccaaggcgggtggatcacttgaggttaggagttcaagaccagcctggctaacacggtaaaacctcgtctctactaaaaatgcaaaaattagtccagtgtggtggcatgcacctgtagtcccagctgctcgggaggctgaggcatgagaattgcttgaacccaggagtcagagatcaagccactgcactccagcctgggtgacagcatgagatgctatctcaaaaaataataataataataaggttctcagtttttaagaatttcctgcaaggtgaagtgtcacacctgtaatcctagcactttgggaggccaaggcacaaggatctcttgagcccaggagttcgagagcagcttaggcaacatagggagacccccatctttacaaatttaaaaattaaaaattgagcaaaccaacgcagaaacagaaaaccaaataccacttgttctcacttattagtgagagctaaatgatgagaacacatggacacttagaggggaacaaacagacatgggcctactcaaacagagtggagtagaaaagagtagagggtgggaggaaagagaggattaggaaaaataactaatatttactaagcttaatacctggatgatgaaataatctgtacaacaaaccccagtgacagtttacctgtataacaaacctgcatatgtacccctgaacttaaaagttaacaacaaaaacaacaaatagccaagtgcagtggtgtgtgcctgtagtcccagctactcaggagactgaggccggaggatcgttgagtccaggagttcaaggccatagtgagcaatgattgcgccactgtagtccggcctgggtgaaagagcaagaccctgtttctaaaataataatttttttttaagaatttccatgaccagaaagttttagaacagctggcttatagcagggagaatcatcccattcctccttcctaagccacagcagagcaaaatgtgatttgtgatgtctcaatttagaattctcatgttttctcacaggactgacagtatgaataatgattcattagttcttgagtacagtttggtccagccacgttataggttaaatagatttctgtgggccggcctaggaatcgctgtttaagacttctgacatcgtgattattaagatttcagaaaaaggctttagctttctgttgtgtttactttatttgatttgtggagttttttaattttgcattttgtttgcttacttgtttttatattcttaaaggtaaaagagtggagtaaagatgacacacttaagtcttgactttttaggaaatgcatatgtgaaaggaggtaaaagaagtgtattcaggaaaggaagtagttacagaagttctttattcttaggaagcaaatcctaatgcttaccttgtaaccatacaggaataggagggattatcagccttctatggtaaacatacagtcagcttcagaggaagtacttgggtctctatcatcactcatcagctgcaaagttaataagctttgctgaaggaaaatgtgaatttcaagcaggcaggagattgtagagtgagaagacttagggaagagcaatggagatgcttcattcagcaaaaacctttaccacagtaatggacactgccatgtgatttgtgttgcacactgattttgcttatgagattttttcctttgttaaatttcaagcataatttatctgtttcccacacactgggaatttctagacagtcttgaatatcaggattgtttgatctgctgtctcctctttagcagaaaaggatttagggtctgagcccaagaatgtatagggatcactgcaggagaacagactgtagactgcaagtctgtagtcttcaaattatatgttcaaaagcaaaaacaaacaaaaatcaaaagagaaagaaacaaaatttaatgttcactgtacttgaattttcttttctttttttttttttgagatggagtcttttgctttgttgcccaggctggagtgcagtggcgcaatcttggctcactgcaacctctgcctcccgggttcaagcaattctctgcctcagcctcccgagtagctgagattacaggctcccgccaccatgcccggctaatttttttttgtattttttgtagagatggggtttcactatgttggccaggctggtcttgaactcctcacctcatgatccgcccacctcagcctcccaaagtgctgggattacaggcatgagccaccgtgcccagcctgtacttgcattttctagtgcacaatagaacagccttcactgctgaccttgagtaggtactgattggttaaaattaagtactacattaagtcttctgtgaataatagaatatatagcttctttttttttttgagacggaattcccctctgtcccccaggctggagtgcagtggcgcgacctcggctcactgcaagctccgcctcccaggttcacgccattctcctgcctcagcctcccgagtagctgggactacaggtgcccgccaccacgcccggttaattttttttgtatttttagtggagatggggtttcactgagttagccaggatggtcttgatctcctgaccttgtgatccacccacctcagcctcccaaagtgctgggattacaggcgtgagccactgtgcccggcctatatatagcttcttagaactgtttgaagactggttatgttgccagctactctgtctttttatctttttcctccttgcctcctgctataagatattttggaaattaaccagatttataatcaaattctttttcagggcagcctaagtgaaatctggaagctcagcagtccaggagcctctttttttttttttttttttaatttatttttgtttatttatttatttacttttccaaaggcaggggagaggcagggtccaagtgtagttactgtttgaaaaggacctgccgggcgtggtggctcatgcctgtaatcccagtactttgggaggccaaggccagcggttcacttgaggtcaggagtttgagaccagcctggccaacatggtgaaactctgtctctactaaaaatacaaaaattagccaggtgtggtggcatgcgtctgtaatcccagctacccaggaggctgaggcaggagaatcacttgaacccaggaagtggaggttgcagtgagccgagatcacgccactgcactccagcctgggcaacagagtgagactctgtctaaaacacagaaaagaaaaggacctgaggccaggcatggtgggtcacacctgtaatcccagcactttgggaggctgaggtggtggattgcttgagcccaggacttcaagaccagcctgggaaacatggcaaaaccttgtctctacaaaaaatacaacagttaaccagtcatggtggcgtgcacctgtagtcccagctacttgagaggctgaggtgggaggattgcttgagcctgagaggtcaaggctgcagtgagccataatcacatgagcctggaagacagtgagaccctgtctcagaaaaaaaacgaagaagaagaagaaagaaaaggacccgaatttcctccacttatagttaaatgttgtgttgttttgggatttactcagggtattctgttgcattctgacaagagctttgtgggaaggaggcattcagatttctccttccatccttaattatcccatgatgtctacctgctagcctctcatgacaaggaattgctgatttttcagaataagcaaaaatcatccttgtttaaacttatttatttattttttgagatggagtcttgcactgtcgcacaggctggagtgcagtggtgtgatctcagctcactgcagccgccgcctgccgggttcaagggattctcctgcctcagcctcccgagtagctgggactacagggatgtgccaccatgcccggctaattttttgtatttttagtagagacaaggtttcaccatgttggccaggctggtctaactcctgacctcgtgatcctcccaccttggcctcccaaagtgctgggattacaggcgtgagccactccgcctggcctaaacttgtttattgaatggaattttgtctcaaaattccagtcaacagaaagtggttcaaataattgaagatttttttttttctgatttttgttttgagacagtcttgctctatcacccaggctggagtgcaatggtgcaatctcagctcactgcaacctctgcctcccaggttcaagcgattcttgtgcctcccaagtagctggcattaaaggcacccaccaccacgcctgactaattttttttgtatttttagtagagacggggtttcaccatgttggccgggctactctcgaactcctggcctcaagtgatctgcccaccttggactcccaaagtgctgggattacaggtgtgagccatgtgcccagccttttttctgtatttcttttttttttttttgagacggagtcttgctctgtcgcccaggctggagtgcagtggcgcgatcttggctcactgcaagctccgcctcccaggttcacgccattgccctgcctcagcctctgactagctgggaatacaggcgactgccacaatgcccggctattttttttatttttatttttagtagagatggggtttcaccgtgttagccaggatggtcttgatctcctgaccttgtgatcgcctgcctcggcctcccaaagtgctggcattacaggcgtgagccaccgcgcctggccttttctgtatttcaagagacaaaaataaataacttaataaatagataaatggggttttatttgccattcttttaaataacccacaataagaatttggtgagcaaattaagttttatataataccttggtggattatttatatgtttatccatgaatcagtgagtattcattttaatccctctgccctgtatacctatattactattaacattactgatgttgagtcactgtaaaatcttgaagcactttttggattattggtaaagataacatctcgctttttttttttttttttttttttttttaggcagagtcttgttctgtcacccaggttggagtgcaggggcacaatctcgactcactgcaacctctgcctcccgggttcaagggattcccctgcctcagcctcctgagtagctgggattgcaggcacccgccaccacacccggctaatttttgtattttcaatagtgacggggtttcaccctgttggccaggctcgtctcaaactcctgacctcgtgatctgcctgccttggcctcccaaagtgctgggattacaggcgtgagccaccaggcctggcctgttttgttttgttttgttttgttttgaagacagtatctcattctattgcccaggctagagtgcagtggtagtaccttggctcactgcagcctcaaccttctggttgcaatcctcccatcctctcaagcagttctttcatctcagcctcctgagcagctaggactacaggtacacaccaccatgcctggctagtttttgaattttttgtagagacaagatctctctatgttgcccaggctggtctgaaactcctgagctcaagtgaacctctgtccttggcctcccaaagtgctgggattacaggtgtgagctactgcctctgtcttgataacgtcttatcaacataatgtttagtgtatttgatgacatcctttttttttttttttgagatggagattcactcttgttgcccaggctgtagtgcaatagcacgatctcggctcactacaacttctgcctcctgggttcaagcgattctcctgcctcagcctcctgagtagctgggattatgggcatgcaccaccatgcctggctaatttttgtacttatagtagagacggggttttgccgtgttggtcaggctggtcttgaactcgtgacatcaggtgatccacctgcctcggcctcttaaagtgctgggattataggcgtgagccactgtgcccagctagtgacatcttactttctacacaatcttatctgataattctgaataaatctgaacattcatgtaccaacatccccaactacctttttatttttggataaaacaaagtttcttagaactactgctgttatcagtagaactaacttccttcttgcgtttttgtctgtgaaggtgaagatacaagactcattgtgaaggggaaaaggcaaggtctatctcaaatatctcttcaatgaatttctttttttttcagatagggtctctcattttggtgctcaggctgaagcgcagtggtgcagtcatagctgctgcctcatcctcctgcctcagtctcccaagtagctgggactatagggatgtgccaccatgcccagctcatttttattttttgtaaatatagacttttgccatgttgcccaggctggtctagaactcctcagctcaagcaatcctcccgccttggcctcccagagtgctgggattacaggtataaaccatcacatttggccttcagtgtattttctacctgtaaagttatgttgcagccatgaagatttttgtccatcagtgcctctcatctgtgagaggcagttgaagtaggtatatagttataattactctttgtggggagatgaatgactctggcctttctctattctctcaagtccccatttctgtgtcatctgcctaccaacattgagatccttatatatgttattaaactgatatctttttttttttttttttttttttgagatggagtctcactctgtcgcccaggctggagtgcagtggcgtgatctcggctcactgcaagctccacctcccaggttcacgccattctcctgcctcagcttcctgagtagctgggactacaggcgcccgccaccacacccggctaattttttgtatttctagtagagacggggtttcaccgtgttagccaggatggtctcgatctcctgaccttgtgatccacccgcctcagcctcccaaagtgctgggattacaggtgtgagccaccatgctttttttttttttttttttttttttgcactctgtcgcccaggatggagtacaattgtgcaatctcagctcactgcaacctccacctcccgggttcaggtgattctcatgcctcagtctcccaagtagctgggattacaggtgcacaccaccatgcccggctaattttttatttttagtagagatggggtttcaccatgttggccaggctggtcttgaactcctggcctcaggtgatccacctgcctcagcctcccaaagtgctgggattacaggcgtgagccactgcgtccggccttaaactgctatgtaaaggtaaattgagaagtatcattttaggatgggcaacgtagggagactttgtctctacaaagtttttgtttttgttttttttggagacaaaatttcactgtattgcccaggctagtctcaaactcctggactcaaacagtcctcccatttcagcctcccaaagtgctaggatcacaggcatcagccaccattcccggccaaaaaattaaaaaaaaaaaaaaattagcctagcatggtggtgcacgtgtagtcccagctacttgggaggctgaggtgggaggattgcttgagccagagaggttgaggctgcagtgaaccatgatcaccccctgcactccagcctggacgacagagcgagaccctgtctcaaagaaaagagaattatcgccaggcatgtctgtaatcccagcactttgggatgctgtggcggttggatcacctgaggtcaggagttcgagaccagcctggccaacatgacaaaacccagtctctactaaaaatagaaaaattagccaggcatggtggtgggagcctgtaatcccagctacttgggaggctgaggtaggagaatcgcctgaatctggaaggcagaggttgtagtgagctgagatcacgccattgcactccagcctgggcaacaagagtgaaactccatctcaaaaaacaaacaaacaaacaaaaagtattaaaagataaaggacataaagtgttgggaaactccagagatctcctctttaaattctctataagtctcttttcaagcttttgttttgttgtttacctccctagtaagctaagccctaggagccatgatggcacttcttagcatttcaaagactgagaattagcttaacttttgttggtgtagttattaaggcatctaatgaccttaactttttaatattcctataccttattttccctcttggccccaatttcctgacaatccctgctcttatattttaggtatatgaaaagatggcaaaatgagtccttttctgatttttttttctccttttttgagacagggtcttgctctgttgcacaggctagagtacagtggcacgatcacagctcactgcagccttcacccccgggacaaaactttcctcctgaaatgggaaaagttcccttgtccccctcacagggcgtgcaatgggagtgtggctcacttcttcactgccctgctgctcagacctgtagggtaacatacagaggggcaggctatggggctccaaccccggcagtgtctaggggtgaatgcttacatctgaagccccagtgggtgtgtgttacagggtgctcttttagtttagctgtccttaggcggcttgtgttagctcaattagacccctgccttatcacaagaacagagggctttctgtatcccaaggttcttgtcttggtgtactggaagaattggatcaaatgtgggcttggagaatgagtgtaaggttttattgagtgaaagtaatgctcagcagattggggagccagaagggagatggttttcccctggagttcagctactcagcggcccaggctcttctccaaatgccccagccaaactctgcttcgttccacggcctgctggcatttgtcatgtgctcttccgccacgtgtgctcttctgccggcatgctcctctcaacgccctctcgaggtccagccgctgtgtcttcttctgccaatgtgttcctctagaagtccagccgcttgtgtgtctgcctgctagggtctggggagtttttataggcacagggaggggctgtggcaggccagggtggtcttgggaaatccaacatttgggcgggaaaacaaaaatgcctatctacctaggtccgtggacacaggcccctgatggagccctagccagggaccatgccctcctctacccagcacttcccttacccccttctgtatcatttaaagggaccacgttctctacccagcacacccgtgtcactcctacctcagcgtcccaagtagctaggactgcaggtgtgtgccaacacacccagctagttgtttttgtttttgtttttgtttttaattttttgtaaagacagggtctcacaatgttgccctggctggtctcaaactcctggactcaagcactcctcctgccttggcctcccaaagtgctgggactacaggcttgagccattgcacccagccccctttttctgattgttatcttctcctggaaagtgataaatgaagctatctttgtttcagtgaataatagaatatgaaatcctgtaaagccacataggttattagatgaatatcacagagcttattatgcactatggcttaatgttagattatagatgtgaccaaatggtaattaacagagctggagctgtaattaaatactattatgctgctctgtgatctctccttagatttctgttgcaaagtaaatggaaaatgaatagttcaaacccataggtggatttcgtcgcttctccccatccctgaacatctcttttaattaactaagtaattaaataaagtcatcttcatacaacagagatgccaaactctgcctagtaactctaatcagtaagggtagtttgatgcatacttgttaatgagttcctcatgtgtatgagtctgttctgttattcttagtgatcagttcagctgaagtttcttctcttcacttattgtatagcagggtataatttggcagactgcttgaatgcaacagtgatgtttccaacctacattttaggtgttgttttctggatttcttggtgcaaaactggggacttcattttatctagaatgtattagcatatgtttctcctagcctgccaggagcactgaataacctagcaggaaattaaactacttccagaaaagagctgtcctcagtggctgagagaaagtgtataggtgtctccctggggtaaacttccttctgtgcctagggttgctgcctgagctgtggaacaggttggcaataggacatgtgcaagcaaggcaatcagaaagttcacaggggtgacctggaaggtttaggccaatgtctgtgtccagtaggaccttgcaggaatttctcttgtgagtagaagaaagtataaaaaagggaacaaaccctaagcaaaagaagtacacatataggctgtgaaactgcttctgtcacagttcttccccaagagaaagaatagataaacagaggtgaggccaagagtaaagatgatctgtatattctgtctctaactttccctctctagtgactctcaagagtttgttccagcactgcagaggagtgagtagggaggatccagtttactttttctgtgttgttttttaccttcacttctgtgcatggaaattttaaagatctttccaggatctaccacatcccaagaaggttgggaaattaaattataaatgcccagttttcaagagagcaaatatgccttttggcatttatcataaatgtagatgattcattatacaggcttctacttccatttcatttcatgaaaaaggtggagttggggaagtacaaggggtgtgtgtgtgagacaagcagacaaggatgttttggcagctcttcagggaccagaattaatcagaatcagtgtatgaacattctgtggactcacaatgatgatctacaaatagtgatgactttctaagccaagaagtcagagccaactgtggagaatggatccggaacccagacctcagcctataggctagttttcaaggccaggaaggtgtttgtctctgtgtgtgttgtgggagggaaatggattatagatagagtgatagtcatgtagtaaattattccagaatcagagttttgttgcagagctatttagaagcttggcttacggatacatgtatgatcttctctgaatgtctctattaaaggactagactaagaagtctattaaaggacctagactaagaagtcctcacaaaggactctctattaaaggacctagactaagaattcctcacaaagggaagagtcccaaggattgggaaagtcccaatctttgactctcattttctaggtctgctgattagtatcatacttaatcttcggaggaaataagccagtgtgtgcattgagtgtctttgcatatgcaagacgttatgctcattcaggattggggcatcaatcactcgagcataatagactttgtcagcctcataaattctgggatttaaagagttaaaggatcactgcccacttcatttcattcttttttttttttttgagataggatttcactctgtcacccagactggagtacagtggtgcaatcatagctcactgtagcctcaacctcctgggctcaagtggtcctcccacctccgcttctggagtagctgagaatacaggcatatgccaccacacacagataccttttttatttttgttttttatagaggtggggtcttgctatgttacccaggctagtcttgaactcttggctacacgtgatcttcctccataggcctcccaaaacattaggactacaggcatgagccattgcacctgacccatcacaacttttatgttgtctctagatgggttgcattcttcttggaacctaactaattacattcttgtgagaggttctagtttctggttttggaagcaaattgcttctttcttttttttttttttttgagacgatctcagctcactgcaacctctgcctcccaggttcaagcgattctgctgcctcagcctcctggatagctgggattacaggcgcccaccactacgcccggctaatttttgtatttttagtagagatggggtttcaccatgttagtcaggctggtctcgaactcctgacctcaggtgatctgcccacctcggcctcccaaagtgctgggattacaagtgtgagccaccgtgcctagccatgtttgactatttctatctatgtgtacataatcaacaacatcttcagactgctgttgattggcttctgggtggcaacagcacctcctgtttcttatagataaatttgatgttagaattatattccaagatgccattctcattaaacaaccactgttacatgttacagtttctaagggttagaaattcccaccaggttaatcccagccctgctataactttattccttctagccaaagatgtattaaagcacctaggatcattaggaatcatggcattcctaggatttggctatttcttcctctctttatccccacccaaattcatggattttatgccagactaatgtactgtttgctgaatgatagattggtaggaagcatagtggtggtagcaaaacatacctcagatgctgggccttgtctttctcatcagtctgtgtgctctgttactattgaaatctggccctgattctctttcattagagactttttaatgagatgaggaaaaaatagaactttttaaaaaacattttagccaagtgcagtttatgaggaagatcattaagaagatcattatacgctcattaataagagtttctcttagcacaggatgttctcatctaaaccactagatttgtagtggtatcataagccagaacttgaaaggaagaaccaaagtcttatttatagccgtctgcactctggcaggaatagatataggactagattaaatacagaaaaggtatttcctctaaatgttctccctgcaactcagctactactttttcttccctccacagatggagtcccctgtttccacaccagcagtgctgccaatacaccttttggtgccagtggtcaacaatgacatctcatctccctgtgagcagatcatggttcgtacccgatcagttggggtcaacacatgtgatgtggctctggccacagagcctgagtgcttgggcccctgtgaacctggaactagcgtcaaccttgaaggcatcgtgtggcaggaaacagaagatggtaagtgtgatatgtggctttcccctcccttctcaacctgcttctgcaggggagccaccagggacttattgttgtaaatattaccaagtggttattagagtctcaagtgtccacagtctgcgggagatacccacacagaggattttagcagacttagcaaaatttcccagcttctagagattcttcccttcatagtattcaacagtgttgatcctggtacttatgatatgcagtcatgtgataggtattggccaggtaattcaaactgtatctgtactctccatattttatatgggagagttagattataaattaaatttgaggtcaggcctgaagagaaaaattaataaaagggcagctgagggagtcaagaggatggagaatagtcactcttaaattcacttaatgttggctcattgcatatgcagctcttgccttttttaacacctataggtacagccagttcactcttcccactgattgcctcattgcccagccacccacaccgcttcatgtatctgtcacttggtacagattttataggaaatgtttagatggtcttgttttcaggcatccactaagcagttggctcactgtaggttgctgttgcccaaggcatccagacttcttgcatgttccacttgcccctgagaacggaatctattctgttttgaaaatttatgaacctgaaaaaatggaaggaagtgtaaagagacttaatggggtatttcagatcttttggtaacatctggtggcaatttgatttttgcatattctttttctgaagaatccaaatccttgtcagagtatatgtggttagagagtctgggcctcagtcccatcatgtctctgcatcagtaaacagactttcaaactgtcctcactctgaggagtttagaggcccagaggagcacagctaatcatctctgattatcacagagctattttgtcagtctgcccctagaaattcaggcatttcattctggtcattctaataaaatctgttcccctgaatattttgttgtcattcagtatttatttaaagtttaccgtgcaataggtgctgatgtgttacaggttaagaactctgtattcttgtctgtgtcatcattaggaatgtaatacatcttcagctttcagaataacgtcgctaatgaggttttattgtgtgcctgagtggtagaagctgatgcagagaaggtagagagagagtttaactctagaggttgactctggatatgtgtatacaatatacaatctgaaaatcacaaagtggctatctgatttttaaaatgtcatctgcttatggacaaatgtctgaacagtcacagagtctgttggaatgacagacatatccggaccatatctctgtgccaccaagcaaccttcaaggcctcttacctcagtatattgaagatagaataaatcgatttcctgcctgtttgttctgcttgcctttatgatggtgactcttttccaagaacaagatgctttttttatgtgaacctaacaaaaactttgagagagtgaggctaatgctttcactctcctgaggacaatgaatacctttttatctgaggatcccttcctgccagggcaaaattaacacataatttttttttattttttgtaaatcgtttgcactggaagactctctgtcaggttgtcacaggcagcctattattaccaagttcccctgttacgtacacttttttttttttttttgagatggagtctcaccctgtcacccaggctggagtacagtggtgcgatcttggctcactgcaacctctgcctcccaggttcaagcgattcttctctctcagcctcctgagtagtggggactacaggcacataccaccacgcctggtccatttttgtatttttagtagagatggggtttcaccgtgctggccacgctggtcttgaactcctgaccttgtgatccacctgcctcaacctcccaaagtgctgggattacaggtgtgagctaccacacccagcccagtttgtactcttaaggtactctatactttatttcatagcacacatcacagtttgcaactttgtttatcatttttatgatttttctattaatgtgtatcttttctactgtgttagaagttctgagatcaggcagtctgttttgctcatcattgtatccaaggtacttaacataggtggcatctgacacctatagtagtagactgtcaaaaatacttgtttgaggccaggcgtggtttatcacctgaggtcaggagttcaagaccagcctggcccacatagtgaaaccctatctctactaaaaatacaaaaaaaaagctgggtatggtggcgtgtacctgtaatcccagctacttgggaggctgaggcaggataatcacttgaaccccggaggtggaggttgcagtgagccgagatcgcaccattgcactctggcccaggcaacagagcaaggctgtctcaaaaaaaagaaaaatatatttgtttgaatgaaggaatgcttgcatctatgtcattgtcatttctggatctatcttaatatatatctagaggagccgggtgcggtggctcaagcctgtaatcccagcactttaggaggccgaggcgggcggatcacgaggtcaggagatggagaccatcctggctaacatggtgaaaccctgtctctactaaaaatacaaaaattagccgggtgtagtggtgggcgcctgtagtcccagctactcgggaggctgaggcaggagaatggcgtgaacccaggaggcgggccttgaagtgagccaagattgcaccactgcactccagcctgggtgacagagccagactccatctcaaaaaaaaaaaaaaaaaaaaaaaaaaatatatatatatatatatatatagagagagagagagagagagagagagagagagaggatattaaaatattgcttgaacttaggaatggtgtcgaagtactttccaaaattctaaatcttctctgcaactcagaataaatactgctttcaccaggtttgagatcagtctcgttgtctaaatctgtaagatttttaatcctacttttaataccaggttttctcccacttactgtatttcaaggcttaggtctctttctttattttattctctttttctgaaagagaactgttcagcaataatatactcatcttttctttgctttctggtcaccccagagggccttcacctgaactgtcagttggcgaaggtctgaattgggatcagagttggttcacattccttttcatcttcaggtaacagagatttcctgcaaagatcattctctgaagatctgtaagatccaggataccgagtcagtcctcaagttaatcataagaactacatacagatactttttaaaaaattcttccagacttctaggtttttttttctgcctctcgacattttgtacttctgtctgtctctttgtccagcaaactacactgtcttcaaacagaaaagtccttacagctcagagagaagctgtgaatgcttggcctctgaggggaatggaggacactgaggtccctgtagaactgagccaccttgctgagaacaggtataggagtcatggcctcaattattcctagtttctttgcctacttgtcctacagtgttacttctttctttcctcttctctccctatcactccctttaaaccttggatgcatttttaaattcctgcagattccatttctttttaggctgttgataattcagtaagcactgcaaagatcctacttgactagattcaaccgtgggactgttaagaagacccaagtgtaacctagaatttttttgtctgtttgtttttgagacattctcagcactatgtaagggctagttccactggattttgctttatctcacctcacttcaaatcaaaatactgagtatgtccgaggcgggaggtacacttgaggtcaggagtttgagaccagcctggccaacatggcaaaaccccgtctctactaaaaatgcaaaaattagcctgtaatcccagctacttgggaggctgaggcaggggaatcacttgaacccaggaagtggaggttgcagtgagccgagagtgtgccactacactccagcctgggcgacagagagtgagactccgtctcaaaaaaaaaacaaaaaaaaacaaaacaaaactaccaagtctattctgggttcacaaggcttaactctaatctaggatcctgaaaaaatgtataagaagccttaaagcagactatgtacttttagggacacaaaattgcatactggcttgtgtggtattttaaagaaaggcaaggctgactttaggtaagagttctaggagatgctataggttctcctttttggacagtagcactaacccaaaggccaataccagtgatgtagtttactttggcaaatgtgctttatggaagaatttatggtatagtggaaggagcactggagtaaaactctggagacttctatatctctgccactatcattatgaccttggaaaaatcccttaattttctgggccttagttacctcatctcttaagttgaactaggtgaccaattaggacctgacagttctttttagttctttttttctttcttttttttttttttttttttttgagacagggtcaagctgtgtcacccagcctggagtatagcaacaacatcatctctcactgcagcctcaaactcttgagctaaagtgatcctcctgccttggcctcctgagtagctgagactacaggcatgtgccgccgtactcagctaattttttatagagacagagtcttgctatgttgtgcagactggtctcaaactccaggcctcaagtgaccatcccacctcagcctcccaaagtgctgggattacaggcatgaaccaccatgcccagcctatcagctcttaagttataaaaatctatgcaggccaggtgtggtggctcatgcctgtaatcccagcactttgggaggctgatgcagatggatcacttgagcccaggagtttgagactagcctgggcaacatagcaagaccctatctctacaaaaaaaattttttttaaatctatgccttaaaccatggaatcagggccaggcacagtggcttgtgcctgtagtcccagctactcaggaggctaaggcaggaggatcacttgaacccaggagttcgaggcaacagtgagctatgattgtgccactgcattccaggctgggtgacggagtgagaccccatctcaaaaaaagaaaagaaacatgtaatcagcatggatccaacactggttgactatggcaacttaaaaacgaacaagtggacgggcacggtggctcacacctgtaatcccaacactttgggaagctgaagcaggtggatcacttgaggccaggagtttgagaccagcctggccaatatggtgaaaccccgtctctactacaaaaattagccaggtgtggtgatacatgcctgtaatcccatctgaggcaggagaatcccatgaacccaggaggcagaggttgcaatgagccaggatgtgagagaatatgcggctgtctgtagaacaggaggagcagagacttttttgagacagagtttctctcttcttgcccaggctggagtgcaatggcgtgatctcggctcactgcaacctccacctcccgggttcaagcgattctcctgcctcagcctcccaagtagctgggattacaggcgtgtgccaccacacctggctaattttgtattttcagtagagatggggtttttccatttcggtcaggctggtctcgaactcctgacctcaggtgatccccctgcctcggccttccaaagtgctgggattacaggcgtgagccaccatgcctggcccctgctcactattgtaataacatcctgtcatcagatttcttctaccaccatttgactgaaatatttctcataccagttttccagaggtcttctctcagtccttcctagacttctattagctctcttatttctttattcttgaaactctcctctcttgccttggtcataaatctcatttctctttataactggttattctctctattttgtgccagtctctcttccttcttgtattcatttaatcagaaattcctgttgagattcaggatgctgaaatatcggtcaattcagtcctatcagccactagatagggtctgtagcagctggtgccctgctccctttcccacaggcaaacagccttatccacaatatattttttcatttactgtgtgtgtcatagtggggaaagttgaggaaacattgagttaggaatggcatttagctgcttggagaagaaatgaaactataataatgatttaatataagagaatttggaggtaggtaggtaagtagtctagggctggtatgatgacatcgcaatggaatcactgtttcaggctccttaaagttacttctttattgtaaaattgcttctgtagctccagccatcatgtttactttccagtcttgaaagaaaaggaaggtagaagagaaaaagcacctgcctcccatcttagtctgttacctttggagaggtttcccagaagccacaccataagacttctgcttacatcttgttggctaccctgtgtgcaaggaaggcaaagaaatttagccttttagctggatacattacttccccgcacaaaataggggctcttactaagggaaaagggaagaaattagtagaatctgccactcttctgctttgcatagccttcctacatcataacttccaaaagctattactttagcagctttctattgtaagtactctcctatatattcatatctttagctgtctaccttgtgtgaacaataccgagaactttatctccacacttgaccttttgcctaatacagtttcactgatgaacatcaacagaaactgatttattaaattcgaatgtctaaaaaggagtattcatcattttttaccaaaaatttccttctctttccttctctgtttctcttcattacacctacattaccatcctcctaattttcttttttctttttttttttttttttgagacaaagtctcgctctgttgcccggggtacaatggcctccacctacggggttcaagcgattcttctgcctcagcctcccaagtagctgggattacaggcgcccaccaccacacccagctaatttttgtatttttagtagagatgggttttcaccatgttggccaggctggtctcgaactcctgacctcaggtgatccacccgcctcggcctcccaaaatgctgggactacaggcatgagccaccatgcccagtaccatcctcctaattttctaggctcaaacctccctagtcatctcttgactcttcactcttcatctctgtataattttttagtggtttctctaggaattacagtatatatatttaacttttcacagtttacttaaaattagtacctcaagtggaatgtagaaatcttactaccatataagtcccttgactctccattcttttttctttttgagatggagtttcactgtctcccccagctggagcgtagtggtgtgatcttggctcactgcaacctccgagaagaaatggagtttcaccgtgttagccaggcttatctcagactcctggcctcaaatgatctgcctgcctcagcctcccaaagtgctaggattacaggcatgagccactgcaccaggccttactctccattcttttgttttcttttttgtttgtttgttttgtaaattattttatttcttccatgatgatttagaggcactgtcttcaaaccaatacaaatatttcataaataatatttggctgttttctaaccagttgagtaacttgttgcacaataagctacttcacatctttcagcaagaaatacattaaatttgagtagtaaagacattacataatgaattaggacacaattaaaatttgctttaaatatttttttaggggagaggacaccacacttctactcaatgaagagaaacatttttacagtcctgaggtcttttatttttttaacacccattatgctgtgaatttgtagggaagaggttccagcagttcaggctccttcccattggttctcacaaagtgtgcttctctgggtagaggctgctgcttcaggtgaacccagatgcctttctctttggcttctttctttttctgatcatttttccttcacatgtttcaggaagctatcttggcttttagagagtgagtgcttaatgtgctgaatacacacattaattctcttggcaagaatcttgcccttgtttgtttacaacaatgccaacagcgtgctgggggacactgtagactcttccagtttagccgtggtaacacttgtggggcattcctttttgaacagtacccattcccctgatgtctacaatatcacctttcttatagattcgcatatacatggccaaagaaacaacttcatattttcttttctttctttttttttagacggagtttcgctcttgttgcccaggctggagtgcaatggcgcaatctcggctcaccacaatctccgcctcctgggttcaagcgattctcctgcctcagcctcccgagtatctgggattataggcattcgccaccatgcccagctaattttgtatttttttttttttttttagtagagacggggtttctccatgttggtcaggctagtctcaaattcctgacttcaggtgatccccctgccttagcctcccaaagtgctgggattacaggcatgagccaccacacccggccacaactctatattttctaagagacctagagaacatatattgggtgcctctcttcttaacctttgtgtttgtccactggaagatggcagttctggccgaaaggctctccattatttatgttgtagttgtcttacagtagcacattgcctgcttttgtatggcttatgagctaagaatggcgtgtgtgtatatatatatattttttgagacagggtcttgttctttcaagacgggagtgcagtggcaagatcactggctcacatacagtggcacgatcatggctcactgcagcctcagcctaccaggctcaagtgatcctcccacgtcagcctcccaagtaagtaggaccaccagagcatgtcaccatgcctgggtagttaaaatttttttttggtagagacagtgtcttattacattgcacaggctgatcttgaattcctgggttcaagcaatcctcccgcctcacctcccaaaatgctggtattacaggcatgagcaaccacacccagcctctattttttaatagttgaaaaaatgcaaaatccaacaatatttgtgaggcatgaaaattacgtggaattcaaatttcagtgtctataaataaagggttttttgtttgtttgttgtttttattttattttttatttttatttttttgagacagagtcttactctgtcacccaggctagggtgccgtggtgcaatcttggctcactgcaacctccacctcctgggttcaagtgattctcctgcctcagcctcccaagtagctggaatcacacgcctggctgattttttttgtatttttagtagagatgtggtttcgctatgttggccaggctagtctggaactcctgacctcaggtctgcctgccttggcctcccaaagtgctgggattacagacgtgagccaccatgcctggctgttgttgtttttgttttgtttttttcagatagagtcttggtttgtttcccaggctggagtgcagtggtgtgatcagtggtgtgatcatggctcactgcaggctcaagtgatcctcccagttcagtctcccaagtagctgggactacaggcacacaccaccatgcccaactaattttttttgttttaattttttttttgtagagatggggtctcactatgttttacaggctggtttcaaactcctaggctctagcaatcgtcctgcctcagcctcacaaagttctgcgattacaagtgtgagccatcacacctggtccataaataaagtattgttttgtttttttttttctgtaacctattagaagtgacacgttttgttttgttttgttttgttttttgacacagggtctcactctgttgcccaggctggagtgcagtggcgtgatcacagctccctgcagcctccacctcccaggctcaagtaatcctcccacctcaacctcccaagtagctgagactacaggcatgtgccaccccatctggctaattttgtattttttgtggtgacaaggtattgccatattgctcaggctggtctcaagctcctgggctcaagtgatccgcccacttcagcctgccaaagtgctaggactataggcgtgaaccactacacctggcctataatattttcttacggaaatgagatctcactgtgttgctcaggcttgtcttcaactcctgggctcaagcaatcctcctgcctcggcctcccaagatgctgggattacaggcgtaaggcactgggcctggacccataaataaagttttattggaagacagtcattctcatttaatgtattttgttcacatttgccctacagtggcagagttgagaagctgtaacagagaccatgtggcctgcaaggcccaaaatatttgttatctggtcttttgttgaaaaagtttagccaggcatggtggtgggcgcctgtaatcccagctactcgggagtctgaggcaggagaatcgcttgaacccgggaggtagaggttgcagtgagccgagatagtgccactgcgctccagcctgggcaacagagtgagactccatctcaggaaaaaaaaaattattaaaaaaaaaaatgtttaccaatctcatgcctcgtatagccaccgtgcctggccaagggtctgaatgtttaattttatttaatttaaatttaaatagccatatgttaactagtggcttatggtattgacagcacaggggctagatctttaaaatatatatacacagacatgcatatatatatgtgtgtgtgtgtgtctgtgtgtatatactctgagatggaaagaagagtaattgtgtgggagtatgaagagggtgggtaagtagctgacatctaaacagacccatggtgacttctgtgtactctggcccctgttacccaggagaacattcggccctacttcaaactctgtggttgagccctttgctttggtctgtgggctgcagttttctcattatcagagtaataggctatggttttgcttagcaggaagttagtctgcctgtggtagctccgctgagaacctgccccagctattcttcatcctcatctgattgcagatcccagctgtgggcttttatccttttcactaaagggaaggggctctccattaatcttctttcatggaaatggtaaccttggtagttactcttggtttttcctgtgtgattttgatgtagaaaagtatgtgtgtgaactgtgaaatatctaattttagatatttgcactagaaaagtaaggtggcattcagctattggtttttctttctcatatgctataattaatgccccttcaccttcagtcttgccccaggcagtactcacctagaggagagatggggcacagtaacaaccaagctttctccactgtttagccagttgcatactagcttgaatcccgaagaaatagctctaccaatagcacagtcataaagagcctagcagccattgtctgacaccacaaatcttcatagcaacagaccaccacatggcaacagcagccacacaaaggaaacattagggaaatcagtacctactttctcccacccctcccccaccaaaaacaacagccaacacattcccacctagcagcttactcccagaggatactttagggcagtgacgtgtttatatacctttgtggattgtgttatatgtccactgtcatacatttaaatcctgaagaccttgggaaaaatttcagtcaccggcttttttgagtttcattttgcaaatggcaaaatagactaatctccaggggagaaagagagtctccctttgtgcatgctcacacacctcctccctcccccaagcaaagcacagtcaggcagtatatataggtgactaggctgtgagcttgccagataggtaaggttgtttgcaaatgagattctttttatatttcagtaacaaaacccagacctattttgttatcaaaatcatcctgatacttaggaatttagttgagtgatacctaggcaataaatatcttactggtattgcctgggattaatcattagccctaactaacttagctttgaagtgtgattcaaaggggaaaaagtcctatttgagagccttggtgttttcttgctctgttaataaggtcgtttgactatctgggccttaatttccttatttgtaaaatgaggaggttggactacatgatctctatgatccttctagctctgatatttacaactctgtaatcatttatgtggaatagaagagggacttgtctttgttagtcattggttgtgatgaaatctgctggaagatgttgagccctctggtcttagtgcttacactgctaaaaacaggtcctggccctgccctatttgataaagctgctgtaacaatgataggcagaagctattaacaaagttggcaactagccttttctcccacagcagtagtttcagactagttcaagcagagctttgctcccaagctattgctactgaggctgctgctgcctcttaatgataccggtgagaactaactccatttctctctttaactcgctctctctctctctgactactctgaaacaaggggctgttctccacctcttctgatacctcattattccatctccctcaggctttacagaacaaagaaatcacagggcatcaactttataatttaggcagctggagataatttcaccaggatagggtgggtaggtagctgattcctcctggcattaggcagcattgctaagtggccttgtgttttgtctgccaggcttaagctttgttaggcccattcaggcttctctgtatttcaattaaattatagtggtaaaccaagcccatgtactttcaaaggggtaggggttaggaaaaacaagaaaagtatgtcatttataggccctgctactcactaattgctcaagaaatttttgtttaatctactatccctgtgcttactcctgccagatcctttatttcctttagttgctgccttcacggccttctccatagcaacaagctatatgacaaaaaggctatggtgagaaattgagcagtcacccctccccgaagttgtactctgttttctccttagggtatctaaaagcagcccaaaagactgctgtcaaataattttctacccccattgaactcataatcaaatgaaacttttaaccctgaactaatttggtgaacaacctgcattctccttatttgactctgattatccctaccttttgaaaattttctagatcattcaatatacttgaaatattgtgcatattctcatttatgaagctcccttttgctttttagctttcagcttactccttagaattatacagaaaatctcctggaatgaagtatggagaaagagtagatgaagaaagcgaaaccctccccttttctgccatgtgctgttgccttagatactagactagtcttctgccctagagattgggcaagctgcctgaagtatagaactggcctgcatcttggctgatcctggcatagcctaatctgttatcctttgttatcttcccagccacttgtctacaggagtcacaaacccaaaggttttgtttttgttttatattaataagtcttactgaaaataatataaacatgtacgcaaattctacgtgtgcaagtctgcattttcgaagtgaacacaccatgtgataccagcacctagatgaggaaacacagtattgccagaaccccaaaatctctttcatgcctcccttctaatagctagcccttctccccaccccaggtaaccaatctcattgttaataccatagattagtgttacccattttgaacttcatgtaaatagaatcattacagtatgagcttttttatgttgagctgttcaacattgtgccagtgagattcatccatattgttacatgttgttaaactttgtttattttcattatagtattccattatgtgagtatactgctacttattcagttgttgatggcatttgggttatttgcagtttgaggctgttataaaaagtgctgctgtgaaaattcttgtacatgtctatttgggactatatatacatattcctatctatctatacttagaaatggaattattgaatcataaggtatgtgtatgatcaacttgaatagacatcacaagtttcccaaaatgtgtaaaccaatttacattcctacttccaatgtattagaatcctgattgctctgtgttctagccaacacttgaccttatttgtctttttcattttagccattctggtggtgtgtagtggtatctcattgtggtattaatttgcatttccctggtgagtaatgaaattgagcatcttttcatgtgttcattggccatttggaaatctcttttacgaagtgtctgttcaagtcttttgcccatttttggattgggttgtatgtctttttcttattgatttgtatgaattctttgcatattctggttattagtcctttgtgagatttatgtaatataaatatcttctgtgtcttaacttttctgttaatggtgtctttgtcttcatttttatgtagtctattttatcttttttaaattttttgtttttcttttattgttagtgctttctgtgccctgtttaacaaagttttgcccatcccaagataatatattcttctatgttttttctgagaaccttgttttatatatatatatatatatataaaatatatataaaaatacatatatatatatatgtatttacatccacaatctatctggaatttatttttgtttaggatgtaagttggaagtcaagattcttatttttttatatggatatctaattggcccagcaccttatcaaaaagaccatcctttcccccattgcacagcagtgtcacatttgtcgtaaaccagttaacctgtgtgggtttatttatgggttctcttctgttccatttatacatttacgtattcttgtgtcaatactacattgtcttgataactacagctttgtaaatcttgttatctagtagtataagtcttccagttttgttgtacttcttcaagattgccttggctttacttggccttttgcatttccatgtaaattttaggatcatctttgtgaatttttacagaaaaaaaagtgctgaaattttgattaggatctacagatcaatttggagaagacccaaagttttatccttttacttaagctagtaaactcagcagttactgagggagaattggggggaggggggatcagagcaagtcactgatatcatttagggatcttgtttaaaatatatgttagctggccaggcaccatggctcacacctgtaatcccagcactttgggaggctgaagtggacagatttcttgagcccgggaattcaagaccagcccggacaacatggcgaaactccatctctacaaaaagtagaaaattagccaggcttggttgcaagcgcctgtggtctcagctacttggaaggctgaggtgggaggatcacctgagtccaggaaggctgaggctgcagtgagctgtgattgcaccactgcattccagcctaggtgacagagtgaggccctgtctcaaataaataaaataaaattaaattaaaaagttagctatctcctgctcctattctcaatcagcatgttcaagatggagcttggaaccaggtgcagtggctcacacctgtaatctcagcactttaggaggccaaggcagaaggatcatttgagcccaggagtttgaaaccagcctgggcaacatagtgagacccgtctttatttaaaaaataaaataaataagatggagcttggacttgcctattgtaaaaaatgctccccaagaaattatggtttgctgccatcaccactgttctccaccaaccctgtttgagaaccactgacttagactgcagtctagcagcaattcagtgaggctagttaaggtaaaatctgactgatttaatcaacaccacatctgcctttggggctgtattaatttcctgggctgctgtaacaatgtaccaaaaactgagtggcttaaaacaacagaaagttattatttcacagttcctgaggccaggcatctgagatcaaggtgttggcaggaccatctgtctcctgcagctctagggaagaattcttcttttcttctgctctttgctggcaatccatagtgttccttggcttgtagctgcatcatcccagtcacatggctgtcttccctctttgcatatctgtgtccaaattgctccattttataaggacaccagtcactggattagggcagaccctaatgaccttatcttgataacttgattgcctctgtaaagaccctatttccaaataaggtcatatgctgaggtactaggggttagaacttcaatatacctttttttggcaggggaagggtgggacagggacacagttcaattcataaaaggggcaaatgaaaatttcagaataattattgtcacaagttggagagagaagattttctagaaatgtgcataataatgagagacattgcttcccaaagtcagtctgagcagatcatccaccctctgaccccaactgttactgggttgagttcctctttttttgctttgttttgttttgttttgtttttttgagtctctttctgtcgcccaggctggattgcagtggcgcaatctcagctcactgcaacctccgcctcctgggttcaagcgattctcttgtctcagcctcctgagtagctgggactacaggtgcctgccaccacacccagctaattgttgtattttttttagtagagacagtgtttcaccatgttggccaggatggtgttgatctcctgacctcatgagccaccgtgcctggcctcctctctctttttttaaatctacttattttattttactttttgtagagctgaaatctcactttgttgccctggctggtcttgaactcctgggctcaagcagcctcccatcttggcctcccaacatgctgggattataggcatgagccgctgcgtcaagacttgagttcctttctctgcattactatttacccttccttgggtaaatacacttgtgctttcttttttttttttactgagagtgaaagggtggttcagctctactctgttaacaaactctgaaacagtcaagtagaggttaccagaaagaaaaataggtttcagcagttggcagcatactagcctctggctgaagaaggccaaaaggaaaagtgcctcgcataagccaagcctagtcatattcttatcctagttccttctgctaggtcataaagcagtaaagctgtggacagtgggattccttctcaaccccaggcaagtattttttcaaagctgttccattgagatgataccatctttcttattcctagtggttttcagaggactccagctgtatagccaaaggcatgatgacctttgctgagccaccttctccagccatggctgcaggatatggttacctcagcaagaggaaaggaaggatatacgatttaagggtgtggtgaaacagcctttgtggcacttatgcaaagtttccctagtgtaagaatgtatagatgggaggaggaactgtgtcagattttttgcatttctcccatctttcccatttctcccatttgcacaccccatccccacagtgtgggtgtgaagtggtttacatttactggttattccactttggccttctctatcctgtactagtccttttcctgcctatagttttagcagtaccagatctgaatgctcttcaaattgacacttgcttaataatggtttcagctggctctctaataatacttttgcctgaaattctgttgagagaaaatactatggtcatgtgaaaatggttccaggatgatgggtgttagttacacttgtgctttctttttttttttttttgagatggagtttcgctcttgctgcccaggctggagtgcaatggcatgatctcggctcaccacaacctctgcctcccaggttcaagcaattctcctgcttcagtctcccgagtagctgggattacaggcatgcaccaccacgcccggctaattttgtatttttagtagagatggggtttctccatgttgaggctggtcttgaactcctgacctcaggtgatccgcccacctcggcctcccaaagtgctgggattacaggagtgagccaccgcgcctggcctacacttgtgctttctttggctcctcgagtcccagaagatctcagaattaagggtttaagatttttgttttctctccaacccagacttgaaggtggacaaatttgaagacatcattttctttagcagtagtttccacattttgctgtacattagagtttgggagtgggagtttttaaaatcccagtccccagatctcacccaattaaattggatcagaataactgtgggtgggagccaggtgtcagtatttttttaagggtctccagaggctttgaacatttttacagactatcccaaattgcttattggatcatctgagatatttatacttagaatattaataaagaactcctggatagtgtatagattctctttggaagtatcctctctaaaggaacagtaaccacatttctgcctttaggtttctggttttggaagactcgtacgtaatttgacccttccttacagtcagatccatgaattgaggatgaatggtttgccaggataagtaggataaaaacctagagatgttgctgttaatctgattggaggttctgcctacatgaaatttggtagggcatgagtatttatagcatggcaaaagcattctctctaataatttgcattgcagcaacaaatttggagctaaaatacaggtttttggtttgtttttgtttttatttttttgaaacagagtctcgttctgtcacccaggttggagtgcagtggtgcaatcatggctcactgcggcctccaactcctgggctcaagcaaccctctcacctcaacttctcaagtagctggaaccacaggcgtgtaccaccatgtctggctaactttttttttcttttgtagagactaggtctcgctgtgttgaccagactggtttcaagctcctgtcctcaagtgatcctcctgccttggtctcccaaagtgctgagattacaggtgtgagccaccacgcccagccagtatgacagtttaaaaaaaaaagtttgaccagacacagtgactcacacttgtcatcctagcaatttgggaggccaaggtgggaggattacttgagcccaggagttcgagaccagcctctgcaacactatgagacctcttctctaccaaaaatcaaaaaaattagccaggcaagtggcacactcccgtagtcccagctacttaggaggctgaagcaggaggatctctcgaatctgggagatcgaggctgcagtgagccctgactgtgccactgcactctagcctgggtgacagagcaagaccctgtctcaaaaaataattattattataatggttttcattttctgtaaatctaaaatttttttaaatggttttcagataacaactatgcaccaatttaagaagaaaatcttagctagtacgtaaccacacatggtctaattctttctagtttcttcatttctggaggcaactcactcttggaagtttctgaatatatttaccctttctctacatctctggtttgaactttcatcctggaggaaatagcgctcataaatgcacatactctctaatcacatgtcaaagttaattattagacagtaacataccagagatcagctgtgggaaggaaacaatttctacattctcccatctgaggcttctgcagaggtagtagcatgtagagttccataccagccttcctcacaggcatcctcttgcaactctccctcagctctcagtcctaccaatttcctgcaacattccttgctgcaggcgtgagccaccacacctggccagaaactataatttatttactttcatacgatctgtttctccacctcaacctctaaagagaactagaaaactggagtgggaaaactttagaaaactactagtactgactgggagttgaggtattggttgtagctgcatcttcctccttgcccttactccgaacatcagtaaacaaatatgtctgtcattctcctttagaaataaaaataggaactacatagacaccattaacaggtttttgatcatttagtggtggttaaaaggacctttggccattataagaggtctagagagagtaaagaggactttactaggaaagcaaagagaagaccataactgaaggcatattcaacttctagagaataggaccaaattgaacaacaatttggcaccagtgtaaagtgtgtcagcaacaattattaatatttattgttaactattcatactagcactggacattaggcttaacacttactatttttctgaccaagctaaggaaatacaactttcaagggaacaaggtaacaaagtaggccaggtgtggtggctcatgcctgtaatccctgcactttgggaggctgaggcaagaggatcacttgaacccaggagttttagaccaacctgggcaacatagcaagaccccttctctatcaaaaaaaaaatttttttttaattagctggacatggtagtatgtacctgtaatcccagctactcaggaaactgaggtgggaggatcacttgagcccaggaggtcatggctacagtgagccatgatcttgccggtatactctaacctgggcaacagagcaagaccctgtctcaaaatatatgtgggaacaagctttttatttgtattatttatttattttaaacaacaacatcttgtccaagacaaattttttttaaaaagaggaaaagaataaagaaaaagaaggccaaggccaatggctcacacctataatcccagtactttgggaagactgctttaagccaaattcaagaccagcctggtcaacatatagcaagacctcatctctacaaaaaaaaatttaaaaattagctgggcatgatggtgtgtgcctctagtccttgctactcaggaagctgaggagggaggatcacttgagccaaggagtgtgaggttacagtgagctatgatcacatcactgcactccagtctaggcgacaagagtgagaccctgtgtcaataaaaaacaaaaagaaaaataataaaaagaatcagaggtctttaaaatataacagatgatggatccagtgttacatacctaagtatacctttaccagagcttctgccttgatatgtgagtctgagggttcaactgtaaattgcagaaaacttataaaatggtttggtgcccaaggactgttgctaagtcttgcatgtaagtccaaagtggatactatccaagtgacctgcaatgccatccatagatggtgggcaaaattgatggatgagctcttgatccaatgggtagctttgtttttattatacatgtctttggaccaggcaatcatctactaagtcacattataataagaagaggagtatgaatgcttaaaacagactttgttagctacccttactgtgctttgaattcaaagcataatttcagagataatgagctatatcttctcctaaattttctctctctttcttttcttttcttctttctttctttttctttctttctttctttctttctttcttccttccttccttccttcctttcttccttcctttctttcttcctttcttccttccttccttccttcctttctttccctccctccctccctccctcccttccttccttccttccttccttcctcaggctggagtacagtggtgcagtcttggctcacagccacctccatctcctgagctcaagatatcctcctacctcaaccctctaggtagctgagactacaggcgtgtgccaccatgctcggctaatttttctattttttgtagagatggggtctcaccatgttacttaggctggtgttgaactcctgggctcaagtgatctgcctaccacagcctcccaaaatgctgggattacaggcatgagccattgcactcggcgtcctacattttctgccccacaactagcaactgttttttcctctgatttttttttttaatttttgaaattattttattatttcaaaagtaatgcctgattttttagctatgacaccaaaagcacaagccagcaaaagaaaaattagataaattggatttcatcaaaactaataacttttgtttatcaaaggatactaccaagagaataaagatagaatgagagaaaatatttgcaaatcgtgtatctgataagtgattaatatctagaataaagaactcctacagatcaacaatgaaaaacccaaacaacctaattcaaaaatgcgcgtaagacttgaatagacattttgccaaagaagatatctaaatgaccaataatcacatgaaaagatgctcagaatcattaattataagagaaatgaacataaaaaccatgatgaattaccacttcatacctactaggatggttgttatcaaaaatgtggaaaataaaaagtgttcaagaggatgtggagaaattggaacccttgagaactgttggttggaacataaaatgagtacaagccattgtggaaaacagtttggtggatcctcaaaaagctaaacagaattaacatatgatccagcaattctactcctaggtatatacttaaaagaatggaaaacagatgttcacacaaaaacttgtatgtgaatatatgacagtattattcacaatattcagaaggtagaaataacccaagtgtccatcaacagatgaatggataaacaatgtggtatagccatacaatggaatattattcagcaaacaaaaagaaatgaaagctggtacagtgactcatgcctctaatcccagcactttgggaggctgagatgggaggatcacttgagcccaggaattcaagaccagcctgggcaacatagcaagactgcatctctagaaaaaaatacaaaatggcggccaggcatggtggcttatgtctgtaatcctagcactttgggaggccgaggtgggtggatcagcagaggtcaggagttcgagaccagcctagccaacatggcaaaaccccatctctactaaaaatacaaaaaaaattagccaagtttggtggcacacacctgtaaccctagctacacgggaggctgaggaaggagaatcgcttgaacctgggaggtagaggttgcagtgagccaagatcgtgccactgcactccagcctgcacaatggaaacaagactccatctcaaaaaaaaaaaaaaaaaaaaaaaactgggcacggtggctcacgcctgtaatcctagcactttgggaggccaagacgggcggatcacttgaggtcaggagttcgagaccagcctggccaacatggtgaaaccccatctctactaaaaatacaaaaaattagctgggcatggtggcgcatgcctgtagtaccagctactcgggaggctgaggcaggagaatcgcttgaacctgggaggcagaggttgcagtgagccgagatcatgccatggcacttcagcctggatgacagagggagactctgtctcaaaaaaaaaaaaaaaaaaaaaaatcaacctggtatggtaacacgtgcagtgataaactcattatcactgtataggatgttgtcagttaggcttacttagtactcccagctactcaggaggctgaggcaggtggattgcttgagctgtgatcacaccactgccatccagcctgggggacagagtgagaccctgtctccaaaaaaaaaaaaatgaagttctgattctacaatgtggatgaaccttgaaaatacatgttaagtgaaataagccagtcacgaaaggacaaatattgtattttttccacttaggtatctagaatggatacatttatatagacagaaagaatattaagggccgtggggagcatagggaatggagaattattgcttaatggctacaaagtttctatttcaggtgatgaaaaagttttagatattgtgatggttcaaaaggaaaaagtaacaatttttattgttgaacatttaggagacaaagtcaaaattcaccaagaggaaaagaataaattacccagagataaccaatgtttgaatttttatattatatatttttgttgcttcttttattttatatttttaacaaattgagacccttctctatatatttcgtaatcttctttgtttagagaaatatattcctgtaacatatttccataacattaaatgaccttctataacattttaaataactacagagtattccatgttaaggatgtatcataatggacttagtcattatatcttttatatggtttaaaaaaagatacttcttaaattttctagctcttcaagagctgagcttcattttttacatcatcaataaagtacctcacataccaaggagacacattatgtgtttcataataataaccttgcagctttggacttttcggtttttgtccaaactcccttttctctttttatcctcttgctgcattttgcctacttggacattttctttttgcttcttccacctgttctgtgtgtctttcactttgccaccagtatgtagctttattgctgcatctgtttcttttctggtagaaataggtcaaacgtaaaatcaataacctgcttctcagcccaaaataaacctacaggtgttgatgtcttttgctttagtccacagttttattctcaagtgcagtgcgtaaaccatttagtgttttacaccgaaaatacgagctcctgagaaccaagaaagtgtaatcttatcttgtgaggcagcgtagttaaaaatacgtataaggccatgcagtatggtttacacctgtaatctcaatactttgggaggccagacaggaggatcgcttgagcccataagtttgagaccagactgggcaacatagcaaaaccttgtctctactgaaaacttaaaaataaaaattagccaggcatggtgtcatacacctgtagtcccagctatttgggaggctgaggtgggaggacttcttgaggccagaagtttgaggttgcagtgagttatgatcatgccaccgcactccagcctgggcgacagagtgagacttaacctcaaacaaaacaaaccatacaggctttagttgagagtcatattgattgggattcagatcctagcttttgcatcttatttagctatataacattggaacagattgctctgagtttccagttcctcgtctgtaaaatgggaatgattatacattggaggttggtgagagaattaaatatgagataatatatagaagatgttaaagcacaataagttgtatgcattattggaaatactgtctgaccaccaccacataccaaaaaaaaaaaaaaaaaaaaaaattagggaaagcaaccaaatatgtaacccgttgtatctgggactaagcatcctttctgtatcattaggacttgggaaacttcttccacaattttagtgggattatattggagtctgaatcttactttagtggccagattcagtgtgtagtaacagttaaggtctaggatgcttctaattgttcatttcataggtggaaaaggaagatggatacttactgcaaagtatacagcaaattttgtctgggagcaagacatacataagagaaagaatttgaaatgactccagctttggttgggcaaattctgacaattatttttaaatgtaagcccaatgaagtcaaatatctatagtgactgttatctccagatgaattttgagaaaaaaaaaatagaattgttataaattaaatgaagcttcagaaagataggactcaatttagtcatattggtggttttttaaaaaattctaaatctttacattgtattttaatgccataaactcattatcactgtataggatgttgtcagttaggcttactaacgctccttttccaccccccaacacacacaaatcatatatctgatttaaatcagaactctgtctcacacatacacacacactctcacactctctctcacacacacatgcacacacccatgctgctggaaatttggggaatcacactgagttgagaatcagaaagtaactgagattcttatctttggaaggaaaggtaagtaagtagctgaggagttcctattcttctgtcagctcatcagccagagatgagatctggtgccactccaaaccctgcctgatgggttaaaccagtattagggttatttattctgttcagtacttactgagtacctgctaagtatttagggagagaaaagaaaagtgtatagacgatgttatctcttctaataaagcatcatttttgcgggggaggggttgctttttattttgtacatgaatacatgaagtggcacaacattcaaaagagattaaaaggataggcagtaaaaagtaagtcttctttccctgtccctagcccacctagttctgctaccttgaggcaactacagttatagtttcaaagtataatttttaatatttttaaaatactttaatactttaaaaatcagaacatttatctaggaatagaataatatagcagtcatagggacacactttgacacatcacataagaaattaggtaaagagccaggtatatcgtggcatgtgccagtaagtcccaactacttgggaaggtgaggcaggaggatcacttgagtccaaaagttcaagtccagcctaggcaacatggtgagaacccatctcaaaaaaaaaaaaaaaaagtgtagcccatgcctgtaatcctagcactttgggaggccgaggccggtggatttcctgagctcagtagttcgggaccagcctgggcaacacagtgaaaccccctgtctctactaaaatacaaaagaaaaaaaaaaaataagccaggcatggcagcatgcacctgtagtcccagctacttgggaggctgaggcaggagaattgcttgaacccaggaggtggaggttgcagtgagccaagatctcaccactgcactccagcctgggcaacagagtcaggctccatctccaaaaaaaaaaaaaaaattgtaaaaaaaataggtaaagtaaatcattaatttctaaatcaaataagttcagtcatgacagacaacataaaatttgtatgtggaagtcttggggcttaagagaggataaaagttagattaacattagaagaaggtatggaaaatctgtacacaaaacagtacctatactttagcagggcagccagtgaatcagaaatgtgttaaagggaaagaggtcctctacttagatccaataactgtgtctttagcatctcaacctcctgaaagtaagaagctggggagttgggggtagctagagggagagaccagaccatccatttgcacagaatattcaaaagagtctgtagaactttgagaaaaaccttgcagagtgtacatcttcacctaagactagaatagctaatgcgattgtgaaatggaatatttatttagtgtgtaagatttgtgttgatgggtgggggggggatcctttgtcatttatttaaaagtaatataaaattataaaaatgtttgttactggcccggcagagccaatttggcagtctagaaaaagtctggatttataagcaaactaatggaaataggaaggatttttttagtaatagttttgaggcaactttgtgaggagggaataagttgatttacagacccatctcaaactatctataaacatatatatacatatatacacatgaacatcttaactttatgtaagcctggtcctatttactttcaaatggactggaatgaaaagaaattataccttattgcatttttgtcatgtagtcccaagtaggcagctttgcttcctaagatttctggggtggtttcttcatatttgctttgtatatgggagctcatttttaggaagttttataaccgaaatatcttcaaataaatatatgcaaataataccacaaaacagcataagagccctactaatgatacagtcagcagatgccatataattgtgaactgaaagagatcacttttggctaaattatagagctcagctcattttcaccttttcctaaaaaggtgactctaggtaaaaggtagctgagcagaccacagcaactcttgttcagtttgattattttaaactaggaaaccaggtaactgcagtagatgcctgctattatgagggattagataggagcagtgagccattgctcagctcctgttcagtgtgggggttccccagccagttcatcacaggtatcagagggcaaacactgtgacaggagctgtcaggaggactatacaaagagaaagcattattgacatagcaaagacatgaggtgacctagatgtttgtaagccactctggcagctacagctgagggagcaggcctggttagagatttctcacaggtgttctccagacccgaacactgtagttttatgtagattgctcccctcttgggaaggaagtagagctgttttgtttctattcacgtgttatgtattacctctctcactatctcattaaccagtgttgtcaccaccacacccaactctgtgtactaaaatttgttgttcagaaattaaaaaaaaaaaaacttaagacatgaaacctgagagcccagtttacatttttcttttatttatttatttacttagagaccaagtctctctctgtcacccaagctggagtgcagtggtgcaatcgcagctcactgcaacctctgcctattctcatgcctcagcctcctgagtagctgggattacaggcgagccaacacacctgactaatttttgtatttttggtggagatgggatttcactatgttggccaggctggtctccaactcctggcctcaagtgatctgcccacctcggcctcccaaagtgctcagcttacaggcatgagccaccatgcccagccttatttttattttatatatatatttttagccgggactacaggcacacaccaccatgcctggctaattttttttttttttttgagacagggtcttactctgtcacccaggctggagtgcagtggtatgatcacagctcactacagcctcgacctcccaggctcagccattctccccacctcagccttccaagtagctgggactacaggcacgtaccaccacacgtgactaatttttatattttttgtaggtacgggggttttgccatgttacctaggctgatctcaaactcctaggctcaaacaatcctcccaccttggcctctcaaagtgctgggactacaagtgtgaatcactatgcctggccaacacttggcttattttttaaaaattttagagatagagtctcactgcgttttccaggctgatcttcaactcctggactcaagcagtcctcctgcttcagcctccctaagtagttgggactacaagtgcgagctaccgcacctagttcaatttagatttttctatcattatgccatattacctaagatactgcaagtctggggctggtctgagtgcagtggtgtttacaactagttgatcacaaccaattacagatttctttgttccatctctaatcccattgcttcacttaactaaccttaaaaaataaatacataaaaagatactccaagtctgtacagaatgtgtactgtggctcttcctagacagggcatccagctctgtgccctatttggaaaccagggcttccatctggctccagatgcctgatatgacagagctgaagatagctactataaaatatgttcaacagtaattttattttaaaaccatttctggagactttttactggtctttaaagaaccctttatttccttagacagattaggatattcattaccctatgcatctttgtgatcttttggattgttagaggtaagccttgctggtgataatgtcttctgttttacattagagttttgtccccctcattctagattataaacttcctggaagcgccaggcgcagtggctcacgcctgtaatcctagcactttgggaggtcgaggtgggcggattgcctgagttcaggagtttgagaacagcctgggcaacacggtgaaaccccatctctactaaaaatacaaaaaattagctgggtgtggcggcgtgcgcctgtagtcccagctacttgggaggctgaggcaggagaaatgcttgaacctgggaggcagaggttgcagtgagctgagatcgtgccactgcactccaccctggacgacagagctagactccgtctccaaaaaaaataaataaataaaaaataaacttcctggaagcaatgacatgtttattcaaccccactcccccaacccctaaacaaacacacaagtagaatatagctttgaatagtagctccttgcagattgaatgagaaactactagagtttgcgttatctgttattttaatttcttagtagtgtccaagatatcacactctcctagactgggagccaaagagctataaaaaattggtagcaaagtcaccaacttgctaggaatcataaattaccccttactctgaaaggttgaaggaaatttgagttataaaagacaatatggttactccagcaccatctagaggaaagtctagaaaggtttaaaatggtattttacaagttcactatatcagtttatttatctatttatttagagacagagtctcactctgccgcccaggctggagtgcagtggtgtgatctgggctcactgcaacctctgcctcctgggttcaagcgattctcctgcttcagcctcctgagtagctgggattacagtgcgtcaccatgcccggctaatttttgtatttttagtggagatggtgtttctccatgttgaccaggctagtctcaaactcctgacttcaggtgattcacccgcctcagcttcccaaagtgctgggattacaggcacgagccatcatgccccgccatcagttcaattaaatctagatatcacattcttcctatccttttttattatacatgtcatgatatggtaagatatcgttcacttggccattcaaccaaactttactctcttctttatttattttatatatattttttcttttttatagagatgggagtcttgtaatgttgaccaggctggtcttgacctcctggcctcaagcaatccttccatctcttcctcccaaagtactctgttctcatctactgcctgatagcatgttatttctgcgtgtgtttatctcaactggattgtaaagtgtgtgagaacagattgagatcatgtcttctatttctataatatgtatctccatagccccttactacagataggaagtcattaaagattgattattaagtgataggtataggtattacaaccttataggctagatacaatatagcaatatggaagattcttaaaagcatagcgccaagtgggccgggcacggtggctcacgcctgtaatcccagcactttgggaggccgaggcaggtggatcacgaggtcaggagatcgagaccatcctggctaacacggtgaaaccctgtctctactaaaaatacaaacaattagctgagcgtggtgatgggcgcctgtaatcccagctactcgggaggttgaggcaggagaatggcatgaacccgggaggcagagcttgcagtgaaccgagattatgccactgtggtccagcctgggtgacagaacgagactccatctcaaaaaaaaaaaaagtatagcaccaagttgaggggaaaaaaaacagaatagaaaaaaaaaaattatagcaccaagttgaggggaaaaaaaacagaatagtccaggcatggtggctcacgcctgttggatcactgaggtcgggagttcgagaccagcctgaccagcatggagaaaccccgtgtctgctaaaaatacaaaattagccggcatggtggcacatgcctgtaatcccagctactcgggaggcaggagaatcgcttgaacctgggaggcggaggttgtggtgagccaagatcgtgccattgcactccagccaggacaacaagagcaaaactccatcccccgcaaaaaatcagaatgatatctataacataatactaaataagcaaaataaaatatatgaaaacaaaacaataatatatataatatacatttataagaacatatacaggctgggcatggtggctcacgcctgtaatcccagcactttgggaggccaaggcgggtggatcacctaaggtcaggagttggagaccagcctggccaacatggtgaaacctcatctctactaaaaatacaaaaaaaattagctgggcatggtggcaggtgcctgtaatcccagctacatgggaggctaaggcaggagaattgtttgaacccaggggacggggttgcagtgagctgagatcacgccgttgcactccagcctgggcaacgagagaaactctgtctcaagaaaagtaaataaaaagaacatatacaaacaaaaatgtgtacattaaacataaagaatgtctgtagggggcaggggcatggaaattgtgtaaaatggaataagtaattaactaacaaggggaagctgaaaacaacaactttaccagatttagaaaacagcatggataagtagcagcttttggcgaaggatgaattaagcaactcagcactcagtcaaaagtttttaccttattttcttttttttccttttttgagactgagtctcactctgtcacccaggctggagtgcaatggcgcgatcttggcccactgcaacctccgcctcccgtgttcaggcaattctcttgcctcagtctcccaagtagctgggattacaagcacccaccatcacacccagccaatttttgtatttttagtagatatggggttttaccatgttgcccaggctggtctcgaactcctgacctcaagtgatcagcctgcctcagccttccaatgtgcgggattacaggcgtgagccaccatgcctagctatcttattttctataacttattttaatatattagcccaccaatcagtaacaattaacaaatatttatttagcatcaagtattagatcagctttttccatatctccttcctactctctgacacatgcctcagttcttcacttgtggtttggtctcactcttcttcatgtgtgtcatgcttatcccaaatccatttaggattataaaattctccctattctttctctgacctaacagtccatggctttaccacagtttgtagtgcagcatatggttttgggtttttaagtaatgggttttctccttttttctttctttctccttccttcttttcttcctcccttcctcccttccttcctcttttcttttcttttttcctccgtccctcctccctctctccctctttctcctcccctcccctctctcccttcctcccttcctctttctttagatccagcatcccaactaatggttttgaatatatccattctccgacaccaccctgccccccacctccaagattagaacacaactttccattcagtagccatatctctattctgttttgaatcttcagtagcacttggcacaatgacggagtatggtaagtagtatgggccaggcacagtggctcacgcctgtaatcccagcactttgggaggctgaggcagacagatcacttaaggccaggagctcaagaccagcctggccaacatggcgaaacccgtctctactaaaaatacaaaaaattagccgggcatggtgatgcgtgcctgtagtcccagctacttgggaggctgagccaggagaatcacttgaacccaggaggtgaagggttgcagtgagccaagatcgcaccactgcactgcagcctgagtgacagagcaagactgtgtctcaaaaaaaaaaaaaaattataaaaaataataggtattatgtatttgctgattagttgcataaaagcagtgtttgaggccgtgcatggtggctcacacctgtaatcccagcactttgggaggccagggcagatggatcatgaggtcaagagattgagaccatcctagccaacatggtgaaaccccgtctctactgaaaatacaaaaattagctgggcatggtggtgcgtgcatgtagtcccagctactcgggaggctgaggcaggagaatcacttgaaccccgtagacggaggttgcagtgagctgagatcgcgctactgcaccccagcctggcgacagagggagactccgtctcaaaaaaaaacagcagcgtttgaggtagattaatctgacaatagtttaccgcctggattgacagagataaagggtggagttagggagcacaattcaaagactattgggatagtctacaggtaagttaatgaggacttagactctagtggttgtggggatgtggagaggaagacattattcagagatttcaaaggcagaatgggcaggtcatggtggctgactcttgtccaaatgccagaaagtcaactctatttacttcttttttttttagcccttgatccctcctggctatgcccaaagtttcctgcttcctttacagatcatcagttgcctctcctcaggatccagaattctcacaactttcaagaattcaaactgggcaagcaaatccctgaaaggcaaaactgactgcactggtagaagtggcttgatccccagctttctgtctcccagcatgaagatagcagcagcttagttaacttctctataaagaggcagaaggaaaacaatgcttggcttttatgccttatgtgtagcagttcttatactttttggtctcaggaccccttttcatttaccttaaaaattactattttttttttttgagacggagtcttgctctgtttcccaggctggagtgcaatggcacgatctcggctcaccgcaacctccgcctcccaggttcaagcaattctcctgtctcagcctcccgagtagctgggattacaggcatgcaccaccacgcccagctaattttgtatttttaatagatatggggtttccccatgttgatcagattggtctcgaactcctgatcttaggtgatccaccctcctcagcctcccaaagtgctgggattacaggtgtgagccaccgcgtccagcctaacttaaaaattattgaagggccacataccatggctcacacttataatcccagcactttgaaagatatacacacacacacacacacattatatataatatacatattatgtataatatatgttgaggtagattaatctgacaatagcgtatatgttgggtgtggtggtgcacacctgtggtcctagctacttagaaaactgagagaggaggatcacttgagctttggaggttgaggcttcagtgagccgtaatcataccactacactccagcctggatgacaaagatcctgtctcaaaaaaaaaaaaggtattgaggacctcaaagaacttttgtttttatagattatatctattgatatctaccatttaggaattaaaatttagaaactcaaagtgtgtattattcataataatgaacctgttacatggtaatataaatagtatttttaatggaaaataactattttcatatttttagtagagacggggtttcaccatgttggccaggctagtgtccaactggcctcaagtgatctgctcacctcagcctcccaaagttgtgctttttcgtttctctctctaggagagccttaaagatctatgtttcatttgtagccatttctgggaattcttggcacctgaactgagatcctcattacccattgttgttagaaataacatgttcaaaagaggtataaaacgcgtttttagttttttaaaagttttttattggacatttaccacacacactcacacactgcattcaaaactcgctggcaaactgtggtcgtagggagttaccaaaaatagtttctcagactgattcctttggttagtagctatagaatttttccccatggactttgagttccaaataacagacccttaagagaatcatgtaattagtggatgatagagctacgttaatatttactccctgatttcctagcctaaagtagattggaagaaggaagttggatgtaatagagaggttggtgataagggaaagactactgcagaaggcagacatattaatgacgagaaaaagtaactgctgacagccaaagaggagaccgagaagcaaaacacagaaactcagcagagtagtttggtctcaattaaagagggccattaacccctaatatctcaggaaccttcaaagggacatctctttaccacaccacagaataattgtatctagaataatgaccctgagtcatcaagaaaattttaaaatacgctctgtatatgggaagtccccaacttacgaatggtttgtggtccaaagttaattttcaaaacatttttttggaacgcaaaatatttttctttctttctttttttttttttttttgatactgagtcttgctttgttgcccaggctggagtgcagtggcatgatcttggctcactgcaacctctgcctcctgggctcaagcgattctcctgcctcagcctcccgagtagctgggattacaagtgcacgccaccatgctcagctaatttttgtatttttagtagagatggggtttcgccatgttggccaggctggtcttgaactcctgacctcaggtgatctgcccacctcagcctcccaaaatgctgggattactggcatgagctgccacacctggcctcaaaacattttctatagaaataatgaaataattattttgggccttagacaagctgcttttttcattttatcagtccaataaacaacctttgaatgcctaatattaataaaagtatttcttttttatctggctctcatttatatctttgtttcagtgagagttcattctgaggccagagcctgaacataaatacagttcccctctggcctcataatctgttcctcaaggtgcagacggtctatgtcagggattattagcaagttaggattcggttaccaaatccagtcccacttctggtttttataatacagttttattgaaacacaactatgcctatttgtttacatattgtctggggctctttttctactataagagttgagaagttatgacggagactgtgtggcctgcaaagctttaaatatttactatctgtcccttactttaaaagcctgccaatccccagtctgtgtgatctggtccaccgttgtcactaatatgctgtctctctgacctcatgtgttctcactcttcccctcatttattccactacagccacactatcctctttgctcttccgaacgtgccatgtgcatttccaccacagggcctttgtacttgctttttccgctgcctaaaatgtcttctaatttccacagagctcgctgtctcacctcttacaggtttctctgcttgaatgtcatcttcttgagaaggctttttaaaattgccctttataaaatagcagcatcaccatccctcacatcgtcttctgctttgtttttctccatagcttatcactctctgggtttttgttgtttgtttgtttgtttgtttgttgagaccgggtttcactcccgtcacccaggctggagtgcagtggcgtgatgtggactcactgctgcaacatccacctcctgggctcaagtgattctcctgcctcagtctcccaagtagctgggactacaggcgtgtgccaccatgtctggctaattttggtattttttgtagagacagggtttcaccatgttggccaggctggtctcgaactcctgggctcaagcagtcctcccgccttggcctcccaaagtgctgggattacaggtgtgagccaccacgactggccgcgtatcactatctgacatatgcttacatgttcccttatttattgtctttctcctcttatctgaatgtaagagcagagacttggtcagttttgtgtgttgccatgtcccagtacttgagaacagtgtctggcccagagtaggtgctcatttgtggaataatagaatgaatgaaagcatgtatgtgtgctaatctgtactttaccctggttagttagggtgtatttgtatccagttagggtatagttgtcaacatcaatcaggattgaaaattgggattaaaataagatttaaaagcagcatataggcaaatgctgatgtttccatttggaaactcaatgctactggaatattcaggtacacttcatctcttcccctttctcttttgttgtctcttatgctgagggcaagcatctggccttatttatccttattctctagtacttagtccagcacattccataaagttggctcttaataaacatttgctgccaacccaggagtggacctcagcatttcttcactgtttttgtaacttcaatacttcacagaatgcttggcaaataatagatgctcaataaatattcgttcaaggtaggaatgaattatttgtctacctagggtagacattattccaggttatctgttatgtaacaaattaacctaaaacatagttgtctaaaacaataaatattatctcacagagtttctgtggctcaggaattcaggagtagcttaactgggtggtctgactcagggtctctcatgaggttgtagtcagttgttgactggggctgccatcatctgaaagcatatctggggctggaggatcctcttccaagttgcttcactacatgactattggcagagggcttcagttgctggcctcgtggacttctccatagggctgcttaagtgttctcacaaaatggctgctgtcatccctaagggaagaaatcccagagagaaagcaaggaggaacccccaataataccttttatcaccttgtctcaaaagtcatgcaccatcacttctgcaagttgctaaaggcagctcacactccaggggatgagaattaggccccatcttttttttttcctctgtgaattaggctggagtgcaggggcaacatctcaactcattacagcctagatctcccgggctcaagtgatccccccatgtcagcctccatagtagttggcactacaggcacatgccaacaagcccagataatttaaagaattttttagagacagggtctcactacattgcccaggctagtttcgaattcctatgctcaagcaatcctcccaccttggcctcccaaaatgctgagattacaggcatgagccaccatgcttggccatgaagcatttttaaaacattgagatatttctactaaaactaataattttttttttcttgagacagggtctctttctgttgcccagacgggagtgcagtggcgcgatctcggatcaccacaacctctgcctcccaggctcacgcgattctcttgcctcagcctcctcaggagctgggattacaggcacgcgccactactgcccggctaatttttgtatttttagtaaagatggggtttcaccatgttgaccaggctggtcttgaactccggacctaagatgatccacctgcctcggcctcccaaattgctgagattacaggcatgagccaccgtgcttggctaactaataactatttttatgtgtttttttgggaataggtgatacatacagatgtatgtatcacctatacctgtatgtatgagttcaaaagctaaaaggttttatacagagaaatgataggatatgagaggttttatttaacaggatctctctggtctctgtgttgagaacaggtcagaaagtgataaagatggaagcaagttaggaagctattgcaataatttaaggagtgcttggagcagtagaagtggaggtaatgagaaatgatcaaaatctggatatattttgaaggttgagccaaaaagatttgctgatggtcaggtgtggggacatggatagtaggagaggaaccaagtaaaactctaagggttttgacctgaacacctagaaggatgtacacatgccattacctcagatagggagaattcagagcaagttgtttttgttgttcttggaggagagggttgttaaggagaggatgggtatcaggagctcagtttggaacatattaagtttgagatctccatttagacgtccaatggaaatgtcaagtttgtgattagatacatgaatctggagtttaggggagaggttggggctagggatagaagtttgagtcatcagctacacatgaagtaccagcaaaagatgctgaggaatgaccagagagataggaggaaaaccaggagagtatggtgttctggaagccaagtgaaggaagcgtttcaagaagggaattggtctgagcatgaaggagctgagcatgaaggtaccagatccctgagagaaagtatgtactaatggaaatagtaaaaatgaggggcctagaaaaaaatctctctctctctttctactattatacttggatcagccttgactacacaaatgttttgaggttttgaattattatctgaaacaaagcagtgctgctttgggattgagtttgtctcagcatttcactcctaagaactgtgggaacctggccagtcgtggtggctcatgcctgtaatcccagcactttgggagcccgaggcaggtggatcacctgaggcaggacttcgagaccagcctgaccaacatggtgaaacagtatctctactaataatacaaaaattaacgaggtgtggtggtgcacacctgtaatcccagctgcttgggaggctgaggcaggagtattgcttgagcctgggaggcagaggctggagtgagccgagattgcaccactgcactccagcctgggtgacacagtgagtctctgtctcaaaaataataataataataactaggggaacctgactagtgcctcatacatgtcatcattttccctttactctgctccaatatttatcaccttgaagaagggagaatagtgagtactctaaaacttaataatgggtacttagattatgtccataagacttggtaaatctgaaagtaagattctagagaaacacggagcactatttattactgctgttttttagcagtattatcctcaaacatgctgagcctttccttattttgtgaacacttatgaaaaatagtaagttttccaagatgaagaccagtttttctttctcttcagcctacttgcttctctaaagctagcccctaatagagaaacttggtctgttaagtgttatttgctgcttttctttcctgtcgtcctattctccagctgtctcaactcggaaccttgcaggaagactattaaacctcatcaatgtgtgtttcctttgacatttaaacaagcctccattttgtctttccatatcataattttttctcttcccttctcccatttccagcaccttgtttgacctgtcttctcttcagctcattcattattgctaaagtttgcagattataccaaaggaagaagcctgatttataaacatgtgttcccacccagctgtttcaagaatagtaatgagattcatcttctagttgtgtgcctgctctctgtgtacagctgtgctcatctgcccttataaatgagatgcctatctctaagtcttaccttctctataaatggactctgttcctattaaattgattatgcagtaatcagagcaggccaccttttgggggagacatccatttgaaatcactttgctaatagctagagagaatttagcctaattacttctttaggagagatgccatttcccttaagatgccagggcactgcaaagggataggattcctatccttttcccctctggatgaccccctgcaatcctgtatgtgtatgtgtcttttatctaaggtgaaggtaacaggatattctaagaaaattgtgtgaaaacaatcagaatccattagagatagctgtgtcaggccttagagtctgaaagatctgaccactaatagtgaacccttgagtaaatgatttatcctttctggtgtatcatttcctcctttgcaaagtagccttaacaatccttatatgacaggatttttggcacccacttatggcctgccttcctcaaaaagtgatttaagaccaggtgccgtggctcatgcctgtaatcccagctctttaggaaaccaaggcaggaggatcacttgagaccaggagttgaaaccagcctgggtaacatagtgagactctgtctctatttttaaacaaacagaaaaaattataaaaagtaaacaaatgggccgggcccggtggcgcatgcctgtaatcccagcactttggaaggccgaggcaggcagatcacctgaggtcaggagtttgagaccagcctcaacatggagaaaccccatatctactaaaaatataaaattagctgggcgtggtggtacatgcctgtaatcccagctactcgggaggctgaggcaggagaattgcttgaacctgggaggcggaggttgcgatgacccaagatcacgccattgcactccagtctaggcaacaagagcaaaactccatctcaaaaataaaaattaaaattaaaaattaaattaaaaaataaataaacaaatgccagctactcaggaggctgaggcaggagaatcgcttgaacccaggaggcggaggttgcagtgagtagggattgcgccactgcactccaccctgggcaacagagcaagacttcgtctcaaaaaaaaaaaaaaacacacacacacaaataaaaataaaagtgattggcctagtgactactgtaatctcagcactttgggagaccaagttgggtggatcgcttggggccaggagttcaaaaccagcctggccaacatggtataaccctgtctttactaaaaacacaaaaatcagccatgcatggtggcacacgcctgtaatcccagctacttgggaggctgaggcacaagaattgcttgaacctgggaggcggaggttgcagtgagccaagattgcactactgcactctagcttggacaacagagcgagactctgtccaaaataaaaataattaaataaaaataaaagtgatttaaggctgtaaatattcaataagataatatgaaaacatctagcacataatagttttatttttcttttttactttattgtatttatttattttttgagatgaagccttgctctgtcgccgaggctggagtgcagtagcacaatctcagctcactgcaacacctccttgaacacctcctgggttcaagcagttctcttgccacagcctcctgagtagctgggactacaggcgcccaccaccacgcccagctaatttttgtatttttagtagagatggggtttcaccatcttggccaggctggctggtcttggacccctgacctcaagtgatcactcgccttggcatcccaaagtgctgggattacaggcatgagccaccgcacccggcttaatcctatatttttaaaaatctaagatttgggccaggcgcggtggctcatgcctgtaatcccagcactttggggaggccgaggcgggcggatcatgagatcaggagatcaagaccatcctggctaacatggtaaaccctgtctctactaaaaaatacaacaaaaattagccgggtgtggtgatgtgcgcctctagtcccagctactcggggggctgaggcaggagaatggcgtgaacccgggagacggagcttatagtgagccgagattcgtgccactgcacttcagcctgggcgacagagcgagactctgtctcaaaaaaacaaaacaaacaaaaaaaccctgagatttgtagaagccaagtgacttgttcaaggttacactataacaaagccaggatttgcactgaggttttctaactccatgtccagtgatttttagacaacattgtatgtcgaagaataaatgaatataagtgagttactagagatatgtcctagaagtgccaaatcaaaaagtattttattagtgggtggccgtagacaaacaaaagctaattccagatcccccagatttattgtcttgatatattccatagaaaatatgccttggagctgggtgtggtggctaacacctgtaatcccaacactttgggagtctgaggtgggcagatcacctgaggtcgggagttcgagaccggcctgaccaacatggtgaaaccctgtctctgcttaaaaaaaatacaaaattagcccgggcatggtggcacctgccgtaatcccagctactcaggaggctgaggcaggagaatcacttgaacccaggaggtggaggttgcaatgagctgagatcaggccattgcacttcagcctgggcaacaagagtgaaactctgtctcaaaaaaaaaagaaaaagaaaaagaaacacagatgcaagtcactaagtggggctgaatctgtggactggctgacctccagatctgggaacaaagagtagtcgtgagaggtgatttcagaggagtaaatagatactaaaaaagctcatagactaagaatgtgaggccaggagagtgagatgctaacccccaaccagccttatgaaaggaggcttaaaataagttaattgttgagtggaggagggaagctttaaggagttgggaaggactgtgtcaagctgcctcctgattcattattagaatagaagtgtgatatcctaaatttcactgtggcataggccatttgaagacctgttgtactgagtccctagggggccagaagaaagaaattgcaaagtgatgagacagagaaaggggaaaaagtaataacaaagacattccactcaatatgaggctgcaaaccaaaatgttaataatagaaatctaatgttaagaaagataaccaataaaaaccaggacttccacttcagagaagatggagtagacagatttttccctattcctcccctaaatacaactaaaaactctggaaattatttataaaacaaatacaacaagactgtgaaacgtggaagaaagaaggcagaccagccatgggtcacaagaccttagaaacaacatggtgatgagttccctgggttttctttttgtctctaatatcccagacatggcgctaaaactgaatattatatttaatggtaaaagactgaatggagccaagtgtggtggctcacacctataatcccagcactttggaaagccaaggcagatggattgcttgatctcaggagttcaagaccagcctgggcaaaatggtcttgacaagaggatagcttgagcccgagtttgagcccaatctgggcaacataacaagacattgtctctaaaagaattaaaatgccagccaggtgcggtggctcatgcctgtaatcccagcactttgggaggttgaggcaggcggatcacatgaggtcgggagattgagaccagcctgaccaacatggagaaactctgtctctactaaaaatacaaaattagctgggggtggtggtgcatgcctataatcctagctacttgggaggctgaggcggagaattgcttgaacccaggaggcggaggttgcagtgagcggagatcacaccattgcactccagcctgggcaacaagagcgaaactccgtctcaaaaaaaaaaaaaaaaaaaaaaaaaggaattaaaatgccaaaaaaaaaccctatataaaacataatttttcttttatcagattggcaaagaacaaaatgagaacatcatgttgccaaaggaaaagggcaagaggtattcatgggctactataaatgggtatatgaatgagtatgtcctctttgaggcaatttggaggtggtttggccgtatttgtgagaactccaaatacaagtgcactgtgattaacagttttacttacaggaattcatcttacagacatatttgtgtaggtaaaatgaagcatttgtacaagattattcattgcagtttatttgtaatagcagaagattgaaacaacctaaatgtccgttcaaatgctgccattgaaaagaatgaagtagttctctgtctacacatatggaatgatccaaaatatttgggtacatgaaaaaagcagtgtgcagaacattgtgtgtatattgctatcatttaaggaagaatatatgaacatatttgcatatatacatataaaatatctgtggaagacttttggatgtttccaagtaggggaactggaagactgaagaacagttatggaagggacacttcattttatattagggtttgttggagattttttttggttgaggtgtggggactaccttttgaattttggagtaaggctacattacctagtcaaaagctttatttttttattttttatttttttttgagacggagtctcactctgtcacccatgctggagtgcagtggcgcaatcttggctcactgcaaactccacctcctgggttcaagtgattctcctgcctcactctcctgagtagctgggattacaggcatgcaccactatgcccagctaatttttgtaattttagtagagacaggttttccccatgttggccaggctgatcttgagctcctggctgcaagtgatctgcctgccttagcctcccaaagtactgggattacaggcgtgagccaccactcccggccaaaaaaaaatttttttaattatccaggtgtggtgacatgctcttgtgatcccagctacttgggagactgaggtgggacgatcgcttgaggctgtactccagcctgggcaacagagcaaaaccccatctccaaaaataaaaataaaatgtgtcttgacaaaaccatgaagtctttacaactgttacccatcctaagggacctcagtagcattgtaggcaattcctatggaactattctggcccaatcctatttgtcccattggtacccagagtacctcctaaaccctcttatagaagtcagagtgctgatcaaaagaatactattctcagtggcaaatggggtgtgtcttgtctatatctatgtgctcttattttccagggatgttggtggtaaatgtaacgtggaggaacaagacatatgtaggtacactccttgactgcacacgacatgattgggcacccccaaggtaagcacttacagctatttagtttatattattctgaaccacactaattggtgatcccttatacttttatcctgctagagttgtacatccagcttttaaaggacatgatggtatagataccagggaaagcactgtatttatctgacattcaagaagactgaatggccaggcgcggtggctcacgcctgtaatcccagcactttgggaggctgaggcaggcggatcacctgaggtcaggagttccagactagcctgaccaacatggagaaaccccgtctctactaaaaataaaaaattagccaggcatggtggtgcatgcctgtaatcccagctgcttgagagggtgaggcaggagaatcgcttgaacccaggaggcagaggttgtggtgagccaagatcacaccattgcactccagcctgggcaacaaaaagcgaaactccatctcaaaaaaaaaaaaaaaaagaagatgaattgtgtattaaagtgttcggggggccgggtacggtggctcacgcctgtaatcctagcactttgggaggccaaggcgggtggatcatgaggtcaggagatcgagaccatcctggctaacacagtgaaaccccatctctactaaaaatacaaaaaaattagccgggcgtggtggcgagcgtttgtagtcccagctactcgggaggctgaggcaggagaatggcatgaacccgggaggcggagcttgcagggagccgagatcgcgccactgcactccagcctgggggacagagcaagactccgtctcaaaaaaaaaaaaaaaaaaaaaaattaattaaaaaaaaataaagtgttcagcgggtgctcacttcagtggtacatatactaaaattggaccaatacagagaagattagcatggcccctgcacaagggtgacatgcagattcgttaagtgttttatatttttaaaattaggaaaaaaaagtgaagtgttgaggggatgcactttgactggaattattaaagtcaccttgagaccaaagctataacatctaaccatgggtgagcaaacattcattgatgatagctatttctcagaaatttgaactcaagaacatttttagttttataaactctactagaacatacgggtttcacaaggaccttttcatgtcgcaatttgacctttagatggatatttcaatcaatggccccttatagctttttcctaatattagtactcagttcgtcagggtttgggaaatccaggcgttgagggtaacttgcaactaacatacaggtaacatcctaggagcttaccaattaatgcaattcccatgcagtcacaagtttctttgttggatcatattcattgaaaatggtagttattatctgaacagttcttttaggaaaagtatcttaaaccttcatctgcccattgttcccatgaaacaaagatgggcagaaatgtcccaaggaaaggtattttaaagttcttgattccataccactttcttattctcagatgtgattattctctaccgagggctatttatgcctcttaattttcagagatgctgggccaggtttctagaggcttagacttttttttttttttttttttttttgagatggagtctcgctctgtcgcccaggctggagtgcagtggcgcagtcttggctcactgcaagctccacctcccgggttcacgccattctcctgcctcagcctcccgagtagctgggactacaggcgcccgccaccacgcccggctaattttttgtatttttagtagagacggggtttcaccgttttagccaggatggtctcgatctcctgacctcgtgatcctcccgcctcggcctcccaaagagctgggattacaggcatgagccaccgcacccagcccaaggcttagacttttataagactatattcaggctgggtgcggtggctaacgcctgtaatcccagcactttgggaggctgaggcgggtggatcacctgaggtcaggagttcgagaccagcctggtcaacatggtgaaaccctgtctctactaaaaatacaaaaattagctgggcatggtggctcatgcctgtaaccccagctactcgggagcctgaggcaggagaaccgcttgaaccagggagttggaggttgcagtgagctgagatcgctccactgcactccagcctgggcgacagagcaacactccatctcaaaaaaaaaaaaagactatattcagaccataatagttgccctgataagaatcagaagcaggccaggtgcagtggctcacgcctgtaatctcagcactttgggaggccgaggcgggtggatcacaaggtcgggagatcgagaccatcctggccaacacggtgaaaccccgtctctactaaaaatacaaaaattagctgggcgtggtggctcatgcctgtaaccccagctactcgggagcctgaggcaggagaaccacttgaactagggagttggaggttacagtgagccgagatcgtgccactgcgctccagcctggcgacagagcaagactccatctcaaaaaaaaaaaaaaaaagaatcagaagcatatgagctaaaacaagttagtaaagttctttatgccctccctttgcatttctgagaaacctattggaaggacttatttctgctttgggcatgcaagaatccagagagataggagctgagtgagtaggttgataacaaggaagcagtaagtagctttacagtagaactgttctgggaacccaaaggagatatttgacaaaatttgcctcttttctgcaatagctatggttcccactgtcttagaaacaacctactccagctgccccctggaacaagagagtcaaaaccatctttagatttacaagggaaccaatcttagctaaaggtttaattctaggcagtgttttaagctccatgaaaagctactttagggcctatgaggagtgacccctaggtgcagatctccagacattcaaagaactcatgtactcttggttatatctgatgtttagggaactcttaaatggataggtgctttgttctacctttctatatcttcatagtgaggtatgtaagaaaaaggcattgggctaaaagtagagctagagtcttgttgtatgttgccattaatcagtgatgttaccttggacaagtcatttagcatgcctggcctcaatttcctgtatgatctctaacatcttttctgaaaccatgactatggctgtatataggaaatgttgacttgactatcttacggaacagattctgcatggttttagaggtaaatgtttgggaataatttgcagctaacgtgtatcccaggagttcaccatttagtgcaattcacaatcagaatttcttttaacaaatcatattcattgaaaatgatagtcaccatctggacagttctggaggctacagctaaactgctttgaagatgttttctcttcttaataatattctgttgtgtttatcctttgccaaggttctgtgactccccgaccagtgacctggaaatgcgcaatggccggggtagaggcaaacgcatgcgtcccaacagtaatacacctgtcaatgagacagccacagcctctgacagcaaagggaccagtaacagcagcaaaacccgggcaggagccaatagcaaaggccgtcggggcagccagaattcttcagagcaccgcccacctgccagcagcacttctgaggatgtcaaggccagcccttcctcagctaataagcggaaaaacaaacccctttcagacatggagctgaattctagctcagaggactccaaagggagcaagcgtgtccgtactaattccatgggctcagccactggcccccttcctgggacaaaggtagaacccactgttctggacagaaactgcccctcccccgtcctaattgactgtccccacccaaactgcaacaagaagtacaagcacatcaatggacttaagtaccaccaagctcatgcccatacagatgatgacagcaagccggaagcggatggggacagtgagtacggagaggaacctattctccatgcagatcttgggagctgcaacggtgcatctgtctcacaaaaaggttccttgtcccctgcccgctcagctacccccaaagttcgacttgtagagccccatagcccttctccttcaagcaaattcagcacaaaaggcctctgtaagaaaaagttgagtggggaaggggacacagaccttggggccttatccaatgatggctctgatgatggaccctcagtgatggatgaaacaagcaatgatgcctttgattctttagaaaggaagtgtatggaaaaagaaaaatgtaaaaaaccctctagtttaaaacctgaaaagattccttccaagagcctaaagtcagcccgtcccattgcccctgccatccccccacagcaaatctacaccttccagacagccaccttcacagcagcgagcccaggctcttcctcaggcttgaccgccacagtggcacaagccatgcccaacagtccccaactcaagcccattcagcccaagcccactgttatgggagaacctttcacagtcaaccctgccttgactccagccaaggacaagaaaaagaaagacaaaaaaaagaaggaatcttcaaaggaacttgaaagtcctctgacccctgggaaggtgtgtcgagcagaggaaggcaaaagcccattcagggaatcttcaggagatgggatgaaaatggaggggctcctaaatggctcatcagacccccaccaaagccgactggctagcatcaaggctgaagccgacaagatctacagtttcacggacaatgcccccagcccttccattggaggcagtagccgccttgaaaacactacccctactcagcccctgactcccttacatgtggtgacccagaatggagctgaagccagctcagtcaaaaccaacagccctgcatactctgacatctctgatgctggggaggatggggagggcaaggtagacagtgtcaaatcaaaggacgccgaacagttggttaaagaaggggctaagaaaactctttttccccctcagcctcagagcaaagactcaccatattaccaaggctttgagagttactattctccaagttatgcacagtccagccctggggctctgaaccccagcagccaggcaggagtggagagccaggccctgaagacaaaaagggatgaggaacctgagagcatagaagggaaagtgaagaacgatatctgtgaagaaaagaagcccgagctgagcagttccagtcagcagccctcggtcatccagcagcgtcccaatatgtacatgcagtccctgtactacaaccagtatgcctatgtacccccctatggctacagcgaccagagttaccacacccaccttctgagcactaacacggcttaccggcagcagtacgaagaacagcagaaacgccagagcttagagcagcagcagcggggagtggacaagaaggcagagatgggcctgaaggagcgggaggcagcactcaaggaagagtggaagcaaaagccgtcaattccaccaactctcaccaaggcccccagcctgacagacctggtgaaatcaggacctggcaaggccaaggagccaggggctgacccagccaaatcagtcatcattcccaagttagatgactcttcaaaactcccgggccaggcccctgaaggccttaaagtgaagctgagtgatgccagccacctaagcaaggaggcctctgaggccaagacaggtgctgagtgtggtcgacaggcagagatggatccaatactctggtaccgacaggtaactgttgccctgggaggaagtggaaataccgtatggtaatcgtctatcttcctcacaaataagggctgtccttatacaggggttcaacggaattgagattagcaggagagatgtataattttaaggattctttacctttgtaaactattttaatgttttttattttattttagtattattattttttttgagatggagtctcactctgttgcccaggctagagtgcagtggtgcaatcttggctcactacaacctccgcctcccaggttcaagcaattctcctgcctcagcctcccgagtagctgagattacaggcacacgccaccatgcccagctaattttttttgtatttttagtagagatggggcttcaccatcttggtcaggctggtctggaactcctgacctcaagtaatccacctgcctcagcctcccagagtgctgggattacaggcatgagccactgcacccagccaatttttattttattttatttatttatttatttattttgagatggagtctggcactgtcacccaggctggaatgcactggcgcaatctcagctcactgcaacctctgcctcccaggttcacacgattctcctgcctcagcctcccgagtagctgggattacaggtgcacgccaccacacctggctaattttttgtatttttagtagagacggggtttcaccatgttagccaggatggtcttgatctcctgaccttgtgatccacccacctcggcctcccaaagtacctggattaaggcgtgagccactgcgcccagtcgtaattttttttatttttatgtttttatagagaccagagtccctctgtgttgcccaggctggaatgcaatgatgcagtcatagctcactgcaatttccaactcctaggctcaagcagtcctcctgcctcagcctcccaattaaccaggactacagatgcatgccaccacacccagatgatgttttaattttttgtagagaggggtctcactatgttgcccaggctggtcttgaactcctggcctcaagcaatcctcgcgcctcagcctcccaaagcacagggattcatattaatgttttttaaaaagcacttttatatccatagcaggtgttttttccatttgacaggaaaggcccagacaagttagcttaatttgtctggggttacttgagacctcactagcagagccaggattagaacccaggtatctcgattccttgtccgtgtttcctccactgtttggttcctatgaaatgagttattgatggtctctctattttttagagtaggtccaaagtatactcagttactgagtttctttaacaaggattttataggttgagttagaactaggaacttggaatctcatatcttgctctgctcatgagacttagaatgtcttcccttccctcttggtataatagttatgcttccctccctcctctgatctgagtgtcacttataagctttccagtccctgagcgtgctctgaaaaagtgaaacaatctaaacatattggaaggggcagcctctcctatttcagtcgttttcccagaatgcttgttcttacctagaaaacatccactgatgcatggatggattttccttttctccccctgccccatcttgttccctgtgggtgggtgcagaggtgggggcgggggctttttaaccaaaagggagcagagttggattataaacaagatcagtagaggccaaaatcctactctgccccaggtgtctagtactaattatctgctctggtggttctactgggaccttgggcttgaagtatatctgtcttatctgtacaacacccagtcgttgttctgtgattgttgtaggaggcagagccccggatgtggacatatgtttatcctgccaagtactcagacatcaagtcagaggatgagcggtggaaggaggagcgggaccgcaaattgaaggaggaaaggagtcggagtaaggactctgtccccaaggaagatgggaaggaaagcacaagtagtgactgcaagctgcccacgtcagaggagtctcgccttgggagcaaggagccccggccaagtgtccatgtgcctgtgtcctccccacttacccagcaccagtcctacatcccctacatgcacggctattcctacagtcagtcctacgaccccaaccaccccagctaccggagcatgcctgctgtgatgatgcagaactacccaggtacagcaccaagtgccagcactattccattcactggaagggggaatgaagcacagatttcacatccagagttttcttgctcagccccaaggcatattgaggctcgcttagatgacggaccttttttcactgagtcattctgtgaggtggccaccataacccatagttccttgaatgacccataatgatagtctgtgtgactacctctctctcccttgctccagctcaaggattgtctctgtagtcagttttcattgctaactaaaggtaaaactccttctctgtcactgctgtctcccctcagctggaatttgtaaaccatatactccacgttttgcagtgtgctaggcactgtgggaggtacaaaagaagtagagccattgagttccttccactcccggagcttacagcttaatcatagtggagagacacaaagaacaaataaaatgcaaaccataacaatgcatggattcagttgccagatcatgttcacctgtcaagtaagaagagccatctgaagtcagactggggggaggtcctgctagattcagcttggaaaagacaagctctttatagtgtttaaatgttttttgtttgtttgttttttgagacggaatttcactcttgttgcacaggctagagtgcagtggcgtgatctcggctcaccacagcctccacctcctgggttcaaacgattctcctgcctcagcttcccaagtagctaggattacaggcatgtgccaccactcctggctaattttgtatttttagtagagacggtgttcttccgtgttggtcaggctggtcttgaactcccgacctcaggtgatccggctgccttggcctcccaaagtgctgagatacaggcatgagccaccgctccggccttaaatgttttttaacttgttagaagaaaatgctcttatttaactctactcgttttgttgcccaaagaaccatgtggggtgcttctggggtggaagggcactgctttagcctcactccttagagcctccagcttcctacagcagcctaaatagtctcaacattctggtgacattattataaagcacactctaaatagaaataagcttttcaaacagaaataggaaatttcttacccttgaggtgttcctttatccctgtcactcacacccatcaatataaaaatcatagttgcatttgttgagtgctcgccctgagccaggcgctgtcctctgagatttatagacattatcttttttaatcctccctatcaccttaagtaataagtattgatatcttcatttttgatgatgaagaaactgaagctcaaaacagttatttatttgctcaaggttaccaagctagtaagtctcagagtaaggttttgagcccaaggctctgactccagataagtgtgatctttccactttatcatatcacttctccaagatgaatctgagaccagttcaaagaacagtatcagatctatggaagttggaagcaggaaacagggccatgttcctaatatcccttagctaatttttcctgtagagctcagtaaagaaaggtcaagccaacagtctcagccaaagacactatgttagaaaatacctcagcctgtgcctaggaaagctgatgcccacccaatcaagctcactaaagcagagtttcctctacctctcccatctctttgactgtttgatttctccttccacaggttcctacctgccttccagctactctttttccccatatggcagcaaggtctcaggtggtgaagatgctgacaaggcacgagccagccccagtgtgacttgtaaatccagctcagagtccaaagccctggacatcttgcagcagcatgccagtcactacaagagcaagtctcccacggtaagaaaagtacagtgatgctggctgttacccaaagactagtaaggccagatccagggtctgggagaaggtgggcaagttcaggtcctgaccacagtgcagcttggctgacttgacactggcagcccccagggcatcttctttattcttaggtatcttgcacttttaggggtcataaggtggcaccctgggcatctcacttgtgtgtgtgtgtgtgtgtgtgtgtgtggttgtatgcatatgtgtctcactatagtgcttttgtgtctctggtttcctttccagataagtgataaaacttctcaggagagagatcgaggaggctgtggggtggttgggggtggtggcagctgtagcagcgtcgggggagcaagtgggggtgaacggagtgttgaccggccccgcacctctccttcccagcgcctgatgtccacacaccaccaccaccaccacttggggtactcattgctcccagcacagtacaacttaccctatgcagcaggtaagcctgttttccctaccacctgttgttttgtcttgttttgttttgtttatcttcatcccagtagtaatgtccacagctaggaccctcctacctgcctcataagaatccttttttaattttttttttttgagcttctaatctgtgcacagtcctaacctcctgcagtcattaaagcatatgatatttattcctcccttggagtttggggactcttaaattcctccagaatactggccttgatagtcagaagaatatggaacaggtgttccccaaaggcaaagagaaacaatcagctgagaaatagagccttattatctatctccagcaaatatatctggctgagtatcagatttttttttctgtcagcaccccaaaactcagggaaaaagattaatggaaggtttctgtgagtgctacactaacatgttctcctgcttattcagggctttcttctacagccattgttgccagccaacaaggctcaactccctcactctacccaccccccaggaggtgagaatggtaagtcacttttattaatttggggcaacacataaagccgggatagttgctacctggatcacagaatccctaggtgagaaatagctatgaggggtcagcagtctggaatccatggaaccctggccaagcctcttgtacaagagtctcccgtgaagccatgtgcatctgagaggacctgtggaacacagtgtcccctagggaccagtactggccactcctacaattcattttcttggagtgccaccttgtggtttttttaccaacaggctgagtgcctggttatctgtccatgtttcccttgcagacaccaagtgcccggataaagtcagcttcacgggcccggactggcttacccaaggaggtgctgaaggtgccgtttagacatcagttaaatggtgttgatcatcctgtttgccgtttccaccatgactgaaggcagacccttggctatctcacctccaccagacctccggactacctgaccctacctcttcctcaggagctggagagctggtacttagcaaaaatatttattctctcagccacagttatgactattgtggcctctgtggagatgaaggcacgggaagcaaccaggggaacatggcctcagcccagagaagccactgctctgttccccaagcccttggtctgctgctggagcagtaccagcccccccgcccaccagggagggacccccacccccaagcactgggtaaggtctgaagacagcacagcagccatacccctcaccatcattaccaccatcaccagattctgcatctccctagtgctttgcaccctgggaattggcagcatgtggaggaactagaatctcaggaaagaaattgggggttgttttctacataattgtgaaaacaaggtcttcaaatgtggagacttctccccatttacatgagcacatataaacgctcacaacctagcctggaaaggaagaccaaggcatctgccccaacatggccttgagctgcctgtgaggcagggggcaggggttccaacaccagcacagggctccccagggacactgggagcaagctggtgctggagcatgaatgacgtctgtgaagtagaacctgcgtccccactaagtcctgctgcttcttattccccaactccttgcccttttcccttccctcctaaccccttggtgcctttcccagggggatccccacactggtcttgcctcttcttttccactgcttggctcttaagcctcaggcagataaactagtattccccccagcttggggaaccttggagtctgccaggtcaccttagggcaaggcccagaaggcagcccctgggagcacccagcagttcttggagatgtcctgtcatctagccatctgatatcttcctcatttgaggccacagatatatacagcccaattcctctgtctacaagtacatgattttatatagctcagtctataacctccatgtgggccaatataagctgtgtttcttggtaacacatattttgtttgaggggccactggccatgggaggttatttgttccttagaccctggaataacacatccaagccattacttattagagtctcagaatgtactcagtggagctgtgctttgaggcagccaacatttctctgctctccttagaaatgcagtctcccaatggaagctttatactctttgtactgggaaagtgaggatgatttggtagctttattggggtcatgtcttccccaaggtgtggggagcttagcttacttggcttttgaggtatcatccctctgttctcccctcctatctttccatgaccctctggattgagagagagagataaagactgacagacaccagtgtaggctggaaaagggagtgtgtgaccagagtgccaaaagtgactaggagcaggaacttggctccgactcagtttggaaaatgggaaataggggacagtaagcacaatgcccagtagtagttgatttccaaggaccctggaaccctacacttgagaggcttagggtcaccatctgctcaagaggatcccctctgatctacaggccttttccctaggtttctgcctcctcgtttttgttcaagttgggttctgagtcctccccaaaaaccattgttttagacctcttggcagggccccaaaacagcctccctcatacccatcattccctctgccttctgctgccctcatgggcagtgctctgagcagtgacctccctttcctccgtggaagtagctagtgcagacaccgtcatcccaccccacctgagtcaccccaaccaagagggtgactgaatttcagcctgattatgccctcctggggctcctgtgaggtggagccaaggttccctctctgttcctgtttgtttttaaatattgttgtgtgttttgtatctgtggcactggcctgcagcatactctgtatatattgtaaagaaaccgttaggagtaattttcttttgcattgggcaggcatggccctgcattcctgccctttccactcattctgtaacacagaggacgaacttctgtattagctgggcagccttgggttctccagaagagaacaggtttttcttttcctttttaatttttcttcttaaacatttggctctttgatcctcatatccaagtctcccctgaagagtaggagctgctcagaagagcaggtgaaagccaccatggcagatcctgatgcctgccgggcctagtcttccctctgaaataacatgaagcagcagctgtggagattcttgacaagtgctgagtgaaagatttgctgcccacctctacatggggaggagaaacacaggtgggagctacctgtggcatccatgacctagtcagagggatgagatgctcagcaggggtccccatcctatcccaccccacaaacaaaggctggaaaaatttgctaccaagggccaagaccaccagaccaagcctgtttatgagccacccctgcccaggccctcacagacattgctcacggggcttcccatagaggagaagctaaagagggagggggcctcatccccagatagatcaggcaaggcttggagagctgctctttaggatccacatcaactacttcctcattttaaggtatggcagttcccttcatccccttttcctgccttgtacatgtacatgtatgaaatttccttctcttaccgaactctctccacacatcacaaggtcaaagaaccacacgcttagaagggtaagagggcaccctatgaaatgaaatggtgatttcttgagtctcttttttccacgtttaaggggccatggcaggacttagagttgcgagttaagactgcagagggctagagaattatttcatacaggctttgaggccacccatgtcacttatcccgtataccctctcaccatccccttgtctactctgatgcccccaagatgcaactgggcagctagttggccccataattctgggcctttgttgtttgttttaattacttgggcatcccaggaagctttccagtgatctcctaccatgggcccccctcctgggatcaagcccctcccaggccctgtccccagcccctcctgccccagcccacccgcttgccttggtgctcagccctcccattgggagcaggttggggcgagctggaggcccgggctggaggggcagtgttgctgttcatagattttgttccattggcgttgctctgttgaatttaatttcagtcttcctgattcttcccttctgtaaagtgtacattaccaagttccttgtttttttatatatatatataaatatatatatatacaaactgtactctttttgcctttgtacattcaggcaagaagagaaaataaatctttttaagagacaatcacaaatctgtgagggctgctggttatttctcctggagtttgctgctgagctgcctcttccttcctcccaattttcctgttctccctcagctctcctgatcttcctggccctgctccatatgcatcctcagcttcactttccctggctgatggcaagctgttgaatccagtgtccagactacctgccttgtaacccttttctgcccagcattgttttctggcttggccactggcttagcccaggagctttactctgtgccctggcctcccctctcttcacctttagatttccattcaccgaagtggctttggacccctgggtactctgggacctgtttcctggaggccctggcttgggacactcacctgtgaaactatgcagctgggagctctctgcctaagagtttgcactatttaaacctgcctgggagttaggacggatggttttaggaatgaccggaaaactacccctaaaactcccccgacattccagcctctagaatgctctgatccagagctcagtggatgattcccagctggtggactcctgtggctaccccatcagaacaagggctaagggtttatgggtcaagagtatttgatcagaattttaaagggtggtatactctgaaacacagcccaaccaaaccattgtttggccgctttctcttttcctctaccttcctcatccccacttttttccctttctctctacttcctcttcttaattggctttggaattgaaatatatttttaaattatttgttgtatttattgaataaagtttttaatgtccctgttctt

SEQ ID NO: 721 - DNA, 29663 bp, Homo sapiens
aggatgcagcgcgctggcgggaggtttggagcagatggataccgtatcgacgtggggcctccggtatgttgccgctgcgttgaggtaggatggggctggcgagtcttcccttcccaggacttcgcagagggggcgatggggctggatttcctccccttgtccccgcattgcgggagagagggaaggaagcgggcatcccgagacctgggtctgtcattccttgcaatgataattggattttaagtgctacattcgcttgaagtttttttcatcccttcagtatccttccaacttggagtgtgagatgcttaatgagcaaaatatctctgaaatctttaatctcaaataattatataaagttaaaaaaagcgtgtttcggcttattaaggtagttgtgttcagccgggggggtgggggggtgtgtgtggggggggcggttttaccacccaggggacctttggcaacctctggagacatttttagtcaccactgctaggggccgggggcaaaagagatgctcactggctactagtggatagagaccagggaagctgccaaacatcctccagtgtacatgaaaattcacaacagttatccagcccaaaatgtcaatagtgtcaaggttgagaaagatttagatttaaagggactggaacaaattttattcgtcagttaaaaacaattgaaagaaaatagttgcgcatacaatattgccttttttaaagttgaaagatactgaaaactacaaacaagttgtaagaatagtcccccatatttccatcaaccgtagtcatccatgacagaatggcatgttagcatcttttgtcctagacttttaaatatatttacattttttatgggaaaaaatgaacacattgtttaaacgttgtttgactacatccttaaaagatatttcagatataactaaagtctccttctacctctactcacctatcctggacacttccttgtccagaatcaacagcattcagaatttggcatgaaatgtttacagttttacatttttttattttggatcatactgcctgggtttgaatcctggctctgtcacttcttatctgcaagcctttgagaagatcctgaaactccttgcctcagtttctccatctataaaatgggatagtaacagtgcctatgtcataaggatgttgtgaggaagaaacgagttaatccaaagtgcttagagcagtacctggcactgtttcttcaggaaaaaaaaaaaaaatagtacatggcactatttcttgagaaagcactcagggactgtagtcattgtaggtaaatagaacatatataatgctgttttatttgttttacataaataatatgctgcagtgtacatttgtctgcaacttaatttttaattcattttatttttgaaatttaaccatgattatatatatatatacacacacacacacacacatatatagatagatagatctaattcattccttttaactcttgtttgatagtccatctatactcattcccctattggtgttcattgaggtttttactttttttatattgcaaatatcagcacagtgagcttctagagcaatgtattcattcatatgtgggattatgtctctgggtttatatctacaaatgaaactactgggtatatgcatttcagttgactgccaaattaccttcagagtcatctctcccttttatttaagtactcataattttcttctaattgttagctctttttccagtctgatctcactcacacctttaacactgtcaccaggatcttcataactcaaaagtacagtcctgtgatttctgtttttgaagtctttcagtgggttatcattacttatatgagaaatttataagtccttaatatgacataaaaatcttctttagcgtaatcttcccaaatcctctaatttagttgatcacgattctcccgcatttactcacatttcaggcatattagataatgttgaaaaaggtgagatcaattctgtataggacccaataaataacttatgtagggagaaaaaaacttttaacagtggccctattttgtaggaaagttaatttactttggttaacaatgtcatatgtcttggaaaaacaacatctatcattattatcttcataaaattatgttcagtattattaggtgccattttagttgagtgtcttaattttacttttttcccaaggatactttctcttggtcacagttaatatggtttcttagactttttggatgtcatctgctcttctaggataatctggaaccacactgatagtttatttaaagaattgtcacatttatagggccaaaatgatttatgagcatttaaaaagaatgaacaacatatttattaagagggggggcagtaaagagtagatgaggatgataattttattgccagcctactatttttatgttagcatatgcttgtatatattatcatttttctagtatacacacacatctgttttaattttatgtataaaatagatagtcaactttgatgtatggtaatatagaacaggaaaagctcaaattaattatgtagtattttataaataatctactttctggtctccacgccccgccccgcaccgccaccctgccccgcaccgccacccctagttacttctgtatcttctgcagccactgttataatgttaataagtaaaaagtcaaatagcccataggctagaatagtaaacctggggccctgataagcagagtttaaaatagtgaggggttgcttataattggactaagaacctgtaaattgaaccttagtttgatttgtttccagatatgtttctattttttttaaatgccagttatttcatggcctgcaggttttatgaacatatcccaagaactttaaaaatagatgttgcagcagcaatacttaatatctactgtcttagcagttacacctcaataaagctgggaaaaaagttaaaattcattttagcaatgaattaaattttaatgattgagtattacttagatataataaatagcaaacattaaaaacaaatgagattgaaaacatgttgcatcagtataaaatatagtggatatgcacatatatgtaaattcaataagtcttgcaaaaacttttcactcaatagtcataaatagtcatttatgtttttagatcagtttaagttcatgagaataagtttgctttctgcctggagatcgtattgaaagcaggtcgaattaggattatacaacagagttttgaatgccatgctaagcttcatagcaatgatttgcaagctttttttctctacaccattcatatgttcaattcacagtgtttagcatctatttttccaggtagtaattcaagaatcacaggtctattgagaaaggcaaggggcatgtaagcttttggattagggggtggacagtgacaggatcaagtgtgtgttttagaacaattaactgatgtattaaatagcataaatgagttgatatattggagggaagatagattagattaaggaagactaattaagaagcttttacctcagcctgagagatcacagcctgaactatagtagtggcaactggaacagagagttggaagatagatgtttctaacttagggaacttgatgatgacatttaaagaacagaatgtaaggagcctaactttcataaattctgaccattttataatcaggttttccttactcctatcacacttaagttattggtaagtgaaccagagcattgtactgattaaacattagttgtgatatttaacattaaaataataaaattcatacagaggtgatttttgtttttgatattaagaaatctgaaaaactttgaataggtagtaaaagatgatgaattcttagagctttacctcagaatgtgtaattttcatgcttttcctttctagaaatctaggaaacctgacatgggacctttggtaaatacattattattcatacattttgatggaatataactaatatgtttattttctctaaaccatagtttcataagtacaagccagacctttgatttacctaccctatcttctttactgatgaagctgaaactactttgtgatgcctattgtcccagatctttctgttaattgcctaacaacaaaccagtaagccaatgacttctttttttcttatttacctgtttttattgacacattgtaattgtatatatctagagagtgcaatttgatgttttgatacatacatatattgtataatggtcaagtcagagtatttagtgtatccttccctcatgaatgtatcctttcttcctggtaagaacattcaaaaacatctagttattttgtaataagtaataaattacactttagtgttaactatctttaccctactgtgcaataggacactagaacatattcctcttatctaattgtagctttgtaccctttgagcaacccctccccatcctcccatcctctctcctttccccagtctctgataaccagtattctactctctgcttctatgatagcaactcttttaaaaaaaattttagattccagctattagtgagatcatgcggtatttgtctttttgtgattggcttatttcacttaacatgatgtcttccaagtccacccatgttgttacaaatgacaggatttcatttaattttgtggctgtattaatagtattccacgctatgcaccaaaaattggtatatacaccaaattttttaatccattgattcattgttggacacttgggttgattccatattttggctattgtaaatagtgctgaataaacatgggggtgcagacatctctttgacattgatttcattcctttggatatagacccagtagtgggattctggatcatatggtagtactatttttagttttttgaggaacttccatactgttttccatagtggctatactaatttaccttcctaccagcagtgtgtaagtgttcctttttctccacgtgcttgccaacctttgttatcctttgtctttttaataatagccattcaaactgaaattaggtggtatctcattgtggttttgatttgtgtctccctgatgattagtgatattgagcattttttttgtgtgtgtaccttttgaccatttgtgtgtcttcttttgagatatgtctattaagttattttgtccatttaaaatattgggatattgctgttctttatatattctgatattaatcccctgtcagatgtatagtttgcaaatgttttcttacattttgtaggttgtctctttactttttttttttttttggctgggcaaaagcttttcaatttgatgtaatctcatttgtctctttttgcttttgttgactgtgcttttgagatcttatttaaaaaaatccttgcccagcccaatgtcataaaatgtttcccctatgttttgttctggtagtgtaataatttcaggtttacatttaagcctttaatccattttgagttgattttttatatggtgagaggtaggagtctggtctctgcatatggatatccagtttcccagcaccaccatttattgaacagactgtcctttccccaatgtgtggttcttggcacctttgtcaaaaattagttggttgttggtgcatgaatttatttatggcctctccattgtgttccatttgtccatgtgtctgtttttatgtcggtaccatgctgtttcagttactgtagctttatagtatattttgaagtcaggtagtatgatgcttttaggttcattctttttgctcagtattgctttggctattaggggtcttttgtggtcccatatgaatttcaggattgttttttctatttctgtgaagaatgtcattgatattttgctagacattgcactaagtctatagattgctttgggtagtatggccattttaacagtattaattctaccaatccatgagcatgggatctttccattagtttgtgtcatcttaatttttttcatcagtatattatagttttcattgtagagatcattgacctttttggttaactttatttctagttatcttatttttttttgtagcttttgtaaatggaattgttttcttgatttctttttcagatagttcgctttttagcaaatagaaatgctgctgatttttgtatgttgattttgtatcctgtgactttactgaatttattagttctaacagttttttggtggagtctttagggttttctcagtataagattatggcatctgcaaacaaggacagttttgcattctcctttccaatttggatgtcttttatttctttctcttgcctaattgctttggctaggatttcttgtatgcagttcatagaagactgaataaagagatatcaacaacttttttttatacatgtgttcaatattgaggatattcttttatcctttattttactaattctctcaagttacctttcttacaatgagtttgttcagaataagggaatgcatgccagggcagagtggtagttaaaagtgtagactccagagtcagaaggccccttttccaaactagcaccattgctgatttctgttaactgtggattagtgttgtaaccttggaaaattttcttatcttctttaaaataaggctttcttgcttaaaaggtagaataataagggtacttattttaagacaatagttattagaattaaataatgcatgtattgtacctgccatataataagcttgaatgattgatattatttaattcttgtgttcattgtaataaattatgttaatcctctattttttctaatttgaataagaatagtgactttgttgggtcatacaaatgcatacaaatgcattgcctttgtaaactaagatttatttttattaatcctatggagattttttaaagccttgttacagcatctcctatttttattcctggggtttcttttttgtcttagagcctgtataggctcctgtctctagaaagcagaagcccaattgcctgggctgtgggagaagtataattgaaaatcaacgtatttggggagagtgagttgcaagacaagtaaacccctaattgaattgtcattctaaaggggctaaggcagagagtgggaaaccacattagagttgttaggtttgaaacagagaagtataacccttaagcaattttctgagccagaacaaatatctgaagtcacttttaatagagcatctaaagctttaaatatatgccgttgacacattcagttatcttttttgatatggttatttgaattcttagcaaacttttttaaagcgtctacagaaataatatttagaattttttttataagtatgatattgtcaaaatagtataaaaagcttaaaatgtttacttaataaaatgtgtagttacctatgttgtagttctctaacagaaacgtgttttcttttcaacccttcctacttcatggcagtttttcctcatttcttttttaggtttagaaacatcaactggaatcaatttgcatttgaaaattagatcagcacaaagacttgatattgtggaatgactagcaaacaagcaatgtcatctaacgaacaagaaaggctcttgtgttataatggggaagtccttgttttccagttgtctaaaggaaattttgcagataaagagcctacaaaaacacccatattacatgtcagaagaatggtatttgacagaggaacaaaagtatttgttcagaagtccactggattttttaccataaaggaagaaaactctcatttaaaaatcatgtgttgcaactgtgtgtcagatttcagaactggaattaacctcccttacattgtgatagaaaaaaataaaaagaataatgtttttgaatattttttactaatccttcacagtactaataaatttgaaatgcgtttgagttttaaactaggctatgagatgaaggatggcctaagggtccttaatggccctttaattttatggaggcatgtcaaagcattcttctttatctcttctcaaactggcaaagttgttagtgtgtcaggtaacttttcctctattcagtgggcaggggagattgaaaatttaggtatggttttattgggactaaaggaatgttgtttatctgaggaagaatgtactcaagagccttcaaaatcagattatgcaatttggaataccaaattttgtgtatattctcttgaaagtcaagaagtattaagtgatatatacattattcctcctgcttacagcagtgtggtgacttatgtacatatttgtgcaactgagatcatcaaaaaccagttaagaatatctctcattgcccttactcgaaagaatcagctgatttcatttcagaatggaactcctaaaaatgtgtgccagcttccatttggagatccttgtgcagttcaacttatggattcaggtggaggaaacctctttttcgttgtatcctttatatccaataatgcttgtgctgtatggaaagagagctttcaggtacaacacttattgtaataataattcagttggtggtctcagaccttttaaacatttgtatagttcatagagttcattctggagtcttattgtctaagtcaattttcagttctgtacatgaaatgataaatattacattgttcttttttcttaaggttatctgagtacaacctgatggtgttttttttgtcttgccattttgagtcataaagcctttgagttgtttggaaatgtgtaaatacatatgtaactagaattatgtatttatttttctattataactttctaatttttattaatatgatagtagatgtgcattttcacttacaataagattattagtgatttgactagatagataagccttcctggaaaattcaaatcagtttttcatctttttatttttatttttttatattttttttgagacagagtctcgctttgtcatccaggttggagtgcagtggcgtgatctcggctcactgcagcctctacctcccaggttcaagcggttctcctgcctcagcctcccgagtagctgggattacaggcatgtgctaccacacctggctaatttttatatttttagtagagatggggttttaccatgttggccaggctggtttcaaactcctggcttcaagtggtccgcctgcctcggcctcccaaagtgctgggattacaggcgtgagtcaccatgcccggccaactttttaaacatttataattatctatttaaatttacttgttgtctctgattcatttctgaaagtgaaatatagagaaattccttgaaatctggagagacaaataattgttctccatagacaagtggtaagcattactttttctaaaaacttactcagagatttttattatgttatattttgaaatgcagaactgacctttgagcaagtattcacttttttaagtttggaaattgttctaaaatattcactggtattgagtgttaagtaacaggtaaaaaggcacagaaaaccaataggaaattagagttttgtaactgggtgtctccaccaataatatttctctgactctgtatttttgggtaatgttgcatcctcctggttgaaaatgtattcagttatgtgatttgaagtgtttatgaattaagacaaattatcattactagttagaaatgtctcttccaaaagtagtacactatacaactttagtttttgtgctacttaggagagaaaagcagatattgccttattttgtgtgccctatccatttaattagaagctcaatgaaaatttttatcattatattatcacctctatgtggaatattgttaaatgttttagaaagtttgaaattcatttttaaatgtgaatcattattgtttgtgtggggggaggaatgtcaagttggaattatgaatcaggctttgccttaccaagtacttttatattaatagggattattttgaatttctgtaatacgtatgtatcctctataatacatagagaatgcaaaaggaaaataatttgaaagctatcctattttatcttgaaagcaatcttttaaaagcgcattatacatttatttgaaagttatttggaattgtctttttccattctcttttcctttaaagaaatggtaggggaaaaacatctggtataccctatagtgttttactgtagtcaaggtaatataatagaaagaacacacgtaccctgggtttgaatcccaactgagccacttaccagtgttaccttaaggaatgtaattcttgtgaactcattttcctcctttatgaaatttgggatcattctgactctgagaggggagaattaagtcaaatgacattgtaaagtgtcttgcacagagcttgacacataggaggaactcagttagtagtagctattactctgttatattactgttagacaaaagccagggctgtcatcagttacttacacttactcaagatcccctattcacctagataaggaaaaaacaattcctttatgtgtcattaattgcaatcgtcactctcttgaagtgggtcccctgcttggaccctgtaaagctttgccactaacatgttacccaaggcaggagactgcatcattccctgtaggtggacctataattgctgcttccctgacccgaagttgtattctagtgcactctctctacaatggaccactatcttttccacacgttacttacctaagtccctactgacttaccccctaaggtgcttcaggaattctgtacttctaacctgctctcaaatgccctgttttaaaagctctggaattcaccctgatatctacaagtaagtgcttcaaagttgcctctaaccctgccactttgggcgtattcaggtcctgcttctatcttggtgttacatttatactcaacttcttaaaaaaaaaaaagggaaatattagtttagggtaaaatattcagttactttaaaaacagaaataaggctgggcacaatggctcatgcctgtaatcccagcatttcagactgccgaggcaggcagatcacttgaagccaggagttcaagagcagcttggccaacatggcgcatgcctgtagtcccagctactcaggaggctgaggcatgagaatggcttgaacctgggaggtggaggttgcagtgagctgagatcgccccgctgcactccagctggttgacagagcaagatctgtctgcaaaaaaaaaaattaatttaaaaaaacagaaataagagctaagaatctagaaataaagtgggagtagaaataattatgccaaaaactcaggttaagagaagtaactacacttgaacaattacctttagttttaacagttaaggcaaaaaagtaaatatgatgggttttacaactgaagggaacatactacaagggaaaagatttttttctaacattaagttctgagaagaatttactgtttgtggtattttgtaaaaggttttgagtaataaggtgaataccttattaaataataaggtgggtctttgatagcagttttcccccaaaatagaaagcaatagaagcagttttcctttgggttggctatggatccatccatccatctattcttttattacctcattccaagaaggaattaagccagcttacaaagataggtaaaatacaaacaagcataaattagagtaaataatgaaaacaaggttagtgttttcccagatcaacacttcataaaagcccgaggcatgatgtttaatgtggtaataggacttgaaacagagctgaatctaaaggaatacatgattaacttttttcttcttaggctttctctcttgggtaggaattgtctctgcaagttttgacaagaatctatgtggcaggcatttcaaaattgaggtcattggccgggtgtagtggcccacgtttgtaatcccagtgctttgggaggccaaggtaggagaattgcttgagacctagagtttgagaccggcctgggcaacatagtgagacccccatctgtacaaaaaattaaaaaattagctgggcgtggtggcatatgcctgtagtcccagctacttgggaggccgaggtgggaagattgttagagcccaggagttcaaggctgtagtgagctgtaattgtgccactgcactccagccagggcaacggaatgggaccctgtctcaaaaaaaaaaaatccatctgtcaataaaattgaggtcattgtcaagtatacctgaagcatagctattggtgtgttgttgatagaggttaatgtattctggtgctgtgctgtctgatatggtagctactatccagatgtagttattcaacttttgaaatgtggctagtctgaattaaaacatgttgtaaatgtcaaccatcaaatttcaaagatgaatagaaatggtaacatctcttaattttttaatgattacattgaattaaaatgacaatattttagatatattgtgttagatatattaaaatttcatctttttactgctaccagaaaatttaaaattatatgccttatatttggggctcacttacctttctattggatggcactattctagagctatagattgcaaatatgtgtgtgtacacatgcatacatacatagttctgtgctgtttgcctgccaaacacattcttattactaatgtcttttcccatagtccattatactccatgatactggtgggagaaagggaggatatgggtttacagaaaagctgtctctctgcacaagtgaagaatcaactttggcaattagccttataggggaagattcatatttgggtatgtgggttgaagagccttactttcattcttgctctaatgtgagctaccttcctgtatcatctagatgatgtatctgtgctgctggaattctgagaaggggttttagattttttgtctcagggaaaagggggatttgatcctcatggtgttagtttaccctgggaccaatcttgaggctttcagctatatgtaccattaagaagttgtcctctattttaaacttgaggtctcaggttctgatataaactgaccaaatcattccgtgaggctaggatggttctggctgtcccacttttaggacccctcacctgtgtacccgatactagctgtattcccctccacacccacatcagggtttaaggttttaagctcatcttgactctattataggttattttccattaagagctcttaaggtgtctactagtactgtctggttacctgacagtactgcagctgtcaggtatgcaacagaatgcaactgaattccttgggtaatttgtctgatcataaatacatatacactaagacttaatgggaatgaaggtcatccttaaattagctgtgcgagagaaggaatcttcactagagtttgactcatgataaatgttagaatttccaaaggttagtcatgaaaagtgttagaacttataaatagattacaataaaattttgatatagaaatcaagaatgtgacagtccctggacaaacctgaataaaatattaaatctaagtaccttgctatttataaagtttttataactcttatatttcctcatcccctaatatctttattttattttagtttttactattttcattactcatttataagattgagttttacaaatgacaactacatgaaacaaaaggacttaatttatttatttcacattcgattttttcttgtctactcctcctataatgctccctttcttttaggttgctgctaaatgggaaaaacttagcttagtactgatagatgactttattggaagtggaactgaacaagtactcctactttttaaggactccttgaactcagactgcctgacttcatttaaaataacggatcttggaaaaataaactattcggtaagttctatttacttattatatggtattttaagaaccattttagaaaatttaagtgctcaaaagctttgacctatcatttaaatattggtggttttatacttaaaattttgaactttaaaaatatatagattgaatcttttaaatatatacattgaatctcctttcaacaaatgttatacaaattgaccatgcttttgatataaatttgaattgtagtacatttggtggtcacttaagtgacagcagtactataaattaactttatttttgcttctgaaaatcacattttataccaataaatataatattggattaaataaggaataaaatgaagcaaaattgctttagtaaaggaagtaacagctcacaatatcttgagatattggacataagggaaattatgcccctgaagtttcagatcaatacaaaatctctctaagcctcagttttttcatttgtaaaattagcataattttaattttctccagttatgggattttaggattttttaaaaagctaatgagagcccaggaattcaaggctgcagtgagctatgattattatgttgcacttcaacctgggtgtcagagcaagacactgtctcttaaataaataaatggaaaaatgtttactctttaaaaagaaagctaaccagctgatactttgtaaagcagtatataaatgttaggtggtagtagtaggaatcataataatttttttctagttacaagaagatgatggggaaaatatatagtttgcctttgtttatttttttttttttggagacagagtcttgctctgtcatgcccaggctggagtgcagtggtgcaatgtcagctcactgcaacctccgccccctgggttcaaacgattctcctgcctcagcctcccaagtagctgggattacaggtgcgcgccactatgcctggctaattttttgtatttttagtagagacagggtttcaccatgttgtgggcaggctggtctggaactcctgacctcaggtgatctgcccaccttggcctcccaaagtgctgggattacaggcgtgagccactgcatctggcctatagtttgccttttataaaatagtgtgtattttatacacactagggaaactgttctgactggatatactttaattgtattttgttagttttgtgaattttcaattgttgcaaaatttcagtcttagtgtatttatttatttatttatttattagagtgaaccatcagattgcaatgaagatgacttatttgaagacaaacaagagaatcgttacctggtggttccacctctagaaacaggactgaaagttagtgtctgtttgcttcttttgcttttcgattagtgttattctaaatgaaggaaagaacattgaaagaaaggtccttaaagtataagcaacttggtgcttgggtaaaaatggtatttcaaaggatctttatctttttggcacctctgtacaaatattatgatactacttataaatgtatcatctaaacataccttttttgtagtaagactatatagatttaataagcctcatgagacaaaatagaagcagctcacttttgaaaacacattctttctgggatcagtataccacagtatctttttagagtagcagcgaatatgataaatcataatgcattccagacatgaacagtttactctcatattttccataaaaagctccacaaaagagtttttattttttttcccaaatgtaccaaggtaatgaacattccctgtaaaatactgaggctttgcaaagaaatgtcaaaacaaaacaaaataaaaaaaacctaatgattgtctgtgattccactattttgcaataaccaattttaacactttgccctgtatattcttgcagatttttaaatgaatatacgcattacatagaaatgtgattataagatgtatgttcttttgtaagctgccttttttgtttatagcattttcaaatatacagaaacattccaggaatacagtgattatctctgtatccccaatacattcaattcttgttacttttaaaaatcttattggcctcatgtgtttgtgtttgtgtgtgtatgtgtgtatatatttttgtagaaccatttaaaagttgcacatgttatatttcactcataggtatttcagcaggaatctcctaaaaataaggatattctcctcatgcaactataataccattatcaaagttagaaaattgttaatgatcccttaatcttatttgctatcttgtccatattcaaatatatttagttatcacaaaaatgtttttataactgttttttccaggatccaatctatcaaagtttttactcgcatttgattatatctcttattggtctttttatgtagaataattcccccttcccccttttaaaaattatgctaaagaggaggccacgctagttgtatcctctcttttggatttgtctcttttcttgctgtgttattgaactttttcttctttgcctagggttggaaaactttttctggaaagggccaggtggtaaatatttatactttgcaggttgttttaaaattattttgcaactatttcattattagagtgagttcactttaataaatgcttattgaacacatattagacatgaatttgaacaatagataaacatcataacagacagaaccatgaatgaagacattgatctattcaaaatttttgtaccctgaacaaagtaaatgtaataagacaaattgtgaaaaaagaaattgtaatacctgacaaaatattaattttcttaatataaaagtacattcttctatagtatttttgtgaatgtatagtgagtgacccaaccttctcagaggaaaagttattatagttgctaaaatatgaattacttatgtctttttactcttgcagtttcacttctagaaatctcttctaaggatgaagatgattttacaagaatgtttatgtagtatttataaactacaatattggtccaaatctaaacatacatcattaggagtatgataagtaaattgtgatgtgcctgaactatggaatactatgtagctgtcaaaaagaatagtgtatatttttatactgatttagaaatgatgccaaagtactttaatttatgaaagcatgactttatgaaaggcttaatttatgaagcaggaccaactctcctgattaaaactgaaaatgatagatgaagtctcctttaaaaacattcttagaagcttcaaaaagctgacactctaagaataaattatcaaatcaaactttcaaggctggaacccagagagataaggagaacactgatgctacttttgccctgggagcatgtgtattgaacttaaattggtggtgccccaggcatctgacagaaacaaacagaaaatcctgtctggaaacacacattcatcctagccctcataaatctcacaagtaatttttcaaagaaaatgagctgtccacagaataactaagcacataaagaaaaaaggcatcgtgagtaattattcacagaaaataaccaaacagcatctctttcaagcaaaaacacactgaaataaaaaactcaatagatgactttaagagttaaagagatgaaagagatacagagcaaattagtgaccccgaatatatgagaaaaattatccaaaatgtagcacagagacagggaaaatatgaaaggctttaaacaacattaagggaaggaagggaggaatggaggtggtggataagagatagttgaatatccattttgtttcaagtatccatattttaacagtagctttcaatgtaggtaataaagttctaaatgctggaaggccttttagagatgaacaagcctacctttgcaccattttgcacatgacgtaacaaatagccagaaaggttacgtgacttgcagagctagaactagagtccatttcactgttctttctcccctgaaatttgtattctaatcagttactggaaggggagatggggagaccaggaccttagagaatcttgtacacatgtacacagatgttcatagcagcattgtttataacactgcacaactgagcataacccaaatacccatcaattggagagtggagaagtaaatcgtgggtagtcatatgatggaatactgtaaagcaacggaaggaatgaactacagctactagtgataacatgggcaactctaaagcctgatacatgcagagtgattccatttataaaaggttcagaagcaaaacacacaaaaaacttaaaatactccttaagaattcatacaaaggttgtaaaatttgaagacaggcaaggaaattatcttaaaaggccagggtagtattgactccaggggagaaagggcaattatgattgtggagggcccctgggcagctcctggaatgctactttttgatttgagtggaattacatgggtgtcggcttcattattagtctgtaaaatgttattttgtactgtgcattcttctgcacgtatgatagagatcacaataatgaacaaaaaagcaaggttcagtgtcgtgcagtacgatatgctcctgtatttggttttgggtgggtttttgtttgtgcaaaggaaaaagcattccttaatatgcacatggaaaagttctgggaaggtacacaatctattggttttgcaaacgggattgggcatctaggaagagaaggtgaggtgtactttcacattgtttaaatttcttaccatgtgtctaatttatttttgtagttttatagcaaaacttcacagccaagattatttaactactctactcaatcactatattgtcctggagtaaggggcatgttaaggaggaaggaagagtgaacactgacaattttcgagggtgcatttcaatctgcccacatagttttttcttctactccccacccctccagtagctcagttgtggctacatacctttgatgggtacatctgcctccccctgtcacgaattactgagtgatggagtgtgaatcatgtgcatcccacagaactaggtcaacataagaagttttaaaatattagctagacactttacatactttgtgcaataaggtaacatataggaataattcagtcttcactctccagtttctatttgttgattaaaataaaaagaatttacttgctttgaaatgtaatttaaaagaaaagaatcccaaataatgatgcattttgttgcataaatctagaaaaatatgttttattaaaagccagatgaatacttaaacagcctcagatatccacctgaaatgaaacaacttctatcagttcaatgacatgactctttaaattttcagtagcaaactatattctgtgaatgttttatccttagtgctgaaatctagttatctggtatcataaaaggaatggattgctgtatgcccagttcagagccaaattgttatttttttcagtagttttcagtagactctagcactgagtttattagcacaaaaataaacatagtttgggggctgttataattttaattttatttaaaaattttgctatgaaggttacatgaacagaaaatttcgagcagtatctgattaaaagtgatattttctattcattatgctgtctttgcttatgtggatgccttgtttttgaagcagaaactatttcaaaaagaaaaagttattttgtgtggggtgagtgtatttgtaggccttgatttttatttacattgattcgaagttacttaataactcactagtgaaacatgctaatatattgccactctctcaatttgatacataagctctatgttgcagttattttttatattttcttttgaaagaagatacattttttaaacttagagacttaaaatctataaacaaaactgttttgctctgagaagtattttattttctatagaaaaatgaattgataagcacatttggagaaagtatttcctgaattattggtatgtctggtttcatttgaaatcatgtttcttgccactatttttctttctactttacaggtttgtttttcttcttttcgggaattacggcagcatctgttgcttaaggaaaaaattatttcaaaatcttacaaagctttaataaacctagttcaaggaaaagatgataatacgtcaagtgcagaggaggtaaaagtaatcatgtgaccattttatcattttatgaattgaaaatctataagctattgaaaagttatttaaattggaatattagaatatattagaaaatgctgctcagtggatcaagaagaaaagtagcagaggttataatggtggacttttatgacattgaaaaatatttgattaaggagccaatattttatcaatttataggtaattctgtagcatattaaaatttcagttatcaggaaccttggggaacaagtccttttgtttacagatttaaccattaaacttttttatttgtattgtttggatagaaattactcataagtgaattatgtatttactgacttaaatagaatatactgagtattatttaactttgtattggtgatgagataattttattattaggataatgattgttcttttagtctgttggattgtttgtttctaaggttattttttcctctagcaaatgttcctacactgctatgggtttttttagtccttctatctgcttttcataattttactctctttttccttgtggctgatcatcataagatcctcctcagggccgggcgtggtggctcatgcctgtaatcccagcactttgggaggccgagacgggcggatcacgaggtcaagagattgagacagtcctggccaacatggtgagaccctgtctctactaaaaatacaaaaattagctgggcatggtggctcgtgcctgtaatcccagctacttgggaggttgaggtaggagaataacttgaacctgggaggcggaggttgcagtgagctgagatcgcgccattgcactccagcctgggtgacaagagcgaaactccgtctcaaaaaaaaaaaaaaagaacctccttgggtctcttatgtggtaacttatgtcagtacattaatgtaggaagttagcaaaaactgctgaaacttcataaaaataatatttatgcacattaatttcatacagagaaaggcacagcacagcaacactatagtaaatcagtaagagctgaactaatgttgcattttattccctcaagtcactgtagtgcctagctctgacttccttctggattgaccattcttgtcatgggctatgctttgtgtttgtatttcagtcttagccatgtaagggtttgggtccaaaatatgatcttgttaatgtaataaaacgtaacaaaaaaacattgtgttgcatttctatattactgttctaatttcctgggaaacctcatgaaagtcattgttaaaattgtttcaccatttcctttcctcacctcaatgattttgccaattttagaaaggggaagggttgtttagaaattaatatattgaaaccactatgtgcaaggccccatttttggctctttacattgttagttttaaaagcaaacctggcggcaggtagtaaaaatttccccaggtttcagatgaatagcctgcttcagaactcgcagctactggcagtagtgtcagattcctgggaacatatttagtctcctattgagtgaatgcctctatctttagtaattaccacatggagaggcagtatagggtaatagttaaggaagagcatgggctctggaacgagttggcttcagttcaaatcccagccttgctacttgctaactgtgtgaccctgggcaagttacataacttccctgtacctcatttttctaatctgtaaaatgtagatgataataccacagacctagggcactagggttattgtgtgggttaaatgaattgatacacaaatggcatttggaacagtgcctggcataaagtaaacactcaatagatgttgtatattattattatcgttactattattcttattactactctttcgaatgttatatatccacatgtgtgtggaaatgaatatggcttggactttaagaataaaattttagcaataagctataagtagtctaaagatagtttaatcagttttattcatacaaaagtttacagttataggcttagtgcaagtcactgataaaatacagactggattattttcagtataactggggtacatattatcagacttttttttttcaaaatggactccaggtttacctcccttttggctctttgttggataccccatcttgccataccccagtcatgccatgcctcttgatctgaatagatagggaattttatatattttatacatttcattttagtaaattgtgtataatctataatatgatatgttatttgtttttaaatgtttgggccataagccctagccaaaagcacacttaacttttttttttttttagttttgctacagacggtacgtattttataatcagttatttaaacttttttttttagaaggaatgtcttgttcctctttgtggtgaagaagaaaattctgtccatatcttagatgaaaagttatcagacaattttcaagattcagaacagctagtagagaagatatggtatcgtgtaatagatgatagcttggttgttggagtgaaaactacatcttctttgaagctgtaagtaaattccaacatgataacactgtcttgatgctccagaacagtactgtccaatagaaattaatgtaagccacgtgcaattttaaatgttctagaggccatatttaaaaatgtaaatagaagcaagggaaattattattactgttttttttgagacagagtctcactctgttgcccaggatggagtgcagtgggatgatctcggctcactgcaacctccacctcctgggatcaagcaattcttatgcctcagcatccccagtagctgggattacaggcacgcaccatcatgcccggctagtttttgtatttttagtagacacggagttttgccgtgttggccaggttggtctcaaactcctgacctcaagtgatccacccaccttggcctcccaaaatgctgggactacaggcatgagccaccatgcctggccattttaatgatatgttttatttaacccaatatatccaaaacattattttaacatgtaattagtataaaaattattaataagatattttgcatttattttttcatacaaagttttaaaaatttggtgtgtattttacatgtataacacatcacaattccaactagccacatttctagtgcttaatagccacatgtatctaatagctactctcttggccagcacagctctagaagtatctcttttacacaaatgcattgagttaataatatgaagaggatgaggtttatgaaattaagatgctatagtctcacggtgaagataatcaaacagcatacagaactttctaatcaaaatatttagaggtattagggatacttagagactattgaccaaagtgaataggtaaaaatttcgttaaataacaaagtatctctccctctgataacagacgatattctcttttgggatgttgaaatcatggatagagaagtattgtgcatgccatctatatctgcagtctaacaaagagctttttagccaaaacaggctaaatacaggcattacagtaactacattgaatttgaaccacgggtacgcagagaaaccaggtagtgccttgtaataggtgatggcagtatatttgagcagcttaacacagtaagggagccagactacttatctagtgggtttgagatatggatttattgttttgtttcagtgaatttctaagctgttttgggctggttgatcatctgggtttttcttctctcttctttaatgtggtactctatattaatcaattttgtcttataaaatcagtcttgcattcttgtgataaacagtttgtcactggatttggtttgctatcctttggtcaagaatatttgcatctaaattcatgagtgaaattggcttgaaattttcttgaatgatacttgcctgattttagtatcaaggctatactagtttataaatgaattgaggaatatttccttttttcctgttctctggagcagtttgtgtaaatttggaattacctattgcgggatctggccagcagcccgcaatgcaacggggctctctctttgttcctaggcagatcggcaggttgagaaataacacacacacacaagatagtgaaagctgggtccgggggggtcactgctttctggtcccacactgccaacaatgcactggatataccagcatttattattaaggttagtgagggcgggggtaggttagtgagggatttagggtcgtttgattatgaggtgagatggtcacgtggggatgaagtaattctttaacataacatttgtatgtagaagtacagtacatttttgtatgtagaagtacagtatacagagataagaatttacaatatagtgtgtgtgtcagtaatttctaacagagccttaaaacagaaacacaatctttcgataacctatgattagcaagatattaatcagcagtaacaattgcaacaaaagctggttactaacaatccatggaaacaggacgtgaagctagacaaccggttagaccagaaattctcagaagggagtatgccttaaccctaaagaggcctagaagagccgtggcaagatgagggtgtttatagccctatcttatccatatggacaggcgccccctgtgcgtccatttataggctctctacaagggtcgcattccattcccagagctatgaacatctgcttttctgggataggaatcttggtgatgtgaaacctccctgactgcacgtccattcataggctctctggagggggaagcacatcacgcgctgttggctcgttctggcagtccaacctggcattgtctttatgcaatcctgcatgcaattttgtatttacaataatcaggagcatttcatcttttattccatagcaatagtttcagggggtctccctacaattacctactctttgatatttggttgtagtcgcctggaatgcagtagaaatctggcatttctttgtgaggtgacttttaactactgattcaatttctttaatagttacaggattattcacatttttatttattcttgaatacattttgcttatatttttctattaattattacatttattagcataagttgttcctaagatcctctttagatatttatcactgtgttgttagtgtttgtcagtgtctttttattccaaatcttatttgtgtcttctttttccttgatcttgccagagtttcatccattttattagatcttttcaaataattaaattttttgttgatcttcaattgtgtattccctgttcatttctgatcccttattatttccttttactttatttggatgtattctgttattctttttctaaatatttgacaatgacatgattaagtgcagatttctttttttttttttcctcctttagattgttgagcttcctcaaactgttttgttttcttctggcaattcaaacaattcttagttcttaattctcaagatactgatgcttccttactttctctagtatctgtctccttctggaacttcagttagtcctctgttagatcttctcattccatactctatgtctcaacatctctttcatattttctattcacctggataatttcttctgatctatattcttttcactaattttatcttcagttctttctagtcagctatttaatccagtcattgagtttctaagttttattattatttgtattatcataaattttattctttcttttttagatctgcctggtaattttttattctctattttctgtcttttctttttttcatatgctaaatagaattacttaaaaatgtttttatatatagaacatttgaaacatacaaggagaatagtgtggtgaactcttctgcccgtcactctgctccagtaattatcaactcattgctaatcttgtttcatctatacctccatgcactcctcacccccatcccccagattattttgaagcactcaaaggcattatattatttcatctgtaacaattccagtgtatgtatctaaaaaataagaacttatataattacccccccaaaattatcagtaattcccccagtaaatggtcaaatttcccatttctgaatttaaaaatattttttcaaatcgtgagccagataaggactgtaaattggacttgactgttatctctaagtcctttgtaatctgtaggtatcctttttctgtcttttttttttttcatgcaaagtatattttatagaagccaggcagtttaccctgtgaagttctatagactggattttgctgattacttcctgtgatattgcttaacatgtttctctgtctcctgtatttcctctaaattgatggttagatctagagactgggtcagaataatgcctgaatttttgttaacagaatacttaatagtattgttttcttccactgggaggtatgtaaagtgtgatcagtttcattttgtgatattagcagctattgatgctcattacttagttccattgtttcattagattttataacatggtggtattctaattctattactgcttctttatttattagctggaatacttctataaagagaaacctcttctcatcaattatttagttagaccctcaagtatagtttgtaatttagaaatcagaatttgagtgcaagaggtgcttatttatcctcagtgggttgttgtttctgggcctttttagtaagcagaggtaggaaatatgtgttttgttagtttggtctgttgtggttttggtaagtccatgctgatacgtccaattcagattaaggacttcaggtttttacttatcaccatgatgtaaaaacttcaaggtttttacttaacatcatgatgtatcttctttctgtatcttctgtctccgctattgataatcccaattctctgttgcacctactacataattactctacagtatatatgtagtgttcataaaacagcattcccaacaaaacaatagttcaattagtgcaaattaagatttttgagttctttttaaatctttagtgtaactcattagacatatggtcaaattcctgtattaaaggagttttcagtattaaatttctacattcaagttctttctttggtcatgtcaccattcttacctgttttacttgataaactttgacaatgctggaatgtgctacagtaagcctgtatatatttgtaaattattataaatgtagatatggaaagaattgctgagggatgaacaatattctgactgaaaaagattttattcaagtcgtttagaggaacgaaaaatacaatttttagtttagagctgtttgcattctaacgtatcaccaaaataaactcttaaaaaataatgaggaggttttttcttgtttaaaaagaggagaaaaaaaagaccaacctgaaagataaaatcctggcattattttgccattcctttatcttaaaaaaatttttgtcttactttaatttctcttactatcattcctaataccattcctctatcttaaaaattttactttcctaaaacctagcatagttacagtgtttttgcttgccttttgagaagtgctatcacaggacctttaaaaatgtgtttggcttttactcttaactttttgatatattttacatttgaaatgatgttttctaggaaaggaaagaataaacattttttactgttgtttgtatgacatttaatcatcaatttgattttaaagaatgagcttttagattaaaccaaagtctgggttttttacaggtccctgaatgatgtgactttatcattgttaatggatcaagcccatgactccagatttcggcttctaaagtgtcaaaatagggtgattaagttgagtacaaatcctttcccagcaccatacttgatgccatgtgaaataggattggaagcaaaaagggtcacgttgacccctgatagcaagaaagaggaaagctttgtttgtgaacacccatctaagaaagagtgtgtacagataattactgctgtaacatctctttcaccacttttaacattcagtaaattttgttgcactgtactgctacaaattatggagagagaaagtggtaactgtcctaaagatcgttatgttgtgtgtggcagagtttttttaagtctagaagatctttcaactgggaagtacctactgacatttccaaagaagaaacctataggtaattttgttggcacttttagattatatatttaattgaattagaaaattttaagaattctgtttatctgataatgggcagagtttaatgatagagcttgtgactttttttgtagagcacatggaagatctttttgcacttcttgcagcattccataaatcttgttttcaaatcacatcacccggctatgccctgaattcaatgaaggtgtggctcttagaacatatgaaatgtgaaataatcaaagaatttccagaagtgtacttttgtgaaagaccgggaagtttctatgggacactcttcacttggaaacagagaacaccattcgaagggattttaataatctattccaggtaatgcatattaaattgtaattggtccagagaagtgagtgtgtatgagtgtgatcaatgtgtggttcaacagcgatccgcatgtgttttgtattattgccatggcaataatacagagccatggcctagcatgaatgaacgcatcggcttcatttagaaactgaagatctctgttttaattttatatttgtttttggctttttttagtgcctagtaattattttgagatttcccgttacctctcctccacagtaaaatttaaaaaaatattatattgaccttattactcagcaaaaaaaattttaattggaaacaatctgattaatattaactgattcgatatggaatatgtatatttgattgctgtagtctgaattttatcaatgctcacgtacataattggttctgtttatcattatggtgtttataaatgaatattaattgattactgcagtatattgtacatgactgctttgtgctgtcctaatttttgtaatattttgtttgtttttttattttaggaatcaaacagttatgttccagtgccttcataatctcatcagaattctccctataaactgtttcctcaaaaatctaaaatcaggaagtgagaatttcctaattgataatatggcatttactttggagaaggaactagtcacccttagttctctttcttctgccatagctaaacatgaaagcaattttatgcagaggtgtgaagtgagcaaaggaaagagtagtgtcgtcgcggctgctttatcagacagaagggaaaatatccatccctacagaaaagaacttcagagagaaaagaagaaaatgttgcaaacgaacctaaaagtgagtggtgccctttacagagaaataactttgaaagtagctgaggttcagttgaaatcagactttgctgcacagaaactgagtaatttataattataatttcaatttgatcatattttaaaatatgttttcaccaccatataagattttggttctacttgctatatgcctcctttgtaaaaataaacaccgaggcttactgtagtagaaactttagttttgatgatgcacaaaataaacagcagtggttctc

SEQ ID NO: 722 - DNA, 14714 bp, Homo sapiens
aacttccaaagcccgaagcggtctcatttcccgccggccccccattcgggtccgggttttagttcctcggggagcccctggtgccccggatacggctgattttgtcgtgtgggacctgttctggctgctccagccccaggaaggacccaggacacccggaagccggaaatggtgagcgtgcggagccgggcgtccggagacctgaggaggagctggtcggaaccggcagtggctggacctgggcctccccgcggcgactgtgggggtctgggacccgagtcccccaggcgcagctcgacccttggtcccctcggtcgccgggtggagctggaccagccgccgggaccccgggtgtcctgtcccggccccggagccctctcagggcagctccgcgcccgcagccccgcgtctccccagatcgtgcgggggcctcaggagggtcttagggggaatcccgcctcgggtgtggggttcgtgcgggaggagccgtggcctgtggggtccccagttcctcctcccttaggcggtccccgtttccttcggagtcttccaaaggtgtgggaagctgggtttcaaacccacgaccccgtcccccagcttcgctcctcccagggctgcagtaaatccctaaatttccccgcattccccaaccctaagttctccctccagtacatccacttcacattattattattatcattatttctattatttttgagacggagtctcactctgtcgcccaggctggagtgcagtggcactgtctgggctcactgcagcctccgtcttccgggttcaagtgattctcctgcctcagcctcctgagtagctggaattacaggtgcccgccaccacgtccggctaacttgtattttcagtagagacaggttcaccatgttggccgtgctgaagtcctgatctcaggtatctgcctgcctcggtctcccaaagtgctgggattacaggcttgagccactgcgcctggcaagacccagtgttttaactgtcatcttttccaaggagccctagatggcacttcttaaaaagttcattttccgtttgtgaacatttcacatgcgagcaaagcagaaaataaccccctgacactccgatgttaaaaaaaaaaaatcactgtgcctgccctctttttaccttccctaggcgcggccaccttatcagacagtctttgggtggaggcttctcttgggaacttcacagggtattgggtcctcagcccaccctcctatctttctggtcctgggtttcaggaccgtccagggacttcttccagctgccctcggaagaacgggtgaaaagtctgtcctggcgtggttaatctttcctggttgtttgatgagcctcctagggaggagttcttgtcttttgaaaagaagtttccttaggaaattccagagggattccctgctggcccttgggggtggggtggggccagaaacagtagaaagaaacttctcccttctgaggcagctcagggtggcatgcagtggcacagtcatggcttactacggcctcaacctctggggcccaagcaatcctcctgcctcagtcttccaagaagctgggaccacaggcatgcgccacgcccggctagtttttattttttgtagagacaaggtctcactatgttgcccagtctgctctggaagtcaaaagcgattctcctgcccaggtggctcacgcctgtaattccagcactttgggaggctggggcgggaagatctcttgagcccagaagtttgagaccatcctgggcaaagtggcgagaccccatttctacaacaaatacaaaaattagccgggtatggtggcgcatgcctgtagtctcagctactcaggagactgaggtgggagagccacctgaacccggggaggttgagactgccgttagctgtgattgcgccactgcactgaacgacagagtgagaccctgtctttaaaaaaaaaaaaggaaatcttccattatggctgcagaatatgaatacattcccacaaaaaaaaggcatggtaggtcgggcgcgatggctcacgcctgtaatcccaacactttgggaggcagaggcaggcagatcacgaggtcaggagatcgagaccatcctggctaacacggggaaaccccgtctctactaaaaatacaaaaaaattagccaggcgtggtggcgagcgcctgtagtcccagatattctggaggctgaggcaggagaatggcgtgaatccgggaggcggagcttgcagtgagctggagatcgcgccactgcactccagcctgcgcgacagagcgagactccatctcaaaaaatacataataaaaaaaggcatggtagataagcagaaattagtgatttacaaagattcaccagcacatcagctcctctcctttgcaggttggggaatttgtgatggtggataactctgttctgttttgtgttatctggatttgacagattaacgctgaatcctttgggataagtttggcaacatctagaagtagtcagatatgatcttttgtttactgaatagtttattatggaaaaaatactgaatgacatctgaaagtgatagatactcatctcttttcctaaggatactaatctgtactcctaggtctctctcatgatctcatgtaatcccagttatttcccagagttgctgcccgtaatattaataccatcaccttaggtgttaggattttttttttttttttgagacagagtcttgctctgtcgcccaggctggagtgcagtggcgcgatctcggctcactgcaagctccgcctcccgggttcacgccattctcctgcctctgcctcccgagtagctgggactacaggtgcccgccattacgcccggctaattttttgtatttttagtagagacggggtttcaccgtgttagccaggatggtctcgatctcctgacctcgtgatccgcccgcctcggcctcccaaagtgctgggattacaggcgtgagcccccgtgcccggcagatatttttcaacgtatgctttttacatcataatcattttattcacgagacattttcagacttcaagaaaaatttcagtaggctttgttcttttctaaaaattgacttcaacggcttgtaacagcaattcaagatgaactgagggcaggaacactggcaaacacctgtaattctaggtacttgagaggctgaggcgggagaatcgatttagcccaggagttcaagtccagcctgggcaatatagtgagacccccatcttaaaaaatgtgtgtgtgtatatatatatatatataaattatatgtatgattatatatatatttataagttgtatgattatatatatttataaattttatgtatgattatatatatatttataaatttatttattttatttttttactttcgagacaaagtcttgccctgttgcccaggctggagtgcaatggtacaatcttggctcactacaacctccgctaaagtgattctcctgcctcagccctcccccacgcccggtagctgaacccggtagctgaatcctgagtagctgggattacaggtgccctccaccacacctagctaattttttttagctttagtagagacagggtttcgccatgttggccaggctggtctcgaactcctgacctcatggtcctcctgcgtcggcctcccatagtgttgggattacaggcgtgaaccatcacattcagccctatatgcattttagaacgggctttttttttggcggggggggtctctgttgcccaggctggagtgcggtggcacgatctcagctcattgcaacctctgcctcccaggttcaaacgattttcctgcctcagcctcccaagtacctgggattacaggcacctgccaccacgcccagccaattttttgtatttttagtagacacggggtttcaacatgttggctaggccagtctgaaactcctgagctcaggcaatcctcccacttcgacctcccaaagtgttgggattataggcatgagccactgtgactggctggtatttttatttctgaaaaaagaaaacaaaacaaaaaaaaccagacatgggattttgatagggattgtattgaatttgcagatcattttgggtagtagtaccttccaaataatgtaaagtcttttttttttctttgacacagagtcttgctctatcacccagactggaatgcagtggcacggtcttgactcactgcaacctccacttcctggtttcaagccattctcctgcctcagccttctgagtagctgggactacaagcgcatgccaccacgcctggctaatttttttttttgtattcttagtagagatgggattttaccatgttggccaggctggtctcaaactcctgacctcaggtgatttgcctgccttggcctcccaaagtggtgggattacagatatgagccaatgtgctggctttttttttttttttttttgaattggagtcttgctctgtcgccgaggctggggttcagtggcatgatctcggctcactgcaacctccaccttctgggttcaagcagttcttctgtctcagtctccggagtagctgggattacaggcacgtgccaccacacctggctaatttttgtattttcagtagagacagggtttcatcatgttagccaggctggtcttgaactcctgaccttgtaatccacccacctcggcctcccaaagtgctagggttgcaggcatgagccaccgcacctggccaaataatgtaaagtcttcgaacacatgaacacaagatatttttcaatttgtctttaatttcattcagcaacattttgttgtttttagtgtacaagtagtctttcgacttcttggttttgtaatttctaagcgttcaattctttttttttttttttttttttttgagacagagtctcactctgtcgcccagtctgggctatttggtgtcctgggttttatatttgttgaggctttttaaattattattattattattattattttgagatggagtcttgctttgttgcccaggatggagtgcagtggtgcgatctcagctcactgcaacctctgtctcctgagttcaagcgattctcctgcctcagcctcccaagtagttgggattacaggtgcctgccaccgcgcccgactaatttttgtatttttagtagagacggggtttcaccatcttggccaggctggtcttgaactcctaaccttttgatccacctgcctttgcctcccaaagtgctgggattacagatgtgagtcaccgcgcctggcctattcaattctttttggtgctattgtttgtggtattgttttcttaatttctttttcacattattcagttttggtgcatataaatgtagctgacttttttggtcttgagacagtctacctctgttgcccagactggagtacaatggtgtgatctcagctcactgcaacctctgcctcctgggttcaagtgattctcctgccttagcctctcgagtagctgggactacaggtgtgggctaccacacctggctgattgtgtatttttagtagagatggggtttcaccatgctggtcaggctggtcttgaacttctcacctcaagtgatctactcgcctcgacctcccgaagtgctgggattacaggcgtgagccaccgcacccagccccattgtttttcatatttgaaccatccttgcattttgcggataaatctctcttgatgatgtcatataatcctttaaatatgctgtcaggtatgatttgctagcatttatttgaggattttttgcattgatattcataaagggcatttgtagttttgttttttgtagtgtctgtctttggtgtcagcataattttgacctcatagagggagtttggaaatgtcccctcttcagttttggaagagtttgaggaggattgatagcaattcttttttaaatttttggtggatttcagcagtgaaactatttggtgtcctgggttttgtattcgttgaggtttttaaaattattattattattattttgagatggagtctcgttttgtcgcccaggatggagtgcagtggcgccatctcggctcactgcaacctctgcctcccaggttcatgccattgtcctgcctcaacctccccagtagctgggactacaggtgcctgcctccatgccagcctacttttttgcgtttttagtagagacggggtttcaccgtgttagccaggatggtctcaatttcctgaccttgtgatccaccctcctctgcctcccaaagtgctgaggttacaggcatgagccaccgcgcccagccaatttattatttttcttaatttattttatttttttgagatggagtttcactcttgttgcccaggctggagtgtaatggcatgatctcggctcactgcaacctccgcctcccgggttcatgggattctcctgcctctgcctcccaagtagctgggattaccggcgtccaccaccatgcccaggtaattttttgtatttttagtagagacggagtttcaccatgttggctagcctgtctcgaactcctgacttaaggggatccacccaccttggcctcccaaagtgctgggattacaggcatgagccaccgtgcctggctattttttttttattactatgccaatctcctgctactacagctctgttcagattttttgttttttcatgactcagtcttggtatattgtgtatgtgtagacatttgtccacgtaatcagttatataatttactgaagtattctaaaggacttctgaaattaagcctgagttgtacagttttttgtcctctgctgtatgtatgtattctgctgctgttgctgtgagtgtaaggggtgaggtgaggggaatcattctattgacctatgacttagcctcatttaaagataataggccgggcacagtggcttatgcgtgtagtcccagcactttcagaggcgaaggtgggcagatcgctttagcccaggagtttgagaggagcctgggcaacacagggagagcctatctctacaaaaaatacaaaaattagctgggtgtggtggtgcccacctgtagtagggaacaaggtgggatgatcacttgagcctgggaggttaagactgcaggggccatgattgtaccactgcactctagtctggacaacagagtgagatcctatctcaaaaaatattatatcaatctttatttatttatttatttggagacaaagtgtcactctgtcacccaggctggagtgcagtaacacaatcctagctcactgcaaccttgaattcctgggctcaagcaatcctcctgccttaacttcccaagtagctaggaccacagacacctgctaacataccctgctaatgtttttaaaaaatttttctagaggtggctataacttttaatttttttgttttttgaggtggagtcttgctctgttgcccaggcccaccatgccaggctaatttttctatttttaatagagaccagttttcactatgtaggccaggctggtctttaactcctgacctcaagtggtccaccctactactctacatgcctgctctgttattaaccaagttttcatatgaatactggcccattgaagactcttctttttccttgatctatttgtttatctctctgctaatagtatgctgtcctgaatgtgatggtttggaaatctttggtgttaggtaagccatccacctgctattcagaaggctttgacaattattagatgttaattcctgcacaccaggtggtgggaggtttggaaaagtagcttttgtttacctaaaatgtctgttttggggatttttttttttttttgagacggcgtctcgctctgttgcccaggctggagtgcagtggcatgatctcagctgactgtaatctccgcttcctgggttcaagtgattcttctgtctcagcctcccaaatagctgggactacaggcatgcgccatcacgcctggctaattttttgtatttttagtagagatggggtttcaccatgttggccaggctggtctcaaactcctgtcctcaagtgatccacctgcctcggcctcccaaagtgctgggattacaggtgtgagtcaccacacccagctgtattgggtatttatgaaattttgtaaggatatcatttggaagaagggacatcttattgagttttttctaggaacacatgttatctttccacttactccatactgctttgacattacctgacagaaattttaaaattcttccattaggacaattaaatattgatcatgaatcttatttactacttgattaaatttggtctagagtaaactgcttgcaagcttcaggatattctctcttggtataaccacatgggatgagctcagttccccaggggacaagttgtgacaacacgtgtgacatattgtctcccaggaaagctcattaaagactctgtgcccagagtgtttttctggggctagtgccctaggcaccacttctagtttggaacaaaagagtaggctttcagaaggaaaacagttcagtcagtaccatcctgtttgtcaataccataaaccgtttagccacagtaagccactttgtcacttaagttgatgggatccctctcgtagtctaagttgaccccgatagtagcaaaggtcgaacttggtaaacaggcctttctaaggatacccagactcaggactgctgaaatgagcgctgtctgcacaccaggtggtgggagtttgttgtgacaggtactagagattcactctgcaaagagcatttggggcaacgcagcagcacaactgactccctggacccaccacagagagggtggtcctcctctgtggctggctctctgagtaggtcagttctcacactggaactgctgcgagggaggaagtgcgtgtagataggaggaggccgatgactcaatcatggagtgagtgtttggagagcccggcgtcatgggatcactcatgtattgagtagagatccccagtgctgagtctcacccctcctcctccacacctgtgggatgtttcaggactcagtggcctttgaggatgtggctgtgaacttcacccaggaggagtgggctttgctgagtccttcccagaagaatctctacagagatgtgacgctggaaaccttcaggaacctggcctcggtcggtaagaaggacatttccttccttagtcaattagaagacaagtgtgttttggtcaccagtgtggttgcacagtttggaatgtggaaagagaatacgttggtgaataaatggggcatcgtgggccaggtacagtggcttacccttgtaatcctagtgctttgggaagccacggtgggaagattgcttgcgtccaggagtttgagaccagcctgggcaacatgatgagaccctgtctctttaaaaaaaaaaaaaaaaagtggggggtgggcaattgtggcagctcatgcctataatcccagcactttgggataatgttgagataatgttgagaaatgcagaagtattgctgggtgtgatggctcctgcctgtaatcccagcactttgggaggctgaggcaggtggatcacctgaggtcaagagtttgagaccagcctggtcaacatggcgaaacctcatctctactaaaaatacaaaattagctgggtgtggtagtgcatacctgtaatcccagctactcgggaggctgaggcaggagaatcactagaactcaggaggcggaggctgcagtgagcagagattgcatcactgcactccagcctgggtggcagagtgagactttgtctccaaaaaaaaaaaaaaatcaggcattgtggcagtgtttaatgaacttagaacctagtgatttttctgtaattttaaataattcataataatttctctgggtctacattttaggaatccaatggaaagaccaggacattgagaatctgtaccaaaacctggggattaagctaaggtaatctccactcacaagaggaagcagtgtctcttgagggaatcttagtaggtcaggaaaatttttaaaaaaatacaagacaaataagtacaatgttaggtttttaactgattattagaagattgctaccaaaaatctatccttcaatgtaatgtagatgttgagtgtctggacagggtactaagaatctgtgacatggatgtcactgtttggataactgctatggggagctgggtagcagaatcatcaatacacttcctttctaataattctgacccaggagaaaacctccacttttcctgattttggtagcagcataagtcttaagacatgtcaattagtagaaaagcattaataaaccaagcattgataatgcgtttgtcatttttcatagaagtctggtggagagactctgtggacgtaaagaagggaatgaacacagagaaactttcagccagattcctgattgtcacctgaacaagaaaagtcaaactggagtgaaaccatgcaaatgcagcgtgtgtgggaaagtcttcctccgtcattcattcctggacaggcacatgagagctcatgctggacacaaacgatctgagtgtggtggggaatggagagagacgccccgtaaacagaaacaacatgggaaagcctccatttcccccagtagtggtgcacggcgcacagtaacaccaactcgaaagagaccttatgaatgcaaggtgtgcgggaaagcctttaattctcccaatttatttcaaatccatcaaagaactcacactggaaagaggtcctataaatgtagggaaatagtgagagccttcacagtttccagtttctttcgaaaacatggaaaaatgcatactggagaaaaacgctatgaatgtaaatactgtggaaaacctatcgattatcccagtttatttcaaattcatgttagaactcacactggagaaaaaccttacaaatgtaaacaatgtggtaaagccttcatttccgcaggttaccttcggacacatgaaatcagatctcacgcgctggagaaatcccaccaatgtcaggaatgtgggaaaaaactcagttgttccagttcccttcacagacatgaaagaactcatagtggaggaaaactctacgaatgtcaaaaatgtgccaaagtctttagatgtcccacgtcccttcaagcacatgaaagagctcacactggagaaagaccttatgaatgtaataaatgtggtaaaaccttcaattatcccagttgttttcgaagacataaaaaaactcatagtggagaaaagccatatgaatgtacaaggtgtggtaaagcctttgggtggtgcagttccctccgaagacatgaaatgactcacactggagaaaaaccctttgattgtaaacagtgtggtaaagtctttactttttcaaattaccttagacttcatgaaagaactcatttggccgggcgtagccagtgctttggcaggaggcagggggatcacctgagcccaggagtttgagaccagcctgggcaacataagaaggccccatatcggctgggtacggtggctcacgcttgtaatcccagcactttgggaggctgaggcgggtggatcacctgaggtcaggagttcaagactagcctggccaacatggtgaaaccccgtctctactaaaaatacaaaaaaattaactgggcatggtggtgggcacctgtaatctcagctactcgggaggccgaggcaggagaatcgcttgaacctgggaggtggaggttgcagtgagccgagatcacgccattgcactccagcctgggcgacaaaagtgagactccatcacacacacacacaaaaaagccccatatcacgtggtggctcatgcctgtaaaaccagcactttgggaagccgaggtgggtggatcacgaggtccagagatggagactatcttggccaacatggtgaaaccccgtctctactaaaaatacaaaaattagccaggcgtggtggtgtgtgcctgtagtcccagctactcgggaggctgaggcaggagaattgcttgaaccagggacttggaggttgcagtgagccgagatcgcgccgctgcactccagcctggtgacagagcgagacttcgtctcaaaacaaacaaaaaaaagaaggccccatatctccaaagaaaaaaaaaattaactgggtgaggtggtgcatccctgtagttctagctgctcagaaagctgaggtgggaggaacccttgagcctgggaggttgaggctgcagtgagctgagatcgtgccactacactccagcctggatgacggtgacactctgtctcagaaaaaaagggaaagaaataattctcatttatacaggagagaaatcctatgaatgtaaggaatatgggaatacattcagtttccaaagatatgaaaagactaactggaaaaaaatccaaagacctcagatattccagttctattcagagccataaaaggactcatactggagaaaaattgtagaaatgtacagaatatggggaaactctcattgctctcatctccattcaaagacacgtgtcagtgcacactggagatggatggtatgaatcgaagaatacacactggatggaaacgttagtagtttggaaaatacaggaaacttccattttaacaataattaaaattcacatgggctgtgcacagtggctctcccctgtaatcccagcattttgggaggctggggtgggtagattgcttgaggccaggtattcaagaccagcctggcaacctggagaaatcccatgtatacaaaaaatagaaaagttagccagggatgatggtgttcgcctgtagtcccagctactcaggaagctgaggtgggaggattgcttgagtttgggaggtcgaggttgcagtgagtggagattgcgccactggactccagcctgggcaacagtgagaccctgtctaaaaaaattaatcatgtgagaacatccactcgaaagaaatcctataaacgtaagtaattttgaaagcctgatgcaaattaattattatataatgctcaaaaacttaatcatgaatgagttattacacaaagttataaatatatagcatttatcagtggctcattcttttttctttcttttttttttttttttttgagatggagttttgccctgtcgcccaggctggagtgcagtggcacaatctcggctcactgcaacctccgcctcctgggtgtgagcaattttcctgcctcagcctcctgagtaactgggattataagcacatgccaccacgcctggctaatttttttgtatttttagtagagacggggcttcaccatgtggttcaggctggtctcagactcctgaccttgtgatccgccctccttggcctcccaaagtgctgagattacaggtgtgagccaccgcgcctggccttttttttttttcccgagacacagtctcactctgttgcccaggctagagtgcagtggcgcgatcttgactcactgtaacctctgacttctgggttcaagcaattctcctgcttcagtctccgaagcatctgggattacaggcgcacgccaccatgcccagctaaatttttggtatttttgtagaaacagggtttttccacattggccaggctggtcttgaactcctgacctcaaggaatccatcctcttcagcctcgcaaagtgctgagattataggcatgagacaccttgcccggcccctgtgactcattcttaaaaaggatctttggattatgggtttccacttttgcaaggaaatgtgagaatgatactctttaagcagtggtacctgaggtttaataggaagtgtttttatcctaagttagttaataaaatttttttctatccattttggttttcatttttttctatccattttaaagtgttggatctgtgggtgaagtgaaatttatttctaatatgtaagcaggtttaatttttatgtagtgtttaattgttctgtgatgaatgggccattacaaaatgagtctatttttgtttgttttcttttgtttttgagactgagtcttgctctgtcgccaggctgaagtgtagtggcgcgatcttggctcactgcaacctccacctcccgggttcaagtaatccccctgccttagcctcctacaggcgcgtgccgacatgcctggctaattttttgtattttagtagagacggggtttcattgtactggccaggatggtcttgatttcctgaccttgtgatccaccccaccttggcctcccaaagtgctgagattacaggagtgagccactgcgaccggcccatgagtctttattaatagagatttcttactggtgttatgtggcagattctgcatattcctcacccatcatatgtattccactttcctttattatggggaaaactactctttttggcatgatacaatgttgactccattttctttgctaataaggacttggtatcaatttatcagtatgtaaagtttaccatagagtattgtctcatgtgaatcattcccattttttgctctttactctttgtcgttatttctgagtattatttggatggttcattttgacttaaggatagccctgtgatatgacaatatttttatctaatctgatggagaaagcatttagtctcctgatcaagtatgatgttagctgcaggtttttaataaatgccttaattcagtttgaagaa

SEQ ID NO: 723 - DNA, 127089 bp, Homo sapiens
gtccctcaaagtttgtgtctggagccgtagcggcaagtgggcttgcggctaagggattttcctgggatgagagcgggtcttctgccttcattttggatgcacatcccgctttagccccggcagcctttggtccggctcgtgtccctggggattctcggatctccgaggacaccggacgggagcgcttggccatcctctctccggcagaggagcagacgtttgctttccaagtgcaaaactacagacacgcgcgcgcacacacgcaagcacacgcggagagagaggaaccttgccggtccgaggcagctctgcgcgtcccctcctgcgcttagcatcctcggcccagcgcggcccgcaccgccatggaggtgctggagagcggggagcagggcgtgctgcagtgggaccgcaagctgagcgagctgtcagagcccggggacggcgaggccctcatgtaccacacggtgaggacccggcgggcggggcaggagggctttcaaagcgggcaagtgttgtcacgcgaggagcagctggagtcctgggacccgggaaggcagggtttggggcagggcatggtcagaatcaagaggtcctgggcgaggtgtactttaatgtctgagcagatgaaggcgggcagctggcccctttacatttctcatgagagtaatgccactttgtattcctttaacaattcatgcttttttccctgaggctttttccatctgtaatatcatttgctgttgttaacagtactgtaatgcgggagagggagtgtgtgttttgagaataacatgcctccgcctagtttgctattgatttttttttgaggttttcaaaaactggacaagattaagtagcatttccttttcatctgtctcgtattctctctccctctctccctcccttcctcttctttcatatttatattttaaaaagtacacgtgtgtgtgtgtgtgtgtgtgtgtgtgtgtgtgtgtgtgtgtgttgaaagggctcctctacgttagggagaaaggcggctttatttgctttcttaaactgtacgaccaagaagtctccttcctccctcttcggaggaaaaaccagcagaggagtatggaaaatctgagacagttgcatatttaagaaaggctctggggaaggtgggacagctcaccagttgcttgttcagtcttatactaatgcctcagagatctcttgggggattaagctgtcccagagcacgcacatttcttttaaagtttttaatgtcaagtttttggtattaagtttgcaaaatgaaattttgttttcaatagccagcactgatcataggactttatgcaagatctctttgtttgattcttatccatgcagacgtttgtaatgggggtggggctggggtgaggggggacactaatgagaaaaccactggaggcttggctgcttccccttcacgcttttttaatggggtcagtaccaagatatttgaaactttcgcaaaatggcctgcaggctccacctctttggcctttgactctggctgacgttattttgagacaaggaatgagggcctccctgctgattcccaccgaagtatttgtggtggctgagagtggcttgtttaaaaaaaatgcagagtgcagggctgagagggagtggtagttcatgctggggcaaaagccagatgttcagtgtgatcttctgggctttgcttgctgagcttgtcatggggacactatgtgggcagcacggaggttggggtaccagatgtgcttcctgtcctcagtaaagaacttggagtatgttgttcctcaaatatcttttgatgaatgggtgctccaggagtttctactgacaggctacattttatccatatgcagaggggcagcccttctcttttgttcttgaagtattctttcgctgtgacagtgtctcatccagcagctgcaatgccacagctagggggttgtctttcagctggtgggatgaattacgcacaggcatctaccttgctgttctttggccctgtagcttgcatttgtgagttcacagggaaaggtgcgagatgctacccgtgactgtggcattcactctgggaagaactgcttggactggctctaactaacaccttatgcacactttcagggagtagaggccttacatttgctttgatattaacagcccagtttttctgtcattgtgataaagcaggaatgtgtgattatttttcttttatttctatttttaaaaaatgcttattatgtcctccacttaggtacatgtctgttgtgaacagctcattcctgtaaaatgctgctcatcattgctgcaagtcagtgcaacaaactgtgcatatgaattactgttgaaagaggtattggtttagcagcacaaatgattgggttatatttctctcaaactaagggacgtttgggagaggtggggagataattttcccatctgtttcctgaactctgttagatatccaggggcagagctgtttgttactctagctgaatctttatgtagaaaaaggatggcctgattattcattcagtcagagagatatttgttctttcgattaatatttgtggaatatataaagcacttggaaacatgagtgaacagaagcagacaaaatccctgacttctagaagcttatattcgtgtgtgtgtgtgtgtgtgtgtgtgtgtgtgtgtgtgtgtaggggaacataaacaataaacattataaagaagtgattatgttggatgaaataagtgttatggaaaacgtataagtagaacaaggtgagggggatagagaatacaaggtggaagaagagcaaactatgggattgaactgagtgatcagagcaagcttcccatagaaaatggatctgaacaaaaattggaaggaggtaagagtgttagctcagcaggatgaagaactagagcaaaggcctaaggtaggtgtgcattttcatgagactgtgttaatatcatgtatttcagattactcattttggtgagttatttgtcttataaactctgggtgcttctgagacaccagtgcctgtttttggaatgatttcataaaactttccaagttgaagagagcctgaggggagggtgaggttcaaatacgagttgtgagggtggtaagagatgatgacagctaccatctattgagtgtttatcatccgaaaggcagggctgaccacatggcctgccacccatgcagtgccacggggtccacacttggtttgatgctgtgctgtcaccatcttgaaaatcttaattctttttgaactggggaccttacattttcattttgcactgggtttcacaaattacgtagctggtcctgctgaaagacattgtgtctagtgctttacaaatattatgccatttaacccttgtaatgacccagtgaaatgagccatttttattacttttattttacatataagaaaaatgaggcttcgtgagtttaagccacttggctcagttcccacagctatttagtgatagaaccaggattcaaacccatgtttgcctgcctgcaagtacttgcctatcaggctgtctgagtgaagaatcctgacttaaagagaaggaactgaataagaggttgggagagagtgattggaatataggaactgctgagcctgaaagcagctaatgtttaaatgaggctgacagtggcagccaccaaaccttcctagtgagatcacttttgttgctcttactagggatttagttactacatgcatgattgctaatgctctgttttagcaaacctgtcacatacttgatttaaacaatttagaatgttcaagttacccaaggctgagattatgatgtttctcaggagccttctgttaaccgttaggagcaatgttttttttcatttggttagttatgaagacatcttggtctacaaggacaaaggcagacaggttcagagtctacaaaataatgaagcatatggatagggcaaagatggactgatcattagatcctgaattgctaaagctctgggcttcctcttgaagcttaaaaaattgtttccatacagatgatgaaatgttattttaattcagtgagtactgattttaggaaagctgttgcttcaagatggaatacaggctaaaattggttcagaaaagatggcaaatctagaaatcaggagaatatctcttggggttcggtaccaccgtgagaagaaaccttgcctctttccccagacctgcctgtatgttggacatttctgccatttgtattgtattcctataaaattctctgaaaattactttctgggaattgtctgtgcttttgtaatttctattttattttattttattttattttatttttgagatgggtcttgttctgacacccagactagagtgcagttgctcaatcatggctcactgcaggcttaaccttccaggctcaagtgatcctcccacctcagcctccagagtagctgggagtatcagtgtgtgccaccatgcctggctaatttttttcttctttttttttggtagaaacgggatctcagtatgttgcccaggctggtctccaactcctgggtttaagggaccctcttgccttggcctcccaaagtgctgggattacaggtgtgagccactgtgctcagcccccttttgcaatttaaagagcaaaataatctataaattttaaaatgtattttatatatgtataaactgtatctggaaggatgctcaagaagtggataatttttgggaaagcagcttggggaagtggaagtcaagagatgaagggaagcatgtctacacactatacctgttggtactattcagatttttacctcgtcactatgtctagaaaatggaagaaatacaacttgtaggcaccatgtaaaactggactagaggtaattttcaaccaagtgttcttgggggaaaaagggagcttcagtactatatagaaactcaacaccactcaaggtcagtggaggcgttggatgaagaacaggggaagtgggaaggccccatggaaagaggctttagggggagaggttggcaggtggtttgcccatgataaacatcaagatcttgataatgttctcctttcttctatctcagtttagccatctggaaaataaaacaatttttgcaattttcgccatgattatatccttttaaaaaagtgtatcataaaaactaagtctttgtgaaagtaacaacagaagttctgcttgtttaaaatgcagaattcctataaagccaagttatttgtaaaatcatttggtggttatgctaatacagttttatatctggttggttcttcaagtgaaaccactggtcccagacagtggtaggtagggagttgggggaatattcgacctgcctggtgtccagatggaaaggccatctggcttccatgtcttactgagtgctgaaaaggagttggctgatctcacagactgtgtggtttcctgttcctcccgcctggcccggagagtgatatgatttcaatgcgatattgaagcttttggtttgatgttccactttggagttaactcctagggttggccccaggccaggttctgaaggggcacccgggtcctcattggctgagaatgttattacttatggtcacatgacctccacaagctgaataaatgtagtgagttctaacgggagacagaattgggaagtaagtataatttttccagacccttgtggcacctttcaacattctcgccccttttgtgttcccctcctttcttagacatcaagtgttcactgtaatgttctctttccaatttcatcccttcaaattttgctgtcaggaaagatttgataagctttcactagaaattttagtgttagtaagatttaacatgttaaccctaaatgggcatttatatttaacaataattacttcaggtcaaaagggtgaatctccacttggagaacctagggcgatagccaggtagtagtgggcgaatatttggggaatgggagaggaaccctcactgccctccattatttcataatgtggctcttattcataaggcagccttgtttatgtgttgctaatttgtctatgatctagaggatttcccttggcttagcaaaaaatctttgacggattattttactgtctctgaaattgttctcatgatagtaacattggttgggaggtggtagacataggcacagtcctgaaagatgagagggcagtacagagttttatatttgccctccttctcgaatgatccctgagttacagtgttcatgggaaacaggggtctctgatgtgacattgcttttgcaggagttataagatatagcatctagattaataattgaattaattacagtgcttgcagctagaagtaactgaaaatggattcagatcggctcatacagtaagtaaattatctcatgttgcaagaggttgtgaaatagagcccctggccgggcgcggtggctgacgcctgtaatcccagcactttggggggccaaggcaggtggatcacaaggtcaggagttcaagagcagcctggccgagatggtgaaaccctgtctctactaaaaatacaaaaattagctgggcgtggtggcgggcgcctgtaatcccagctactcgggaggctgaggcaggagaatcccttgaacctggggggtggaggttgcagtgagccaagatcatgccactgcactccagccttggtgacagagtgagattctgtctcaaaaaaaaaaaaaaaaaaagaaagaaaagaaaaaaaaagaaatagagctccttgttggctgattcagcagttcctcaatggaccttggttctgcccatgtgcagctttcatcctcaggttggatgtgtgatggacataggagttacaggggttacattcaaaatgacaacatccagaggaagaagagaagttgtctctttcttgtgtcccttttttagaatggaagaaacttttcttactagcccactagctgatttttcttaaagctttattggtaaggattcggtcatatgaccattcttaagccaatggctggaaaggagaatgggatttatattatcagcttagattaatcatatggggatggagactcaaccagcatgaccattgggatcattagtaaaatagtctgagttaacaattctttccttagtcaaaaggtatgtttcttttctcatgaacatgggctagcaactagaaaatttaaaattcacagtaatttgccctgggcgcaaaacagtaaacccaagtactgtgccactcgcagagttcttttgttttttgtttttaaatagagacagggtctccttatgttgcctaggctggtcttgaacccctgggctcaagggatcctctgcctcggcctcccacagtgctaggattacaggcatgagctatcacgtccggcccagcaaagttctaagaatattatttagctgtgctaccaatgcccagtgaaagaagactatagatgtagaaatagcctcttgaaagtgcagggaaaggctagggaggggtgggagccaggaggagattatggctatgtcttgactcactaactaggagatgtagaattaactgtattatctggactcttggcgtcagagtagaataccagggctggaggtagctagctgagcctgtaatcatgcttaccatgcaggacaagaatgatttgttctgtttgggatcgacagcaggtggcaagctaaatgccatttttcaaagaagcaatttttccagttgcatatggctgttcaaatattgatgagggcacatgtgcctgtctgcagctaaaactgccggcctcagcctgacatggctctacgctgtctggtgactctcttggggtaaatagccttaagccttagctgggcatttggtaggattgaggcctatggttgcagggcatctgaattgtccaaatgagtgatcttatgagtgagggagtgctgcccttgttttctgcccctgtggaatcaggatggaaaggaaataatgagacccactgtctctggatcaaccttgagcctatttctctttttccctgctcagtggatgcaccctggcctttctaaatgaagtgctaagggatcttgatttttccttgaatcaaattgtataggttattcatgaggcacatgggagaagatgggccattttatctatggggaatgtaagacatagagcagtagagatttgctcagcacaagttccttgaggacaggagacatgactgtctcttctataccctcatggtccttagtcaagtgcaggatgcccagagaatcgtaagtgcttgatgcatagttaagtagagtgaggcagtcctggaaaatggataagctgggtggctttggcctgtttttatatatttttaaaactctgggcaagacgtggtagcccatgcttgtaatcccagcgctttcagaggctgaggcaggaggatcgcttgagcccaggaggttgagtttacagtgagctgtgatcacgcctctatactccggactgggcaacagagtgagaccctgtctcaaaataaataaataaatgagcaaacaaacaaataaactctggattcttgtaaacggttttgcaaatgtgaaaattcagtataatagtgacttgggtaattcagtgttgatatcttttcttgttttgattagagaacaaggtgggcgtggggtgattgaaacagtccctgtttccagtgggagtggagttgatggcatggtggaaagggtgggctttcaaggcaggccattttgatgttgagggacacaggctctctggtgaccttgggtacattacttcacctatttggatttcagtttctttgcatgtcactgcctgatccataatagaagtacttttccaacctatcccctaagtcaaatgtcttctctttgagaacaaggtgtcccaaccttaggagtctgacatcattcagaaagtggagagagcctgtcattattctctctcatgcatctttatttcctctcctctccagctcctacattgtgctgtaaacacaggcctctgccttgaacacatgtttgccagatgctccctcttactcatttcttttctcttgtttactgccaggttttctcaagtgcgtggtcaccagccatggcctccatttccttagtctctaccctgtatcctctgcccgctgggtcctactgctcaacctctccctggctgctaaatccaatagtcttttctctgtccttacctgcagggcctcatgggactatttggcaatactgaccacaggattgtctcataactcgtttttgctttggcttccatgacactctggcaagcttagttcttcctccttttctggcttccataccagctgttaaatgtgagtgttttggtacttggccttctcttctctctgtatgttcccctgggctctgctataaacttcagtgcatctggttctcagttttttatacttgttatttgtcttttgacgaaaagcagatctttggagtttgactcaagcctgctaggtccacctgagcagcagaacagctctggctgggtaacccttgaattttcatgtgtttcttgatgtgtttcaaagaagagctgggatgttgatccttcttatcgctgcacccatttatctcagggcatgttgagtgactcagctctcttgcagtgtaaacccaagaggagctcatgggtcattcctgggattcagctgcttctacagtccgtgtcactcattagaggcaagctgtgttttgcctagacttttgcttgtactttggcttgggaaaccctctgtggcatcctgtgggggtaggtctaatcttttcgactgtgtggaaggtcaattcaaaagtgagacgtaacttcttagatcacgtaccatattttcctcttgtgtgtacagctgctctggggctcagctacagttacctcatgttgaattgcctgcttttgagttgctgtattctggtgtaggtgtaatctgtttatttgaactttactgatattacgaagagctttggggatttttttttaaagaattgagatgggttattctgaaccatccatattttaatgcccgattcttgttagaattattaacagtagttcttggaagagagtttttctttggaggataaagcttttttttttttttgaggcagagtcttgctctgttgcccaggctggagtgcaatggcgtgatcttggctcactgcaacctccatgtcccaggatcaagtgattcttgtgcctcagtctcccgagtagctgggattacaggtgcccaccaccatgcctggctaattttttgtatttttagtagagacagagtttcgctgtgttggccaggctggtctcaaactcctagcctcaagtgatccacctgccttggcctcccaaaatgctgggattacaggcatgagccactgtgctcggccgtgccttttgatctatgaactcatcacagtacaatttacttcacgtctttggtgatcactttgtaaattctacatttttattacatgatctcaaaatcccaatggtattacatgtgttatgcccctaccactgaagaatctttaaaaaataagctatttaaggccaggcgcggtggctcacgcctgtaatcccagcactttgggaggctgaggtgggtggatcacgaggtcaggagatcgagaccatcctggctaacacggtgaaatcccgtctctactaaaaatacaaaaaaattagccaggtgtggtggtgggtgcctgtagtcccagctactcgggaggctgaggcaggagaatagcatgaacccgggaggtggagcttgcattgagccgagatcatgccactgcactccagcctgggtgacggagcaagactccgtccccaaaaagaaaaaaaaaaaagctatgtaaaacaatgacagccacgacgacagcagcaccagcagcattcagtcgattgtgtatttcatttgggcaattcaattggcaggtgtagttttgcgttttgtagtctctgttttctgacttaaaactttgtttaagtgaaacccagacaaaataaagaatggaaaaacagagacacagaggtaggaaacatttttttaacattggaaaaaaaagtcccttcagactccttggcaaataagaggagtctggggaaaaaaaaatctgcaaacagtttcctagttgtctgagtggaaaatcctggtttttcacatttcatatcttggaaatgtctgaatagtttttgtttaaagggaaattccttttggctgagaaagagcttgcaggattcaaactgatagggtgatgtttttagaaaacctggaggaaataggatttgtgatgaaaatgctttctcagtggccaattgtgttaaaccgaaatttaaatccaaggttaccaatcatagagttttaaaggttcagccattaactccttccttcccctcgcatcctgtctgtttgcatcctggggaaacctctcacatagctggtccttcctccaattcgaggaacttaacaagctgcttgtctaagcatgtgcctgttctaggcaggggataaacattcttgacctgtggctttccaagtagagtaggaaggaagatgcgtcattaaattataagtcattaaatgcctgatacatgttttgcatgagagctgtgtttgaagtatttctgtagcaaagcggatggaatgacaaatctgaagggggtgaagagttggggaacacttcatggaggagcaagtgatatttgcaatgggtgctgaagtatacataggagttcaccaggcagtgggaacagcagctacagaataggaacgtggaaaaagtcatgactgatcctgggaatcccaagtcattttatgtagtttgagagtagggtgctctatggggagtcttgggagataccacaagatcatgagaggtttgtgtgcttggcaaatgacttggacattcttttgtaagcgggaaggtgggaggcttttaacaagagagaccagacaggagcagaaatgtattttagaaaggatggactggacggcagaattgatagtgacaagttgatcttctggctggctatttcatccatggagtagaataagatgccatgagggcctgaacccaacagggaggagtagatgaattcaagagaggataggggaggttagactggagatgtgattacagggcatgagggctatgggagatttcttgttttctggcttggaaggctgagttgacggtgttgccgttgaccttgaatgggagtatttggagggaggatgagtttggcagggaagataatgagttcactttcaggcacagtaattctggtgtacttgcagaacattcacaggagcgacacgtaaagggcatttggagacttgggtctggagttctggagaaaggtctggactggagatgtagatttgggtgttaggatcctggtgagggattagtgaagccaataatccatataagatagtccagaaaggttagagtgagagggaggagtttgagagaagggctgagtgtggagccctgggggcaccagaaggattggccagggagaagaccctacagatagaacccagaaagaatcatcaaaaaaaaaaaaaaaaaaactggagaaaagccaggaaaattccatcataggctccaaaataggggagagtcgctacagagtggtcagtacaaataagggttgagtgtgctattcagctgaccgccgagtcccctgaggacttactagcatgttagctcagggcggtgtctgtgtctctgtagccacaggtcttctctgtagcagacctgtgtgcatgggatgtggcattctgctgggaaggagaggcctggtttccaggcgagagcacgaactgcagaaggccaggaactcagagtaaatggacaaagtgtagaacacagcgctgcctcttttgatttttttggaacaagattaatatcagtcctcaaaattggcattggagaccatcactggttcattggtgcttgtgtagttttatgagggttctttctttctctctttcttttcttttttctttcttttccttccctccctccctcccttccttcctttttttccttccttccttccttctgtctctctttctcttcctttcttgctatgttgcccaggctgatcttgaactcctgagctcaagccatcctgccccctccacctctcaaagtgctgggattgcaggcgtgagccactgagcctggcctctgagggtcctttcatcattcttctctccagataagtccatctatctctggatgtccttcccatcggctggatggagtttgtgcatgtgtctgttttgtgactgtgtcatttgcagttcttagttttggggctttgcaaaaggatagcctttgtactcattaacctgttcaagagtgttgggattcaccacatgactccaaggtgtgagtcttttcctctctttattcttctgactcttccactaaggaagtatcaggtggatccactgaatgccgaaaatgagtttgatcacagaggcatcaacaatattcaagtggtagaaacatagaaacaagccctaattggttccatttttgtatgacataataataaggacaggtgaggacaaatggctttgtaataagaatatgagcctgcagaaggaacattaagtaaataattgtagcttcaaagaaaatgagcagctgctggcaatgcccaggtttcaggacccgcaaaggcactctggccagacacatccctgctcccctcttgtgcctcccacgtgccgtggctggattctgggttctgcccttgctctctgtttcactgaatctctgttcctgtcatggccctcaggcctgtcagggacatgaggaacaggtgtgggaggaggaagcccttcagctgggcctgaggtcgggcatgtgagtactgaggacagaggtgggtgcagaggaaggagaattctgcctcagactgcacagggaggaaagggccacccttcacagcccagagcagagcaggctctttgaaggagacacagagtttaggattcactccacagtttagctgtgtggtgaattaaatgggtttctgaggcctgactgggaaacagatgactttttatcacattatgtcagtaagaaaatgtcttgtgagtttgaaccacccgtgttacaaacttttaaaaaaggtagagaaaggtgtggtggcttatgtctatagtcccagctacttgcaggaggccggggtgggaggatcgcctgagcccaggaggttgaggctgcagtgagccatgattgtgccactgtgcgccactctgggcaacagagccagatcctgtctctccaaaaacagaaagcattttagagcagttttatgttcacagcaaaattgagcagaaatacaaaaagctcccgtgtatctcttgtctccccaacacacaaaacctgtcccaccatcagcatcctgctattacagacttttggcatatggagtcataagctggggtcacctgtggcagcttttgatttaaacttaatttttagagattagtcacagataagcctccctttgtagtccagcaagaagccagattggccacaaaagccttgaacaccgaagactgtatcctgttttttgttttttgtttttttttgctactgaaaacttattcaaacgactaggcacagacctatagatttcagtaccattaaaaagtcaaactgtggtgcggcatttccctccctctttccagttacagatgacttaggcagtagatgttatcctttggaaagagatgggatctagtgaggaaacagtatatattttttgtaaccaaagaacctgactccgatctttgtagttttgactttttacttcctacccctgaatggtattcatttctgaggcactgccaggaattgtttttctggttccactctgggtttgcaagctttctctccaggctctcctgcagcccaagacccatgttggagccgctgggagagctggggcagtgggctgaggaggccaaggcccaaaccagctccaggcgaacagctgcagcacagctgtgatgttacctgcatggtgcagtggggtcgcccttgggctcgaggcatcatgttctaaggcagtcttcacagacacgttttcttgtgtgctaagagaggggcagaaacgtagctgccaaaaaaccatttggtttctcagctgtgtttacaagctgaggaacatgaggcacgtcgaaatccagtgtttccttttgactgaaatacagacttctaggaggacactgaaatgagggtgggatggctgggtagatggagcatgaggaagtttcagcttcttattcccaccctcccagtttcggtgtgggattctgactgtcctcttgtctgcagattgctcaaccactggaaaaggcagttggtaggaggagcagggattttgcggtcagcacaacttcatagcccttatcaccactggcaaatgatttctttagtatccccgagccctgctgtcatggcagtcatggaaaatgatgatatctgcatggtgctttgtgtcaaagtaatggatgagcctaatcatagtgggtggaatccatctcaggggtgcagtcgctccagcctctgctgccaacttgccctccttcccagtcccatggagctggggcactccccggcatacctgttgggaagccctgataagtgtgcttgtctgttttctcgtctaacaaaatggaaacaccgtgaaagcagagactttcttttattcactgctgtttatctccagctaacagaacagtgctgtgcgcatggtaggtgtccagtaaaatgtttggtgaatgaatggatgaacaaatgaatgagtctaggcttacaatctggttctggctctccctactgtgagcacctttctgagactgtttcacaaggccatggtggaggaagataaatgacataagtaaagtgtcactatgtctggtttgtggccgctagatgggggatattcggttcctttcttctatttttttttctccaatagtttctgagaggcctaggaagaaaatttttgctgcattctgaactcatggataaaatgagtaaatagaataagacctctgaattgtggcctaattgtgaaaggcatttagggaaaaagacctgaaatatttcttcagttcttacctgaatcctcttaggttcaacgcctggtattgatttgcatgactgaattaacacttcaaattttcaggcacctgcttctgaggaactgaaatgtttttgtcagttttgagggggtgggttggcagcaggtgttagcactctttaagttacaagagggaagacaagaaggggacggcttgttccatgtccctgtcatttcctgaaacaccatctatcactggacactgaggtcacttacattattttttcctaatgaaaatagtctttctggggctgattgtgacctgtttaggggtctgttaacagcaggaaggtgagtaggggacagcaggatggcactgagcagtcctggtagggctactgcctgcagtgtcagggacaagctgaagcgctctccatccacgaggcctggggcttcctggcagagcacctttggaatgctgtccatacactgcagcaaaggcatttaagccacgttcttcctccgacccctggcctgaactgcgtctagccttggctgttcccaagcagttgatgtacatattgttgagcgagagaacctctctgagtcctgctttcttgggaatcaggttctaagttgctctcctgtgccttccatttatctggaccaactagcattttatcaaacagaggttatatggagattctggcgtgtgaatgggcccccttccccctttccataatgtcttattattgctttggcaattgcagtaggtctttgaagagggagctgactgaaaactgtgcccaaatctcaatgtctcttggaagttaagttacacatttttattttaagtaaaagcaaaagaaaacaaacaaaacccccagctccccgcaaaactcattgctgataatggagttcaatgagaaaggaagaaaatgttagctattgaggctgacaagctttaatgagctgcctgatggctcttctctactgggctacgttactgtagaagagtttgcaatttgggagactttgagacctttgatctttcatgaaacgcagactcctttcatggagaagtttgttctttggtatttgccaaccgaaagaaaaatatcctggtaggtagattttttattcccccatagcttttttgaggaactattactcgacccaagtttgcttttagaaaaaccaaacaaaaagctgcaggagcaacaaaataagaagaataaaagtatgaagatgacaagcttatctgtcacttggcttgagcatttggtaatttaaacatgtaagggcctatttatctcatgaaccaagcagtcctgagctaggccctccagggctagtgtagtgcttgatcagggccaacggggcccttcccgtgaggctgtttgtcacctttgtcctcatgactacaagatgactgcttcacttccagcgtaacatcagcctcactggtggaagaaagtgacggggcaaagcagaaagggtagtacctatattaggacaagccagggctttctctgaggcctccagcagatttcccgttaggtttcactggccatccctagctgcaaaagaggccaggaaggtgtgagtgtgttagcttaatacttgccaccctgaataaaattggtgtctgatagtaaggaagacgggtaggatggatattgagtggtcaagcagcagtgtccaccacatcccaaaataacattttcccaaatttgtagaatccaaggtctggtcgggacctgtgagatggctgagaatgacgcctgcatctcacagataagggagctactttatttccttctacttctgttcagccaaaaacctcagtggcactttttggcacttctgggtgtggctgctcatcccctgatccccaaactgtgcctggaatgtgagtgggccgagaagttccttcactggagagcagagtggcagggagcgggcagtgtgcggatgggaatcaaaaggcccgattgtgctttctcaggaaaagcagccggccaacaataatgactgggccgcccctgagtgcagaacctggaatccagccttctggaatgaaaaagccatgcaagactcagtccctgcccctgaggagtgaaggcctagtagggcggacagaacaaccacaggggagaggtaaagcagagaggtatgcgaacaatgaagaaaggccatagcaaacggagtggccaggccgggaaggtggcttggaggagttgactttgaccagggatttataaaggtctgttatttggcggctcacaatggtgtgtaaaaatactaagtgagagtcagcagctttgcctggttggagcaatttaacaacacctgcctgaagcctgctgtgttttctttagaagaacagcctgagtcaacagtgcttatggattccttgatggatgcagagggagtattaagttagccagatttattggaacatgtctaaaagaccactagctctgtaccagcgtttcctctgaagtttcagtctctgtcctctcttcccttccccactgcctggtagctctgatgttgcatttctgcccttgcttctcttgtttaagattccttcttcgagggcccagccagcctcctcagtcctggggctgtgtggtagatagtcctctggaaggcattcaccaccttgtcatagggccgtgtggttggtggagggggcagaaataaggagactagtgtttcagaggctcttatggcacacatgggaacaggtagactgtattttggcattgagagtatctgggtgtattagtctgctcaggctgctataataaaatgctacagatgggtgacttaaacaacaggtatttatttcttacagttctggagactgggaagtccaggatcaaggtgctggctaattctgttcctggttagggctctcttcctggcttgcagatggccatcttctcactatgtcctcctgtggtagagacagcatcttctttcttcctttttgctatgtcctcttccaatgaagatgctaatcccatcatgagggcaccatcctttcagcccatttaaccctcaggcccagtctccagatactgtcacattggaggttagggcttcagcatatgaatttgcaggtgtattagtccgttctcatgctgctgataaagacatacccaggactgggtaatttataaaggaaagaggtttaattgactcacagttccacgtggctggggaggcctcacaatcttggtggaaggtgaaaggcacatcttacatggtggcaagcaagagagagcttgtgcaagggaacttctctttataaaaccatcagatcttgtgagacttattcactatcacgagaacgatacaggaaagacccacccccatgattcaatgacttcccactgcgtccctcccatgacacatgggaactgcgggagctaaattcaagatgagatttgggtggggacacagccaaatcacatcagcagggaacacaattcaaccccatagcactgggggttcactagagtttcataaggttcccaaggactcatggcggtgaccagagcagtgtgttttctactgaaagaaacctgtgggagttgaaaacctacagactgaaggttcttaagctgagtttatggcctcaagagggtctgggaacttctggaaatgctctttagggcattgtatgtgcagtgcatatgtgtgtctttcatcacattttcaaaaggtttgctgacctaacagtggtaaaagctaatgtcccagagactgtacctctaaagtagaagctgagaaggaacaggtctgtgcacactggtgtccaccaccagcataccccccacctcattgtgcagccccatccccctggagcattccagagaagctctgctccctcttgctgctgggcactaattagaccctgactgctggcaggtgagcttactgcccaagaactaaagagagagagctcttcccccaaaagctgccctgtgcctctgtactcgaaacctaaccctttgttgacttcttttactttttatttttggagcaaactctatttttggagaatacatgaaacgagtggctgtcttacatcataaaccagaaaaaccactgtgcttattaaaggcatttcggagtattctcaagattcggactcaaagcagacaatagtagaagctggcttttctgcctctaaatggagggctctggcccccacattcattcatccctccttgagctaaaccactgcctgcctggctaactgatctcaagagcaaggctgggactcatgggtatatatttttggtctgtgacttttttcctagttaatttctgtggggtctggactgttttctagccccatacttattattttttcttgttctctacttcctggttctcccacatgactaatccttctctacacccatgttgaattttatttgacctcatttgatatgttttctctaagtcacttcagtcctttttaaaacttggtaaacatgaatccattttaaaagcacaggccctcatagaatctgggtttatcctcaggctaggtcactgctacccctgaccagtccccaaagaatgctggaggcctttgccatgctccaccttcctattctccacccaggctcccttttcctcctctcctttctctccttctctttccctttttgtctcctttgctctcctctttctttcattcacgcaggccttcccctcctcctctgggctttaactctgccggttttcctagagctttgctcagtcctgacaggtgtgaggacctgaactcagggcttgggatcttatctcaggttctcctgctttattgcaaggactcggggtcctcagcagatcttggcattctggagggtgtcacattattggtgtgcatcatcgttaagggtctttggaggggatttctgtctggcatttggaaattgcagaattgactttctaaatgtatggagtagctggcgacaaaggggggtcacattgtggaggaacaggggccagtgcatcagtaaagagcaggagaggcaaagagaggagctggtcactcttagaaattaatgaggaattttattgatggccagtggaaaattgtttcctagtttgcctttcccaactcctccctctcagttgaaatcctgaggaccttcagcctatagctctagcagctttggagcctgtatggagaaatcccatgtcatgtattttaggagcctgggccactggttggggaagtctgaaagtaggcctgatttttacaggtgtctgcaatgcttggggtaagccctgggcaccagcaagtcttctcttcccctttctctggttgtgtttgtctaggcctggggttgccccccaccagtttggaacctttttaactgagcctgtggtcacttgcataactcagcctgggtgaccactctcctgagctgccccaggccaggcgaacccactggaacaatgaagctcctgctctgcccatccccacggtctagagcaaagagtctcagtcttggctgcacatcacacttacctgggagcttaaacaactttgatgcctgggtcccagcccaagagattctgatttaattggttctgggatgaggcctgggcatcaggcattttaaaagctctcccagtgcttccaaagtgaaaccgaggtgagaactactggcttggagtatgactactcaaagcatggtccatggtctggcaacattcatctcctgggagtttgtcacaaattcagaatctcaggccctactctagactttctgaattataatctgaagatccccagatgatccatgtgcatgtaaaatttgagaactgctggctagaatattctgctgcctcctgtgaggctgattggactcacccatcatccgcatgcaccaggtactgatgccagatcaagctagatggagcccaagaaactgatgtggcctcccctggatcccttcttggggatctgttctacatctgagtcaggctccctgctgtctccatttctgactgatcccttttatacctgtccactcagaagtcccagcatgtctcaaggccagagattgaaagagccaggcagtgttctttgttgttgttgttgttgttgttgttgttgttgttgtttttgagacggagtctcgatctgttgcccaggctggagtgcagtggcacgatctcggctcactgcaagctccgcctctcgggttcacgccattctcctgcctcagcctcccgagtagctgggactacaggcgcccaccaccacgcccggctaatttttttgtatttttagtagaggtggggtttcaccatgttagccaggatggtctcgatctcctgacctcgtgatccgcccgcctcagcctcccaaagtgctgggattaaggtgtgagccaccgcgcccggccggcagcattcttatattaaactaaggactggtaggaccagttgcagcctgtgctttttgatgtcttggcctgatgacccgcccttgctgtgctttatttggtcagcctggcagagcctgccatcctgaccctggagggtaggaacaggaaaatcaggctaaaaggaaaagtttcatgaaagaaaatgggtacaatatgctagagctgtgatcaattagaacagagatgacaggcacaaagcactcgtattcttccctcactgtgtgtcctgaacatgcttgtttttcaacacagatctttcccctactgagctcagacttggtgctagttcctctgtcagcagggcacaccaggcagatatggtcaattacttaagatgcaactattttgaaatttctttttcccagagtagcatcatttactgctctcgttgtgagtcttgagttttgtcccacagcttccaagttctcagatcacatctctgagatgccatcagaccttcgcctcatcccaccatgcatggggccactctctaggccctcacaggcagttggtgaaatgagtgtgtgtttctccttgaggttttcatccacggctctcttccatagatgtttcctgagccgcactctgtgcccagtgctgcagtgggctaggagttggaagaacacaaactttgtggggactcagctgcctgcctcagctgcgtcactactgccctagtcaggatagccccccttcctctcattcacccagggggaatgacagcacactgagtcactcagcttcttgacccctgtgtcactgcctgaccagtgtcttacgttcttttcccactcaccattatttgaaaacgatatgacatgacttcctaacctttacatcgtaccgggcctgccattgccaacttccagaaccacctgccatcttggttgatttgagctcaggagtcaggcacaggaaggagtgaagctggtcagagacatcatagggaggaggagggacggaggggataggaaagttcaggacctgcttaaaggaagcagctgccacttagctccaacagacccttaccatataggaatttggacccagtgttttcagctgttctgacttcaaaagatgttagaaatacagattttatatgtgtgtaaaatctcttgctttatatatagacagataatctctagagagatatatagagagttatctctgtatagagagtatatctctgtaaagtcgtccagaagtcaggatagttgcatttttgggctccttgtgctccatggtctctgatttgtttttatttatcttggtctctctgcttcatttgtaaggtgaaatgataatacctattgatttcacaaagctgatatgatgactaagattgtgaggaatctcttcagaaaaggctaattgtaaggcatcaagtttgaattgtaaggcacttttggaaactgcttctaccttcctcccctcccctcccctcccctccttttcctttcctttccttttttcctttcttttctttcttagtctcactttcttgcccaggctggagtgcagtggcatgatctcggttcactgcaacctccacctcccaggttcaagcagttctcatgcctcagcctccccagtaactggaactacaggtgtgcgccaccacactcagctaatatttctgtttttagtagaatcagggtttcatcatattgaccaggctggcctcgaactcctgacttcaagtgatccgcccacctcagcctcccaaagtgctgggcgtacaggcatgagccaccacgcccagccctacatttctttttaaacaaaacaagatttgtggttacatatggttatctatctgtctagatagataatctatctgtcatttattgccttcaaaatgaaattaattttcaaggttttttggaaatggctactaatgatgtagttagatgcccagtgggttataccaagattctttcctgagtcactatttgtcattcctttttcccaacccttgtaagtattaactgtccccacagtcttattttataatcgttgtgttgttgcataaccatttcacttgtgtgctttgggtctcttagaggacagacgtggagatgctgcttaccggtagcttctgccacctcggcactttggttttggactgtctggactagaaaatctaggcagggtttattgctaatcccactttcttccttttgctggattttgagaagccctgcaaccccatttccatgcagacttccactgtggttgggagtcagaataacgggggaggaacctgggaaggatggtgggaggtgcaggggcaggggccgtgtttaagtgtggaagctcagggggtgtctgtctttagacctgaatttccccttctgcagcctcatttctaaaggaataaagggaattttctctttccacctcccaacccattccttggcctttgcttcatttgtcgatggttgatgttgtgtgtgggtgtgtacgtgcaagaagatggcaggctgccgtctgcgtagcctatatagcttatgatgttccacaggctccacccactggcctctcccactgtctctgggcggggctcatgggaggcagaagcattctcccctatccctttggttgcacatttgaattacttggggagatttttaaaaaatactaatgcctgagccccactcaaaactgactaaattaaaatgtctggaggtggggcataagattttttaaaatagtctccagattggatttgtgtttatatatactgaggtctgcaacttactctgtaatgcataaaaaataaagtggggtgatggatgaatatgtcaatgggtaggtttgtgataagcaggaacaatgaaatattaatggtgttatttaggcagtaggcatatggtattcattataaaattctttcaactttgctctgatttgcatattttaaattagaatgctgggaaaaaaacaaacataaccacttctccagatgattgtaatatgcagccaggtttgaggatcactggacgaaaggataaattaacgagtggccactgcattgaggtgcttagggcaggaaatttggggccgatgccacccaaggcttgagtgtggaggtaagtggagagagactacattagttctctgggtaaagggtgttaaataagcagattttggcacatgcctggtggctgggtggccatatatttaggaaagggaccccaaggaggtccaactgagaaagtaggtaagagcagactcctggctgataaaatatccatattgaacccaatacttggctaatcagagttctgagggccattgggccacattattagcaaaaagaaagagatgtttttgaaagatgctgattccctaattggagatgatgtctgtggaacatctggttcttacttatgggatcagactcttggagcagagaaacattgagggtcatctggctcggcctcccactcagtgtctttcccagtggcctgagctgaattgtattggatttatgcagctgggtggaatgattctaaggtcagccttttaagggcaaaactactttgaattccagagaatgaatatagtttaaaaccgttttcctaaaagaagaataaaagctgtttcatgcaaagcttgattgtctctctctttcctgctgtttaattaatttatttacttcttttttaatttttaaatttagtttcgggctctaactgaatctttcctgctattttacaattggatgttgaggtgctggaagacgcagagagcatctaggagaagtatgccgtgtgctacttgtgttttacttcccatgcagtcatgggtcctggtcctccccgaagtgtgcagaatgaagtccctttctaaagcttttaagaagtacagaagcaaaggctcttctgtcttgcctgtgaggctggggaacaaaggacaaaggccctttaaaaaagagagaaggggcgagagtcctgcagatgtgaggttgcagtgtgtgtcagcccgcctgggagctgcagccaactgattgcagaggcccaaatatgggactcatttgtgggttctgcaagaagaaatagcctgctggttatgagtaaccctaagtccccttctgagagcctcttgggctcacagcaaattcaatctgttctcctggacttttggagctttgatatggattaaactcctcctgagttctgtacaactgatggccttgttgagtttgatctatagcttttaatgtcagagaaatattaatttccatgccctttcatcttttaaagtaactaatatttttataatgctttacggtttataaaagatattcatataccttatctttcttgattcatgcaactttctaaaaggtctgagtatttcaaggcttgatgctgaaatgtcatttcttctcattctgtaactgtctcttgggcaacactccagttggcatctctatcatgatgggcccataatttatatctttagcctggatctgtctctaagacctgattatccagttgccagcttgtctctccactggactatctcaaaggttcctcacctttcacaggctctaccccaaacctgttccctatctccagcaaatggtgcagtcaaacattcactggggcaggccaggcacctaggagccgttcttgatgtcattctctcctaacttgtatcccatctgtcactcagtcctgtggctcttccctcttgaatagcttgactccattcacttctttccatctccttggtcacctcattagaactgagctatccctgtcttttgccaggactattgcagtagcctattaacaacttttctcatatctgttctcccttctctctctttcgtgtcatccccaagtttaagagaaatcttttcaaagatttcttccctgacatctgatctcttccctgacaatctgcgctccatccatgagtccccttcccctttttaagatctttaaatacatttcttcctgccatggggcctttgtacatgccggttggtcctggttggaacactcttttcacccttttccctttgcctggtgcttagccttcagattgtgctcaagccttaaggaaactcttcctgcttttagagatctgtattcctttatttcagaggggttataatatttcatgtttttgattcattattttgattgtttcaccttttctctcccattattgtaagttccaatagagcaagggtctctttgcttttcatcaccgttgtacctcagtacccagctctcaggaatatttgttcaatgaatgaaaccaatggggtaggtaggacaagtatttttattcattttctttttacacaaggaggttgattttttttttttaaagagcagatgcttggcattattttatttctaactttataatatggatatttctgcctctgataggttccctgtgccatcatttctcggtcttggctcgttccagattcacttcagcagagacaatgatgagcagttattggtttggaaatactccccagaacatgcaatgccagctcataaaatgttttcaggttgttggaaatcttgtgaaaacgtgcatagttaactattggagaatttaactgtgaatatgaatgggggagccattcatcagaagccctgtctgaataattgattaaacaatgccaggaggtgtgtaagagaaggatttgaagactgagttgtaaaactatggctgactagtagggtccctcttggcagtctcacttttttgcctcgtggcattaggcattagtgtctcagatccatcataataagtctctgggcttactaactgtgatcttgtgtcggatgggccctgtgctgctaccttcttgactttaggatatctcttgttacctttttgctacttgctcccaccaaggagcacagcagactccaactcactctaggtgagctttcctctagctcccgagggtcatgtgcctctccattgtgttcaaagagaataggcgccggtgggccgctgtctgggaaactctgtgttccttggtgcggtactgaacctatttagttaaacttgatcaactttagcacaccctcaccaggagtgtgtggattctccttgggacccaagtcttccgtacaaggcaaacaagttggaatggggacttctatgattaaggtcatcgttagttgaagaatttcaaaccattttagtttttcatgatatgctatttctttttttttttttttcattattattacactttaagttttagggtacatgtgcacaatgtgcaggttagttacatatacatgtgccgtgctggtgcgctgcacccactagatatgctatttcttcaatttctcatgtggatttggggtgtgtgtgtctgtgttctctcatgtgtaaatattttcatagaggccctgaagcttctttcctatatagggatttggggacattcccccaaacaagaggactttgttaccagggtgtccattctggggccttgctggtatgaaaatgctccctgggttgatccacagtgtatttattcatgaatgttacaggtgccttagagtttagttcccttaggtgactgtggaatttaaaataagaaatcaacctttatcctaggtttttctttttcttttctctctctctctctctctctctctctctctctctatatatatatatatatatatatatttttttttttttttttttttttttttttgtagagacggggatctcactgtgttgctcagactggtctcaaactcctggcctcaaactatcctcccacttcagcctcccaagtagctgggattacagatgtgagccaccaaacctggcttccttttatttatcaagaaaaaaatactgttcttattgttcattacaaaaagagtattacctcattaaagaaactaaaaaacaagcaaaaaagacatctctctgttttgttttgttttgttttgtttgagatggagtcttgctctgtcgcccaggctggaatgcagtggcatgatcttggctcgctgcaacctctgcctcctgagttcaagcaattctcctgcctcagcctcccaagtagctgggattataggtgtgcaccctactcccggctaatttttgtatttttagtagagacggggtttcaccatgttggccaggctggtctcgaactcctgacattgtgatccgcccgcctcagcttcctaaagtgctgggattacaggcctcccaaagtgttgggattacaggcatgagccactgcgcccagccaagacatctgtcaaaagctcattatgcactcccgaaactgctgttaatttctcttgtgttagagttcagattttttttatgaatacttcttttacatagctattaataaaacatattcatataactattgtgccatgcccttttgtatttaataatggacattttcctattttaatacttagccattatttttttttttttaaggaagtgaacaaatgaaagaatggctactccatagacagagcagcctatctatcactttttaatggccgtgtattgttcattgagtgtatgttttgtaggttcttaagtgacatccaattattaggattttaggttatttcccatttttccctcttttaaataagttggcttaatgtttaattaatagttttagaaaaatggaaagagcaagaatatacattagaaaacagaccctggccttttttttttttgtaccatccagagaagttaatgattaaggtaagaacttatgataaggttatttacaatggggaaagagatccaggggattcgggttgcagagagtaaggaccggtgttttgtgtgcactcacacatcacagcctagccgcaaaaagatcaagttctgcggtgtctgcagtgttgccttagtgtccttcatacaatgtctccccccatccaaaattttttttttttttttgagacggagtctcgctctgatgcccaggctggagtgcaatggcgcgatctcggctcactgcaagctccgcctcccaggttcacgccattctcctgcctcaccctcccgagtagctgggactacaggcgcccgccaccacacccggctaattttttgtatttttagtagagatggggtttcaccgtgttagccaggatggtctccatctcctgaactcgtgatccgcccttcttggcctcccaaagtgctgggattacaggcgtgagccaccacgcctggccccagttttttttttaaacataattctgactctggaaataagtaggcacctttaaactctgtgtagacttgattttgttttttcttgaagtttgtgtgtatctcttaatatgtgtgctaacttaatttagggtctaggttcatgctgatgttggaagcatgccattctccaagctttttaaaaatatggatattcttaagtatctcacactgaggcacccagctataaagtaaccgtagtgtaggtaggtgcacactgcataaacacttcttctgtaagctggagaaatagctggaggagaaatctgttcttagaacaaggcacatgctgttggttccagacattctttttagtggaggatacaaaagtgtgtttaacggttgctggccccacgcctgctgtccagccctatggaatgtgctctgtctgggccacactgccagtcatcaaggcagttactgtgaggaaggaagaagccagctcttcagttccttgacctgagcttttctggccaaaagaaggaatctgttttgaagattaggtttcccacctggatcctgcccaccccacccacccccttctgtgaactgtccggcttatcgaagaagacccatttttccttcttacagttgctgtttcttcattgcaagtgattcaccctgaacgtaaagttaggaaacttagtttataaggaactttatttggtggagaaatgtcaccccattctctcgttaaaagatacgatgtctggattgattccaatatctgtggtttttggcacatgccatctttctgaaattgcttctctgtgttttatgtaagaggaagaaagaaaaagaaagttctaaaacaaaatggtcagcttattctttggaattctatttgggcagtttaagtgaggatagtactatacatcctgtcttttcttatatcaataataataataactcctgtgacttattacatttaactctcataatcaaccctttgtattcaatactgttttgggcaccattttacagatgaggagactgcggcttgaagaggttaagaaacttgctctttagatggtattccagtgtaggcagcctgactccagagctggatgatcttctaacccccccataacagtgctttcaagtcatctggaagaacttattatgcaaattaaaataccctgggcatctggaaaacatttgtttcttaggttgtgcctatttcataatttcttttcttttttattttgaaaaagttcaaacctgagaaaggttgtaaaaataatacagtcaagacatatatcatttgactaaatccatcagttgctaatattttaccatattaacttatttttctgtctttctgcgtatgtgtatgttgtgtgtgtgtgtgtgtgtgtgtgtgtgtgtgtttgatgacccttgaaagttagttgagacattatgacatttcatctctaaatactttagctggtatctttgaaaaaaaaaaattctgctaaacaacctcaatgaaaatcataggccggacgcggtggctcacgcctgtaatcccagcactttgggaggctgaggcaggtggatcatgaggtcaggagattgagaccatcccggttaacatggtgaaatcccgtctctactaaaaaatacaaaaaaaaaattagccgggtgtgatggcgggcgcctgtagtcccagctacttgggaggctgaggcaggagaatggcatgaacccgggaggcgaagcttgcagtgagccgagttcgtgccattgcactccagcctgggcgacggcatgagactctgtctcaaaaaaaaaaaaaaaaaaaaaaaagaagatcataatgctcaaaaaaattttacattaatacactgctattatctaaggcattcatgttcaaattgccctagttgtccccaaaatgtcctttatagccacctctttttctgatccaatttatcaaaaaggaaacttagcttttatgatttgtaatcttgatatcatcatgcacattctcttctcagactgggaacagttttctttggcttaactaggagaccagggatcttgctggagttccagatttgagctctctgcccttcctgactaagcagccccacagtgtcctcacttgacacatgctgttttatggggcgccacgtcttcttcgttccttctctctcctctgatccacttttttccttgaccctattcttctccttcgtttctttcttcctcattttctttttgccccttctcactttcttccttcttttctccaaccccctaggacacacacaagacttgttcttatgtgctgtaattggaagttgtaaatcaatggggttgaaggtgggagccaccaaattggattcatttatgagttgggatagagagttggtggcgggcctgagctgatggtatactggggactgatccagctgtaccccccattggaggaggttcagctggcttgaaacagtgtgaggctgagaggatacaagagtggccagctccactattcacagtagcaaagacttggaaccaacccaaatgtccatcaatgatagactggattaagaaaatgtggcacatatacaccatggaatactatgcagccttaaagaaggatgggttcatgtcctttgcagggacatgcatgaagctagaaaccatcattctcagtaaaatatcacaaggacagaaaaccacacgctgcatgttctcactcgtaagtgggagttgaacgttgagaacacatggacaaagggaggggaacatcacatactggggcctgttggggagtctggggctgggggatggatagcgttgggagaaatacctaatgtaaatgacaacttaatgggtgcagcaaacccacatggcacatgtatacctatgtaacaaacctgcacgttgtgcacatgtaccctaggacttaaagtataattaaaaaaaaaaaaaagagtagctagctccagtccagggcaacatcagctgtggaggacaaggaagggatggggtgtgccaaaatggggtagaaacgacgctgtgttgtattggaaagaaaatagactttaaagtcagaaagaaaggtgaaaatagcaagcttttactgactggctgtgtgatcttgggaaggttatttaactccctaagtcttgtgtgcttcaaccacaaatgggaagagtataacctaccttgcagcattgtgttgaggattagggataatgcgtattaaagcagagatcctggcacacggtggtgctcagtcaacagtggctgttaggtatttacatggtgtcccaggaagtggatggggcatcacagtgaggggaggtgatggttggaagttcatgcaggtggccaacatgaggctgagctgccagtggttagaaggatcttaggaatgcagtgcagggcaggcttcctgttcctgggagggaaacttgtgagtcagtttccagcgatcgggagcaggggccacaggaacactccagttcagagacatggggcttggtgtctgggagagaatcgaagagccagaaccaaactgtctgatcaggttcaaatcaatagcaagggcacttgcggctgagtcatccggagtatctcttgttttgggttagcattagggagaagctagggttgggggagtgactgtgggaggagggctgggactcaagctaagcctagtgtttgttctccttttacatccgctagtagtgtggtgaccatgataacattccagaggctcttttcttcctgagtccttggcccaaagttaggtaaattgtctctaggtagataatgatgtcccgataatgagctcagagtccaaactgctaggctgatggagattcactcaccttttgccttggtctgctcaggccaccttaacaaagtaccatagactgggtggcttaaacagcagacgtttatttcttacagctctggagactgaaagtctgagatcagtgtgccagcatagttgagctctggtgagcgcccgcttcctgacttgcagacagctgccttctttctgtgtcctcacagggcaaagaggagtgggaaggagaggaagggagaaagagagaagactgagagagagagaagaaggggagagagagcaagctttctgggctgttcttataagggcactaatcccatcatgggaaccccacctcatgacgtcatgtaaacctcccagaggccccatctccaaatactatcacattgggggttagggattcaatatatgaattttagggggacacactttcagttcataacaccctccttccatgccctcattcccagacacttgagaatccatgtgtaatgagagtgttaccttgaggagtatgcggctcctgcgtattatatggaggcagagacaaggattcagaagcacagttctagcagcttgtcagtaagccactgcaggggagctttgatgaactctcatatggcataggtccttcctttctacctacgatttttctttttaaaatttccttattatttttatttgagaggcatgaacatgaggcaaaatatgttatttcctgttctttgtaaaatctccaaattgagctgtctgtagtcaaaagtgaggtaatcttcttcttttatccaaaagattaacttattctgagctttccttctatctgagtcgtggctaggatcaacatacacttcttaaatattccaattccatatcaaggatagtgctcctccttctccctgagccactggagggagcaccaatgtattaacagttttctttgttgactgaatttgctttttttaacctgctttctgaaagtgcatcacattaccatccaaacttattggacataattttttaaagtatgtaagcaagtaacatataatctattttacaaattatgcagtaagacatagtgggatataatttaagaagatgcaactagcccttatttttccactctctggaggaatttcataacttttcacatgtttgcacttcctgtctctgatctgtatcttctttggctcctctgtcttgatgcccctcccaacttctgttcacctaagtccttgatgccatcagtgaacatcagattccttctttggaagaccagtggttctcagagtgtgctttatggaccagcaaagcatacgagaacttggtagaaagacatattcttgggccccactgcagacctactgaattagaaactctagggtgagatgcacccattgtgttttaataaactctccaggtgattgtgatacaccctcaggtttaagcattcctgccctagaggaggaggctagattcagtaggtgtttctcccagttgcccattttgacataaataatagcactttgttttgctcctcctcaggcatagaatcccatagttttaagtggagtgggattttgagtggacgttaccctggtcaactctctttaccgtagaagagagagctttgcagatagttgcagtgtttggctggagaacctagggctttctatgtccttgcttataacatgggctgtgtcacttccttgaaactttaatcagtgcttcctgagaccagggttctttgtaaaataacttaaggaagtattccagaagaaccaatagcattggtctactcacctgtgtgttctattaacattttaatattaacaatattctgatatttcagatgtagattgcaaagcctcacaatcaaggggcttttgtcattgattcgatttaattatcctaagggaaaaaatggaatgcttaaactagcaaaagttcacgtttctgtctttttggccatgttttcctcaacgagtgtaaatatatttgtgcgcatgtgtgttgatactgcgtgttggaaagacagaaggagacagactaaatttctgtttatagaaaaatcgtaagtaatctgaggaagcagtaattactggagttggcaacagtttgagcactatcctgtcccttgatctaactctggctttagagatagttgaatttagaatgttaccttatgggcagtttctttatctattttgtttccccggttggacaatctctgtagtagaactagagtttggtcactacttgtattagtctgttcttacgctgctgataaagacatacctgagtctgggtaatttataaagaaaaagaggtttcatggactcacaattccacgtggttggcggaaggcaaaaggcacgtcttacgtggtggcagacgagataattgagagccaagcaaaagaggtttccccttataaaaccatcagatctcatgagatgtattcactaccatgagaacagtatgggtgaaaccgcctccatcattcaattatctccttccaggtccctcccacaacatgtgggaattatgggagctcaattcaaggtgagatttgggtgggaacaaagccaaaccatatcactactggattatgactctctataatttgaaaagaatggtagaatttaaagaatttgaaagcagtccgtttgttttcaatattggattgttcaatattgattaccttgcatatcatgcttgttccctccccatctttgtgggagtgcaggaggcacaaagaaagcctttaactgaatgatctggtttttctagatggcttaacatttttgtatttgatgggtcaatagccttgggtgctttagtctagatgctgagtgctcaaaaggctaaacacggaggaaaacattcccctgtcgaaacacatgattgatttggtagtgacaagtgttttgggagccagagacatgctagtgggttaagcaagggtttgtttgtttgtttgtttgttttgctttgttttgtttgttttgagaggaagtctcgctcgtgtcccctaggctggagtgcgatgacatgatcttggctcattgcaacctccatctcctgggttcaagtgattctcctgcctcagcctcccaagtagctgggattgcaggtgcctgccaccacgcctggctaatttttgtatttttagtagagacagggtttcaccatgttggccaggctggtctacgaactcctgacctcaggtgatccgcccgccacgacctcccaaagtgctgggattacaggcgtgagccaccgcgcctggccgcaagtgtttctttaacatggccatcttaaaagggataaaggatcttctaggaatttatttcagctgaaaacagattgtgatacattcttactttggtgttgtcatcatttgttcatttctattttttctttctttcttcaacagatatgtcaaatactatcctaacattgaacaaaataagttgtttaaaaaaaaacaccaaaataaaaaaggcaataactatttttaaacttataaaaacaaatcaagtttggcttgacataattatccctggacataattatccctgcttcggcaatttagggaagaggatttcaagatttcaaaagatcctgggggaaaattaggtaagctccatggccagagactctaatataaatacagttcgtgaaggaggaagttagaaaaacatttaaatttaatccagtaaaaatgaacaataaaaacaaagatgggaggggtggatcatgataccagagagtgactagagacattttgctcagaatttaaaataatgtatccagaagctagaaagattgatgtttaccttaggataaatacaaaatggcgtgaattagaaatcagtttaaggactaacaaagtcaagtacgaggtgcctgaaaactagaaagaagtgaataccgtactggtttttgaaaagggaaaagcttgacattaatacctggaaaactggtggagctggttattaaagagatcctttgtgaataggaagaaagcagtgctgactaagtgggaacagggacttgctaagaggtcctgaagagcaggtaaattctggcttagagcctccggagagggggatctttaaatgagctctgtttgctcagcctttttatcagcatatctgaggatgacatagaccataacccttatctagactttccaggcgttgcaggcttgggatccagaaggaacgtgaaggaggggggctggttgagtgagatgaagaaggagggagacatcttcatgaagatccaagggccccaaagctgagagggactgctgggatgtcagatgtcagatcagtatccaaaatcaccttgctgtttaggaaagctggatatgcagaccagtgaatgcagagagaaagcaaagaggtttgtgtgtgctgggggatgagtgcgaggatggaagggagtgggaattcatttattgatatatacatacagagcactgcacccactttgtgccaggtactgtgttctgggtgctgttgtagcagtgaatcaagtagacaaacgttcggcccccatggaactcatgtgtagtgcaggagatcggaagcaaacatacatgtaatttcttagggggcgattcatgttatggagaacaataaaccacgatggggtaagagaatgctggtggggggtgggaggctctgactggcttacacagggtggtggggagtcctgcctgatgttgtgatatttgagtctgggggcagtgaaggtgcaatcagcccagatggctggcaaaagtggttccccagggtgtatgctggagctgggagaggcaagtgtgcctgtagcagagatccctcagggaaggggaaggaggatggtgcgggaagaagctcaaggtgagaaggcagagaaagggggcctagaaaccctttgttcatcctgatgagattcaggatttgagtagaggagggacaagatctgggaatacacactcaggatccttcttgatgacagccttccaatgctttaagggaacagttccaaagtcagagccatggccatctagtgaaaggtaccaagagacagcttttagttcagtgtatggcagctttagaattcaagtcgcccaagcaatggtctgtgctgcttcatgagtttagtgtccctggatttgcgcttaaaaaccaccagggtccatttcaacgtgaacattcagtgagtcttcccccttgttctacaagtgtttcctgacattggtcctgacttcggtggggtcgcagatggggaagagcagagcaggcgcgtggaggtgcaggggatgctaggagaggaagtggaggctgggttcatggagacacaggggagcagtgtgagttcctagaagaacttcctagaagttcccatggttcagaaaagtgagggggcctgccacggagagactgagcattgggcatgaagagggcatgggtcatgagatcatggaggaaaggcctggggtaggctagagatctttcaagaagcagcaaaggatgaatggaagaattgccaagggcagagcttagagcggagtgaccaaggtgaccatcagagtcttgtgaggtgtgccccccgggtgggaaaaggaaagcttttgtttcctagggaccacaggtacctgagagaaagatagaggactgtctggcatagaaatggggaggggaggacaagagatgccacaggggagggacccccaaaatgacaggaagagttgaggcctagaggttggatccacagaagacgcattctgtctgtatcctgtgatggcaaaggtgggataaagggcctctgcctgagaggctgaagtaggagaaagcctgagattcttccaggtttgggttgcctgggtgtggggagcaacaactgactcaaggagagaaagcctgactcagcctgtgctttgactgtgcagggggagggcccccatgatgttccttccccaatttcaattcagagacatacgtactttcctccaaactgccacttaattatatgctggcttgactgcaaggacactgagcaaattcatttacattgagaaaattgaggacaaatgaaaaattttaatgttctcatgtcccccaccccccaccccccagtttataatttggaggaaggaagtaaatttaatgcagaatataaacatttaacaatgtaggcttcttcctaaaataatagattggttttttaagcccacatttctttctgagtgaaagaaataattcttgggaggccaaggtggctggatcgcctgaggtcaggagtttgagaccagcctggccaacatagtgaaaccccgtctctgctaaaattagccgggtgtggtggcacacacctctaatctcagctactcgggaggctgaggtaggagaatcacttgaacctgggaggtggaggttgcagtgagctgagatcgtgccattgcactccagcctgggcaacaagagtgaaactctgtctcaaaaaaaaaaaaaaaaaaaaagaaataatttagttttaagtttaaaataattggtaaataagattatgtttatttgttaatttaaatgaaataaaacacgtgcttctgtagtagttgtactatggcaaaactgttcaaaatatgcacagttaattaattgaatttcagatggttcccctgtggatgtctttccaggtatgtgctttagagccagaggtaattgatccaatgttgtcttttattagatacttccaggctaatatcccactgaccctaactgttatatattcctgattctctctctaagccttggaaaggctttggacaaaatcactaatattctcttttgacggaatttgagttttcacaattacttctttcttttattttctctctccccacccccctgtgtgtgtgtgcatgtgtgtatgtataaacacacacatatgtatttattctgcatttacttatagtcactgtattttaagcttgcattcttatggaaagtctatgttacgaacttagcacttactcctcagaggcagtgttagataatggaaaattcatgagctatgtaaccagacagatggtggtttaaattctagctccagcacatgcaaaccacatgttcttggcaagttacttaacctctctgagccttggtttactgccctataaaatgggtctaattattacttatctaatgggttggttatgataattcactatataatgagaattatatattttttactagatgttaaaagcacctagtaaagtgcctccattagtggaagctactgctgcttctgtttttgctagaggagtacaatggagacatgaagccatgagaattctaaaaactagggaatgggaacatggaaagtagacctctgaaaaataaagggaagagagtgaaagtgaaaagttactgaggtaaataagtattttatcactcaactttctgttgtactggtgaaccagtaattacattaccttacattttctaaatattgcacgtactttcctcgccggatggcaaaggatgcagtttacttcggataatttaattcggttattatactttgattctcatcatgctttcttttaccctggtttgtagaatgtttgagaaatcattgattgggctccctgtcttcacagagttgaatgtcttttcaacatatggtcatgtcttctctcccaaaacgtttttgggaatggtgtttaaggttttgctacataacaaatcaccatacaacttagtggcttaaaaccaccatcatttatttagcctgcaattctgtgaaccagcaatttggactgggctcagatggacttttcttctgctggtttcagctgggttcacctatgagtctgtgctcaggtgctggtcagccagctctgcttctagggaatgggtggcgatcagctggggtgatagagaaagggaatggtggggaatatggaccttgggggtcactcattacccagagactagtcctgtcttgttcagatggcagctgaaggttccaggagggagactggaagtgccaaagactcttggggcccagtttcagaacttggacagttatactttacttcattgtgttggccaaagcaactcgaaatgccattgcagaatcaaagagcagagaaatagacatcacctcttcatgggaggacctgccaagcattgaggccattttcacaatcctccttaggtggggactctacagtcctcattaacaagtcaattctggtctcttggagtcaataggttccttctcagacatgagacagacatacacacatactgtagtaacttctgctttaatgttagtctctttaaaaatgactcggcattttgaagactgaaaagaattacttaagtttttacatcccttgtgttgcagacagatctcaagtgtgtgaagtgttggcgccagaggattgatcctgactgcactggaccttccttggatttaatcctgaccagatccactcacctgtgtctaagcagtggtcaggcagaatgaggaagtgttagctggtgacctcactagaggctcttcaggtggccctggatcaagagcagcttatttgttgtctttgatgcagaaagtgagacatgggagaaagggcctgcccttaactcactggatttcttaaaacatttaaacattgcattgtaccaaatgccaagcagataagtgagttcctcaaatacagctttttaaaactcttatcactcatcagatatctcaagctgtttggcttgtttgaagcagccaaggatttcttttctttctttctttctttttttttgaacaggcagggtctccactatgttgcccagtctggtctcaaactcctgagctcaagcgatcctcctgccctggcctcccagagtgttgggattataggtgtgaaccactgtgcctggccaaaggtttattttctgatcattttgagggaaaataaattccaatatttctcccaagacagtagacttaggatctcagtggtttgtctccaagtcgcaaacttaaggggttctttttttacatgaattttacctgagttctaacttgtgttgggccatcaagtttgttacgcatagccttgggcttgtgtgccttgggtagtgtgaactgttcaaattgacttctggcctgtaaactctactctcttcccactgaggactgaccccagggaattgcatgagtcagggagctgcctgtttcccttggtgaccatggaaattaggaacagtgatgacctggatttaggggaaaactagaaagtgactgattcagttgaacagctcctgggacttcagtgggccaggcctaggacggaacacgccagacacaatgttcctgccttctgggaggaggtcctagattgtagccattattcccttgggaccaaacagtcttccaccctgtgatacagcaaaaattagtaggaatgcatctgaagtgtttttgcttattgatgaattaataccttagcagaggaaagagataaatgtcattgcatttaccactcttcttgtacagccagtcttctttcttacaggtgcgttctttgaagaaaacttgtgaagcctgtaaattgagtggaaggagtaggaattatttgggttattaatatattcttcactttctaaaaatgaagaaaaaatatccatcttctcaagtttaagagttctttactagttgaggggctgggcctagttgttgagtttggagttactgtatttttttctgatgcgaagtagtctgggcccagtggagattctagggtgaaggaggacttggggttgtataattaggcacccctgtggacagtcaggatgctgtacagacggtggggaaaggaatgaggttgtgatgttaatggatttctcaagtgtttatttgccttctgttatgtctaggcattgtagattcctgtagtcacatctttgaagagagagaaataggtttaaaaaaaatgcagaaagtaagtggtaaatgtgttaagagaaggaaatgtgtgagtccttgagtgcactttgggtgcctagtgacatgatttcctgggtgagtggaaaaaggctagattgtggaagtagcagttttccaggtggagaagggagggaagtggaattccaggctgtaggaacctgtgttcaagatggggaggagtgatgagcgctgtgttcagggaactccacgtcatcattacatctgactagaccagagtgggaacccagtggagtggagaggccgaagaagaaaagacaaaacattttatgagttttaatgtacactggggggtggggggcattggattaaatccacacacactgcttttctaaaaggcctctgtttgacaaaaggaaatgctgttcagctctaaaagtagctcttcactactgggttaattgaatttgcctactttcctgtaagtgacaaatccctttttctagaaaaaggtgaacagattcacctagctctgtgcggaatgttgtttcacctgtctgaatggtctaactcttttaggtggggccttatgctgtatgctagcaatcgcaaatgtttgcccaactcaaagaattcagaacctggattgtgaaattcaagttaaagtaaaataactatcattgttaaattgtgctgtttcaatatggcttacctgggctgctggcttctcgagaaatattcggcatggctgtccgtgtgaaggattgccaggacctgaaagatggaaggtagagagtgcaatggcagtttgaaagcagctcaggtgggcttaggagcttttgtgaataagagagagctcagatttgatttagaagaaattgacttcaaattaattctattactggaaacttgcactggggaggaaacccgggtattactgtccactgctaacactgcgaaacgattttcttctggcaagagtggtagttggaatttaaaccagacactgacctgagatgctctctaaagtaaattgactaaacacttatttgaaaatgctctataatgaaaatgttcaattagattgaaattgtattctactccttatagcttattcgtctcactcggtttgtgctttttaattttatttccacttgtaagtgggaaacaactgtttataaataattagaaggcctttgggtcttctctgattcaaagtcttacattcctgaggcaaactgatggttctgtcttgccaccaaatacctggtgcctagtaacacaagtggcagcaaaatctgagacctgaaattaagtgccttagctagtgttttaaacatcaaagtatgagtgatttcaagtgattgaaaggtacccactgagagaaattttacttgcagcaaggaagactaggacttgaatgtgtccagtgactgtccccatacatcctggggtaagttatttaacccctttatgccttaggttgtaattttttgaatttttgcatgaatgaaacatcagaccttggcgatgaccttgagcagtaggatataaataactcccgcatgcttagtgttccagtaatggaacacgaggcatattaatctttccgagcttcagtttctgcctttataaaaaggagaggatggtgctcagatctgcctctttgaggtgggttttagttttattggtaatatttcagttctttttcaaaaatttgaggccaagattgcagatttacatttgaaaagtcgaggtggtggatttcaggggtgcctgttaaattattttctgagttatgtttgtttcagattatcttccaattagaacaataattgaatcacaaattagaagtgaaaatgccaagtgccctcacacatatttctagactccatgagtatttctgaaccggacgtgtaagtttggcgtgtggggattaaggggagaggagtgaggtggccgtgctgaagaactaatcataagactgccatcttcgccctcccccatcctgtggtgcttaccaaaccaggatgcgaccagcttcaatccaccagggctttgctgcttgctccttagagaaactgtctgtgaacacgtgctttttctatacctgttggatggattcttactgtactcattgaagatggaaatgggcaaggatttcagggggtttctaatgatgaagtagtagcgtatctgtaaccacttataaaaaggtcagcctggtgagaattaggggtcaagagagtgattggtttatcatggtcattcattatttacttttaaatgtaggttaacgtggtgggagaatggtgtctctaccagtggctctgtccagggaactttagagttttatgttaaataagaacccagactctggcagttacaggacctggtttcttgggtctgggttctcagtcactgggagtcttgagtgactaattacacttgtgcttaggcaacgtttgtagtcttctttctattcctttgtaggttgggcagttgttccgacttctgtgggactgagagatatcccaggatgtggaactttacaaccagaaaagtctgaggcaactggggcagctggtcttcctactttctagcctccatgccttcctcttctcctcttacctcctctctcatggccagacaataccatgagcattccaaactctttaggctgctgttacagataaactttacatgtggtggacctggggagtttggcaacacaaagttattcattttaaaaaataggagtgctcctagggtagtttggacgcaagcataagctgcctttatagagcttaaatgtgtgctgcctgcagtgctcctgatgatttctttgtggttctttcctttttgctaaaagttttctgaaaatagaaagccgtggccattatagttagaacagggagcaaacaggaacctctgagaggatccctagccccctgccccctgcctgggtccacccctacttctgggtagctatctgctgtcaccacctgcaagagcaagagtatttgtaagctgtggattatgtccctaggattactagtctttctttttcaggaaaaataatacacaattcaagccaaatgtaaacaagcactaagatcctacacttttgttctcggtgatcattaaatgctgtgggtcatttcacaatttcagttgtcattttagttatccctcatgcgtagacaggacaggtacaacctgtatctcaaggtcaaagggcaggactctacttatgtttgtggaacttcagaataccagacagaaacccatgcagagaggtagcctctcaagattttgatcttgtctcctccgtgaagaatgacatgaagaatttctctttccctgtgattcatcaggagagtgctgtttattcttccaggtttacagctcacacacccctgctgcttttccctcctggagaggttacaggaccttgtgatcttactgggctgtgtgaaaaacccatgatgatgcctttcccttctgcagatctttgtttgaccgtctgttttaagtgcccctttttctcttggttatctagctgccagctgtttacaaactagtttgcatcaagcggttgcctagaaaccatcatgaaaacaggattaggcaaagcattttttctatattacagctgctttctgatgaaggcttggcattagaaagagctcagtgtctaccccttcccagccttaaaacacaatgcaagtgaaacaaggactttccaacagagatgaaatgatttctctagagtcacattctgagaccgtcatcacccacccaactctcccctcctctgcaaacccgcatacctttccctttcaggagagtcgtgtgttggggatggttgacgctttttaaagaacatttaacatacaccaacagcaggtctcagatactgttatttatccatctattcctcaggcctcagctagactggagtgggtgcagagaagttagaaggctctggcagtaatttggtcataaggaaggaatgtgttatgtggagtagcagttaatcaactaagcggtaagcaggttttcagtgaaacaccaccgggagctaatcccacttaacataaactacagtgacttagagggaacaaactgtctaaccctgagctctcttgtttcccaggaaataaatcaggatgaagtcaagagacatcaaggagtttacattaaaaggtcttactaagtgattgaaatattcttaaactggctgggcacagcggctcatgcctttcatcccaatactttgggaggccgaggcaggcagatcacttgaggtcaggagttcgagaccagcctggccaacatggtgaaaccctgtctctacgaaaaatacaaaaattatccaggcgtggtggcaggcgcctgtaatccagctacgttagaggctgaggcaggagaatcgctggaacccgggaggcggaggttgtagtgagccaagatcacgccactgcactccagcctagttgacaagagtgagagagagagaccccgtctaaaaaaaacaaaaacaaaaacaattattcttaaactcctcctggagtaggatagataggtaaataagtgattatatctggatttggggtcaaaggagaaagaggaatcaggaaaaacttaagagttagtaagtcagcaaatacttactgagcacttccttctaggtgtggtagagttggggtggggtaggtagggtggctgtcaaacactgagcaagacagacagtccctgtatattctagtgcaaaggcgggaaagcaggggccagatcataaaaactggaacagataaatcagtaagctaatttcacagactggcaaatgcagtgaagatgacaaaatgggacctgtggctaccgtaggggtcatggacactgtttctctaaggtgacatttgagttgaaaggctgagagcctgagggctgggcggggatatcctctcagccatggggaagttgggaaggaggctgagtatgtggaagagatggttaatagaaatcaaacacaaggagaaccttcaaagtcagatgataaatcaggtccatactaggaagatcttttccaagtttcccagaaaagtaaatcaaacctcaccaggcctctagatggttttaattacctttttgtagggctgctgaacagggtattagtcatatacttgacaataaggacttgtggatttttctcagagatattaatggatgggagtaaatttgcatttgaaattttatttttaaattacgaaaataacatattaccaaagttagagaaataagaaaagaaaaactcttatgttcccactatcctaccagccctattgtctattttgtatatttcttgaagactaggtctcactctgtcacccaggttatagtgcagtggcgtgatcctgactcactagagcctccacctcctgggcttaagcgatcctcccacctcagcctcctaagtagctgggactgcagctgtgcaccaccacgcccagctaattaaaacattttttttggtagagacagagtctccctatgttgcccagactggtctcgtctcgaactcctgggttcaagcagtccttctgcctcacctcccagagtgcaggggttacaggcatgagccaccatgtctggcctgttttgtgtgtttcttacagtctttttcatgtatatgattttagatagttaatacattgccctttgaatgcatgacagacatttcgccaataattccttgagcttatataccatacttatacatttcaataagtacaatcaattcttgttatttgcagtggttatggtctcttaagtcactgtgaacactgaactagcaaatactaaccctttgctgctaagggaaatagaggattaggttcttgcgggtgtctgattacatttttatcactaatcagtatataaccttgttttatgtgtgcttctgtttaaagacaccatacttaatgtatcaatatattgttggtttattaacattgagctacagccaagagtgctatcacccatacctgaacaaagcttatcgaacacgtggatttttttctgtgaggcatatcacagccgtcttgtacttaggacactagatagcacttcagcactgtgcttgggaggtgttttagacagcaacgtcaccaacaaaaagcacaaagatatgaaaaacatggcactaaatagaccatgaaaaggaacctgcgtaatagcctgagagctacagcaagaaggcagagtgtgccctttttcagccttagctgggcacgtgcatgtcagtgactcaaattttttgccactctatgcggattctcaaatgaccatgaaagtgccacaagtattgatttttgaggttacaaatacattttatcaattagacacaattcagaaatatggaatctgtgaatagtgaggatcagtgtattattcttcagactgtaccatggctgtaccatgaaactagggatcttgaaactagggaaagcctccccaggcctttgaattactggagtggagaaatgaaaaggttccctttctcctgtaatattgcaattaaatgagaatatgtgagtcctttataaagtgtgttttgagatctagcttacaccttacaacgacacagtttctgatatgtccttttgtttgtttgtttgttttactctgaaactaaatcataaatggctcaccttcggatgcatacacagacactgctactctggtgtttgtggagccttcgtaatacctcctcactccccaccccaaacaaaccaaatcctgaaaaaaagcactactacggagtagctcagaagcatggggtagaggagaaacagccctttgtgtctcagtagggaacagtggtgataatatcaccttacatttatgagaggcgttagcatttgtgagcttctttgatgtggtccagtttccccagaaaaagacaagtgtggactgatggtaatcatacctgaccttacctgaaatgactatcagacgttttgccctctggagaaatccagggtgtgagtcttgatcctttctttgaccagtgcctgtttggtgagaatagctatcccattggaaaacacagtacccctcatatgacccacaaatccatgacaaaaccacccacattttcaccatcgaagatcaagaagcatatggtgtattggaaagagtgtggcttttgcagtcagaggaactgattttgatttcctagttctaccccttcctcagctgtgcaactttgggtaagttgtaaagcctctctgagcttgcattttctcattggtctaatggggataattatgaccccactcatatgtctgttgtgaagattaaataaaataatatacttagccacttcccttattatacttctgacagtacctccgttgacaaggagcttatcaatagatccttagagaaaatcagtgagtcatcttgacagtgacctttgtttcccagcaactcggcctggagttgatcactctcaataacaccattatcaaataaccagtgcggattgggttttgcatccatgagtgtctaagcaaatgtcactatttaattttattcttccaaaacatgttatttttccctggtgtgagaaacacaaatgttccaaagtaaacattcatgaaatatcccttagattttttttctaatcttgattggggtgttgacaagctttacgtctgtgttagctgttgaataaagtcatagaagagacttggtgaatataacatacccaggtcaaaggggtgtgggaagaggctagtgcaacactggtgtccatttgatccatgggaaaagcgaaatataaggaagtaacttgcacagaaggatcttgaaactagggaaatcctccccaagcctttgaattactggagaaacaaaacctagattccctctctcctgataattttgcaattaaaatgagaatacgtgagtcctttataaagtgtgttttgagatctggcttacaccttacaacgacacagtttctgacatgttcttttttaaacgtctgtgggaagttagcaagtgaatcccaactgctggattgcccatcacgggtccgtatcagcctcactgtggcagagataatggggtcagcagtttgaatgccgaactccaggtccaagtggctatttccgtttgcactttgatagctggcatttgcctaagagaaaatgatatttctttgggctgacttggcctttgagattgccatgagacgagtgatctctgtaccctgatgttaggtgtagacttatttctcaactaggaagagggacaacttcatgtaaacatgtttggaactttgttccattcttgtgtgaatgtcctttatatttctgatgactcctatggtgtaagttggtaacagacagccatccttaagcctgggatagtcacaaaactgatgatcctgctggttttcatcatcatcactgaaactcatttgaatggccagttgttcattatgttgtgcaggtcacagaacaaggacaacaaaatgcatctgatataccttcttggagcttgcagtctataacagataactggataggaatggtcaattcgttttcatgaggctattcttcagttacgtgctaatactcatgctgtggattcagtaggaaaattgaaactagagaagtcttatggtgagcccagcacgcttttgaatagccaagatgatcctcttaaatgctaatatttaccttggccaaggtaaatcaatatcctgtttccttctgttaacttgcagtggctttctgcaagtaagtaaacagtctaatagtgagaaatttagtagggacatggaactgagacaccaaaattccaatacatttgttttattccaactttgtagagttggagagttggaggagatggagaagctatgggtaagttttggttcctaccataatgtccccctggctactagcaagatgaagcttaggcactagttgagaaaaacagtttaatcgtgaattgagtttcagcatgatgtaataccagcttcagtaatgaactagtgagcatgttttaggtagtcctagtaggctttgagctgcaagacagcatctatgcatctccagaatttagcacaattgactgacacattatgaattttgaatatatcttagctgaattgaagccaaggtggtagacacaagagcagagaggcctggagacagggaatcatgggaaagcactgtcttgtgaggtcctcgatattagatccaggtgaggaattgttgaggtcaggtatggaagtaccttgttcatccagggagccagaaacagagcaggaggacttggtggggtagctgcagagtggcagagcccgaggctccaggctagtgagggagccaactcaaatgaaggtcgggccggaggaggcctggcacagttataaacctcctgtaaagacagggcaggggaaggaagtggatgtggaggtggatattctagacgtgacaccagccaagccaggctgtgactggtcttcagttaagaaatgtgtcttatataaatgtgtctactttgagcatttcaaaaattcttcttcctccctcccctcagttttcctgtaaaagtttctttaaaaaactcaacttggtcttggctagaccatcaggaataaagagatttatctaaacttaggccagggcagaacaactaacctgtgatctgggagcccaggtatgaagtcacaggcgccatcttagtctgacttccttttctaaaggagtgagccaaggggggcaaatggcgggatcaagacacaggtgtggagaggctcaggggagccccggagggcacaggccaggactacacccccagtttgaggctgactgaaagtgtcacaggttctccagctctcctgtttctcttcaggattcatttttcctcctcaagaatgtcttcagatagtagacccagagaagcgagggtgtaggtgagggagtggacagagatgtagccagttagtgggtatattagttttctcttgctacgggtgttgagcgggtgtggctgccataacaaaataccacagctgggtgcagaaatgtatgtctcgtgattctggaggttgggaagtctgagatcagggtgccagcatggttggtttctggtgagggctctcttcctggcttgtaaacagccaccttcttgctgtgtccttagtgggtagagtggagggaagagagagagcgagagagagagagagcgctagggcttcaacatttggatttcggtgggactcagttcagtctatggattgaactatatatatatatataactatatatatataactatatatataactatatatatataactatatatataactatatatatataactatatatataactatatatataactatatatataactatatatataactatatatataactatatagataactatatatataactatatagataactatatagataactatatatagataactatatagataactatatataactatatataactatatagataactatatagataactaaactatatagataactataaaaaactatatataaaactatatatatataactatatataaaaatgtatggacagccttatagcttatatatatagcttatatatatagcactacacctaacaaattaccataaacatagtggcttaaaacaaccacatttattatctcacattttccatgggtcaggagtctgggcatggcttagctgggtcctgtcctcagtggctcaccaacctgcagttaggtgtcagctggagctgcagtctcatttgaggctcaaggtcctctttcaggagcatatggttgtagacagaattcagggttgtttttttttttttttctgcatttgtacatcttctagtggtttgcctcttccaggccagcaggaggaaaatttttctcatttctagaccttcttttaaagggatcaccttattagatcagacccgctcaggataatctccgttttgatgaactcagagtcaactgaattgagaccttcaagacacctgcaaaattgccttcaccattgtaacccagcactcacaggactgccatctgtcataatcacatgttgcacaggccacactcaagggaagggggttataccgagcatgttacagcagggagcaggagtcttgggagtcatcttagaatttcagcctattacagtgggcaggagggagtgtgtggccagtgcctgtttattctttgcataaaagcagagggatttaacagactataatttgggggagggtgcatttggagagcaggatcaaaaatattattttaagtatttgtggctggtggctcaagtcatgagagaacagaaacggccactaaatacaatctaaagataaaagcttaattgtagcggctcaaggtggaaatttggatttatgaaagaaaaagtgtttcgatagggcaatttgttaggagtcatttcagagcccaccctcatgaggaggcgggtgaataaagaggagctcctttccagcatttgaggttctaatacaaaacctgcgtgttcacctgtaggtaaccatacttgttggtgaaaggcccagttcttcttagtccagattgctgtctacatggagggcaaaattagagagcagatttctgcctatgtaacatttaaagtgtcagaggaaaaaggatctgtgatttggggtattattgccctgcagaaaagtctgtcttttaggcctgtgcctaccaatgggttagtttgtttatttgttaacatgcataaaatatagaatatctatcttttgggcagaaaatattgtctctagtcagttgtcctccctggtttttgttccctgaggactatttaaaccaggtctcacgcaattcagttaaacagaggctgttttgaaaaagcaaatgcttttttcctcccattgtaaattagaggtcttcattgttagaaatatagataagaagaattaaaaaaccgtattaacactacacaggagtgcatcaacattttgctataaggctgtccatacatttttatattctagcacttatagataatttctactttcaattaaaagttataaatttggctgggcgtggtggctcacgcctgtaatcccagcactttgggaagccaaggcgggcagattacctgaggtcagaagctggagaccagcctggccaacatggtgaaacccccagtctctactaaaaatacaaaaattagctgggcgtggtggcacatgcccgtaagcccagctacttgggaggctgaggcaggagaatcgcttgagcccgagagacagaggttgcagtgagtcgagatcatgccactgcactccagcctggtctacagagcaagactctgtctcaaaaaaaataaaaaataaaaaataaaataaaagttataaattctaaaactataaatttgattattcatttatgaaatagataaaaagacattgatatataaagtatgtaacaacatatataaatatataaagacaattataaattagggaattcagttttcacaatatatttttcatttagatatatgacgtggacatttctgtatattaacagatagttttctacagtagcagtttgttttcatagccacttagatataccttaatttatttaaatactcatatgtgggctattttaaatttcacagattgatggatcacaattcagggatatctacctttgatcagtaagctgttctttctgattgtgatcttgttgccttcactcaaatggtctaatgttcattgattcagtgcttgctgcttgcaaaggcaaaacttgtgctttaggtttactttttccgtggtcggttcccaaggctacatgcagagtttttaaatacctcttttgtgagccagaagacctaataaacaaaccactttgttgagactgggaatattagcattggcacaatttcttaattttactgtgcgtttgcagacatcatgaggcagagaggtggtccagctgcaccttcgttccacacacggactctgtgtacagctttgtgaattgctatttttctttccctttcccttctaaatgggctcccggtggcaaaaatctgtttaaacaaaggtaagcaaaagatcagtttaaagcccaaacttcaaaagttaagaggtttaacctattagacacccagactttgcaaatgtgaagagtattcagatcaatggggaaaggggcatttggatattggtgggtctttagacagtgaagagaatacaatttcatgccagagacagtcacgaagagaagtttttgacacagtgctgcattttgcatgaatgctgaaaacagacccatggaaagaacctaaatcaacgttatggatccctcttagttgaatctacattttgaaagctccttttttggcttttggaaatacatggcggcatttttggttgttgtcataatgggaaagggggatgttaccagcactgagtgcccaggggccctggaatgtacaggaaaatcctcattaatgaagaatcatctcatcgacaatatcaacatggcctggttgaacatctctaaccacttcagaaattgttagtttcttatgaggaatagggcagaaaacatgaaactatggccctgaatttttttctaggcttcctagaaatggtctagtgccatttccctcccccatttctcatggaggttctgcataactgaggctagaagatactggtagatgaaaggaggtttggttgaggagaaagtagtacagtagttttaagtctgatactgctctccatctatgcttggcctccacaagttgagtcattttttctgataaagcctgtctggttgtttgtctcagagaccagctgttgaaagggcagagatcacccagtactgcccagctgttagctcagccatcctcaagggaagccattctttgccaatagaatctcagaaaaggccagagaaggggagttgcagggaacattgactcaggcttaagatttattttcaggctgttttactcttttaggtgtgagtggaagcagaagctacctacgtcatagttggtctcagaataccagagccgcagggggcctgggagactgcctggtcccacctcttattttatttcctaacaaaagagacccagaggggttcagtgacttgtccaaggtcacagaaccaagtagtgacagggctaggtctaaaacccaagcgttttggttccaaacaaggcattctttctgctatgccagcaactacccctttgacttcttacttcttaatgaagctgtgctgactttctttctagaatatctcccccacccccgaggcattgcatcattattgcattcaaaccttgtgtactttctgatgccattggctttataggtaacagaaaataatcttttgtgactagaaggcaaatgtgtcctattcatgatccaataagcagctatccaccattgttcaatcatgaacaaacattcagaagcattgctctacctcgtcttttgggagaaaaatactcaaactgtttgggaataacttttaacatatggtgattgcatgtgttttccagcaggactgcagaatatctctgtttgcttgttcttataataacctgctgagatcactagattctatttatggtctttcttagaaagagaatattatggcctcgtgttttattttgttttgttttgtttttccttcttagaaattcttcaactctaccaagttgaagaattgaagctccattgttttcaataaagaatctgaagctaaggtacactgaaccactaccactatcccaaaagaagcagagtttgatgtttccctattcatttagaatggttcctttctgttccaaaagggatgacaggactgtggctcaatgacaggggagatccgcctgagggcagaaggatttagagggatactttaaggagaacctggaccccacttccagagaaagatttgagaacctgaaaatattcgtctggttttcagcagtgccaccaaagtaggaacttgatagtgcagttcagctttaaacagttccttcataaaagtttgaatgagaagtttgcctaaaaattataattgctggttaagatgaaaggacactaaagaagcttatggatgtgagcacagtgtggctggtgaactgtggagaaattgcagggaatgagagagatggtttgagactggagatatgggcctagttttcaaaaaggggaaaggaagatcaatcaatcaattatgaattgatgaactgaaaatgagccccctggtaagcaaatgggaaaactagaatcgaccgagttcactaaagaaaaatgatgttttatgaccttcatcattttttatggtattaagagactgataagtcagagaaatacttaataattttgtcccagttttagcgaggcatgtaatacaaacaacaataaaacagctaacatttattaagctcttattatgccaaagtaattcttctaaatgaatagagaaacatcaaactctgcttctttagggtagtggtgtagtgtaccttaacttcaggttcttcatttaaaatactggagcttgcctttctgatctctcttgtttctagaaatgtgattggaatgaataacctggctggggctagcaatgtgggataacagaaagccaaccggggccctttactccccactgctccaagatagtctgtcctgagcaggcctcaaagctcttggattctggtagcacttagagatagaagagggttcattgcctcagctggttgaggtttatgagaggaaggaacatgcaggagcggacagccaatggctactgcgctcccaataactgcggttgctaactggctggccacgatggagataagaactctgtggatgtctgggaagtcacttccgtgttcatagcctgcacatggttttcttagccagttttcatttaccatagcaccatcttgtatctggattagacttgtatcgatgaattcatttttatcttcactacagttttgaaaggcagattggatttctcattttctagtggtgtggagagaacaagtgatttgacccaaggttgctgctaggatctacagagctgatgtagactatatgccttctgtcccatgagtccggtgcataacacaagggtttcaaaggctaagatcccctggtatgtctcaacacatgtcattccagagaggtggggcatacatgtgaggtctcacagagcaggagccaaagtggctagaagccagaaccttcctggtctcccatttgctgacctgcgggattcccttagctcttatcttggggtggaggggtacctcctggcagagtcatgcctgagcatttaaacaacacaaacagtactttgtacctctcaagcactttcccttttccccagtgtggccctctagggatgagattatctcagtaatgcttaagacatatttggctcataaataaagcataggtttctaggaagcatgcatgccgttcattttttcccacaaacttcatcgcccgttagtgtttcatacctgatgtttttggcattagatcttgacttggaggcagaattgttccattgcaacatgcacgttctgttcagagaattctgtgggggtcgtctgtggaacacttttcagtcacccatttggtgatctttatgtctggtcaccgtttctcttgttagagagtctgtagtgtagatttcagttctcaactctttgatttcatgtgccattttggacctcagttttctcaaattagagtgaccaggtcaggccagatgatatccagtgtttcctcaagcttcactagtctgtgatttggagcctgctgtaatccaaaatttttctggaatgaatggcagagtaccagattgtattcttttagggtaggatgcaagagtgtaggaatagtaaataccttagcttgtgccttcactgaaagatatgagggaatgtcctgggtgtcccctggtgaggtaaagactgaaatggagatggagagtgtatactgtgggagagggaatggggatgccttctgtttaagagagtggaagataccagagaggagaagcttatgactgcagagagggcaagagacctcattacagcagtctgaccaaaaaaccctccaaatttccttatataatgagcatgtaaaagggttgaaaactgcaaattgaaggataagggacagaaggagggatatcaacaacaccaattaggaagagtatctagagaatttaactgggtagtaagaaatttaaatctactttaactctcactgtggggaatttggacataggctgagttatgtaggaggctcttaagtgtgggagggttaaaagcaaacattttttggccttggcttgtgggatagatcaggcaaaaagccccgctgggcctccagcactcccatccaagattgcgggggtagagtctagactcggggatagaagtggagaaaagggagagggaagaattggtggtcctgatggcagctgctttcagcatcccagtctctgtggcttccccactatggatgacaagaacagaatcacaggttctgtactgcctcagccttgaacggttgacttgatcatggctttgatggtctttcacttgttggtgagattcagctgtctgttgtggcagaaggaaggggcaagaggactcggggatggtttgagtttcttgaagcatatcagaggacttctctacctgatacgggtatttctggaacagctctgtctgctctaaaaggatcctgaggatttccttcattgacatgaggagattgcccttctctcaggcccaagttacaattcaaaaagcatttttggggaacaattagaaatctgagctccaagtcctctgtgttagtgattgagaggcagcagggactatgccgaacgtgcctgggaaggggtcctgccctactccaggctgccccactgtctctaccctcgggataattctccgtcttgtgaggatcagatacagtcatggtgtgcaagtgttttgtcatatgtaaatactatgcattgaatatggaaggtgctattattattaaattttcttcgcattatttttattcctgttggtacttgttggatactcttgggccatggaaggacaggccctactaggctagaggctaatttgggttcagaaagaatgaagaagtgcattttgggggtatttgcagctatatgtgtaaataagccaagaagtaggcagattgaatttttatgtgctagctaattctgaatcttgcagctctcctttgttatcaggagccacttgtggggtgtttctcccttcatctcattaactgatttatttgtattgtgggcagatgctcttaaaatgaaacagtggattttttttccacatcaaattctaataactgctataggccattcaggattggcatgcatttgggaaagtggatcattacttgttttaatgatgaaaaattatgtagtttaaaaggaattagtatggtgcatgacccttgaagcaaatatcatatgtaaaaattcatttttacttaatatatacattaggaattagtttttaaaaataaaccatttctggccaggggcagtggctcacacctgtaatcccagcactttgggaagccgaggcgggtggatcacaagatcaggagttcgagaccagcctgaccaacatggtgaaaccccgtctctactaaaaatacaaaaattagctgggcgtggtggcgggaacctgtaatcccagctactcaggagactgaggcaagagaatcgcttgaacccaggaggtggaggttgcagtgagccgagatcgcaccactgtaccccagcctgggcgacagagtgagactctgtctcaaaaaacaaacaaacaaacaaaaaacccatttctgaaagcagtttgaggttcagagcaaaatcgaacagaaggtagaaagatttcccatatgtcctctgccccacacattcatagcctccgccactgtcaacatctaccatcatattggtagacatgatggtagatacattgacacattgttatcactcaaagtccatagttcacattagggttcactcttgtgtcgtacattctatagatttggacaaatgtataaagacgtgtctccaccattatagtatccgtgtcagagttccactgccctaaaaatcatctgtggtccacctatttattcctccttctcccagggtgactccttttacaaaatattgaatataccctaccaatggatttataataggtttcctttaaatatcatctctcaatgcctttattgcttaatctatttcacatacttcatttacaaaaaaaaaaggttcatctggatactaccaagcaaggtgtacatatatttatttatttaatttttttttttttttggtaataagcctctttaaaacacagcttttgttactgctagtgaaatttcagtaaagcaaatatcacttcagaacaaaacaccctccccaaaataacccccaccacaaatctccaaaactctggtgtaataaagagttcgaagctcagcccccattttttaaaaattaaagaaatatgtaatgggcctacatttttgtactagaaaagaattgggtatccttgaaatttcactgtaatggagtttgacttgtgagccatttttttttcttgggactttgacaaggtcacctttttcctcatggttggcatctggcccttttctgtgtgttgtgtgcagggtacttgtgtgagagccactcaggtctaaggtgcactggttttgaaggcaggtcccttctctccctgcaaggggaggagggagggtggcctaggggatgccaggagcccagggcagctcctccctgcctgagcaatacagtcaaactatgttttgctggaaggaggccttggtttctaatgtgaatttgagctgtgtcctctgaatcatttatggagaggatcagcttgctcttgccacactcccttcttctatggctccagtctttgggaggcattctgtgctctaggtaaggctcctagccacgatttttaagtacagaggcttcttctcctgcctgccggagaactatcttttcagccagagactggctgcaaagcttccctgtttcccagagggcagggctgggaattgaatgcttggggagctcagaaggagccccggcaggccttgggcctcttgttgccagcccaggttctgctttctgaatcctattacctgccgtggccacctgcttcactgcccatgggctggcattacaggggcaaatctaaacaaacccgggaggcagaaagagggtgttctctgtcctccttttcccaagttgaaaaaccttcgtagctccattttatgttgcctgcaacattttagaaaatgatagggtagtagagctgaataggttgttagcaatgacttataaatatccctgtgttattactactttctctgctggcagggtttagcccgggatccatggaatccccctgccgtctgcagacagacttcaggggcgggtcagcctcctgaaatgctgggctgtgtttgtgtgtttgtggctgtgagcatttctcaggcaggactgtcattagattcccaaaaggagcattaggttgtcaggcaggagcattcattagattcccaaaagggtctaagaatttaaaaaaggtgaaaaaaggtgacaaactactgatcaggtttaaagcctaccctcatccccagtacacatagcactcacacactcacatgcacacacgcacacacacagaggtttacaggtaaggaaactgagtctagaagaggcagactgaccaccactgaagtgcaaggctgggactagagaactcctgtccctaactggtctggtgcagcactcttctgttagcctgtgcacaaaagaggcctgttgggctgactatgggatggcacaactgctttagaacacgctctgcaagttctctggatgatggggcacaggacatacattctggctaactcattttgcaccttgggataactctgtctttataagactgacctttattcatctttctgcccatgctcccactgtatttgttgagtgggcgaaccttagtggagagtactgtacggaagacaggtcggtagctttatgcagccagttatttgaactaaagaattatgaatccttccttttcctcccactttgttcccctttcctcaccctcgtgacctctgatcttagggcagttgttagcagcaggaagtggcccagatcataaaccactccttccttgcaagctactttggcagttcattagtgacctgaaaactcaaagcgtaaatgcttcagagccgaggtaattttttataaaataagtaattcttataaggataaaaatttctcctaatttatctgatttgtaaatttggatatacattttaaatgtttgaaggcacttatttataactgttgggagatctagccctaatttggatttatcttctatttcgttaggatgttatagaatgataatagatgcaaatgagatagttgttgaatgcagcaactatctacgatctatgatctctgatctgggctaggtccagagagaggggtgggtaaacggtttacatctgggccatagagtttggaaggcctagtgataagatatttaagtaacttggcaatgaaaggaacatcaaagaaaaggaaaaatgtgtcaaattaagagatacttaaagggctttacttgtttagggaaatgagagatcaattcaaggtgtatctgtctagggatgactttctaaaagaagtacatttgttctgtcttaggtagtttcctgtttggtaaagatgaaaatgaaagcatattctaggaagaacaatgcgagaagctggtgtgcaagtagaaaatgccaacattttattgttttaattatgttagttttttaaaagagctttttaaaagattgctatgcagtgaagtgttaggtgtattacgtgcattatttagtttaattctcatgacacaaggccggaactattgttaacttcactttgccggcattattgttaacctcataaaccaaggtttggagtatggacatatcttcctcaggcttgcacagccaggattcaaatttagggctgactgactccaaagctacattgccacaatgccatactgtgaccattaggattgcaatgaaggtgttgtgtttataagaataaagggagacaaaactttatgggatagttgcaggatgtttaattcagaatcttaagataatggggagataaaacttgacacaaatttttaagggaagttgccatgtgtattctctgaactgggtgaagaacatttatgttgtgaggcaggggttcaatcctattaggaggtttcttccaactgagagattctgtgatgttgcttgaatcctttggcagaaacatgcattaaggccgaataagtatctccatccttattgctgatgtatcacagcaagtgataccaggagcctctccttctaacaaactcttggcatgtttctacaggtttagtgcaggagaccatgtgttcatagcggatgaccgtctgtgagcctatctttatctagctttagaggctgacacaaatgagggagcatgctgtagaaagtgcctgtgatttggaactggctgaacatgggctagaatatcagtttcacctttcatcagctgtgcatctcagggcaaaatagctaattatcctgagccccagttttctgatctgtaaatggggacatgttttcattttctgaaaatcgagtatgtcaagtacttagtccatcacacaagtctagcacctaatcctgacaacatcattatccatgatcatcaccatcatggttttacacttgttagaacctctccatacagttgtattgtgaggcttaaatatctctttcctaggagaaacaataaggaaaaaaaattcagtcaatttgacatgagtaccctagctcaaggtctctcagtaggggacagagatcttggacaatggactaaaagccaatttacaggattgtcgtgagtattgagtgagaaaaaggttatgaaattattttgtaaactcataaagtttgattcaaatattagaatgctaaaatgttattatgccattgcctttgaaggaattaaactaaaatcccataacccttgggttcacatgagcagtacttcgctaaagcgtttgcagtatccagaaaggcttcctcctcgaggctcactttgctcctttctctggtttttggccttcaggaccataaggcccctttccaactggctggcattaaagatgggcccactctggcccgatcctggcaccagcaatgggatgttgacctgtctgctgagtcttggagcccaccactgccaaggacacccagctggagctaatttgctgggctgagtcatagcatctggttggaaccggtttcttttccatcacaaggatctccctgaacctactgagagctcaccaccttgctaaattcttgggtgtgggtgggtgtttaggcacagttagacttctgaggaggatccttttccagaggggaggttatgataataaacttgataacaactgtgaatgcttcaaaactgtctatcgttagtgctgaatggtttgtaacatgagaattactgcataatccaaagtagggggagttcagggaaagttagcagagttagagaacgtttattattggttatccaggggatgttcatgaaaacattcattagtgctgctcagaagaaagaaaacagagtgtcagcagagtgcgccaacctgggcaacttccataggaaagcctggccaatcaaagagagcgttgcctcgggatagaatgggattccagagctttagtggccagcacagcagatcgggacttgaccttgtagttcagggaacaaaactgtggcttggaaatgcagggactgtgggtttacctcttgcatttgcgtgttacattctgttatttatttctctttttgttaacttagttttgtcttcaaaggatctctgtcaaacagttgtagaatagtcaccatcaggcaaccaggaaatttgtccttggggagctacttaagcaatcagatgctgacttagattgttgtataatcaggaagtctggttctaatcttagccttgccactgttctgctccttgctgcccagagtgtggtctgtggagtcacagcgttacctgggagctgatgaaaaatgcagaatctcgggcctgcttagacctgtgagtcagaagcgacggcttaggagccccaggtaatttatctgcacataaaactttgagcactgacctaagtggtaaactctggcagggcatgggcattttctagtttcttatttattattttgtatccccagcgtctgtctgaagtttaacacacagtagctgcaaaatccttgaatcttcctcttaccttgggcatatttgaacttgtaggaactttgtaagcttctagggacttaactgtaaagtggcgtagggagaggactgttgagtggaaatggagccagtgattgagaaactgaggtgagcatagaaggactggtggtgtgagttttttgttgttgttgttgttgttgtttattttttgtagagatggggtcttgccatgttgcccaggctggccttgaactcctaggctcaagccatttgcctacctctgcctcccaaagtgtggggattacaggtgtgagccactgcgcccggcctaggtggtagttttaatatagacgtctttaacttcctaagtcaaagtctctgagggtggatcatcaaatttgtatgtttttatttatttatgcctttaaaccacattctgaaaacaaaacttttgtgttttttaaagttctctttatgttaaggaattttttttacaatgttacatacaataaaaatgtgagggttcctcaagaggaaatggataaatacaatggaatagaattcagatgtttaaatcaatgaaacagggctacgtgtataaacatgaataaatctaaaaaaatgtttttgataaaagaaaattgcagaggaaatatgagatatggtaccatttacttaacgttttaaagaatcctatgtgtaatggatacatgcatatgtagtaaaaggataaagacctggatgggaaagataaacaccaagtctggctaatggttaactttgagagggatgaagggaatggatgggagctttaacagtccttcatgttttatttcttgagaaaaagaaagaaaaagcaacaaaagaaagattacagcagcaaccatgtaaaaataagatttttaaattttgtattcaaatttttttaaattgtatttatttatttttaagacagagtctcactctgttacccaggctggagtgcagtagtgtgatctcggctcactgcaacctctgccttctaggttcaagtgattctcctgcctcagcctcctgagtagctcggactataggtgtgcaccaccacccccagctaagttttgtatttttagtagagatggagtttcaccatgttggccaggccagcctcgaactcctgacctcaagcgatccaccttcctcggcctcccagagttctgggattacagacatgagccaccaagcaagcctggccagttttttttttttttttttttttgagacggagtctcgctcagtcacccagactgaagtacagtggagtgatcctggctcactgcaagctccgcctcctgggttcaccccattctgctgcctcagcctcctgagtagctgggactacaggtgcccaccaccatgcctggctaattttttgtatttttagcagagatagagtttcaccatgttagccaggatggtctcgatctcctgacctcatgatccgcccatctcagcctcccaaagtgctgggattacaggcgtgaaccaccgtgcttggccttttctttaaagacaggttctcactccatcacctgggctggagtgcaatggtacaatcatggttcactatagtcttgacctactgggctcaaggaatcctccttcctcaccctcctgagtagctaggactacaggcgtgcaccaccatgcctggctaatttttgtattttttgtagagactgtgtctcactatgttgcccaggctggtttagaattcctgggctcaactgatcctcttgcctcagcctcccaaagtactgagattacaggcatgagccaccttgcccagcccagtttctttttttttttttttaaaaggaatgactacataattgttcatgatatgtataatctttctgaatgcttacaatatttcattatgaaatgactaacccaaacttccctggtaattgtgatgcaggcagttggcatgtggccttaaatactcctaaggaccttccagtttgaaatgtatttgtactcagagagctctctccctgaccctgtctcttgttctcatagacaatcatgcctataggacatgcccaagtcctgtagcttccctgcattctgtcctgatgaaatgccatgtcccgtgtttgtgatgtcagtgaatttcaccgttctaactctttagggactgagcctgcagaagcttcctctctgctgttcgcttttcttctttattaaaggaagcatcctgttctacaactaccctgatcttagagcgccagctctagggacatctcccatcttcccttctggtgttcattttcataacgccttcattgacacttcagtttggtggtgggacttaggtgtccaagtgaatcccaagaattgtattgcttaccccaagcctcattatttgccatcgttctcttattgctgtgtctgctttcttaacttcctttctatactagaagtgtccctaaagtttaatcagtaaggatgacacccattggtctgtgattcagagaatgttaagaaggcagaaatctctaatagctagtgccaaagtgggctttaaaatttcattttattggccgggcacagtggctcacgcctgtaatcccagcactttgggaggccaagacgggcggatcacgaggtcaggagattgagaccatcctggctaacatggtgaaaccctgtctctactacaaatacaaaacaaaaattagccagacgtggtggcgggtgcctgtagtcccagctactcaggaggctgagacaggagaatggcgggaacctgggaggcggagcttgcagtggagatcgcgccattgcactccagcctgggcgacagagcaagactccgtctcaaaaaaaaaattattttaattaattaattaatttatttatttattttgagatggagtcttgcactgttgcccgggctggagtgcagtggctcgatcttggctcactgcaagctctgcctcctaggttcaagcgattctcctgcctcagcctcccgagtagctgggattacaggtgcctgccaccacacccagctaatttttttttttttgtatatttagtaaagacagggtttcactatgttggccaggctggtctcaaactcctgaccttgtgatccgcccaccttggcctcccaaagtcctgggattacaagcatgagccaccgtgcctggccctattttatattattattattatttctaatatagtcaatagcagtgattctaaaccaggggtgactttttcacctacagacatttgggcagtgtctggaaatatttttggtttcacaactgggggagtgctaccggcatctagtgggtggaggccgggaatgctgctaaatatcctacaatgcacaaaacaatgccccacccctgcccttcacaacgaattatccagtccaaaatgttattagtgccaggttgagaaaccctgctctgaagatcctcataccatgaatatagacctatcaaggagggagagtggatggggctgcagctcctttagagtggtacagtgtcacaggggatatgggaatcccggggaatttatatgggctagtcctatattatgtccaaagcatggtgggggctggaaagttcatggtattagagatgaaggatgggagcatattaaggaaaaaccagagaggaacaaagtctagcccatggggagactagagagaagccacctctaatgtttttgagcatggcaccttagtgtaaactgcacctttgtgctatagaaacagaggattgcttatttaaacatattatcagtgcaaaatgtggtaggtcatgatagcaaggacccccagtgaatcatgccccccgcactgtccacactcgtctgcattgtgactctgccattcctctcatcaagcagtggagtctgttttcccgccccatgggtgtgagctggtcttgtcccttgccttgaccaaaagaatgtggagggtgtaatgatgcgtgatgtctggggccactcagctttggtttttctccctcatggaagatttctgccatcatgggaggaagcccggcctgatctttccttttgagaaagaggcccaagtgtccaggggtcccagcccagcacactcccagccagccttcccactaatgtgctgtgtcagggaacacagatgaaatcagctcacccacccagcccaacccacggaggagggagaagtaatatattaatattatggttaccttcagccactaaacattggggtggtttgctacacagcacgagctaactggacattgtgtgtgtagaagggacttcatatcgagcagtggatgaggtatttggtatgtgcgtagggtatctgtcacattatggttaagagaaactgagttcttcctcctttgtttcttgtagcacttctcagaacttctggatgagttttcccagaacgtcttgggtcagctcctgaatgatcctttcctctcagagaagagtgtgtcaatggaggtggaaccttccccgacgtccccggcgcctctcatccaggctgagcacagctactccctgtgcgaggagcctcgggcccagtcgcccttcacccacattaccaccagtgacagcttcaatgacggtaaactcagaggaggaggaagacctggaccttagcgcctttggttctgagctcttgagggtgtggagtgtgtattatattaaagagggtgtcagcacccttattagtgagatacctacagtgtgtacggccttgtgcttgggctgtggggaaaagcaaagaggcccaggacccatttctctacactgcccaggttcccttggaacttgctataactgaaggatggtcattactctctttcaccctatggcttcagcagcagagcagccttttgcaaatcaggccggcctatctggctggtcattcctaccagtacagtaagtctcttgtttcaaggggtcatgccatttttttttttttttctgagaaagaactattcctctatagaagcttcttgggcatcctctcaacccaattccatcatgttctattgaccccatgtcccccaccccagatcttagtggacattcctagactttcttgttgattaccctttcatgcccatcatcaatgccatgagtgtggtatttgttgaaggtctagtttttctggccttagagatgttaagatgttttgaccattactctacagcccttaattggtaaaagctgtatcttgttccaaactctccaaggcatatatatcttttaagtgtaattttcttttcttttcttttcttcttttctttttctctctcccttcctccttcctttcccctccctcccttgcttcccttcccttcccttccttccctccttccctcccttccttctctcttttctttcttctttttctctctcccttcctctttccctccctctcgctccctccctgcctcccttcccctcccacccttccttccttccttcctcctttcctttcctttccgttctgttccgttccgttccctcccttccttccttctttctttattttctttccttcctccctttccttccttcctcactcccttctttccttctttcttttttagacagggtcttgctctgtcatccaggctacagttcagtggtatgatctcagctcactgtagccttgacctcctgggctctcatgtagtcattcagcctcagcctcccaagttgctgggactacaggcatgtgccactacacctggctaatttttttatttttatttttttgtagaaatgggggtctcactatgttgcccaggctggttttgaactcctgggctgaagtggtctttcctccacagcgtccccaagtgctaggattataggcatgagccaccatgcccaggtttaaatttaattttctatgttttgttttcctagagggatagccagctattttagtactttaaattttaaaaactctatttcctattcccagtccagcatatgccttcttctttacaggaggatgacatggtgaggaatactcactaacttgaccttcttggtgttggtgttcacctcttgttcttataccactgtacatatggcagcatcttttgaaggtggctgcacctatcaacccatcatgtagggatttgtcctaatgctgtccctccccttgcccgctacccaccgacaggccctggtgtgtgatgttcccctccctgtgtctatgtgttctcattgttcaactcccacttaggagtgagaacatgcgggtcctgttctgttcctgtgttagtttgctgaggatgatggtttccagcgtcatccatgcccctgcaaaggacatgcactcattcttttttatggctgtatagtattccatggtgtatatgtgttacattttctttatccagtctatcattggtgggcatttgggttggttccaagtcttttctattgtaaatagtgctgcaataaacatacgcgtgcatgtgtctttatagcagcatgatttataatcctttgggtatatacccagtaatgggattgctgggtcaaatggtatttctggttctagatccttaaggaatcgccacactgtcttccacaatggttgaactaatttacactcccaccaacagtgtaaaagtgttcctgtttctccgcatcctcgccagcatctgttgtttccagactttttaatgatcaccattctaaatggcatgagatgccctttaattgtgaggccaaagcattcaccattcagttcccccagctggggctttgttctatttatagctcttaggctgtgacaggccgtgctggtaatttgctgagaacaggtacagtgggtcagatatattttacaaagggtttctgatccacagttcagcttttttgaagtaccagtgtcttatctgagtaaaagtcactttcctaggccagcaaaagcaagacaacaaacacgggatactactcatttaagatgtgtgaaatcagagtgaggcagtgtggatgagtggatggggaacttgttcagcaaagctttgtctggatctatttttctgagttgtgtggatgggcagatgtttgggaacagaattattttattcatgtgaaccccagtttgcatcccccttaaggtggcgatctgtagggtgggggaatcaatccacaagtattccttccaaacccaagtgctctgttagagcagataaccaccctgatggagaaggatggttatttttaggcaacacataaatatgtagcatgtatagacagctatatacattacattttatattctttatctgctgcatggtgataatagcttaagcaaaactaggagtccttgtgttcagtgatagatggggaattaatatttcattatacctgggaaagccagtgattcagctctcactgtccaattgtacttagattaaatacagttcttctgcaattgcttctaagcctggaaaaagagtgatgacacacagttaagtggaaactccctcctaatttattagagtttttctccttttttctccctctgcctcctgcttcccctctctccttctccttcccactagaactcttctctttccctcttcctcctttgcccttttcctcctaactttcccttcctccctccatcctccacctgaaccccaggacaactgaaaagggcacacacagatgttcttatcctatcattctatcacagacttcagatgaactgtggacccctaaaactgtatacaaaaatgtgggctatctacatttgttaattttttgagagttattatatcatttcttagattctcaaaagagtttgtgaccaaaaaaagttaaaaataactgttctaagattccacaggaatcatctgtctcagggggactttgtagacttctgaaacactagagctaaggaacttcatgtggcccagccaccacaggagccaaccctagaaatgtaggtgcagccttcaaaacccccagaaagacatcctgcatccagctcagccatttctccctgtgattaaggctgtgaaccagatgctaagcaaggttttctgttctacaaaaaaggcaacaacaacaagaaaacaccaaaaaaaaaggaagaaggaagaagaaaaaaaacatgtcatgaggttaagagagaaacgcagaagcatcccagcaaaatatttatgatacttttatgctttgagaaacaaaagcttgtatttgaatgaccaagtcttgtacctcaccacatggaggttgtctttatgagttactatatttcagtcatgttcctttgtgtaattcagttgggatgctaggtatgcatttgcattgtcctttaattttggtgttcttcctaaagaagaaactagtgctggatgagggctgttcagagagaaccagacatggcccctatcctctaagatgatacaagaacagagctaaagattatatagactatcaacagaccttagcataaaataggctaatacagaagtggtctaatactacctttgcatcacaaatgtagtcaagggtggaacaaaggaccgtgactatggctgtcccaggtctacacagggtgggccaggaacatggataagaatcatcttcctcctgatgaatttagtagggctttcagtggcaagggatggctgggtaggctggttcactacagataccttaaatttatggagctgtgttctcaggtgggaatgaacacagtagtctgtgaggtaaaggtgagcggatattgctggagcaaagtcacatggggtaagtgggacaggctggagaagggcaaggactagggttttatctctgcctgatgggaagcagggactgagaaacataggatcacattttttggagcttagatgaaacacagaagatcttatggctgccatgcgagaacagggaaggtgtgcactgatatagttatccagggagaagtggaaaggtatataacatgatggcaaagaaaaaatgggttttgaaatgatttgatgaaacctgcagcaggaaaagcacaggatcgaatatgctgaggaaggggcagagatgagtcagagatgacttaggtttttgctttgcagtgttgaagagatcttgatgttgacatggtccatagaagtgagacttgaaaatcacagaaatgaggtgcataacggtgtcttcatcacatatagcgtgagctgatgacaagaacatcactctgaatcatcgtagagtagccagactcaggggtagaagagaaaagtatgtgtatctactgagtcactgggtcctctgtcatgcacggccaaagagagaacctgacagtgattggggaggacaggcagaggaacagttgacctcttccatctgaagcttgggtttgtaatacacgctattttgctattcctccgcttttttggtgttaccttttacttttttccaaacagataaaaacaatagtgatgtttcccctttttattttttgaaaaaagtaaaataatgacttctctgcgtagccattgcagtgctagattagtataagaaagcaatgttcacattaatccagcgattacagttactttggatattcatacatgagagtcataacttctccattgaagaaaaaaggatgtagtaaatattttctgtttctactactatcaccacctcttcatgccattcaatactgaaagttatttcagggttaagatactcaggaacgggccagggggagataggcctgtaacttccattggagcatgtagtgggctgtagtttaatatgattctgacacatttaactgaattcttgcccctttccccagcttccagagcctagccattatatttttcctttaagagatttttacataaaaaaattgttcaagatttgccaactcctttgaaaattctcaaagggcaaacaaatgaaatgctaaaggatttagatgaggcatatttatttaatttataaaattttcttttcactttagatatgttacataaatagtaaatggatgtacggtccgccctccctgtgcttgggttttgcatcctatgaatactgtattttcaatccacgtttatttgaaaaaaatctgcttgtgagtggacccgcatggttcaaaacccgtgttgttcaaggaccaactgcgtatgtgtttttctcatgtaagtggtagtacgtcatctgatttccctttttaagaataaatgcccattctctctatgttcacatgtatatatatatattgtgtgtgtgtgtgtgtgtgtgtatatatatatgtgtgtatatatatatgtgtgtatatatatatatatacgtatatatatatatatatatacatatatatatatatatatatatatatatatacatatatatatatagtaaaccagaaagtatctgatacaggtcccaatcaatttaggagtttattttgccaaggttaaagacatacccagaacaaataaacacagaatcacagaaaaaatctgtggtctgtgcctttctccaaagatgactttgaggacttgagtatttaaaggaaaagtggctgaatggaaaagagggagggtacggtaatccatatgttgcaagagagaaaaggagcaggtaggggaatagtccattacacattcatcttgtgctcagtaaatcaacacttttcataagataagatgtatgttgagctgggtgctcatgactgtgatcccagcactttgggtggctgaggcaggaggattactggagcccaggagtttgagaccagcctgggcagcaacacagtgagacctcatctctatcaaaaaaaaaaaaaaaatagctgggtgaggtgacgcacgcctgtagtcccaacttcttgggaggctgaggcggcaggatcgcttgggcctgggaggtcaaggctgcagtgacagagcaagaaaagaaaaaggtggacatagagtgtctacctgtggagatctttaacctttcatatataactgtgcttaggaataaaaggaaaggcagtttcttggatgactcagctttcagcttgatttttccctttggcatagtggattggggtcatgaatttttattttcctttcataatatatcaagataatgccaactcccaatttagggtttttttttctttcttagcaatcagtatccattcaatgcgcttagctacgtggcacctatggaaatgatggaagatctgcattttgatgttgctattaccttggctttgagttcatgtctttttcagtctctttgatgatttgcctatcttgatgatttgataacttggcatctagccccattgctcatggctgcaccattttgtctttggatgtaaaggacttgcttctcaccacgatcagtggcttgtttttattttcttgctgacagttaagtggtgaagctgaggaaatgtgccagtcgagtttgacctttgacaggaagctgtttaaatcagctgatatgggggttgttcttcttactctccaaactgtggactgctaaactttaccagggatgtttttcgtctgaaatgacatttaaaagacttataaacacaatgcggaaagaacatttttattttttccactcggtatctcagcttcaagttttagaaattagagggtgtggagtgtctactgactcttatgtttgtggtttagccaataactaagacatccaaggataattccagttctaagccagggtggccctactgatctttttgccaataaagtaaaactacaaaagtaaggacatggagaaacattgtgatacatattctgctccttctcctctactctgtccttccttaaccctcacttcatagattacatttgtcattttgttttctgtgatttgatatttatttccattgagtaagagagtacaagccaacctccagtagttcagaatgaaagctgttttctttcatttcagctaccactggaatgctgttctcaccaaactacttactggctgactttcttcatatgaagtcatttcgtattttgtgatgtaactagtaggtctgatcagccaatctacaaacatttattgatatgatccatagttgatggtttagagaattattttggaaatgaatgtagtcatttcattgtaatagattctaatgtaatgggtttaatttatttttcatacattcggctatattgtatcagctagctctgttgcggcataacaaaccacccccaaactcagtcactcagtcatttattatcgtaatctacctgtctgtttctgtgtgggggtcagcagagtggttctgctagtttcagctagattcactggcatctctaaggtcagctaatagttggctggtcttgactaagctcctctggaggtgactgttctatgtggctgtcatccttctcctgagatcactagattatcctagctcattcttctcatgctgatggcaaaactacagcaacattagttccatcctgcaagcacattccaaaactccgcttgtattaaaaagctcacataccaatggtacatcaagccacaggaccaagctgtgggtggggatcagcccaaggtgggaggtcactgcaaaattctaaggcaaaagacatggatggagggaggaggaagacctggagccaggaatgcaacttatttacataataagggtctcattgactcttactgagtcaagggcttctaaacacccccatgggcaattacaacctctacccaataattaccatcctaagccatgaagtggagcaggccatgtccctgtgtgttcatccaaagacaatagtgtcccaaggttggaaatctagaagtaccataaaatttaaagaaaaagtcattcatgttctgaacgattatccagagatgcttactatttggcatatttcttttgatgcttttctatcactttcttctttaatagttatagatttttatctagagtttttgtcttaatatttcattataagtcttttctttgtaattaaaaaggctgtatacatgtaatattaatgtctgcataaatattccattgtatggatgcaccataattgacttaacctttctcttgctttttaatgttttggttattttcagtgttttgtcatcataaacaatgccctagtgagcattatttatgcataatctttatccacatagaaagttttcttgttaatgggaagattactggccagagtgcagagatctgggttctgccactaatttgccatgtgacctaggcccaggtgtcattttcctcatctagaaatgataggctgggtgtggtggctcacacctgtaatcccagcactttgggaggctgaggcgggtgggtcacctgaggtcaggagtttgagaccagcctagccaacatggtgaaaccccgtctctactaaaaatacaaaacttagccaggtttggtggcacacgcctgtaatctcagctacttgggaggctgaggcaggagaatcgcttgaacccaggaggtggaggttgcagtgagccgagatcacaccactgcactccagcctgggtgatagaacaagactgtctcaaaaaaaaaaaaaaaagatatctttgagctcaatggccttaaatctctttataactctaaagcatctttcaggatcaaggactaaattgctgtattggaatggaagcatgaaagcagcgcctgttgtttgccctcaaaaaagctcaggggaggagaggccgcttccttgggcttctctcttggaaatgtacagttgtccttgagagagaaggtttccttttatagttcaagtaccatcacttgccctgtggtttccattccctgaggcagcactgatgatatttgtatgtttgtaaagagggctataggacactgggcattaagaatattaaatggtcttgacttgttttacgaatgtgcacactttgagaatggcctcactagattggaataactgattctatctatcacccatcttcattttgttttttgtattcacttttttttttaacttttgcctcttcttttgtttgccttgtgaattaagtttcatcacagttgccttcactgcacagtcaagggatctggccttatctcacaatttcctggtaattgtgtgcgacctttttctcagggatgcttccttaccgtccatttcagcctgtactgaggctatatttcatcctaccgtctttcttccagcctttgccagggataaatattactcagtgtgggcaggctttaagtgttgacttcaaaaagcaaaagcatggctgttcacggtggctcacacctgtaatcccagcactttgggaggccgatcacctgaggtcaggagttcaagaccagcctggtcaacatgacaaaaccccgtctctactaaaaatataaaaattagctgggcgtcgtggcgtgtacctgtaattccagctactcaggaggctgaggcaggagaatcgcttgaatccgggaggcggagtttgcagcgagccgagatggtgccactgcactccagcctgggtgacagagcaagaatgtctcaaaacaaaacaaaaagcaaaagcatcaccatgtcattgccgaatggaaaaaatgggatctatgcggtctctgtctctccagcccttccctaactgtcctaagcgggtgttctttgcagcggacattgtcttctagctcctaagctcctttggggagagtcaacggaatcttttggctcgtggtccagttgctccatctctgggctgagctggggcacggtctgagtccagtacagagtggtctccctcctctggccgccatcagagagccctttgttcccccgccctccccttccaccaggatgtggcgcacaccccatgaaggatggaaatccccgtcacaccatagcactcagcagccccactctaaaagcaaaacatcttccaccacctgcccatcctgtctttatttcaccttgggaaataaattgaggctgggataattcatcaattataaactggatttaagggggaaatcattcctcaaatatgaacctaacatttttgtgctttaaagaagtcacttatgaaacataattttaataatcgtagattttagttcttagtttctgtgtctacccttcccttcttcttagcggttctaaatgattgtaccttttcataagaaaactggagtcacattcttgaatgtaaaataaatttataatgtgaacgactttgctctcctgacagtcatgggtcactaagtatgtgaaatgtggtgtatgtgtgtaagcattttgagaaagcaaaggagcgtgtctttgctttattttagcctcattttagtaaaactggtatcagctaaggaacgttgcctttggcttgctttgtcttgttctgtggctgtttccaaccctctggtcgtttcctttccttccctcctcccggcttttccaggcagtgctgagcgctagctccaaagtaacttgttaagaaatacaaattcttattcttttagactctgagaagaatgtgcattaagtggcagaggcactctgtctgttccgtcttgtctctcggttgttagctatctccaggcctggtgataatcaggaaagacaagacccagactcaccaagatgcagctgttttctcaggaagagtattttgtccatttcagcaaagggcagatggttattacaaaccaaagtctcccaaagggctaagcagagtctctgaaagtctaagttaggtttaaggctaggtgggatcacagtgaaaacagaagaggacaaaaacaaacaaaaaaatggagtgagaagaaaaaatatcaaaaaaccaaataactttcctttggagagaaggagagagagacctactcaccatgttctctcatcttctcccgttggttaccaaccatttgcttgcttctctctctctctctgtcgctctcgctgtcactcgctctcgctctcgctctcactctcactctcactcttgctttctctcgctccccctccccctcccttccctttctctctctttctttcttgacagggtctcactctgttgcccaggctctggagtacaatgatgtgatcacagctcactgaagcctcgacttcctggtttaagcaatcctcctgcctcagcctcccaagtagctgggaccacagatgctcaccactgcacctagctagttaaaaatttttttttgtagagacagagtcttgcattgtagcccaggttggtgttgaactcatgggctcaagcaattctcttgccttggcatcccaaagtgctgggattacttgcgtgagccactgtgcccggctgcttctttctttcatgtttttaaatgtgcttatttatctatttttgaatagataatacatttacatgatttgacaaccaaaaagagtagctcattacatattcaaaatcctccctcctattctattccccatcaacccaggtttcttcctgcctttctcaggaagccaagtttctttcttttctatggattccttccagagtttctttaggcatactcacatgcaagcgaatacaagtatagattctttctttgctgttcatatctatcaatcttttccctcacatatttcattttcttttattctactttcaatcatccttcactgagcttttttggggagaaagactagtggtcgcttgttttgcttatgcctgatgccctgaacaagttcacatgtgtgcttgtcttttttcctgcagatgaggtggaaagtgagaaatggtacctgtctacagacttcccttcaacatccatcaagacagagccagttacagacgaaccacccccaggactcgttccgtctgtcactctgaccatcacagccatctccaccccgttggaaaaggaggaacctcctctggaaatgaacactggggtatgctcaattttcgtctgtttaaacaggttggattaaaagatacagatagatcctcattctccaataaggtgtttaatctttttggagttagtggctgtgtacatttaaggacatgcaacttcatatgtgtgtatatacatatgtatacatttaataagggtatgttgatttggtgccaacttcctttaaagccattgttcggaaaaaattagtagctaagctgatttcattctctttttgattactgttacaaaataaaaaacacagaaaatatctatggtaaaaaaaatttctctatggcactgatttttaagcagtggaaagggagtgattgaagtggtgatgtaatccatggcttacagtgcatggctactgggaatgtgagctcctgtgtaatattttactttcctagtgagatgctgagttgtccttactcaagtcaggaatgtcccacgtattgattcatataataatatgaataatattaacaatattaataacattataataatagtaatagtaataataacacctattattgtgttacccgtggaaagcataagaaatcaggattttttccttactagattccatgcctaccgcaagtagaatttaattctactctaccttctttctggatatttccagtgtctggccatggaccagcattgtatttgtacatcttcttgcaagtgttggaagcctgtcttagcttcccttaagttcaaagcttcaggttataaacaacaacttcattaacattccttaagtcagatttcttgtgagcaagatagaatgtctatctgcagccgggcacggtggctcatgcctataatcccagcactttgggaggcggaagctgcagtgagccgagatcgaggcactgcactccagcttgggcaacagagcaagactctgtctcaagaaataaaaaaaaagaaagaaagaaaaaaagatgtagtgtctacctgttcagaatatggtaacacagaatcagtagactcattaaagtgtcactgcttactcccttgtcagtccatctgtgtagatgatgaagggttgtagacagaggcctctgcaagtgtgctaggattcctttctcagtagctacctgagtctctttattaggctgggctctctggtctatattagtctccttgctccacagaattttagttactttatttattacttttttttttgaaacagaagtctcattctgtcacccaagctggagtgcagtggcatgatgtcagcccactgcaacctccgcctcccgggttcagtgattcttgtgcctcagcctcccaggtagctgggattacaggcaccagccaccacgcctggctaatttttgtatttttagtagagatggggttttaccatgttggccacgctggtctcgaactcctgacctcaagtgacccgcccacctcagcgtcccaaagtgttgggattacaggcgtgagccacatgcccggcctagttgaattattgtaaagtatgtaactagcaaagctcagaggcatggccttgctcctgtgtatgggccagataacttttctcctttccctaccaggattttcgtgattagataccatcagtcattaggaagccttaataataacatcattaatattaattattaataattatattaattgtattataacattattaattattaatattaataaagttatatataagagaaaggatgtggcttggtgcacagtccctaccccagggcaagctggtggaggcctttgactctttaaaatttagttcccattttccatggtgattgactcgatttaagtgcattgtggctatatgtaatttacaggctgctttacgttgcaggcagggaaaactcccaggctggtgtgaggctgaactgggataagagaccccctggcccctccttattctgctaaggtcaccacctcttagaaggtctcttattttctttcagtgatcaaatgcacagttacgctctacaactaaattctgtagtcttgggaatcctcaccagtatcaactataagttgctttttaaagcccccaaagtggagtgaggatagggggagtggaagcagtgtttggttcttactttacccaaactatgtataaagaataaagttagcagaatgatgccacaaaaaaaaaagtaccagaatattttgtaataaaatgcctttatagtactataaaaacatagaaaagaatattgatatagttttgggcttgagcatttggctttcaactttagagttctgagtgtttttctttttctttttttttcttttttctttttttttttttttgagatagggtctcactctgttacctaggctggagtgcaatggtatgatcacagctcgctgcagcctcaaattcctgggttcaagtgattctcctgcctcagcctcccaagtagctgggactgcaggtgcacgccatcacaactggctaatttttgtatttttttggggagacgttgtctcactatgttacccagggtggtctcaaggaagttctgaaggtcctgtcagctgtaatgccaagtttggcaatgagaaaaaggttaagaactaaaatgactccctgtcagggaagttgcctacactcagctattctccaggataggcagggctgtcccgagaggaagacacaggtgacaaatagctctcctgcatgtgtcttcaaggctgtgattggtttttaaaaattgtgtttgaaattcttcctccaggttgattcctcgtgccagaccattattcctaaaattaagctggagcctcatgaagtggatcagtttctaaacttctctcctaaagaaggtctgtctgccctccctgtgtccctttgggttatggatatggtctctgggtctacagagagggaatatggcgagagagctgggatgagtttgtaccacagatgttgtagctggctttatgaaatagctctgttcttaaaaaataaaaattttgcttccaaataaaaattttgcaagctaactattattttcccatatatgcacgtgattaaatttcagctaagtgttaccatacttttacttctaaccagggtgatatttttcaaaacttttatggactgctactacaaacactatcgaacaagagaactgcagcccttattcatccaggcgtgaaccctacgtagccccacaaatcaacaaccatctacaaaagcaccttgcttatttcaaacaactctagtttcaactctttgtgaagtaaattcacaattaattatgtggccaattcattgtttgtaaacattgactttgaatgacaactattgcaaggagccccctctctatttggtcatgttcatggttcacaattgtgcatctttttgggcttcttgacatccatccatttagaattaacacatccttgaggtgatcatacttttttttttttttttttgagacagagtctcactctgttaccaggctggagtgcaatggcaccatctcggctcactgcaacctctgcctcccaggttcaagcgattcttgtgcctcagcctcctgagaagctgcaattacaggcgtgcaccaccacacccagctaattttggtatttttagtagagacgaggttttgccacattggtcaggctggtcttgaactctcagccttaggcaatccgcctgcttcggcctcctgaagtcctgggattacaggcataagccaccacgcctggccaaggttgttatatttctatatttatctttctctatgtcagtttctttctgagtttctccctctttgttctcctatgaagcccatagttaggaatcctggatgcagacccctgagcctcatgaggtctaatgaagctctctctgccttgcgtatgcagattctccggcatacatcctgctcttctcacttctgtgccttcactcatgccatcacttcccttttcattcatactttttatttatttattttttgtgtgtgaaacagggtcttactctgttgctcaggctggagtgtagtagtgccatcatggctcatggcaacctcaacctcatgggttcaagcgattctcccacctcagcctcccaagtagcggggactgcagacatgcaccaccacgcccagctaaattttgtattttttgtagagatagggtttcaccatgttgcccaggctggtctgaaactcctgagctcaagtgatcctcccatcttggcctcccaaagtgttaggattaaaggcatgtgccacctcacccggtcccattcatactttcagtacaaatttcaaagtacagttcactactgtggtcaacaaataagaaattggcttatacagttgtcaccgaaaaggtatatttgctacggtatataaatgtgaggatgtttacatatgagcacttctcatgaaaatatcgtctgtcttcattccattagaaactaactcaggatttggtttgtaacaatgtaatcagggctggccctttatttgcctttattatcaataaagaaaggattaaattttaaaagttaataatacttagtgaaataatacttagtaaataatacttatttacttagtaaaagttaatacttagaatccatattgagacactatgtctttgcactgagtgacagacagtagtgcctttcagctttatgtactgcttcaaagtaattgctttcgtttgtataacaccagttattactatcaaatgcatcttactcttttaatttatgctgtgatgtggttcagaagtgtcatcaccataacaatgaatcccatagtggcttctgaatccagggttattggaggagaaatgtttcaagaatgaagttaaggacagcccttcctcattatcctggataaactgagataaggaaattcaatatccttgactgcatcagtttctaggcacagtagcttgttgtccccagaccttgcagtaacccaaaagcagcatttcaaatgatatttagaaatctgatcctgaggtgcctctggccagctctgtagctcttaatagataggaaagacaagattttacttgcttcacttgcttcaaattctctttctgtcttttgtggggtgccctctgcttggacgggagaacggtattagaataatttggcccctaccaagtgaaagggacagggtggctctaggtactcctggctagttcttgggaatgtaacagcacaaagcccctattaggttcgtctgcttcccgtttttttgtttgtttgtttttttgtttttaaaccatgaagtgccataatattcatggcattcgagaaaccttgattaacacgcttaggactcctcactcttagccaagcacctgcatattttcccttcctgggctgcctgcacctgtggcagtagtgggaatagcgcgattaggattattttagcatattctttagctttaagagtgcccacagagactaaaaagcccagggacctctttggcaagactggcagagaaaaagggaaagaggaaacatctagagaaaagctgtatgtggcagaaagagaaagaaagggtgggagagagacagggaatcgcaatgagagagagaagaaaaaaagcatgccagggccggggggaccagggttggctgacggggcattgcctgttgtggcctcggctattcaggtattcctgcaggagagagatgctgattgctgctcatcctctctgagggcagtgtattagtctgttttcatgctgctgataaagtacccaagactgggcaatttatgcagaaaaagaggtttaatggcctcacagttccacgtggataaggaggactcacaatcatggtggaaagcgaaaggcacattttacaaggcgtcaggcaatagagaaaatgagaaccaagcaaaaggggtttcatcagatctcatgaggcttatttactaccacaaaaacagtatgggggaaactgcccccatgattcaatgatctcccgctgggtccctcccaccacatgtgggaattatgggagctacaattcaagatgagatttgggtggggacacagccaaaccatatcaggcagctatgggtaaggtcatcttttttgggtcagttgttgtgtctcaggagagcccttcccatccatagtatgctgggtggtctccattggaagaagggacaaggaggtgatgtgctgaggcttcccgtggccttcagcagttagttctctggccgagcagaaccagctgtgtgggccatgcccaccacggggctgctgtacaggggaatccattgtcctgggggctccaggagtgaagcgtttacctgcagttatctcccttggctcagtagcagtggctggtacaacagaaatgtgcactgttcagaaagaacagtgagacccaagagtgctttcattcacgtggaagcctggttggattcctccttcagaagcccatctctgctgccctggagatgcctgatggacgctgaccaaggctccataggccctggcagagagggtgttgtgcctccttgaggaaagacgcgggagactttagaggagaaagtccccccactgcactctcacttatttttcctgtgctcactcccgtatctgaagatggatttcatgttttctgaatgaagaatgcctggcgtcttgcctgcgggcatgaccacgcacattgctccagaaacaaaccggcttttttcaaagcagccactccggctttttgagatggattctcgctctgtcacccaggctggagggcagtggtgtgatcttggctcactgcaacccctaactcctgggttcaagcaattctcctgcctcagcctcccaagtagctgggactataggtgtgtgccaccacacctggctaattttttttgtattttagcatgatctcggctcactgcaatctctgcctcctgggttcaagcgattctcctgcctcagcctcctgagtagcagctgggattataggcacgtgccaccacgccaggctaattttgtatttttagtagagatggggtttcgccatgttggtcaggctggtcacaaactcctgacctcaggtgatctgcccacctcagcctcccaaagtgctgggattacagccatgagccaccttgcctggcccctggtcgcacgtttattggtttcttgtattcacttccagtgtttctttctgccagtataagcaaatgtgggtctatatcctctttctctcctttttcatacaaaaggaggactcccatatccacgctctgcaccttggagatctgtccaggtcagctcatggaggcccctcacactttagtttgctatgccacaaatcagttgtgtcctgctttgtggctctgggatggatgagatgtgcttccttttttgcagccccagtggaccacctgcatttgccgcccacccctccgagcagtcacggcagtgactcagagggcagcctgagtcccaacccacgcctgcaccccttcagcctgcctcagacccacagcccctccagagctgcaccccgggccccctccgccctctccagctcccctctcctcacggctcctcatgtaagtatgcagcgggcattcctggaccaaagggaaccctctccattcattcccctggggctgtatccagagcaggaccactcaaggctgtttggtttttacttttgtcaagaagtttctgcttaatggcgaaagcagagtgatgtcaaccctaaagaacactttctaggaactgcccgcacatctcaccttttactaccacaattctcttccttttcacatgcacacttccagtttttattcatatgtttattttacagagctatagacatgaggaataaaaatttggggtttttctcctcaaagttctatcataaatatttgcattaatttaatggtccttgtgacctatgtcataggaaataccttttatattttaaagaagcaatttttggtgaacttaaaaattactctgagattaatttctttgatgcctaaaggtcaaaaacagtttaagccttttctgtgtgtcatatgactcttaacccagaaactcagatcagacatcaagacccctcgttcatccctcccatacatgaggacaccataataaagaagaatagatcgttaactccttattgttctaggagtgaattgatttctatgaaattttaaaaattataatcagctattttgaattcacaatctcacaactagaaaatttaaatgaaatgagatgttttaaaattctgtaagtaccatccgtccattaattaacataactttgaaaatttgtattgattctgtccctgaaagttctagatctgcaaccacattcttaaatttcatcgttactgaggacaagggaattcacccttccactctttcttcaccttttcaccttgaacctgacttcactccttggattactagaatagcttgtatcctatatacctgtgtgtactactatgatctgtccattctacatgtttatggaggaactcttccccatgtcggatgcttgcccaacaactatgttgtatttccctgttacttgttggtaccaagccctgacacctttactcattatcaggtatccaaccctccgctgcttcaagaactccttacccacactaggcagtggcttcttcagtgacttttcaaaatactgccttttgcttagaatgcactcctctctcttatgtaaatcatcccctttctttcaggaggcccaattcaaatctcatctcctgccctaaacgtttcctgatcacacaactcatagtagtgttctcttacttcaaatttttagtacacctttagctaatgtattagtccattttcatgctgctgataaagacatacccgagattgggcaatttacaagagaaagaggtttaattggacttacagttccacgtggctagggaaacctcacaatcatggtggaaggcgaggaggagcaagtcatgtcttacatggatggcagcaggcaaagagagagcttgtgcagtgcaactcctgttttttaaaaccatcagatcttgtgagattcattcactctcacaaaagcagcatgggaaagactcaccccataattcagtcatctcccactgggtccctcccacaacacgtgggaattatgggagctataaaatgagatttgggtggggacacagagccaaaccatatcagctaagattacagtttagcatttaattactcttatcctttcatgggtatcagttcagtctcacagtcttgatcacaagctgcttgagaggtagggtttgttttgagtcctccatggcatttagtatggagctaaaatgcaatagggactctgtttgattaattataaacatgccattctactgtgggttccatgagatgtgctactgttcttgtcttcattgttgatggacattctgagactgctgaagccagaggcttctgtggaaagagtctgcagatgtgtccctgggtgctctgcactcttagctaaaagtggaggagagaattgactcctgttgtgtagagagcaccttataaaactgcattttcagaaggagaacaacaaaattcttgcacaaagcagggctgcaaatgaatccttcatcactccaaggccaggaaatctctagggatgtgggaaatgacttctctgctttttcttttcatgttttagcgagtagggtgcttcccgggaaataatgggtggaggcttctttattctttcccttgaattataatccctaggttataacactcacatgggggtgtcttccccatcttcccatgcccttcaaaatacccatctgtcacccaaagcagatggggcatccttgtctcagagccttctgtaagacattgtaacagattctcatcatcccattgggaggtgattcttcagtggtcccagttctttttctttgacccttttctgctccttggtctgcacagaaactgcagggatcaggccctctggtcctgacagaggaggagaagaggaccctgatcgctgagggctatcccatccccaccaaattgcccctgtcaaaatcagaggagaaggccctgaagaaaattcggaggaagatcaagaataaggtgagctcttcaaatctaggcacttctagagcagagacgagcagaatcgagtcagcatccctttccctgccttcccaacggccagcactaccccatcccatggtggagaccaaggcccagcccttcccttccctaagccctgggaggagcaccctcaccacgtgcccctctcttcctccagcccatcccatccctcttgaggccagcagactcccagatcagtatctacctctttggtgcccacgatgatacatttacgggtgggaggaagctattagaatttccatctagttttttttttttttttttaactcagccttttaaattttgggtgtatgatatatacaatagtttcctctagtagacatatatatgtactctatgtatctatataaaatacagcatatatatatattatatatatataagatacaaatacattgcaagtgcttggttaatttttttttttcttggtagggttttgtgatcacaaaacttctgcagtttgctggtctatatttggactcagtagtctcctacccctgggcccctcagtgctgagcaggcctgatgaaaaccagggggatggctgaggcacaggcctaccaggagggagggggcaaagagggaaggaagacaagagcttagtgtcactctatccatgtgcggaaccagcagcaagttgatgtatgaccaagccagctgtcttattttatatatgtacttcagccagcagaggtccaggagttaaactcatttatctgagaccacactgatggtttgtgagccacatgttctggcctggctcttcactcagtgtccattgttttcttttcttttctttctttcttttttttttttttcatacagagtctcactctgtcacccaggctggagtgtagtggcatgatctcggctcactgcaacctctgcctcccaggttcaagtgattctcctacctcagcctcccaagcatctggaaccacagacgtgtgccaccatgcccggctaatttttttgttttttgttttttgttttgagatggagtctctctctgtcacctaggctggagtgcagtggcacaatgtcagctcactgcaacctctgcctcccggactcaagcgattctcttgcctcagcctcccaattagctgggattacaagcatgcaccaccgcgcccagctaatttttgtatttttagtagacggggttttaccatgttgcccaggctggtcttgaactcctgacctcaggtgatctacccgccttggcctcccaaagtgctgggattacaggctagagccactgcgcctgccatttttttgtatttttaatggagacagggtttcaccatgttggccaggctggtctcgaactcctgacctcaagtgatccgcccacctcagcctcccaaagtgttgggattacaggtgtaagccactgctcctggccactcagtgtccattttactggtggcctggtttgtaggaaagtaggtgtgagtttggcagctagaaacccgggaggacagactagtcaatgaaccagcagcttaaacaaatggcaagcagcttgcagaagtaagcagggctttggtgacttctacgctaaccacctcccatcttaactggtttacttacagagctggaaattaatcattctcctcccactcctctctctcagatttctgctcaggaaagtaggagaaagaagaaagaatacatggacagcctggagaaaaagtaagcctgctggcaaactgttgcgttcatcgggcagtatgcacagggaaatatgggtgtgcggagaatcggggagaagcagttcaattcctctttctggccaccttggaaacccggtggtttatcagctgtggtttgcctgccacctagtggttatttggaggagacgtctataataaagcaagaaagaagtgaaagtaccttagtaggtgtttgaatcataccactgccagccaaggaccccggagtcctcacagacttcttttcaaacacatacaaatattaacattcctgcacattcctggaacttctagcaggagaagccctgttttagctgaaaggagcagtgctacttaatcagcccccattggccacactccttcatgctctagagagggcacatagggaaagaaagatgtcaggttggcagcctttattttccagccactacaattcatgtttttttttttttgcaaaaacacttgaaggcaatctttgttcttttgaaaagtctgtaatatcaggcgggctgttagaaaaagatgaattaaatacagttttgtcttagccctggaagttagttctttagctaacaaaccaagatatttttaagatgggcatgaggccccagacccagaaatgaacttcatgtggatctggggaaaggagtggctggtggttcctggctgtttctcaaagctactattgaaagtttagtgcttctatcacctgacttaagtactggtaatgcagcattaagtatagttggctctccatatctgggggttcagcgtcctcagattcaaccaaccatgggtctaaaatattcagaaaaaaacttcaataggctgggtgtgatggctcactcttataatccccgtgctttgggaggccaaggtgagaggattgcttgagctcaggagttcaagaccagcctgggcaacatagccagaccccctaaaaaataaaaaaaaattagccaggcatggtggtgcacatctgtggtcccagctactcaggaggctgagaggggagaatcacttgagcccaggaagttgaggctgcagtgagctgtgattgtgccactgcactatagccttgatgatagagtgagactctgtctcaaaaaaccaaagccaaaaccaaacaactcaataaaaaaaaactacaacaataaaaaataatacaactataaatacaagataacacatatttacatagtatttacattgtgtttggtattataaataacctagagatgattaacatatactggaggatatgtaaaggttatatacaaatactacaccattttttaatcagggactcgagcatctggagattttggtatctgtggggagttctggaactaatcccccctgaataccgtgggaagactgtagtcccatgctgtcccaccattttctatgggcatccagggtcaagatgttcctatgaaagtctctttactgtctcttttgggcatgcgtgccccagcaccaggattcctagtcctgggctctcgtcctgccctttgcttaagtctcttcacttcttatcagtcctggtaagagtgtagctgggagtatccagattactgtagtatagagggagaagtatgatgggcattgagaacactagggaggaggtgagaggaaagaggttgtaacaccctaaaagagggtcatattttgtactgtcactattcatctttcattattcaggcactcatcactcagctccctcttttttttttttttttttggagacagagtctcgctctgtggcccaggctggagtgctgtggcatgatcttggctcactgcaacctctgcctcccaggttcaagtgactcttctgtctcagcctcccaagtagctcggattacaggcacacaccaccatgctcagctaatttttgcatttttagtagagatggggtttcaccatgttggccaggctattcttgagctcctgacctcaagtgatctgcctgcctcagcctcccaaattactgggattatagacatgagccactacgcccggccccagctccttctatttttcttttttttttttttttttgagacagatcttgctctgtcacaaggctggggtgcagtggcgatcttggctcactgcaacatctgactcctgggttcaagcgattctcctgcctcagcctcccgagtagctgggattacaggcacgtgccaccacgcccagctaatttttgtatttttagtagagacagggtttcaccatgtcggccaggatggtctctatctcctgaccttgtgatccgcctgcttcggcctcccaaagtgctgggattacaggcgtgagccaccgtgcccggcctatttttttttttttcttaagtctcttcatccttctttcaatactttcccacacttccatggggtggcagatccccccaaccctccttttcctcatccccacctacctccaccctagctcctagcttagtgtttgctctatggataataattttcttctttctccctcctttgtagagtggagtcttgttcaactgagaacttggagcttcggaagaaggtagaggttctagagaacactaataggtaagtgtcactggactgagagctgattgcgctaccaatggaagatggggaaggaagaggatagaatccagaaccagggatggcagaaaagtggaggaggtcacagtgaaagtgcagttgtgctgagatgctcagcatggccaaactccacccacccactcctgctacacacacacgcatgcacacgtgctactcttgcacatatacaaacacatatgcacacatgctctcatgttcacatccacaatacacatatgtacacactctcatatgcacatacatgtacacatacatgcatattctttacttttcctaaatgatacaggattgaagaagaagctgatcatgacaaggactatgactagggggttaaaaaagaggcttggaggagaataagatcaacaagcctgattctcctgaaaatgacatcaaaatttagaggtgaccaaggaggcactggccacttcattataatctaattttagtagcaaatgatacttattagtttaaaaaaagagaaaatcattggtattttttttttcttttttttgagacggagtcttgctctgtcgcccaggctggaatgcagtggcatgatatcggctcactgcaagctctgcctcccgggttcaagtgattctcctgcctcagcctcctgagcagctgggactacaggcacgcgccaccacgtccggctaatttttgtattttttttttttttagtagagatggggtttcaccatgttggccaggatggtctcaatctcctgacctcatgatccgcccccaccttggcctcccaaaatgctggaattacaggtctgagccactgctccggctgcaaatcattgttttttaaattagttttttaaaattagctagtttattaattgcatttcaaacccattttacaaaaattgtaacggtaccaagttgataaattcctctagcacttgctgtgcccagtgctattttaagcactttacagctatgaactcatttagccctatgagatgccattattatcatcctcactatatagaggaggtaactgaaactcggaaagtctaggtgatttgtccaaggtcacacagtaaccgctaaagctgcatttgaacccaggcagtctggctctggagcctggatgtgggaggagtatatggaggtttatgcctggctcatatgcaagagaaaggggtgaaagtgcagggttaagaaactggcttttggggagtttcatccagaatgtatgtgttcatgtgcacacatgatacatacctgtgctgtgacaattatttcttagagactcctgtcaccctgagtgttagagatccaacaaattaagcagagaaaaatggacttactgggtaaacaaaaatttaatcagattaagggtcagtgttaatgcccagtaacaattgtgcaaatattaagggatcagtttaaatctctttgcatgttatttgataataacaaatgaatttaattcccgtttcctgatgcttcatggtttgttgctcaaaaagccagctaatatagacataagctaaaactaccgccagtgggatccccctgaaattttctctgcatttctgggaatgtgtgctcagatagcagtcaggggcagttcaccccaagtgctctgtaagacagactgcccaaagggaggaagtgccaccaacttagtgtggcattaccttgatctcatgaggcaagggagctggtttcactgcttgcctttggccgttagtctgctggggcttcctctgtttttatctccacttcctctccctggggggattgcctgaggcggctctgtttctctggatcctgctccccgagccagcatatgtatgcatgtttttagcatcctgagccgataggcgttcccggcacccatcctggcacttgcttccgcagcagccccatgttcatgggtgggtgggacaaatcctggccaagaattggcgaaaaggggaagagcaaagacctccttggagtttgtgttcaggtttcgtcctctacaggctccgtgtcaggccttccctgggccacatgggggcagcagaggcacagcagggatgtgctggggcgaagtccgggtgtgtgagggagaaggaccgaccccactaccttgcctgggaagtctctcctctcctctgcaggtggactgtgctgcgtgttccttccttccttccttccttccttccttccttccttccttccttccttccttccttccttccttccttccttctctttcctttttcttccttttctttctttctctttctttttctttctttcttttttcttcctttcttccttcccttccttcctttccccttctccttcctttctccctccttccttccttccttccttccttcctttccttctttcctttgttcctccctccctccctccctccttccacatttttatttttgtttgcttgtttgaatcagatatccaaataaggtccatgtgttcaaactgtttgatatgtccattacatatctttttgtctgtaagttctcttgcatgtctttgctgttatttagtaaaggccgagtcagttgtcctgtagagtcttcctggtcttagtttacctgtaatgtccttgtggtgtccgttagcacagtccttcgtccactacagactctactttgtttggttttggtttttggtaagaattcttcataggttccactacatgcctccatcagaaggaacataaaaattggttattcggttctccacaatgtatacttattggctagagagatcaatacattaggggtttgaaagtagccttatagaattctatcatttctcctccagttattagcagaatatttttctaaagcaagactcttcatcgttaatgaacatgggtacacaagtaaccatgagatgctgatttcattgtctttgggtatataccagcagagggattgctgggttatatgctagttctatttttaatattttgaggaacctctacactgtttttcataatggttttactaatttacattcccactaacagtgtggaagggttcccttttctccacaccattgccaacacttttcgcgccttgtcttttttataatgatagtactaacagatgtgaagtgatatcatgtagggttttgatttacgtttctctgatgactagtgtcagtgagcacctattcatataccagttgaccatttttatgttttctttagagacatgtctattcagattctttgcccattttttaaaattggttgtttttgatattgagttgtatgagttcctcatatgtttttaatattaacccctcatgatggtttatatggtttgcaaacattttctcccaatccgtgggctgccttttcattttgttaatttttgttgttgttgtgcagaagctttttagtttgatatagttttacttgtttatcatacgtttcgacttaaggaagatgcatacataatatgtgctccttgtaaaaataatttaggaaaaaaaaagaatcctttcactcagaggtatctttatgttttggaatatcttatgtgtatgtatttatattgtacatacttctttgttaagaactatttccacataacaaaacactggacatattctcatacatttctacaggatctttgactcaccattaaaaataatctaccttgatcaggcgcagtggctcatgactgtaatcctagcactttgggaggccgaggcaggtgggtcacctgttggtcagagatcacctgaccaacatggtgaaaccccatctctactaaaaatacacaaattatctgggcgtagtggcagacacctgtaatcccagctactcgagaggctgaggcaggagaatcgcttgaacctaggaggcagaggctgcagtgagccgagattgtgccattgcactccagcctgggcgacagagcgagactctgtctcaaataataataataataatctacttcatgctattgggatctgagccttccctgacagtctgctgttactgaatgtgaccagggctagcttagccacctgttaaagcagggaaagttttttgtttatgtgttttgttgtcagcattattaaggcataattgacaaaattgcatatttttacagtatacaatgtaacgatttgatgtatgcatatattatgaaatgattatcacaatcaggctgattaacacatccatcactccacataattaccttttttttctttttctttttggtgccaatgcttagcacacttctagtatataatatggcatttttaattacagtcaccatgctgtacagtagatcctcagaatgtatttaccttataactgaaagtttgtattctttgaccagttctcccacttccagtgcccagtgaccacctttctattctcttgtttctgtgagtttgacttaaatttttctttagatgtaagtgataccatacagtatttgtctttgtctggcttattttacttacaaagcagaacaagtttgtcgatgttcctcttccccttggcctccttccctgtactctgtgccttcccttgagtctcaggagcgcagtggctctgtgtgtcttcttctcccatttcttctccctcttcaagactcacctctcctcgtggataacgcttttatggtagtaatggctggcaatggattcatctgtgatcttcccacagataattgtagcggggacctcctaagatcataatatttaagacctggcgcggtggctcacacctgtaatcccagtattttgggaggccgtggctggtgaatcacctgaggttgggagttcgagaccagcctgatcaacatggagaaaccccatatctactaaaaatacaaaattagctgggcgtggtggcgtgtgcctgtaatcccagctactcaggaggctgaggcgggagaatcacttgaacctgggagacggaggttacggtgagccgagatcacgccattgcactctaacctgggcaacaagaggaaaactccatctcaaaacaaacaaacaaaaccagtagcttttaatgtattttggcttgagagggaaatagataaaagcagggctgcttcgctcaaatggggaatagacctagagttcctctaactgctcttccccctttctctttgttttctgccgagggcgtctgtggcgctcagagaataccacagtaaccaaaatgactgatgtaagcattggcaatgccctgccctagagccagccatggggagctggtgattggggtactgggcaagggaagacgttgggaccctttactcacatcaccccatgcaggtgaccagtgtttgggcagtgtgcagggctgggctggggaatgcacacctgtgtgtgtgttcctgttgatgcttctcatattatcattcttcagaggcagctggatggaagtagaacaactttgataagtgaagaggatcctgggtcaccagaaatggggggtggagaggccttgggggccattgtttcatatgcatggcatggcagggaaggtgagtggctgtttcatcattgaccaaatgaaagaaaatgatacctctttacttttttccacccctatacaataccccacaggggactttcgcatctacccagatgaaaatttgtgctcagattatgagtcaatcctgagtatggttttctttctttttttttttgtactggactcagcagcagccacctagcctattattgatttctagatgaaaagatcttttatctgagctatggagagtggaagaggacagggccgggagagtagatgaggaagtctttttcatctttcttcagtttttctctgggagactctgggaacagagctgaagtggtgcgaaagcaccttcacacttcctttgctgaggtgatccgctaattgcatgctatcaggaaatgtgtaagatgggagtgagatggtttcccagggggcccttcttcctgtgctccatcaagaaatacattttcacttgctggtgtctgagcagtgcctgtgtggctgctagagaatccttctggcttttctaagtgaatgcacctctctaagctgcaagctttctggatggccccaccctggtctcatccctgagaaatcttgtcattttttcccactggtatagttttcttctgcatgagtgatgcacatacactgcccggcccattagttgtaggcgtttgtggctcagtttgctccatttatttcttattttgttctcaggcatctttagggctgtgagctacagcttttctccttgagcatggatttgtagaatcataggagcttagacttgagatacaccttagatatcattgtattgaactgctaatcaccttattttacagaaggagaaactgaggcctggtggggttaaagtcatcttaacatttagaggtagaatggggacgagaacttggtcacttaacttttgaactggtccttactttggtttctcttgctgctatacctcttgctccttcaaggaccttgccccagcaagagccaactttagacttggacacaagggcccttgatttggactcagtgttttagagggccctgtgctggctctccttcagccatgtccccctccatgggatgtgtagttggcaggaccaaggggatgcatccatctggagctctcaccctagccctctagaacttactccagtacctaggatcctggaattccctgtccaaaggtcttagctcatttccagggcctatgtggacttctaccccaaatctgttctccgaagggcaaacctggtgaccagtgggcacccctgaagccaatggggtagacagagacagctctttgtgagggctgcatatggagtttgaaccaggcctggtgtgtgcacgacatccttcacaatatgtcaggtctggattcaatttagccttatttatagaagatatgagattcctgggtcaaagacaaaggattctattgctcagtagacagagtgagcagcagcatatatgtatcagttctccttgcccccaggtgccaggacagatccgggtggatgctgtgctctcagtggggattgtgtcacagctaaggaagcctgagcttggagaatccactgcttttatagcaagcaatcagtaaacctgcttcttgcccagggagagacattacctcatctgtccaggttaccagcttcataacaaccttgagaggtggcccatcataaaagagcagtgagagcctttccatcttggcatccacagcagaatgtgtaggaacacaagaagacccaagagactgtctctctccaacggtgtggagcaggctgaggcctggagtaattctgcttatactaccacattttggcaagcagccctgggaagtccaagaattctgttcaaacctggccatagagggagccggaaggagcaggtgttgggctgcttgacttgtagaaaccttaagatgtgtggcatgtggacttcatttgtacactttcctcagacctcacagaattaagggacatgcttgcctgacatttatctctattgttatcagaaataaaattccttaatctttttctttgatcttcctcttagctatagtctttctaactctacttttcttgttcttgacaatctctatatgattcctattaaaggtctttccagccaagtctactgggttttgactggattctggctctcctggtctgtttgtttagcccacacagctgtgtctgtttgcactaattttgtgtatttgttccctacacactattatggttttctgtgtgtgggttcatctcttctctcttagactgacaataactggctgaacccacccccagctgcacacaaagaagctatttgaggactgataaatgacccaagttactctactgtacacttttaccttggttttaattcacttttcatttctgcattatctctaacttctggttgtgtgaagagtgtgaactttctttccacatggaaatatttcaaacttcaaaggattattgggtactaaactaagttccccagagggatttaaaaggcattttagtgtaatttagtgtaaagttcaaaattccacagcctcagtttttgttccttggccagtgtttgttcctgggccagtaggtaatatagcatttcagaaatgccctctggttcctacaaaataaagaagcctcttgtaatgtagcaattaacacaggaagaaaaaggagaaaatttatacgcttttttttttcatttaggccagagccccatgaacaaccttcaaaacttaagtaaaaggccataaacatataggtatttactcaaggtttaggagtttgagctgatatggttgtcttttgtgtatgacacactttagtatttaaatgtctttgagattgttcatgattttccttaaatatccttatgaaatgtgtagaacttataattattaacattgtatcccgccacctccctgccctccatcccaggattttgaggtagaggtttcagctgttggacacccccttctcacctcagaacctcccaggcactaactctagatgtgactcgggtggggtgggaagggattcaggggggattttgcctcagaaggacatggatgctcatctcttccatcatgaggtcacctgatcatcacctgagttttgtttttttgagatggagtcttgctctgtcacccaggctggagtgcagtggcgtgatctcggcccactgcaacctctgccttccgggttcaagcgattcttgttcctcagactcctaggtagctgggattacaggcacacaccaccacccctggctaatttttatattttagtagagacagggttttgccatgttggccaggctggtctcgaactcctgacctcaagtgatccgctcacctcagcctcccaaagtagtgggattataggcatgagctaccgtgcctgaccaagttgtttttttttttttttaattgtgtgcattagataagtaacactcaggcttttttgattgtacaattattttacattttatgtagtgtaaatggcacaccagactaccacatgaacatgtacatatacatcatacacctcactaatatgaatgcttcacaaatcgatagttctttacagcatacaatgccctctgatattgtgtattctatttgactccatttcattaaaaacatatatcagtcacaacccaattgatttcacaaacccacaaatggttcatgatttggaatttggaaatgactgctctaggtgcttccataaggctgtgaaaaagttccttcatctctgaaggaggctgatttacccagggaatagtttacacacatacatatgggcacacacacacatatgtgcacccgcacacaccactccccagagagttccatttctaagatgtgttgtaagatttgatggaagtatgtgtggctgggtgtggtggctcacacctgtaatcccagcactttgggaggccgaggtgggcggatcacctgaggtcaggagttcaagaccagcctgaccaacatggtgaaaccccatctctactaaaaatacaaaaaaaattagccgggcgtggtggcatatgcctgtaatcccagctactcaggaggctgacacaggagaattgcttgaacctgggaggcggaggttgcagtgagcctggatcacgccactgcactccagcctgggcaacaagagtgaaactccgtctcaaaaaaaaaaaagaaagtatgtctacagagagggcctaagttgaagctcccaacacagcaaataattgggaaccaccacttttttttttcctgctcctggtttctgactccagtgggaaattaggttcctgaatgttcaaagtccaacattcaataactgtatgactgttctcattctttcttttgtaaataaggaaacacacacaaaaagcaaaattaaaccaaagacaaagaaaacatgagactgttgatgcatttcccagttattgtaagattgtgtctcccactcttggattcttttgaatgttttgcccaatttcctttgatatgcctcccaagatacagggtgatggtttattttgggcaaggctgacagctgctttccactgctcttttgcaaggaactgcatgaggatagccactgagtttatttttacatctcaccacaggacaaaatccacattttcaatcaagtgttggacactccaatttaacaaattgtgaaaaatctgttggcccagataaacgtatgctaagagtattcctttctctaaattaagattttgttcccggaagcccaagaattcattaaggccataattagccatgatcactgatgatttaaaatacaataataaagaggaagtttatactgagcttcataggcaccattggatctgtcctgcggttgactttttatagctgtagtttaaaaataacttttccatttcatctgctggctgtcttttctccacccagcccttcatgcaagtagggtgggggctgtcatccaagctcccattgctgcaggcagtgacatctgtctcagtgacatcagagaaagtgccacatcatctcaaaccaacatatcagttacgaggtcacaggctttcccataaaaaggactggcctcatctgtcatcagtgaaaagagacagcaagcactcttcaaagatgtatttgcttcagcaaacgcagagttaccctgggagggggcattttctcattattccatgagctgatgtggtcaagggaattcatctgagtagctgcctaaactcagaacttaacttgattaaaggcacatagcagtcatcctctgattgaaactcaggtgtctttgcctttagagccaatcctcctgatatatatatgcatcagcttagcaattctaaagccatctcatcagcttttttggtgtttcacagagagacaggttttatattttccatttttctaaataaagcccaggcttgacttcctgaaccttaactaggcaagaagtacccttgattcttttatctattatctgcattttatctttgatgtatccagagaaaataccacacaatatttatttgccctgatggtttttgtgtcattgttactgaaattttgttagtatgcatctccttgccgtcagaatgggttttattgtggctcttccgtctatggcttagtctcttttaatagtaatattttcatatttaatggtggacatatctcagttgggctggtgtcaacataatattaatgttactggagttaagaaaaatctacttaactaagacatgctttattattaattttagtaggttattgattagggtaccatgctgtaccatgttggaatgtacacaagctatggggtcagataggttttggtttacatcttaggtcctctacttattagctacgtgactttgagatgcttgcttagtattttagcgtatgtagttcttggaactcaagtagtaggcactcagtactctgtcattgttcattttctctttttatgatgaaaaggagtgtttctgttgtatggatgtgtgtgaatttcccaaactctattggatcatagaagtctgtttggattctggggatgactgagcgaaatgcctcagtgttgctgattgatggggccttgcacatgttgtcatttccaccatcagttccgtttactttctccagcaccagtaggagaagcaatggcaaacagcatattattagtcactgttgcgctttccaccaacatttcgaactaaaaatgtgtattttaaaacacatgtttgctcatcttaaagagttagattataaactgttagaaatcagggactattaaacaaccattttcatttgcagtggattcagaatatagtcatcttgagttgggaaaggatgtgtccgtgaatgccaagcaaagtgctgtgcagtcaggaaacaccagccctctctgctctctccagcccttcttgaagggtccttcttcccaacttgtagcactttacacctgtgactggggaatgggggattccaatttgagcctaagatattctttcagtgggcttcaggtgtagctggcctgctgaaagtctgttttcaggaggcactggggagcctcctaggagactgttcatcctaggggaaggggtacagggcccagagatatcaaccagaaattggaagggaggactgattccttgtgtggattttttttttaaagctattcatgctctaaggactaggcaaggggtaggggatgggcagggaggaagtacgggctggctgctggtcaatagggattgttggtaaaaaatggaagtggtcattcccctttcaaaacagcttaagactttggagcaaaagtaacatgctttggtaccatctggaaaggtactaactgaagcctggatggagaaaccttaccccctcatgcccagagcatagctaaacttcagcaccttgcggccaccagcttacaggcagcaggagcgcccagtggaaaactgaggtgcccaggaaaagtggcagctgtcacttacagaagtagctcttgagcaggccaggggaacaggagaccgcttttcatagcttagcaggaaggagagacccattcctaccatagagagtggttggcaataagaggaaagggtttgagccatgtggtcttttctgtgggcttacctggaaatttgcccaaggacttgaagaaatatcagcagggagaacccagcaagggctttggggctggcattacaggtgatagagagtcaaatatatgcttcggccagtgaaatctcgctgtgagaatgaatgcacactcaggaagtggcagtgcagaaggaaaaggcagctgtgctgttgggtaggaagggaattttctggggaagtcctgggagaacagagaaaaagtttcatgaggaaggaaaggtgctgcatcatagaaccatttagttgcaaactttctttaagtagaatttagagtaattatgctgttgagtatttctcagcattaagtaaacatacaaaatgcttttaaagaaaatggtgctgggtgcaagtggctcatgcctgtaattccagcactttgggaggcagaggtgagaggatcgtttgagctcagaagttccagacgagctgggcaacaaagtgagagatgctgtctctacaaaaaataaagaaaagaaacttagctgggcatgatgactcacacctgtattccctcccagctactcaggaggctgaggcaggaggattgctcgagttcaggaggttgaggctgcagtgagctgtggtcacaccactgcactccagcctgtgcgacagagcaagactttatctccaggaaaaaaaagaaaaataaaaattgtacctgaatacatttaaatacaaaccaggtctaaactacattcaatcatacttctatataaacagaaacaaaaatgtacgattaagtacaaaaaaagatcttcacattaaatagaacttaaattagtgatattaactaacagaatgaatgattctgtgttgcttaaattaaaatcactatacctggggaaaatgtcatgtagatagaaacgcatagaaattttttttttttctttgagacggaatctcgcactgttgcctgggctggagtgcaatggtgcaatcccagcttactacaacctctgcctcctgggttcaagcgattctcctgcctcagcctcccgagtaactgggattacagacgcccgccaccgtgcccagctaattttttgtatttttagtagagatgagggttttactatgttggccaggctggtctcgaactcctgacctcgtgatctggccaccttggcctcccaaagtgttgggattacaggcgtgagccaccgcgcctggcccagaaaggagttttgagtccagaaagcatctactctgtgtgctgagggctgctccaattcacccaccactcctatccatttaaactgctgaaagcaaaatcattcttgtggccaacctgtccttaatttgctcaaattgggagaacttgtttcattggtactagctgggggtgaagatgtaagcccaggaaaaatctgcttgtccttctagcacctgaatgctattcgggggtagactgtggtgagaagcaagttatctgcgaaagcccacagcattctgtgaacaaatgatttgatgatgttttccagtgaacttatgtggctgtctaacattgttacatcacagcacacattttccgagaatccttgagacccaagagaaagcatctgctcataaaatctttccactttgccatatgcactgggtttgggggtgggggatgaggatgaggaggagcttcaactctttacaccactcacagggaactcttcccgggtgctctaactcaggagggtgtgttgtcagatccttttctatgccttgcagtgttcagaatttgcaaagaattttaccatctgctctgtgtgctgatgtcacacagagcagagtatataagactgttcttatccctcaaactttgccttttaaggagaggcacagttgtcccattttagggataaaacgtctcctttttttttttctgctcttgctctcttgtctttttcctggagaaaggctagaatctgtttcaaaggatggttttaaagacccttgactctgggcttgagggtccagttgagcaggcatctttgttctttcatatgttggcttcgtttcctgactctggaggtgctgtgagcgtttaagaaccacaggcttgagctgcaggtggctgtttgcctctctgccttaaacagagccgttcttgtttttcctctcctttctctctctctcttctaacctgcctgtgaatgcctgttactctgtgttggcatttccagtcacagcccccacctctggcctttctctctctcttctaacctgcctgtgaatgcctgttactctctgttggcatttccagtcacagcccccacctctggccactccttctgttgttctctgctggtcattttttatttttccttctctttgcctttgtcccttttttatgtttttgtcaatgtttctcatctcttgcttaaatgagttcttcttttaatcgacattttcttagtctgttcaggttgctataacaaaatgtaataaacgaggtcacttacaaacaacagaaattgatctcttacagttctggaggctgggaagtccaagataaaagtgttgggagattccgtgttgggcgagggcctgctttctggttcacaaaaagcagcttcttgctgtgtcctctcatagtggaagggaagcactctagtcttttcagctccttataagggcacgaatcccatcaatgagggctccatttatgacttaatcatctcccaaaggtgctgcatcctaataccgtcacatagaggactgggttttagcataggaatttaggagagacacaaccattctgactttagccaccatccaatcagagtgttccttttcctttgttctcaatcgctgagaaacaagccacagcctgtcaggggtaatgtggaggcagttacctctaactcagggcagtgcaagaacaggactttcaagtgtgaaggctgattctgagccccagtgagctctgtgacaatggtgctagaaggtactggtgttcgtatcttcttccagaggaaactgtcccttggggctctgttgaaatgcaggcacaaaggcacggcggccttcttgggtcacatggagagatcaaaaagcatctcttctctgtcagactcccctcacggctgttgttatcattggcaggactctccttcagcaactccagaagcttcagactttggtgatgggcaaggtttctcgaacctgcaagttagctggcacgcagactggcacctgcctcatggtgagcttcccagcagggtagcacagtgaccgcccctggcctggcccctgtctcccctctccctccacttgccaaggccaagtgctgtgctgtaggagaaaccacatggaggaactccactctgaggctgttcctcggtgaggcactctggtgatgtgactggtgggtgcagtccactggcctgaagaggagagtctgtgtccctgggtataaagctgtgctgtccagaggctgaagtccacagcccctcgtgttctctctcccctctttctctcccacaggttgtggtgctgtgctttgccgttgcattcggcagcttctttcaaggctacgggccctatccttctgccaccaagatggctctgcccagccagcattccctgcaggagccctacacagcctccgtgggtaagacagcatgtggcaagttgggcagggtcttgttttatttccctagagctgggtttctcagtcttccaaaaggaatcttctgtgaaagtccaatgtttaaaaagtggtaaaagtggagcttctccctttgaagaggcaagtgggggttcccctggggcccctcatccactggactgcggcatcactgggaattctccagagcttgacagagcacagtttgcaaactgctgttctagactgtgttccctgatccattctgacatctaatttttgagttctgataagggagagggaagcagatgagggaaagagtctgtcgctttctgtgacgttttaagagaactgctgtgtttctgcctccactgagtggaattgtatgagtaatgtaatgcaatgtatatagtaagggcttgtaaagtgaaattaaataaacagcaaggtcagggccgggcgtggtggctcacgcctgtaaccccagcactttgggaggccgaggcgggcagatcacgaggtcaggagattgagactatcctggctaacactgtgaaaccccatcgccactaaaaaatacaaaaaaattagccgggcgtggtggcaggtacctgtagtcccagctactggggaggctgaggcaggagaatattgtgaacctgggaggcggagtttgcagtgagccgagatcgcaccactgcactccagcctagacgacagagcgagactccatcaaaaaaaaaaaaaaaaagaatcagcaaggtgaggagttcaagaccagcctggccaatatgctgaaaccccgtctctactaaaaatacaaaaattagctgggcatggtggtgcatgcacctatagtcccagctacttgggaggctgaggcaggagagtggcgtgaacctgggaggcggaggttgcagtgagccgagatcgtgccactgcaccccagcctgggcggcagagcaagactccatctcaaacaaacaaacaaaaagaatcagcctgccttccaaaaccttatgcccaagatctagagaatatggggactccggtgtcagataagaagcgtatggtgttctcacctagaaataaagggatggtgagtaaggaatacacacacaaattcacacctacacctataggaatgagcatggggttaggcagtacagtagtccccccttatctgaggttttgtattctaagctttcagttacctgtagccaatgaacatacctgcagttaccttaaaatagctgaatacactatagtaagaaacactacctgcagccaataaaaatacctgcagttatctgaaaatagctgagtacaccaccataagaaattttgagagagagaggccacattcatgtaacttttattagaagatatggttagaattgttctattttattattattgttaatttcttactgggcctaatttctaaatcaaactttatcataagtacatatgtataggaaaaggcatatgaaccctacatgctatatgcccatatataaaccctgtatggtttttcccatacatatataccttataccatatatatagggttcagttctatcttcggtttcagccgtccactgggggtcttgaaatgtattccccatggataagggaggactactgtactggatttgggatagggaaaattttgccatcttgaaacgtctgtggtcttcaccaggcaggtgtgtctctgccaggtatgacagaagtgctagcattccaattaaataatttcagtggcctgttgagaatttttccccccaaggaactatctctctaaatttaattggaagcatagtttctatgtcatggaaaattgctacagagccatctagctgtgtgactgtcctacaaaacaaaggagattgtctctatcctttgatttatggctttggctttgtgtctcctcttccctttctaaatgagatgccctgtacctcatccccctgccagacctactcactgggaatgctgcttcttttagctgggtctggacatctccaagtattccactcccattctccatgaatcattttccctagatggttatgggtggtaaggggggagttttatattttcaaagcagtgggggtggtagtttgccttgtgtttatttgcttttctattgttcttccagcactgtataattggtataatttttcaatgcacaaactccgaagctctaaagtctttatagaaagccaaattctgttggcacccatggttctgggcaacgagaacacacacattgtcatctgccaccagccctgagcacctggagtgagggaatgtgttggacccctgtggtcttttgctaacaccttattattctgctctgtcctcagtgagatccagaaacctgctgatctacgaggaacattctcccccagaggagtcatccagcccgggctcggctggggagctggggggctgggatagaggttcctccctgctcagggtgtcagggctggagtccaggccggatgtggatcttccccatttcattatctcgaatgagaccagcctggagaagtcagtgcttttggagctgcagcagcacctgtgagtcatagagacacagagccaactcctctagtgcactgatggtgggttatgagtcagcaacctgagatgtgaggttgagactctccataggcctggttcagtccctcagctctctcaggacctatttccaggacctgggactgcagagagtctgttgctggccaacagttgccctgagcagagatgaggaaaaaaaccagcgtgagctcccctatgtctgctgcatcagcggggagctggcgtggtggcacaaagaagtgcttgaatcccttcccccactgtctccatcctcccttccaagccacacgagtgaatgcacagcccaggtaaccacagtgtgtttgctgtgcaaatccaactttaagacatgtttcatggcttcaactagggagtagatatatattgtgctatatgtcaatatatgtttatgatttatatgtaaatacacatgtgttaattaaaactatacatattatagttttatacttatagatgtatgttgaggggtaccatttaagaggcactgtgcacacatttccatattgagaacaacctctatttggctccaattctacatgagttgtttctcagtttctgggaaaaatccctttgtaaacataaaggcttatgcgactgcaaggtattgttgttgtaataggggaggtccctgggcctgcatgcatgctcctggttacgtgtgacatggttggtgatttagctgaactctgctcctatgcctcccagaaatgaggccgttccgatgtaaatgggaaagattttgtttcagattcttcagctttcatcccctaattctgcaggggaaggtttataatgaagtacttttatgtgtgtacattatacatacatatttaacatttactagcacttactattttaagcactttacagatgtgaggcaggttgactatcccttatctgaaatgcctgggaccagaagtgttatagatttcagattttggaatatttgcattatacttaacagttaagcatccctaatccaaaaatgcaaaatgcttcagtgagcatttcctttgagcgtcatgtcaatgctcggaaatttctagattttggagcattttagattttagattttcggatgagggctactgaaacagtatcatacaaatccttttaagtatcccatgtggtaaggcatcattattattcccgtcatagagagacttgccaatgtagccaccgctgggatctctagaagacccagtgccttcttacttggctctggacacagtttctcttctctcagctaagctgttcaaggcccacttcaaatcccatttgttctgtgatgtctcctagataacaaagcctcctagccctcctctgaatgcctagaaattttccaggttgttacacaatttaataatgtatttattttctgttatggatttattattatttcaaattagctcattgttaaaaatctttatctggattattagctcttctaggccaaggatcagctcttatcattttattttctccttccctgagtttagcatagggctaaacatcctaagtaaatagaataatttaatgcatctcatagcagatcaatatcaagccaccatgattatccttagtagggttgggatgccttgggtgtagataaaggtaggaatgtggactagtggagaggctggtagcaggggactttggaaacagagaattgctactaggagagaaaaggacaagaaacatgcccaggccgtctcaccaagttgcaacccctgaatgattgcatcacgctacaaagcatgagaattgtagctaacagctggtgactaatacttcgttttccttttaatgccttcacagggtcagcgccaaactggaggggaatgaaacactaaaagttgtagaactcgacagaagagtgaacaccactttctaaagaggctgcctgcaccccctccctttcccttaactctacttttacatccccaaaccacctttgtcatcagcttttcctctttgccactggatcttcatggagacatgggcaagcattagtggcttcagattggagaccagcctgggacttccctgcagtgagagagcatctccccctggtccatgcccctcctgtgcagaagggagcctgcatccctcccttcctttctcttactgccataggaaattattttaggggttggaggtgggacaagcaggcttgtttccaccaatagtgccaaaaagatattgcctaatgtgcacctgtgaggtgtaaccccccgctttggagacgagatggctcttgttcagtcaagaccccagactctggccacaaaaatgccataatgcctgttggtatttggcaaagcactgacccgtgtcctccgttgctcgcactggggtctctggtgtgaacacccccgacagcagccctccgcccactctgccccctgggagccctcgctggatcgtctcgtctcctgcagcagcactggcaggcgagggctctcgttcatattctcaggccgcaagtgcaatgcctgaggggatcaggcttttctactccaggcaaacctgccccatcttgtcgcttttaggacctcccacaacctggttccccacacatccatagttctgcctccccagcttctcctccccagttgtaaatagtatttattagcttgccgaggcttcctgctagcaaccacactgaagagatcgatgcctcctttcaagctagccaagttttctgcgagccttcagagctaggagggcaccctaggctctgggatcccgtgtctttccagacaatgttttgtttcctttcctttgttttttcttttaactggaataattaccattgaaaaagaagttcctttgagcatgtatgtgtctgcctctaggatgagctcagagcgagagatgacacaatgcctcactcaggccccgggctccctggccacaagctttttctatcctgttttcatgacagagaaggggaagccctgttctgacaacagacatttcagacaaccttgctggctttccacacctgcctggccccctcctccctccacacttccactttgtcctcctcgtcccctacctcaacaaagcagggtggggtaggtgacatttgtgtatccacattcttacctttggtagtcaggtttggctactttgcagctcgcccaaagagatacaacctaatccccaacctacttttagtttttttgttttttttttatggttaaaagtaacttttgtagtttaaaaaaatctttcctctttcatataaataagaagtggaaattgcctttttattgtgtaatgtagaaaaccctcaagtgttttttccgagcttgggaaagattttgtgtaggaaatgtgcatagagtttgtattttatttttattagcagctgaaatgcctttggttttggcttctctctctccctctctctctctgtctctccttctctctctccccccaccacccacccccacacacgtcatctgcattgttattggagcctgtacttagagggattaagcccacaccctggcttccattccatatcaggtacaggatttgatgttattaacatttgtcgtcatacctcataagtcggtccctgccttgtctgtctaggcccatttggggctccctgtgagtgattcccctctctctgctatgctggagacggttccagcctggaaagcggccaagttcatcttctcactgtgagtggaagctggatcgggcccccgtagtcctggcagccctgttgtctggagggttcttgttgtccctcccattagccagggcggagactgtctgagctgtgcaggaggagggttgctagtaggttctgcttctgcttctctctgctccactgtctgcagcccagatcctgttgggcctggctggtgtctggtaaccatgggcctccactgacccatccctctcttttaaactgtcaggtcattatcaggcataggcagcctatagggcccaaagaaggcaaaaagataagatttactcaagtagcatttgggcaatgaggaaggaaaggtttcaaatttaggggcagaagtgagagaatgagccaacccatgtacctgctgcaactgaaccagactgggttttcaaggctcccagacgtagagtaggaaacgtgctcttctaaatgaggagggagaagataaaggaaacttctagcccctgtccttagtgctttgaggattttattttctcccttactacgcttgcttgacgtcactctctctcgacctccaaacagcaggactctttctctgggaaaccatccttccaaaacggaatctatgtagacaatgggacgttaggcagagagctcagatggcccttttaagggggctccaagaaccaacatcactgctcttttagataaacctctgccctccactccttgcttgagtgggttaaaggaactaacagttgtccctttaggaggacaaaatggggtcaagaggacacagaagagttgtatagcaccagattggttccaaatagttaatggatgtgtgcacattttctgttcagggattaagaccagaatatcagtggatttgttttccccaccaagtggcctcttagactagtcattaacttatgattagctctaaagatttcaaatagtggcagacagtgtcttctgaatgtaagttttgagaaatacgagtctgtcagagcggccataagccataaagagtcaatctcttaattatatttttcatcatgtaaacaagtttcccatttccctttcttagattgcaccagtgaaggagatgttttgcaaagattcagagaactaatttttcactggataagacctgagtaacccagaccccccaccgtggttcttttcacagccctcgactttgcacttaaaaagggatattgtaaatgaaaggctgcagtgccagttttaagaaagaatttctgtgaagtgtgaggactctggagtctagctcacataaagagagtgttatataaaaatccgacagctgaactaggttgctcttttttggcagggagtggggatgagatttgacaccaatatgggcaaaattagataaccttttggttaatataaatgattttgatttggaggcctaatttgtagattgtgaaagcagcttttagtttaacttattcacagaccccttataattaccatgtttttttttttcttcctaaatctcttggttcagcttgtgaatcttacgtgcccgtaaagttgggatgttgaattggctcttctttgttctggcagtgagtcaagtgtccagcattttttcataagtgttttttaaaattgttctccagcattttatggctcctccctcccatgtcctcagacccagcaaaagcgtagaggcagaattagaggcctctccaggccagctcctctgcccacatgtcatacaaggtgtgaatttgagcacagtccagaaatggagacatcccacccccagttgaataatggcccattcatgccaaccttgccaacacggagagggcagagatgcactagaagaccttcatcctccccttcctctgccccaagtcactacagttggttctattgaagccagtctttaagaaacctgggttaaagacaccagcacttctgcttgctgggctggctggacctgtgaagccatgggcaggtagtgccctcttgagagtcattttatttggccaccttcaggtgagactatccatagacacatgctaggataggccccgctgggagggcagttacaggagagagtaggtggtggtgacgtgagggctgtgaaggatccagagacaagacttagatgtttcgttcattcactcactcattcagttactcctaagacttttcagtttcataaggaagagtgttgcctgaggccctagggaatattggggaatagaagggattgaggaaacattaataatagttattcaaaagacccaaatgcttatacttctctctcccttcttctctctctgacacacacacacacacacacacacacacacacacacacgtgcacattcctcccttacatgctcatttgtgccttaaatgtgccttataggtaaatccaggatgactgaggaatccctcgtcactgggagattttgtatatattcttttattattagattgagttgggtgtggggaaaaatttttttctgaaggctcaaaagtggtttcctaaaagtgagccactatcagatttgcacatcaggagaaaagaaatagggttacgtccattaggaaaatcccagtttgcaggagtgcaatcacatcaaaaaaacaaccagccaggattaaaggtattataaatcctcatagcggaacatttctcagggcaaaggaacctggctcatttgaagattaatgttccatgcctttgtggtcaaagggtcagcacttaacacaggaaaaaactaggtgttgttttgttttgttattttggacaacataaaattcaggaatgttttatttagccttggtttctagaaggaagggaaataatatttcttgagcatttactagggtgttgcgtgctgtgctaagtaaattttaagtctttcagttttatagatacggaaaacaagggtgactctttaccacaggatgaataaagaactaagtaatatgggaaatgcagcaatttctggactagctgagccgattccttcctgtgagcacactgtaagctttcaagttctctgggcaggaattacagcacctgtcccctgcaatggccctgctgtgtgatgctcatcgcttcccttcgtgctggagcagtcccccaggtgtccatctcctatctttttgttccaatcttctgtgagttccagctagcaggctttacatctggggaaaggaaaaccaggggttttagctctgttctctgctcccatccttcgctcaccagctgagtgagaacatgaactttttgcaccatgtacccatggcttacactacttagaaaatcaccttttcagataaaacagtttatgagttcatagagaacaccagcactctttgacaaaactgtgagtgaccctttttaaacaatgctgagcaggccctgagctataatcaacggtgagctttaatgtctatgctgacagttaggttttgctctcttttgtaacaggttacgtagaccagcagtgtttaaatctaaatacgttgtgagtctgttatctgtcctatcgcgttttttaaatgactttttattctttatcatagctaagtaaataccaaaaaaaaaaaaaagctttgtaggacacttgtacttagtttgggaaaaaaaaataaattgaaattgttatgcttttgtatttccatttcttgcaaataaatattttttcttaaatagtaa

SEQ ID NO: 724 - DNA, 8740 bp, Homo sapiens
ccaggaagagagctgtgaccagcagcgtcccttattcgcttggccttggttcctgtttgcactggctacagcagggcactggcccctactgtcaccgccacctacacaaagaccctatctctgagcgctgcagcctactgttcagccccaggtttgaggatggatgccctggacgcttcgaagctactggatgaggagctgtattcaagacagctgtgaggcccgaggtggggggtggagagtgggatggtcttcagaccttgatctacaactgcttgccttctgcttcccatccacaggtatgtgctgggctcacctgccatgcagaggattcagggagccagggtcctggtgtcaggcctgcagggcctgggggccgaggtggccaagaacttggttctgatgggtgtgggcagcctcactctgcatgatccccaccccacctgctggtccgacctggctgcccaggtaagtgtcctggggggctatgggctgccagaccaaggtgggggcacggcccaagaggagtgtctttgctcaggctgcactggctctctccctagtttctcctctcagagcaggacttggaaaggagcagagccgaggcctctcaagagctcttggctcagctcaacagagctgtccaggtcgtcgtgcacacgggtgacatcactgaggacctgctgttggacttccaggtcagctcaggcctgcagccctcaagagcaggaagggctgggcaatggttttggccctgctgatcactgtgtccacccaggtggtggtgctgactgctgcaaagctggaggagcagctgaaggtgggcaccttgtgtcataagcatggagtttgctttctggcggctgacacccggggcctcgtggggtgagtaagactgcctgcccagcctaccatattacagccagcaactggcctcatgctgtcctcagctccaggcttgctccagtgcccctccaaccagcctcaggtctatcccagcatgcctttctgattctggtccccagtcctgccctctggttcctccaacctagcctccagacctgctccagtaaccctctcaaattctagttcccaagcctctccttgcattcctttcccaattctggccctctggccctgccctagtatcccctatccttaagtacaatctgtaagccacctcagtgacccctaccaccccatctcaggcagttgttctgtgactttggtgaggacttcactgtgcaggaccccacagaggcagaacccctgacagctgccatccagcacatctcccaggtgggtgctgagctgtaggcattcacctgctgaccaaggagaggctgccagggcctgtggaaggcaggtccaggcaaccctgagccaagcctcctcctacccagggctcccctggcattctcactctgaggaaaggggccaatacccactacttccgtgatggagacttggtgactttctcgggaattgagggaatggttgagctcaacgactgtgatccccggtctatccacgtgcggggtaagccaatcccattccaattccaggtgcagggcccaagcctccactggaagtgagcacagcctggcccttgggatgggtttttctccctccaccttctacaaggtgcagcaaggtctgggacacagatgcaagataggatggggtgtgggaactactcaggctcaaggatcattactgactagactggaactccctcagaggatgggtccctggagattggagacacaacaactttctctcggtacttgcgtggtggggctatcactgaagtcaagagacccaagactgtgagacatgtgagtgcaagtgcatctgaggtaggggagcttggtcgccttgaggggcccatagcattctggactagaccctgagccaggtgcccttgcagaagtccctggacacagccctgctccagccccatgtggtggcccagagctcccaggaagttcaccatgcccactgcctgcatcaggccttctgtgcactgcacaagttccagcacctccatggccggccaccccagccctgggatcctgtgagtagtcctgttgctcccacccccagcctctgtcatttattggggtcccacctgccagaggcaacaatgaccattcacaaatccaagtctgatctcccaacactgcagcctttagagtagagactggttccatggaagtgccaggcacacatcctggggactcctgctacaccccgacccctcagatctgtgctggaagctgcactcagattagtgaagcctcctggactgctgtctggtactgggcatcctctggtggtgctgtgcaggctggcagcagggccaggccttcccacccaggcttctgcttcctcttctgtggaacagggtggatggagggtggctggaaggatttgagtcaggagtagagctcaggctggggctactatgcccacagagtcctaccaacaggttgatgcagagactgtggtgggcctggcccgggacctggaaccactgaagcggacagaggaagagccactggaagagccactggatgaggccctagtgcggacagtcgccctaagcagtgcaggtgtcttgagccctatggtggccatgctgggtgcagtagctgcccaggaagtgctgaaggtgggcagaggcataggtgtggggggtactgggaagatgtggagatcagtgtgtgtgtcagagggcacccagcgctagagagcagccctggagccttcaccaacctgggtgaagcctccagccaggatctgaggggggtcaggaggtggcaggagtgcccagcctgaagtgctgcccctaggcaatctccaggaagttcatgcctctggaccagtggctttactttgatgccctcgattgtcttccggaagatggggagctccttcccagtcctgaggactgtgccctggtgagagcctgggataggggtgcaagccttgtccaaaatcaggactaggggagaagcatgaggaatgccctccaggtcctgattcagaaaactcagtataagaaggagatgcaggccagtagccatcactgaccccgtctctgtcccctagagaggcagccgctatgatgggcaaattgcagtgtttggggctggttttcaggagaaactgagacgccagcactacctcctggtgagctgtggggtgagactgggggtgcctttgggagagccagcccagcccctctggctaaggctgttcctgccaacaggtgggcgctggtgccattggttgtgagctgctcaaagtctttgccctagtgggactgggggccgggaacagcgggggcttgactgttgttgacatggaccacatagagcgctccaatctcagccgtcagttcctcttcaggtcccaggacgttggtgtgagtgctgacccctctccacactcctgcatcccagaccgtcctcccatacagcttcccacccaacatcttcctgccttcttcccagagacccaaggcagaggtggctgcagcagctgcccggggcctgaacccagacttacaggtgatcccgctcacctacccactggatcccaccacagagcacatctatggggataactttttctcccgtgtggatggtgtggctgctgccctggacagtttccaggcccgtgagtgcttgacttcggaggtcagtcccttgcccacagctgtgccagtcccacttctgacccactgctcccttgccagggcgctatgtggctgctcgttgcacccactatctgaagccactgctggaggcaggcacatcgggcacctggggcagtgctacagtattcatgccacatgtgactgaggcctacagagcccctgcctcagctgcagcttctgaggatgccccctaccctgtctgtaccgtgcggtacttccctagcacagccgagcacaccctgcaggtaggaagcaccctggagactcccaccccacccagctcagccctcagctgcagacctgttctccacctgatacctcattcttcctccctcctccacagtgggcccggcatgagtttgaagaactcttccgactgtctgcagagaccatcaaccaccaccaacagtaaggccaccaacagaggcagatgggagtccagggctccaagcatgagtctgcaggactcagtctcacacttcctcctctctctgcagggcacacacttccctggcagacatggatgagccacagacactcaccttactgaagccagtgcttggggtcctgagagtgcgtccacagaactggcaagactgtgtggcgtgggctcttggccactggaaactctgctttcattatggcatcaaacagctgctgaggcacttcccacctaataaagtgtgtggctaggggttgggacgctgggggctcagggggaccagactgagcccagcagcttctacttacctacctaggtgcttgaggatggaactcccttctggtcaggtcccaaacagtgtccccagcccttggagtttgacaccaaccaagtgagtgggattctgtagggagctccaagatagagatgtggcccctcagagcagaggtaggcatttctgcattctgcagagatgcacagatgcccagagagagccatgcttgtgcatatatgggtgtctacatgtgaggcaaaggcaggcactcaaacagatccacaaatggacagtgacccccaccccatgcacccatgcctctgttcctgctcttggtctggctgcaggacacacacctcctctacgtactggcagctgccaacctgtatgcccagatgcatgggctgcctggctcacaggactggactgcactcagggagctgctgaagctgctgccacagcctgacccccaacagatggcccccatctttgctagtaatctagagctggcttcggcttctgctgagtttggtgaggctcctggccctggcccctcatgctgtctttcaaaggcctgaacctgtcctgtcctcagcctgtgctgcagaaggaagatagggcctaggggatctacagccaatttgctacctctcaggcctcctaacctcactcctccatagtttcaggcttatcctctggtccctcagtaggtcttctccctgctgcctaccccacatcccagttcttgtggcagattcttggcaaaataaataagtaaataaataaagtccattggttcctggggagtgtctagctatggcctgcaggtgaggacagggtcacagaggtcatgagcacacatgggtgaagactggggcttctagaggggagattgtagcattaattaagggggcttcttgatttgatcagggaatagtaagtgacaggcttggcaaagaccaagaataggcacagggctccaagaagagtgcaggagacaggggctaaggactgcctcaacatcccctcccctgacaggccctgagcagcagaaggaactgaacaaagccctggaagtctggagtgtgggccctcccctgaagcctctgatgtttgagaaggtgggtgcccaagtggcagtgaggagtggggctggggagtttgtggagaaaggtcaggagctaataaggtagttttggagccccttggcctgaattctcccagcaagaccctggaagcagctcacattccctgaacctcagcctgtctgatcaagaggagatgtggggcaaccccccgacagaactgtgtggagacttgtgcagtgacacgcagtgggccacggtgaggggcacagctgcagtgttaacactactttgacttgggccttacaggatgatgacagcaacttccatgtggactttgtggtagcggcagctagcctgagatgtcagaactacgggattccaccggtcaaccgtgcccaggtaaccccaccccttgaggcttgggcctggaggtggagggcaaaccctggccctacgccttgggcccagaccaaatctcttgtccttggcagagcaagcgaattgtgggccagattatcccagccattgccaccactacagcagctgtggcaggcctgttgggcctggagctgtataaggtggtgagtgggccacggcctcgtagtgcctttcgccacagctacctacatctggctgaaaactacctcatccgctatatgccttttgccccagccatccagacggtgagcccatgataccccacccttagccctactaggcctgggtttcccctgcacctgcccatacaggccccaatctagctgccggctctcactgaaactcagactgtgcagaagtcctgaagactccctccagccctcttcctgctatgaagccaggctgggacctgtcagacacaggaagcagccgtcagccatccccacccccaatcctccaaagcccaggatctgggggagctgcagctttaactcattagtggagccagacatcccccacagtcccctccttccttggagtacccctgaggggtaggtagtggggaggggaccagggcatcagccccagaaagagtctagcttccccctgcatggtacgggggccctggcctacctcctacaagctgagttaaaaggtaataggcttgccactagaggtgtggggtctgcagccctgagtgtatttgtgtcacagttgtgagtgcaactggggtctgggcatccccggagtgtgggtatggaaggagcaagtttgcacatctgtgcatcagatgggagtgcagggctcccatcttcctgtgtcctcaatgtgggcatgcatggagatgcatgtgggcacacatgtgtgtgttcctgggcttgtgggcatttgtgttcctgtgactgcagcgctgtgaatgcctccagccttgtgcccaggctctgcagttggcatttccttggggcaaggatgagggtagaaggaatgccctcatgaggggagagggcagaggtcatgggccagcactgggtttctgctgagcagcctggggtccctctggactagcacacagagcccctttgtgaggcaccctgcctctaaccagcatacaggctgcctttgtccacagagtgaagcaggtgaaggagaagcccccatctcacctctagcctagtctcagcttgaccccagtgtgttttctcaggggctgataagcaccccctgtcctggtctctagatacctgccagccatccttctgtccttagctctaggtcccagaaccccaagactcttggaaggaaggaagggacaggaggaggaagcctctatgcattgtatccctgctggggtctctgggacagtggggccctggtggtcactgtgccctttgcccctgtgtcccaatgagtagcccaaggcactggcagtacatacaagattgggggacaggatgtgccccccagctcccagccttgtctttgaggaacaagcagctttatcagaggctgcaggggccctgctctgggtttcctcaggaagcaccaccccctcatcccccactctcacaactggcccatgtgatggatcgtctgtttccctgtgcgggccccatagccccatttcctgtgctggccccggcctggacggggagggggctgagactctgggcccagatcccacctcccccccaccccccaccccctggctcctgtttcctgctagtccagctcttcccctaggaaaggctgctggtaactgggatgggggttggggggaggtaagaagtctctgactcctcctctacctcatcccagttccatcacctgaagtggacctcttgggaccgtctgaaggtaccagctgggcagcctgagaggaccctggagtcgctgctggctcatcttcaggtgtgccctgttgctaccccaacccccaggctcagcccagcccggcccagctggtgtctgacctttctcctctaggagcagcacgggttgagggtgaggatcctgctgcacggctcagccctgctctatgcggccggatggtcacctgaaaagcaggcccagcacctgcccctcaggtgagcccacttggggctttagacaggccccaccagtccctggaggctggggctagggaccacactgccttttgtcttcccagccccattctgggcccctcacaccttcccaagcattctttccccaaatggagccagcaaacaggctggaggtggggtgagggccgagagcctgaggaggagtcttcaggagctgcctatttggccagccccatgggctccccacatgctgcacagcccccctttcacagcccactcccaagggacccatagcttcctgcctcctgcttgcctcatcagctgctcctaaaatagtttcagatgtttcctgtcttgagcagctcctgctcctggcttgggctcctgacggcctgccagcaccctctctagtccatgccaggctgccttctgcttgccatggctcacctctccaatctcccctaaacccacccctaccagggtgacagaactggttcagcagctgacaggccaggcacctgctcctgggcagcgggtgttggtgctagagctgagctgtgagggtgacgacgaggacactgccttcccacctctgcactatgagctgtgacaaggcagccaccctgtcacctagctcaatggagccccggatcccaagccctgcattgtaagcccacagtaggcactcaataaatgcttgttaaaggaagg

SEQ ID NO: 725 - DNA, 910440 bp, Homo sapiens
gttgctttgcggcgttttccgcggggaaactgtgtaaagggtggggaaacttgaaagttggatgctgcagacccggtactggaaagtttcatgtggggtgccgttgtggggaagtggggttcgctcattatttcctgctccttccctaggctcgtgggtttcgatattgggggagcggagattttctcttgggtgctggtcacgcccccttaagactcgggatcgtcactaagaaccccgctgtgaattgggggagcttcgggccttcttttggtggggaatgcttggaagctgctcattgttggaaaaagctctttttaggggattctgggtgatgtttccgcctgttgctgcccatcttcctccccagccccttcccgcttcgggcagcctgtcattaggggaagttgagggactctcccacttcaggtggtgttggagagcgtggaatctggagtccggtccctggattcgaatgcgagcttcacaccaattgtcagctgtttaactttgcccaagtttctcaactagttacctcagtatccttatctgtaaagtgaggtaaaatatccgaagcctttggaacagtgtggcacgtaataagggctcaataaatattagctaatattgttcctaaacagttgttgaacatctaacatgaagaattttcttttcttggtggtaaggaggacagggttcattctccagggttgaccgtctcccctcatgtgcaatacacatacgtgctttcgcgcacacatacaccgcaggaatttacgtgctccggtgggggcaaacaaacttgcaagccataatagtattttgataagattatcgaatagatatgtgcgaagttgatgagaacattggagaggaaaagacttgactctggggaaggttttgtggagggaagtcagggagacaggatgcgtgacctaccaatacacataccatgtggctggagggcagatcatgtgagagtcattaaatgatgattgctgaccttaagtactatgtgccacgcactccccgagtcctttaacctccactacagtcatatgaagtagtaaattcatatgactgtaaaacaagggttttaaggaaattaagacactgagaggtgaagtaactgccaggaaggataggaactgaacgttgcaatgtgatgtatgagtgagaaggaagtgagggaccaatttttgatgtttttctctgcgaccctaagaagtttggaatttatcctgtggtctaccagtcccatgggaagtgttaaaggataatcgtgactttttaggaagctactcaaggcaggattgtgacactgatctgacttttgcaggcgaatttggggcttcttcctgtctgcttccatagcacttttaaatagcaattgtaatgcttactgcatggctgtagttatttgtgtgtacctctcttttcatctcaactatgagtattcaaaggggagggaatatgcttaaatgattcttgtaccccagacctcagcagggtgtgtatttaaatgcctgtggaaggagtaaattaaggaacaaatgaatggagtggccagaaacaatatgcaatagtccaggcaagtgatgggagtggccctattaaggcagaaatggcagaattggttgttgttaaagtccttgtagtttagaatttatagttttttgtttgtttgttttttgtttttgatagggtctcagtctgttccccaggctagagtgcagtggcatgaccacagctcactgcaggctcgacctcctgggctcaggtgatcctctcatctcagcctcctgggtagctaggactactacaggtgtgcggcacaatgcccagctaatttttgtatttttttgtggagacaggttctctctatgttgcccaggctggtctcaaactcctgggctcaagcaatttgcctgccttagcctcccaaagtgctgggattgtaggcgtgagctaccttgtgtggcctatggttcttttctttctccttctttttttttttaaattgaatttatcagtctaaatggtgtcattacttgaaactacctgatctgaaaagacactaggcaatattatagcaggtatcacttggttttctactgggggaaacaagtcattgctaacaaattcccatggagagaaatgaggaggatgtatttttgtttgtgagaggtgtgtatgtatgtatattgtgtgtgcgtgtgtgtgtgtgtgagagagagagattgattcagtctgattcagagaatttaggtgttaaatagaaatttgggccatggtattggaaataaacaaatatatacattctcagtatacatatattttcattccaaaatgttacttcttttctgataactatattgctttattccttggatccatgaagagttcctgtttcagttcgttccagaggatacttctttaccatctcaatgagatatacagcttctcctttgtatgcattaagagactcacagtaattcttttttagctctgtgaagataaatctttcatgagcctcatttacccctagcaaggtacaatagtgaaatttaactgcatgtgagaatataagcagctagtgtaataaagaacattttgggccaggtctgatcgctcatgcctgtaatcccagcactttaggaggtcaaggcgagaggatcacttgagcccaggagttcgagaccagcttgggcaacatggcaaaaccctgtctctacaaaaaatacaaaaattgggcaggcatggtgtcgaccctgtctctacaaaaaatacaaaaattagccagacatggtggtgcacgcttgtggtcccagctacttgggaggctgaggtaggaggattgcttgagcccaggagggggaggttgcagtgagctgagatcgagccactgcactccagctggggtgacagagccagacctgtctcgctctctctctctctctctatatatatatttaaaaagaacattttaatactgcagtgataaaatctcatttgattcagaaggtgtgctctgactcctagaaaaaggaagagttaaatatgattatggacttgcagtagagtgtaatggttaagaggataggtttcagaattagactgcctggattcaaattctggatcagttatttatgttttctggtgacaatggactagctaacttttccaggctttagttttctcatatgtaaaaaaggggccaataatctactttccttctagggctattgagaagattaaatgtgataatttagataagttttggaacagtgcctggtatgtggtaggtgctccataaatatacctattgccgttacagtgcaatgtaaattgttacagtgcaatagactttctagtagttctgtttggaaatatgccttgaaagttaattacatttccaaataaaatttatacatgcattgaacattttaagatgctctacaaatgtgaagtggtactatattcatgtagtaaatatcaattaattgtgtgaaattatatttgaggttgccttgtagattttctatgtgcctgtttgacgaacaattgtccctcctatttaaaacatttaaaaaggttctatagcattcctttatcagtaatatttttaacacaatatgtttcattttgcatatggagaaacttgaggaatttttaattttgttttggatagcctattcactatcacttatgttatattctgttgtttttttcatggttcttcttttctttgctggatctggaggcatgggtagcaagaaactaaaacgagtgggtttatcacaagagctgtgtgaccgtctgagtagacatcagatccttacctgtcaggtaaattttatttaacatttttattgataagttttatgcacaagttaactttataccttaatacctcttaaacttgaaatatgaaaatgtaggcttacaaaaaaaagataaatgatggtgcttttccataggctaattgtaaatatcaagcctccttgggtgcatttccaactgctatttcatttacccaaatttagtatttttgcattttgaggggaaagtggtcacggcataaggtgaagtaacagctttactgttttatagttacatgagaaataggactcaaatgaggagatactattcaacatgtatcatttctcttaaaagcaaaagaaattaatagaccattttcttattgatggagcatgagaaatatatagagcggatcttgcatttttaagcaaggtggtgaagcaaatcctccttagcagggtaaataagatttaaaggttttggttggttgtttttgttctttgttgtttttgagactaggttctcatgctgccccagctgatcttgaactcctggccttaagcaatcctccagcctcaactcccagctagctgggattacaggcacacaccactgtgcctggctagatttaaggttttatcttaggattttatcctttttttgtttgtttgtttagagtcagtgtctcactctgttgcccaggctggagtacagtggtgccatatcggctcactgcaatctcctcctccccggttcaagtgattctcctgcttccatctcctgagtagctgggattacaggcacatgccaccacacccagctaatttttggatttttagtagaaacggggtttcaccatgttggccaggctagtctcaaattcctgatctcaagtgatccgcctccctcagcctcccaaagtgctagcattacagacatgagccaccgtgcctggcctgattttatctttaataagacattttcacagagcattctgcaattttttttttgaattgctttctgtgttaaagataacatcggttcctttgttatacatttaattatttgcatatttatactcggaaacattcttaaaagtatgaaatttgttatttcatcctatagtcagtttcattctttttcaactacgaaatattatctctgagtgaacttctagcttagaaagaaactctttcggccgggcacggtggctcacacctgtaatcccagcactttgggaggccgaggtgggcagatcatgaggtcaggagttcgagactagcctggccaatatggtgaactcttgtctctactaaaaataaaaaaaattagccaggcatggtagtgagtgcctgtagtcccagctactcaggagtctcaggcagaagaatcgcttgaacccaggaggtggaggttgcagtgagccgagatcgtgccactgcactccagcctgggcgacagagcaaaactcttgtctcaaaaaaaaaaaaaaaaaaaaaaaaaaaaaggaaagaaactctttcaacctgacactttctgggcatatatttatacccaaattctttttggcacaagtgtagcgctcatacgcacctggattggatgctggtgctatgtgatattatttggtgtatcctctggtatatgccaactaaacaggataattagaagataagtttgtgtcattacaacttttagttaaggcatatttatggggaaaatactacaatgaatgtataaatctttgatctgcgataaattatacttttgtctacataagcagtatcaattgaaggtttccttttaactctagtatctttgttacacatatatgtttaaaatactctctttatgtttctttaggactttttatgtctttccccactggagcttatgaaggtgactggtctgagttatcgaggtgtccatgaacttctatgtatggtcagcagggcctgtgccccaaagatgcaaacggtatatttatattttattatgatttgattatgaatgattcctcatctcattaaacatgtttttttagggatgaggcacatgcagaaatagagatgagtacctcaaaaatactgagttttctactatagaagttagttctctaaggaaaatacatgtgaaaattttttttttcttttttgagacgctctgttgcccaggctggagggcagttgcacgatctcggctcactgtagcctctgcctcctgggttcaagcgattctcctgcctcagcctcctgagtagctgggattacaggcacggtgctaccaagccaacttatttttatattattagtagagatgggatttcaccttattggccaggctggtctcaaacttctgacctcaagtgatctgcttgcgtcgacctcccaaagtcctgggattacaggcgtgagccaccgtgcctagcctatgtgtgaaaaatttatgtagtttataaactcatgggagacaatttctaaatatgggaattagggagcaacagaaagtttttatttttttttctatagccaatagcagtagttcaaaaggtcatctttctctgattgattaggtagtatttgatggcctcatagttaaattataatcttaattttagaatgcccctttctttgatatactgacctttaccatcatcacttgctctagatcataaagtacacataattgtacttgtagttgcttattgattgaataaaaggtaattaaaaatttatcctttactcttaagaaaatttgaagtcttttacaaaagccctcatcaaattgtacattttttcagactttttgtgtcatgactgtagcttttcaaaatgtagatttggagcatgatagaaatatcttgttttctcacagtaagagtttcctaaaattctgttcggtgctttgcaaatgtatttatttatgtggactgtaagtttcttaccttactgccttatattgaaatttactgaacactgaacaatgaagtacaattctctgaagaaggggagaaggaaggaatgttagtgtcactggaaacttctaaaaacaatgaacagatatttgaacaacagatattttctttcttttttttttttttgagatgaggtctgtctctatttctctggctggagtacggtggtgtgatctcggctcagtgcagcctccgcctcctgggctcaagccatcctcccaccgcagcctcccgagtggctgggactacaggtgcacaccaccatgcccaactacgttttgtgttttttgtagagatggggttttgccacatagcctagactgttcttgaacttatgagctcaagtgatcctcccgcctcggcctccccaagtgctgggattacatcagccactgtgcctggccaaacaacagatattttcttttgttcagatttagcttgtgatctgaggaaaatattttaaagacaggatagtcagaaggagaatcagaactggagttagaaactggcattagtcttagctttatcattgatttcattgcttgaacagctttcttttatgggagaaaacagaagttaaaatactatgcaatgattctgtgactagattcaaattaacttgttattattttgaaggttgtaaagcaccagaaaaacctttaatttgtcatctgtcattctaattagtcaatatccatggcatatttcccgttaataaatagagagcatggtcccgaaattcaactttaatttctacttccatcactaccttcagctgccatcttaatacaattccaaatacagttcaagaaaccatctttctcctatggtttacattcattcttgtagcattccttatatttcagcactgccctaaacactggcttagttttttttttttccaacttttattgtaagttccggggtacatgtgcaggatgtgcaggtttgttacataggtaaatgtgtgccatggtggtttgctgtatggatcatcctatcacctaggtattaagctcagcgtccattagctattcttcctgaagctctccctctcccccacaacctcgcaacaggccccaatgtgtgttgttcccttccgtgtgtccatgtgtccatgtgttctcatcgttcagctcccacttataagtgagaacacacagtttttggttttctgttcttgcattagtttgctgaggatgatggcttccaactccatccatgcccctgcaaaggacataatctcattcctttttatggctgcacagtattccattgtgtatacgtaccacattttctttattcagtctatcattgatgggcatttgggttgatttcatgtctttgctattgtgaatagtgctgcaatgaacatatgtgtgcatgtatatttataatagaatgatttgtattcctttgggtatatacctggtaacggcattgctggttcaaatggtatttctgcctctaggtctttgaggaattgccacactgtcttccacgatggttgaattaatttacactcccaccaacagtgtaaaagcattcctattagtctgcaacctcaccagcatctgttgtttcttgactttttagtaattgccattctgattggtgtgagatggtatctcattgtgattttgatgtgcatttctctaatgatcagtgatgttgagctttttttttctatgtttgttggctgcatgaatgtcttcttttgaaaagtatctgttcatgttcttagcccactttttaatggggttgtttggttttttttttcttgtaaatttgtttaagttccttatagagtctggatattagacctttgtcggatggatagattgaaaaaattttctcccattttctaccatgatagtttcttttgctatgcagaagctctttagtttaattagatcccacttgtcaattttgcttttgttccaattacttttggcatttttgtcatgatatctttgcttgtgcctatgttctgaatggtattgcctagattttcttcaaggttttgttttttttcctatagttttggattttacattcaagtctttaatccattttgagtcaatttttgtgtaaagtgtaaggaaggggtccagtttcagtttcctcatatggctagtcagttctcccagcatcatttgttaaataggcaatcctttccccattgcttgtttttatcaggtttgttgaagataagatggttgtaggtgtgcggtcttatttctgagttcttctgttccattggtctatgtgtctgtttttgtatcagtaccatactgttttggttactagagtcttgtagtatagtttgaagttggatagcatgatgcctgcagcttcattctttttgctttggattgtcttggctatacaggctcctttttggtttcatatgaattttaaaatagctttttaaaattctgtgaagaatgtgaatggtagtttaatgggaatagcattgaatctataaattactttgggcaatatggccattttcatgatattgattcttcctatccatgagcatagaatgtttttccatttgtttgtgtcctctctgatttcttggagcagtggtttgtagttctgcttgaagaggtccttcacatcccttgttagctatatttattgctaggtattttcttttctttctttcttttttttttttgagacagagtcttgctctgtcgccgaggctggagtgcagtggcacaatcttggctcactgcaagctctgcctcctgggttcacgccattctcctgcctcagcctcccaagtagctgggactacagatgcccacctccacgcctggctaagtttttgtatttttagtagagacggggtttcaccatgttagccaggatggtctcgatctcctgacctcatgatccgcccgcctcggcctcccaaagtgctgggattacaggcgtgagccactgtgcccggcccagtattttattttctttgtagcaattgtgaatggagttcattcataatttggctctctgcttgcctgttgttggtgcattggcttagttttagttcatttcttcaggaaattttttttgctcatttattcagtcatttattcttttgacctgtatttactgaatgtcaagcatgtattaggtactttgtcaggcaccaaggctatcatggtgaacaagtttatacagtccagccctcttgtagtttacagtctagtgggggaagccagacattaaaatattaattcagaaataattagttaattataatagtgctaaatcctatgaaggaaaagcataaggtactttgaaactttataatagggattacttagtttgggggtcaggaggacccttgcaaggaagcaatactttagctaaaacatgaaagatgaataggtgagagataggcaaaggagctgggaagggagatgggcagggaagagttattgggcgttgggtataacagatgcaaaggccctgggaagtgaaggagaatggggcttgcgtgagtgggtcataacaacgaagaagagagtggtaagagatgaagccagagaagtaagcaggagtcagattattagggctttgatttggactttattccaagagcaatggaaactcataaaagggtatactgtaatatgtgttttaaaaaaaatcagtcttggacatggacaagtgattgaaaaggagcaataaaatattcacgaagattagttaggtacctattactgtattccaaacaaaaagtgatggtgacttatattattaatgcagaggttatagtgttgattaatatgacagatatttaggagggataatttttgtttttttttgagacagagtctcgcactgttgcccaggctggagtgcagtggtgcgatcttggctcactgcaatctctgccttctgggttccagcaattcttgtgcctaagcctcctcagtagctgggactacagacatgcaccatcacacctggctaatttttgtatttttagtagagatggggttttgccattgtccaggctggtctcaaactgctggcctcaagcaatccacccacctcagcctcccagtgtgctgggattacagatgtgagccactgtgctgagcctaggagagagaattaatgggatttggtgattgtttggctgaggtggtggtgaagtataggaaaatgtcagagatgattctctgacttttgctttgagaaactgagtggtaccatttcctgagatcaggaatactggaagaggagcaggtttgagggaggcagatcatagattcaatttagtacttgtgtaatttttttttttttgagatggagtttcgctcttgtcacccaggctggagtgcaatggtgagatctcggcccaggctcccacgttcaagtgattctcctgcgttagcctcccgagtagctgggattacaggcacccaccactatgcccggttaattttttatatttttagtagagacggtttcagcatgttggccaggctggtctcgaactcgtgacctcaggtgatccacctgcctcagcctcccaaagtgccgggattacaggcgtgaaccaccgcccccggccagtacttgtctaatttaagatgtttataaaacatttagtgaagatgggaaataggcagttaaatatatggacctggactttgaaggcgaggcatgcacgtgggagtcattggtgtaaatatgatagttaaagctatcagaatggatgagtgattgcctataaagtgcatacagtaagacgataagtgtacttaagcctgaaacctgagtgatgccaacagttacaggtcagattagatgataatgagtctgagaagaagcagccaccgaagtagaagaaaaattggtagtgtcatatcacaaaactcttctttgtctcatttatatacatactacttttctgaagttttgttctgttagttcattttattcctttttttgagatggagttttgctcttgttgcccaggctggagtgcagtggcgtgatcttggctcaccgcaacctccgcctcccgggttcaagtgatgatcctgcctcagccccctgagtagctgggattacaggcatgtgctaccatgcccagctaattttttttttttgtatttttagtagagatggggtttctccatgtttgtcagcctggtctggaactccggacctcaggtgatacgccggcctcggcctcccaaaatgctgggattacaggcgtgagccaccacacccagctgattattctttttttgacttaccgaatctattattctagaaattacacttaaaattgtaagtgaagtgctttaattttgacagattgggctgcctttgcatgtttgagaaagtatccccacatgcatccacgttgcctgatgataggttatagaaaaaaatgtctacgtaaggatgccgactgaaatatttcttatatcaaaaaattggaaacaataataataggaaggagataaattatattacatttatgttagggaatattatgtaggcactaaaatctttaaaaaatatttgtttgtttattgatttttacagaggcaaggtcttgctatgatgcccaggctggtcttgaaatcctggctgcaagtgatcctcctgccttagcctcccaaagtgctgggattacaggcatgagccatcatgcccagccaataatttttaataacaggagaaatgcacaggatataaatggttagtgaaaaaagcaggctacaaaattgtatatagtatacatgccaattttataaaaatgaccgttataaaggtatttggtgtatattgttaataatggttatctcaggattgtggaattttttactgttctgttttctttaactttttttttcattccaaatttgctttaggtatgttatgttctttaggaaaaaagcagcaacagttcttgtttgtccccttgcagtaatatctggcaattctcttagtctcagtttttttaccatttgcgaaatggagataattatacctgtgtgtaaatgaaataatgtatgtaaagtacttaatacagcacatagtagatgtgcaacagatgttcattagcttcctgtccttgccttttccttactgttcatgattcctgaatcacagcaatatctaagaggagctgatgttatttgctccatatcctagcatagtgactggacagtgccctggagcaggcaaaactaaactgaaatgtaaagcagaccattaacaaagggaggttgtcaaaagcccttaaaagaataaaaggaacattagaaaataaacatcttttaaaaatcaggtaaaattttaatatcccagaagattaataaaagtaattaaaaaaacaattttccttatagagtattaacttttgtagttctaaatacatcagaatgatcaaaaccaacaaatgaaatcaccagaattctttgtataatttcttgtggacaaacacaacaccaaggataagaaaggagaatttcgggccaggtgcagtggctcacacctgtaatcccagcactttgggaggccgaagtggtcaggtcacttgagggcaggagttcgagaccagcctggccaacatggcaaaaccccgtctctactaaaaatacaaaaattagccgggtctggtggcaggcacctgtaatcccagttacttgggaggctgaggcaggagaattgcttgaacccaggaagtggaggttgtagtgagctgagatcgcatcactgcactccagcctgggtgacagagtgagactctgtcttgaacaaaaaaaaggagaatttcagaattgtattatattggaaaaacttcagatatgtagtgtttctccccttgttcacagggaatatgtttcaagaccctcagtggatgtttgaaaatttggatagtactaaactctatgtatactatgttttttggatctgataactgagatgataactgagatactgactaatgggcagggagtgtctacagtgtgtatacacttggcaaagggatgattcacatccaggtgggatgatgtgagatttcaccatgctactcagacctgtgtgcaatttaaaacttatgaattatttctggaattatccatttaatattttcagatcaatgttgaccaggggtaactgaaacatgggaagtgaaaccgtggataagggggactgttgtactgtgtacctgggtttagatatagttgctagtaccaaaagtttttatccccactactattaccttcttctagctaccattatttttctttggaatgactgtaacgtcttcctgacagatctcccagcttcaagctgttcttcacaaactaatctgagtatgtctttgaaattataatttgttgtattagtttcctgtggcagttctaatacaaatcacaccctgggtggcttcagacaacagaaatttattctcttacagttttggagttcagaggttcaaaattaaggtgtaggcagagctgcattctctccagaggttctaggggattatccgttccttgcctctttcagcttttggtggccattaacattccttggcttgtggctgcttctctctctataccatcttcacataaccttttcctgtgtgtattgaattccctctgcctctcttattagtgtgggtatttagggtccatctggataatccatgattatcccttcatctcaagagctttaacttaatcacatctgcaaacacccattttgcaaataaggtaatattcacagacaggttctggagatttgatttggatatccaggggtgggggtggggggtcatttctcagcctaccacaccttccttcacactgttcttcacaaacgaacccaagtttgaaataacttgttcatgtcactcctttttgcatcttcaacagagctgtttatggttaggcccctgcttacttctctagcctcattgcttgctgtgctacacccacactccatctttcaaccattctaaatgaactgtatatttacagtttgtgttagtccctgtttcctctcttgcttcttgacctttctttgtacattctgtcctctttggcaggaatagtcaaatttcctttgcttacctaacagctctttcagattttagcacgggcatccagcaattccattaagtttccaaaatctgtatcagttatactttccctattacaatatctcttattaattgtgttgtaattgcctggtttctagtcctaatttcatagtccctggttgacttcataagactgtgagggcaacgtctctctctttctgttatgtcatatccccataatctagcacagtccctggcacagagtaaatatttgttgaacaaataaataatagaagggaaaaggatggattagggttaaaattgctaaaatttagagaattaaagttggtttatgtttttgaatatatatagaggttgaaaaaaaacttaatcattttcttgtttaggcttatgggataaaagcacaaaggtctgctgatttctcaccagcattcttatctactaccctttctgctttggacgaagccctgcatggtggtgtggcttgtggatccctcacagaggtaaaggaaaaatttttcgtaccttcttccattgacctataaccttcagagctagggaaaaagtttagttaaaaaacataaattatttctggaacggtaatctgaattaaattataagtacttcaaggatatggttctccactcagtacttagtgtggttgttctgcaaacagaggtgttaaaaacaaaatccttgctgactgattaaaatctacttaggttgctgtttcattgagttaacttagaaagtgataaatattgctgggtgtgtttatatatgtgttatatatataatgcatacatatatgttatatatacatacatgcatacatacatttatatgtacacacgtcacatatatgtaatatatacacatatgtcatatatgtaatatgtatgcacataaataacattatatattttatatatatgattatatcatgcctgtaatcccagcactttgagcaacaaggcaagaccctgtctttaccaaaaaaaaaataaaaaaaacccagaaaccatttagccatatgtggtggtgcatgcttatggtcctagctactcaggaggctgaccttgagccagggaggtcaaggctagagtgagccatggtcacaccactgcattccagcctgggtgacagagcaagaccctgtctcaaaaaaaagaaagtggtaaatattatgaaataatattatgaaacaattgggggaattaaaaaaggatcactccttataaattaggaaggacaatttgaaattttattaacatatggaaaaattatagtattaaactaaagtgagctgtttttactttctgttatagataaaatttcttttaggaagtgataggttattggattagttaatactgttggataacaaattatcccaaaactaagtggcttaaaacaataaactttggttatttcttagtttctttgtgagtggcttagctcagcattgttggtgagggatgcagtcatctgaagcttggtaggggctgtaggatctgtttctgaggggcccacttacatgactggcaaatgggtgctggtggttggcaggaggccacagtgcctcaccaggtaggctctccacaggcttcttgagtcttatgacatgatggctgacttcccccaggtgagtggtcttgaagaaggcaagatggaagtggtgatatctttggcaacctagctttggaagttacacaccactacttctgccacttttcgtcattagaagtgagtcattaagtcaagcctacatttaaggaaagggaaattagcctcttttttttttttttttgagacagagtcttgctctgttgcccaggctgaagtgcagtggcacaatcttggcttactgcaacctctgcctcccaggttcaagtgagtagctgggattgcaggcatgtatcaccatgcctggctaattttttgtatttttactagagatggggtttcaccatgttgtccaggctggtctcaaactcctggcctcaggtgatccacccacctgggcctcccaaagtgctgggattacaggtgtgagccactacacctggccaaccttttggaggaagaagtgtcaggaatttgaggacattttaaaaccactgcagttattttccttgaaaactgcttacaatgtggtgacttcatagacaatgtttatcaatacactcctgaggacttcttgcttgaaagttctaggggcataaatactttcaggaaacttctaaacaagaacagattattttcttacattctgatagtcataatttaactgtggattttttttccttggagatagggaccctgttttagatactatattttatttcctgtcttccaagagagatttaaagatttatatgagcaacacctagcagatgcctattaaatagttggtaaataaatgcgtgaattagttattaataaaaatgcacacacacacatacacacacacacacgcacacacacacacatcctcttcttttggaatatactgccaccaggtggtgccagaatcacatgattttacataaactttttgggctgaagttccacttgcttaaacaaggtttattacagtgtgatccacagtcataaacttacttatttaaatagcaaaaacattgaacttaaggaagattaactgggaaattctttttactttttaagttttagaataatttttaatactttttcacttagcttttattaattattttttaaaatccaaacagaagttacaagccttttaggtgttttgttgttatctaattggctgacttggaataggaatataaatactttgactccttagtaggggcaaattctctcctttctgttctagctacaggtagcttcttcaatcttttttgttttttgtttttcaactgagtacagggagtatatcaaattatcctcaaacagagttttttttgcttttattacaatttttaattgatacaataattgtatatatttatggggtacagtgtgatattctgatatgtgtgtgcaatgtataatgatcaaatcaggtaattggcatatccatcacttcaagcatttatcattttttgtgtgtgttcggaacatccaaaagcccctcttctagctatttgaaaatatataataaattgttgtaaattatagtttacctaaggtgctatagaaaactaagacttattcctcctgtcttgctataattttgtaactgctaaccaacctttggctgtctccctctaaccatctcagcctctaataaccactattctactctccacttctatgagatcaatttttttagcttctacatgtgagtgagaacatgcaaggtttgtctttctgtgtctgacattttactcaacataatgaccttgagttccatccatgttgttagagatgacagaatctcattcttttttatggctgaaatagtactccattgcatgtatgtaccacatatttatccatttgtctgctgatggacacttaggttgattccatctcttgggtactgtgaatagtgctgcaataaaaatgggagcgtagattgacatactgatttcatactgtgtatcatacatgcgcatgcacatacacacatgtggaggtaagagagagctagcaaaacgataaagtaaattgggcaaaatgttaacggtgggtggatgtgggaaaagaatgcatatatatattctgtattgtttttatttatttttaatttatttttattttaaattaaaaaaaaagatacatggtctagctgtgtcacctaggctggagtgcagtggcacaaccatagctcactgcagcttcaaactcctgggctgaaatgatcctccttcctcagcctcccaagtagctaggactacaggtgtgcaccaccatgcctggctaattttttaaaatgttttgtagagatgagggcttgctatgttgcccagactggtcttgaactcctgacctcaagtgatcctttctgccctggcctcccaacgtgttgggattacaggtgtgagctactgcgcctggccttctgtttttattaataccattttcctgtaagtttaaaattatttctagataaaaaagtaaaaaaaaaaaaacctgtgatgtttgctgtaagtagatatccttgatcagaaataaagaactttcctccatttcctagctaaaatactaatttggtgttacattttatcaaaaacttttttttctgcattgattgaaatgattgtattatttttcatctttggtctaatagcatggtgagaaacatttaatagatttttctgatgttaaactactattgcatttttgggacaagttcaacttggtcatgatatattatctttttttataaactgttggattcagtttgctaatatttaagatttttcaatatttaggatggatattcagctgtaattttccttttagtagtgtctttgtctgaattagtatttatcttatactagtttggtagaatggattatggaatatctctttttttaatattctgcaatagtttgcctatgatgggaattatttgttccttgaagatttggtagaacttgtctgaaaaattgtctgatcttgatatttttccttctgagaagattttttaaaaattcaattcctttaatgattataggactactcagattttctatttcttcttgattagttacagtgaatgagatttttaggaatttgtccattttctttatgttttcaaatttattataataaagttattcattacaatcttccagctcttaaatctggttttacatgtggtttttgtccccctttccatttctgatattacttactttgttttatttctccctctcttttaaaaaaaatcttgtcagaagtttgagtatgtatgtcatcattttaaagaactctgcattttgttgttctttgttggtcttctctattatttcttcatcttctacctcctttatttctgccattttcttattatctccttttatttaatttttttgtggggttattctttgcttctaacttcttaaattagatatttaatctattaattttcagtttttctttttactctgaccttttaagactgaatttttcttgaagcattctattttgagatatagtatttccattttcattctgttctagaagtatttaaacattcccatcacaattgcttctttgactcatgtatcatttggaattttaaaatatctaaattacttaattaaaaaaatttattttaattacattattaatctaattgcatttttgtcagataactttgcatgatattgattttttgaagttccctgagacatcttttaaggttaaatatgtgatgaactttgataaatgttgcacgtgtgcttgaaaagaatgattattctctaataattgggtgccctattttattttaggttcagggggtatatgtacaggtttgttacattggtatattgcgtgatgctgaggtttggggtacgatttataccatctctcagctactgaacatagtccccaataagtagtttttttagcctttttccctgctcccttcttcctccttctaataatctccagtgttgattgttcccatctttgtgtccatgtatacccaatgtttagctcccacttataagtgagaacatgcagtctttggttttctgttcctgtgttaattcacttaggataatgaccaagagctgcatccatgttgctgcaaaggacatgattttgttctttttatggctgtgtagtagtccatggtatatatttaccacattttctttatctactctaccatggatgggcacttaggttgattccatgtctttgctattgtggatactgtggcagtgaacatacgagtgcatatgtctttttggtagagtgatttattttcctttgggtatatatccagcaatgagattgctggctcaaatggtagctctgttttaagttctttgggagatctccaaactcctttgcacagtgattgaactaatttatatttccacctacagtgtataagcattccattttctctgcaccctttccagcatctattattttttgactttttttttttttttgggacagagtctcattctgttgcccagcccggagggcagtggcacttttggctcactgcaacctctgcctcccaggttcaagtgattctcgtgcctcagcctcctgagtagctgggattacaggtgtgtgctaccatgcccagctaattttattttttagtagagatggggtttcaccatgttggccaggctggtctcaaactcctggcctcaagtgatccgcccacctcagcctcccaaattgctgagattataggcatgagccactgtgcctggccattttgacttcttaataatagccattctggctggtgtgagatggtatctcattgtggttttgatttgcatttctctaatgattagggatgttgagcattttatatttgatggccacatgtatgtcttcttttgagaagtgtctgttcatgtcctttacccacttttaatggggtcattttttgcttgttgatttgtttaagttccttatagaatctggatattagacctttgtcacatgcctagtttgtgaatattttctcctattctgtagggcgtccatttattctgttgatagtttcttttgctgtgcagaagctctttagttaggtaccacttgtcaatttttgtttttgttacaatatttttgaggtcttagccattagttctttgccaaggctgatgtccagaatggattttccttggttttcttctaggatttttatgggttgggtcttagatttaaattgttgatccatcttgagttaatttttgtaaatggtaaaaggtaggggtccagtttaattattctgcatatggctagctggtaatctcagcagcatttattgaataggaagtcctttccccatttttttattttcgttgactttgtcaaagatcagaggttgtaagtgtgtggtttcatttctgggttctctattctgttccattgatcactatgtctgtttttgtaccagtaccatgccgttttggttgctatagtttgaagtcaggtagtgtgatgcctctagctttgttctctttgcttaggattcccttggcttttcagactcttaacttcccatatgaatgttagaatagttttttctaattctgtgaaaaatgacattggtaatttgaatctgtacattgctttgggaaatatgccattttaacggtattgattcttcaaatccatgagtatggaatgttttttcatttgtttgtatcatctatgatttcttgtagcagtgttttgtagttctccttccaaagatcgttcacctccttggttagatgtattcctagatattttattttttttgtgtagctattgtaaatgggattgtattcttgacttggctctcagctggaatgttattggtgtatagaaaagctactgatttttgtgcattgattttgtagccttcaactttactaaagtcatttatcagttctgggagccttttggagcagcagtctttagggttttctaggtatagaatcatattgtcagtgaagagagatgattttgctttttcttttctattttgatgccttttatttctttccctttttgagatggagtctcactctgtcgcctaggctggagtgcagtggcacaatcttggttcactgcaacctcacctcctcaccttctcttgcctcagcctttcaagtagctgggactataggcgtgcactaccactcccagctaatttttatatttttagtagagatggggtttcaccatattggccaagctggtcttgaactcctgacctcaagtgatctgcctgtctaggcctcccaaaattctgggattacaggcatgtgccaccgtgcccagccttatttctttctcttgcctgattgctctggctaggacttcctgtactatgttgaataggagtggtgagactgggcatccttatcttgttctagttctcccaaattttgcctgtttagaatgatgttggctgtgggtttgtcataaatgggtcttagtattttgaggtatgttcatttcgatgcctagtctgttgagggtttttatcatgaaggggtgttggattatgttgacagctttttctgtgtctatggagatgatcatatggtttttactttaaatctgtttatgttgtgaataacatttattgatttacatatgttgaactagccctgcgtctcaggaataaagcttacttaatcatgatgtattaactttttgatgtgttgctggattcagtttgctcatattttcttgcagatttttgcatccatgttcatcagggatattgacctgatgctttctttttttttttctttttttaaaattttattattattatactttaagttttagggtacatgtgcacaacatgcaggtttgttacatatgtatacatgtgccatgttggtgtgctgcaccaactggtcattttgcattaggtatatctcctaatgctgtccctccccccctcccccacaatgctgtcttttacattgtgtctctgccagattttggtgtcaggctgatactggtcttatagaatgagttattgaggagtccctcttcctcagttttttggaacattgtcagtaggaatggtataagtgcttctttgtacatctggtagaattaggccgtgaacatgtctggtcctgggatttttctgcttggtaggctttttgttacttaattcaatttcggacctcattattggtctgttcattagtttaatttctttctggttcaattttgggaggttgcatgtttccaggaatttatgcatttcttctaggttttctagttagtgtacatagaggcgtttgtagtagttctctgagggttttttgtatttctgtggggtcgatggaatatcacctttgtcatttctgattgtttatttggatctttttttttcttattagtctagctagcagtttatcttatatattctttcaaggaacaaactccttgattctttgatctttttaattatttttttttttgcatctcaattttgttcagttcagctctgattttggttatttcttatcttctgctagctttggggttggtttgctcttgcttctctgtttcctctaggttagatgttaggttatttacttgagaacttctgaactttctgatatgggcttttaacagtataaactttcctcttaacactgttgtagctgtgtcccagagattctggtatgttgtatctttattctcattagtttcaaagaatttcttgatttctgccttaatttcattgtttacccaaaagtcactcaggagcaggttgtttatttccatgtaattgtatggttttaagtgattttcttagtattgatttctatttttattgtgttatggtccaagagtgtgattggtatgattgcagtttttttttttaatttgttgactattgttttatggttgattgtgtggtcagtgttagaacatgtaccctgtacagatgaaaataatgtatattctgctgtttttgggtggggagttctgtagatgtctattaggttcatttggtcaagtgttgagttcaggtcttgaatttattagttttctgtcttaatgatctgtcttataatgtcagtggggtgttgaagtctcacactattattatgcagtctcttcataagtctttaagaacttgctttatgaacctgggtgctcctatgtttgctgcatatataggataattaggtctttttgttgaattgaatgctttaccattatgtagtgcccttgtcttttatatatatattatatatatatattttttttattatagtttaagttctagggtacatgtgcacagcgtgcaggtttgttacatatgtatacatgtgccatgttggtgtgctgcacccattaactcgtcatttacattaggtatatctactaatgctatccttccccgctccccccaccccacaacaggccccagtgtgtgatgttccccttcaaaaatgatgagttcatgtcctttgtagggacgtggatgaagctggaaaccatttttgtctttttttatctttagtggtttaaagtcggctttgtctgttataatagcaacccctacttttttctattttctgtttgcttggtagatttttctctatccctttattttgagcttatgggtgtcattgcatgtgaggtgggtctcttgaagatggcacaccattgggtcttgactctttgtccaacttgccactctgtgccttataattggggcatttagcttgtttacattcaacgttaatattgacatgtggatttgatattgtcatcatgttgttagccggttattatgcagacttgtttgtgttgttgctttatagtggcaatggtctatgtacttaagtgtgtttttgtagtggctggtgatggtctttcctttttatatttaacactcccttcaggacctctcgtaaggcaggtctaatggtaacaaattcccttagcatttgtttgtctgaaaaggatcttatttctcctttgcttagtttggctgcatatgaaattcttggttggggctgggtgtggtggctcacgcctgtaatcctagcactttgggaggctgaggcaggtggattgcttgagcccaggagtttgagaccagccggggcaatatgatgaaaccctgtctctacaaaaaatgctaaaattagccgggtgtggtggcatgtgcctgtagtcccagctactcaggaggctgaggtgggaggactgcttgggcccaggaggtcattgctgcagtgagccatgatcatgccactgcactccagcctgggtgacagagtgaaaccctgtcacatatacacacacacaaaaaaacacacacacgaaattcatgattggaatttctttaccttaagaatgttgaatatagtcctccaatctcttccagcttgcagagtttctgctgaaaggttcactgttcgcctgatggagtttcttttgtaggtgacttgccccttccctctagctgcctttaacatttttttccttcattttgactttgatgaatctgatgactgtgtcctggggatgatcattttggatagtatctcacagaagttctctgcatttcttgaatttgaattcaggcccccagctttgttctctgggcccttcaggttaggaaccttctgtgctggaggagcccaggtgttcttggatctctggccacaacactgatgtgtggtgccagccaaattgcgttgttggggtggtggcagtgggatctgtgcttgttcacatgtaccaacagcagctgcgttatggtgggatgcacactccatggcttggatggggtgctggtgggtgcggcgctgccagcctctgtgtgcatattcatactggtggtggtgttggcgcatggggtagtgcggtgctggcaggtacagggctgccagtctccatgtgtgtgttcgtgctggtggcagtgtggggggtggcgtgtgggttgctgtcctccgtatgcgcgtttgcagtggcaatggccacgcagtggtggggttacactctacaccacagctgtggcatagtgggatgcatatgcacatgggtgccagcgatggaggggaggtgaggtctacccacacgtgtgccagcaaaacggtagggcaggtgggggcgtggccgagtgcatgttcctgctggcaaagcagcacagaggaggctgcagtcagtggtggtctggtgtgcctcagtggaggctgctctactggagctcttgatggtcagcattatctgccagtgaaggagctatgatgtaggccccctggaggcacctcagttgggcatccgagggtacactgcaagtgtgctccaccaggttgggaccctgggagaggccagcagacaaggggtgctttgattggactggctccatttcacatgcaagaccaccatgatctgttcagatttgacagttctcctaaggctaaagtctcctaggagagcatggtgagccttgggagatggacaaccctggttgtgctccactgcagacattactgcaccaaaccctctgggttccacactgcattcctacccctaccacctctctaagcacctctcccagccagctcaggtgtccacaccctggggtcgtggggtctcctgctgctaggatttcagaggtctgtggtgagaggggtttgtttttcacctcttcaactcaccccttcctcaggagtccttgagggccagaagtaagtcttggtgtgtgatagcccaatgcagggttcccagtttcttctttcttcagcccagcatctatatcctccctccatccattctcattgccttccctccaaagatctcagaatgtgccagtcttcccaaagtcccagtcacttggtggcatgtgttcctcctggctgcgtctagttggccatcttgccccagggtcttctctctaattttaggcatttattttcttctgctagttttggggttggtttgttcttttttttttttttttttttttctaattccattaggtgcaaagttaaattgttaatttgaaatctttctaacctcttgatgaagaaatttagtgttataaactttcctcttaatactgctttagctgcctcccagagattttgggaagttgtgttcctattttcattaatatcaaataattttttgacttccgccttaatttcttgttcacccaggagttattcaggagcaagttgtgtcctttctatatttgcgtagttttgagagatcttcttgatattcattttaatttttttggcactgtggtctgatagtgtgcttgatgtgatttcgatttttaaaaaaatttattgacacttactttatgaccaaacatgtggttgctcttagagtatgtttcttgtacagttgagaagaatgtatattctgtggttggtgtgtggatcgttctatagatatctgttaggtttaattggtcaagtgtcaagtttaagtccagagtttctttgttatttttctgccttgatgatctttctgtcactgtcagtggggtgttgaagcccccccccatttttgtgtggttgtctaagtctttttatcagtcaagaagaacttgttttatgaatctgggtgctccaatgtttgatgggtatatatttaggatagttaaatcttcctgttggattgtacacttttttgttgttgttgttaagatggagtctcagtctgtcaccaggctggagtgcagtggcacgatctctgctcactccaaactccgactccttggttcaagtgattcttctgcctcagcctcccgagtagctgggattacaggcacgtgccaccacaacccaactaatttttgtatttttagtagagatggggtttcaccatgtcggccaggatggtctcaatctcctgacctcatgatctccctgctttggcctcccaaagtgctgggattacaggcgtgagccaccacgcctggctggattgtaccctttatcactgtgtaatacccttctacgtctttcttagtcgttatggtttaaagtctgttttatctggtataagaatagtgacttctgcttgttttccatttgcctgctagctctttcttcatccctttttactttgagcctgtgggattacatgtgagatgggtctcttgaagacagcagatggttgagtcttgtctttttttttctagcttaccattctgtgtcttttaagtggggtgtttagaacacttaacattgaagtttagtaatgacatatgagactttgatcctgtcattgtgttgttggctggttgttatgtagacttgattgcgtagttactttatagtgtctgtgggctatgtacttaagtgtgtttttgtggtagcaggtgtcgttcttaccattccatgtttagcatttcctgaaggacctcttataaggctgttctagttgaaacaaattccctcagtgttttcttgtctgagaagacgagataaatttatttatttttcacttatgaagcttagtttgtgggatatgaaattatttgttggtatttcttttctacactgaaaataggtccccactctcttctggcttgcagtttctgctgagatgtctggtgctagcctgatggggttccttctgtccatgcattaccattctctcttgcttccttcaagacttttttcttttgcattgacctcgttgaatgtctgtgtgcctttgggatggccattatgttgtctggatttcttgtacctggatatctacatctctagcaatattagggaaattttcttgaattattccatcaagtatgttttccaggttgtcaactttttctcctctctcaggaatgccagtaattcataggtttggttgctttacgtaatcccacacttctcaaagactttgttcattttataaaattctttattctttctttctttttttttctttttcctttgagatggagttttgctcttgttgccccagctggagtgcaatggcgcaaactcgactcactgcaaccttcacctcccgggttcaagcaattctcctgcctcagcctcccaagtagctgggattacaggcatgcgccaccacacccagctaattttatattattttagtagagatgggttttcaccatgttggtcaggctgatctcaaactcctgatctcaggtgatcctcccacctcagcctcccaaagcactgggattacaggcgtgagccactgcacctggcctaaaattgttttttcttgacttttgtctatatgtgttagtttgaaatatcagttgtaattatttttttctgcttggtctagtctgttgataaaattttcaacagcttggcaatcataaagtgaagttttcagttccagaagctctaattgattcctttttaagatgtttatctcctttttcatttcctggattgttttattagattctttgtgttgattttcagtcttttcttttatatctttgagtttcttccaatccatgctttgaattatttatctgacatttctgagtttccattttggttggggacctttcctagagagctactgtgattctttggtggtgttacaaaaattggatttttctggtgccagcattcttatgttgcttccttctcatttgtaggtgttggcacttctaaatttttgttttttgagacaggttctcactcttttgcacaggctgaagtacagtgaatcatgtcccactgtagcctcgacctcccaggctgaagcaatcctcccacctcagccttccaagtagctgggactataggcgtgtgccatcatgcctggctaattttttaattatttgtatagacagtgtcccaccgtcgtcttgaactcctgggctcaagcaatcctcctgctttggcctccagggttggagtgctgggatggattacagacatgagtcaccgtgcctggctggcacttcaaatttttgtagatattttcatgcaggtagggttttctttccctttcttttcttgtattattattgttttttccccctttccttcccccactcactaaagggtgtgacttaagagtatgtcgagtagggtcttttgtctttgtttccatggccttctgttctggcagcaggttgtatattgggctgtggagttcaacctacgggccagtagatgatgcttacgggtgagagtcagctgtggtggaagcagacagttatgtacttggtatttgtttactgtgaagaactctctgttgttccaggtgataggctagactgtggagggctgcataccatgtacttcctattttacgggagtgctggggacatagctgggtagagtggataacctggcttgtccacaaatacccctatgtcaaatgtagaagtgtagtccccaaccctgatgagggtggctaggaaaagctcccagtgaattgtgccacagtctctgtgggggtttggggtgctacacaagccccttctagatagactggaatgtagattgttgcccagtcacacccttgttctagagctcttgactcctggatcagacacacactgcagcctatctccagaccaccatgtggttgagagccttaggaaatgtctaatttttgactctccaggggagtggtttttggggcagaacttcatcacttagcttaatataggtagctgtgtggctcctctgctctccaatgtgatgactcttcttcatttaagagcggggttgggggactccttctttgggcctctgcaggggtgtgttggttttggtggtgttggctggttgcgtcggttcaacctcaggcaatgggagatgtggtaaagtactagcaaaattggaatagggtagggagatctgtaagtccctagttagtccctagatggctggctggacttcctctatgagtcttgatggggctggattgttggggagcctcaggtcctggctgtgatgggaaggggtgagggctgatatctgggtgaggggctaaactctcaggcagggcacttaggcggtgggagccctagggaagatcacaggtctatgggggtaaggttttcgacagggctttgggccatgactgaaatgctcatgtaggggtcggctatgtgcagtagaagccagaaggcagcagtcctggttggggagtgggcagtggaggaagggggtcatgtggaaagcattctggccacctctctgaagggtagctgctggcactggagtttctctccccagcctgggggcagcaggggtggccacggcagaggacctgttcagttgcctttgggagtgatggtgatggggggtgtacctgggaagagggaatggggagcaggttgggtactcctctctgctgatggaggtgcttgaaagcacctttgttccctccctagcctagaagtagcaaggatgggtactgcagcagctgcagtggcagagggcctgtcagttgcctttggaagctccaccctagagaaacagagctgctactcactgaagtgattatgtgggggtaggggtgcctgtgctggcggcccaagtcaggaggccctgccctgtaaggagcagcaggggctgggcctctgagagcaaagagtctggccacctttcctgaaggcagctgcatcctgctggaggtctacttactctcaaggcagctgcatcctgctggaggtctacttactctcaggctcttcactccctccccagcctgagagcagcaggagcaaggacctgacagaggcagttgcagtgggcctgtcagttacctccgggagctctgacccagtgaaatacagagccagagccgtgaccgactgaccagagtgctcagttggtggtggagtgggcgtgctgggggcccaggccagtggccttgcctggcaaggaacagcagaggcagggcctgcagtctgactgctcctaaactccatggatatggcttctatcctagagctacgcgaaaaaacctggcctcccttggtgggactataacagctggcaccagggaactcggggatccaaggttggtggggatccccgactccatgtggggttgagcttccaagaagtcttccttacatggcttatatggctgggaagttggtcctggctgttggcagttctttgcgatgtgaacctttccataggactgcttgagtgtcttcatgacacaacagctgactttctgcagagtatgtgatccaagagtacagggtagaaatgacaatttctttttaagacaaagccttggaagttacataccatcatttctgcagtattctattagtcacagacaaacctgatacaatgtgggaggagactacagaaaggcatggataacaaaggtgagcatcattgagtcttagaggccgcctaccactgatatatgcatgtgtgtaaacatatgtacgcatgcatgtgtgtatgtgtataattaaaaaaaaaactttatgaccattctgttctcagaaatgttgtagtaggcagaatttcttaaatggcctctcaaagatgttctgccctaatccctggaacctttgaatatgatgagatgtcactcccatgattattatatgttatatggtatagttgactttaagatggggagattatttggatctaatcatatgagcccttagaagtagtgagctttctctggctgttaaaaaggggaaggaagaaaagcttaaaacccaagaaggactcaggatgccattgctgccttgaaggtggaggggccatgattaaaggaatgtaggcagcctctagaagcagtgagtggccctgagataagagcaagaaaggaacctcagacctagagctgcagagaaatagatttttgccaacagcttgaatgaacttggaagttgattcttactcccaacctccagataagagtccagctcagctgagatcttgatttcaaccttgtaagaccttaagcagagaacctagccaaccctatctggacttctgacctgattgtctctgatttatcctctgctgcttctgctttaggaatgaatagcacttctctacttccacttttcatcttggtgttgtaactgaatatataagtatacccagattcagtgacattcacataagtcaaaactgacttgcagtgacataataaatggatgctgttcaagctgccaagtttgtggtaatttgttatgaagcagtagagaactaataaaatacaggtgtcagtgaaggtgcctaattaactgcattgcacagtctttgtttctggttaaaaggtcaagcctagtgtcctagatagatgtcagatagatctggtgggtgggtggggtaaggcaactgattgaatgaacttagagtggatctggagattgagagagtaagaatcaatctggaaatattttgctgtcatttttatagtttctctttcctgactttaacttaaaaatttcctaggttatttatcatcagttttgacttacgtgaatgtcactgaatctgtgtatgcttacatattcagttacaacaccaacatgaaaagtggaagtagagaagtgctattcattcttaaagcagaagcagcagaggagaaatcagagacaccaactctgcggacctgctgaaggaagtgaactacagggcattgttccattccctgagaacagcaaacaccttaaagtttgtattatgtggagatcaaatcagttcggtagccttctcatatgagataatatagatcagtgttcctcattcattttttcattattgtctcctaagaagcctttttaacaattttttcttaaccacaccctccaatgaagtttttctaccacacatatactgtatatctgtttttgtactgtataaatatctgtgctttatacataaaagagtaaaatcttccccttcctccaaaacaacttttacccttggggttaatattacccatgctgagaatgcataagatagatgctattgtgaataggtaaaattaaagttatatttaaagatacaggtgaggtgcagtggctcacgcctgtaatcccagcactttgggaggccgagatgggcagatcacttgaggccaggagtttgagaccagcctgcccaacatggtaaaaccccatctttaccaaaaatacaaaaattagctgggtgtggtggcatgcgcctgttgtgccagctacttgggaggctgaggcatgagaatcatttgaatccaggaggcagaagttgcagtgagctgagattgcactactgcactccagcctgggcaacagagtaaggctccgtctcaaaaaaaaaaaaaagtattcagagatatcatcaaaaaaggtattttcagctaggtgtggtggctcatgcctgtaatcccagcactttgggaggctgaagcagaaggatcgcttgaggccaggagtttgagaccagcctgagtaacatagcaagaccctagctctacaaaaagtaaaaaaaaaaaaaattaggtgtggtggtgcatgcctatagtcccagctacttaggagactgaggcaggaggatcacttgagccaggagttcaaacctgcagtgggctatgcttgtgccactgcacttcagcctggggtgagatcctgtatcttaaaaaactattattttcatactgtaatataatctagagtacaggaccagagaactcagttcaacacagagagatgtaatatctgcatagttattatgcctggcaaagtttttgtatttttagtagagatggggtttcaccatgttagccaggatggtctcgatctcctgacctcatgatccacctgccttggcctcccaaagtgctgggattacaggcatgaaccaccgcgcctggccagcatcttagttttttcttggaacaattactattatagttcttttttttttgagacagagtcttgctctgttgcacaggctggagtgcagtggtgcgatctcggctcaatgtaagctccgcctcccgggttcatgccattctcctgcctcagcctccccagcagctgggattacaggtgcccgccaccacgcttggctaatttttttttttttgtatttttagtagagacggggtttcactgtgttagtagccaggatggtctggatctcctgacctcgtgattcgcccaccttggcctcccaaagtgctgggattataggcttgagccaccgcacccggcctattatagttctttttataattggcaggattagctgtggcctacatgatcacaggaaataataaggcaggggttgtaaactcaaatgcctataagcacgagccatgtaacagaagtacatgaaacagttaagtgtaagacatagatatttattagttgattttagctgctgacaacagcagcaaacatttatttttttgctcatgggtctccatgtctgcaaaggtggatcctgtcttcttcaggctgcagtgaggttcagatgtgccccacaagttgtaacagcagcaggaaaaccagagagagatttcaaatggatgttccttgagtacagtctgctgacattcatttatcctgccctatgttttgaaaggcagataactaggcctctgttctaatacagacatttagcatatgcggttgattggaccattgttcccaattcttcacttactctctaatttagaaataaacattctgctctgtaatggtttactagagtcttttatgtggcacatgttcaataactgctgttaaatgaatgattatatcccttaatactgtttgatttttgttaatggtggaacttggggtacttgtcatttccattccctcctgctttttctgctcttttcccatccctactcttcctctctcccttcccatttacttccaaaacggcagctgtcaatatgaaaaaggagggagtggtagagagaatccaagacataaactcttccacatgttggtgtaaagtaatttaagatcaaggtttctttcacaaggcaaaatgcaatgcaacctggcctttctgagattctttttttttttccttttttatggttttggctttaggatttagaatgttagttattttaaaaatgaattttgtaggtctgaagacctactcatatttctacataattgttgagcaaacggagacaagtagttagatgctggaggtcattaaaaaatattttttaatgaagcttttttaaaacatgctcactggtttcagatcagagccaggcatccttaaattgtcttctgccaggtattggcttggcagattaccctgtccagttgccctcatcttgaatgtgaggagagttaacttgataagattttaggtcctaactggaccagattttacattcctctcagccatgaaaagtttaagatgagcaggcttcatttttactttagtacaattagaccttttcttgggaacaattctctttcctcttcaaaccaattattaacattttcttccttgctgatatttgagtgatattcactactgactttttttttttttagttcttttacatttctcaagcaggttgttgaaactttggctctaactatatgaagtgaattgtttttttactggtgttttcgctgtgtaaatattgtattcagtctgagtttacaagaagcaaataacttagcctattctggtttggcatgttttctctttctaaccaccattggggctgaagctgggaactgaacacaacttgaaattttgtggtttgggtgctagaattcagagctagactatctgaagctaaaaattattaatgttgaaatgttttcacccactaaataaacctgaaaaaaaatgaaatgtaactccaggcagcccataaaatcgcatatggtataatttttttgagtctaggaagagatgaaaaaaatttgtgagcaggatctgagattgttaaaaaaaattagaaattgtttattatggtttaaagtaaatgctactatccaaactctaatccaaactcaacaaacaaacccagaaatctcttactgttattcacatgatgttttattttctccaagactatactgaatcagtacataaaaataatgaagtagggaaaatgccagttgcccttgtttaacttttcagctattttttacatgttttctttaaagatagaatagtaaagtaatactttacattttcaaggtacttgatacttcactgaatatttccaaatatatcatcttaattaaaataatggcttgtttcacccttttaaaaatcacaaagcattgaacagttttcagctcattaaatctgagaacatatccaaaacttggcacatggatagtatgtatagaaaggctagtcctttttcctctgctagttagcactctaatgatattaatgatggaagatttttctcagcccctttgctggacttatgacaggggtatcccatttactcggcccaccatgctcaacctcttgcgggagggagcacgtgagtgagtgagtgcgggatctggctggctgttccaggcacttgcaggagcaagcttcatgtgctggtatgagtgagcaagtgcgggatctggccagcacagctcggagtgccagcaggagcaagctctgtgtgggatccgcggccagaccaggcatgagctagcgagtgtgggatccggccagccactctgggagctgccaggagcaaactccatgaagggcccgtggaggcacccaggtaagggtgcctgtgaccccgaatccccagagtgggtgttacagtactctcttagttctgccctctgcggacggtggtgtgttagcagctcagttggccccttacctcgttatgtggggcagttgccctctgctggtgagggcaaagggccagcgtgacagccttctgggtacccgcacttggtgggtccctgtctggcatccaagaagaatgaggtcagttggacaattgacggatggtgaaggcagataattttattgagcgatgaaaatgactctccgtggagaggatagctagagaggggacaggaagggcaggtcatcttccctaaagttgggtcatctcttccccgaagtccagctgtcttacccaaagtctggccatctcccttaaattccggctgtctccggtattgattgagtttgggttctttataggtacagaatggggagtgcatgctgattggtttgcaattatgcaaaaaattttaaagcaaagacaccactcaaaggtgggcgagacagtgtggaaaacgaattaggaaagggtaggtatacgtaaaataggtgaagggtgaggatcagtccagaggaaagcgtgccaaacaggaagacaagttctcactctggtccagggatttaacatatagcttggctttcaggctttgaactgtatccggcttggaggtggggtttcaccggatacctggccctaccctatctgcctaggcatttcactgcctcctgtcgctatcattagtaagcataagcatttctttatttcaagatccactttcaacttttactgacagaagtttcccttgccctgatatctggtgactaatttgatccatgttgtttttgaaaatgaagaaagttccataaaaatgtttagagctctgaatttagactagcattctccaaagcagggtatgtaaaatgtttcattaggttgtgggaagaaaatattaaaacttttattgtttcaatctaacaaatgaaatttaccttaattaacatttaatcaatggatcaacactgacatcctcacttggtctgggtgtcagactgttgggtatcagttatagtgcatgaggaaagcatgcaggggttgacagaggccccttgcttgttattttcaacatactgggatgaattataagtctgcatatatctagttaggtggatttatggatttaacaaaatcaaagttcacaaaacagataaatggcaagaaagattcctgcaaagaaactaaattgtgtgcaatactaataatgagagtggaagtgagccacacacatgtataggtcagagcggatgcttctcctatgagacattaatgttgaagtaaaaatcaacaacaatctaatctcagctgagaagatgtccagaaaaagtgaaattataagcaagacaatttgatagatggaattgtatccactattgttaacaaagaaacactttctgatattttattcccttgaaatactggctaacaatagtaggaagccatcataattaatgaacatgtgggacaggaagttaaactgacaaaagtttttccatgacatttaaagttatgtgacacataactcagtatctagaaaaatgtcattaaaataaataatagatatttaaaagcatcttttgtgttttcttaacagcaaaagaccaaatacagtacattattagtaacattagggacacacttgttcataaaatggatgaaataaaacataggaaacaatatggcaacaagttaaatgaatttttttttttgagcgaagttttgctcttgttgcccaggctggagtgcaatgacgcgatctcggctcactgcaacctccacctcccaggttcgtgcgattctcctgtctcagcctcccgaggagctgggattacaggcatgcaccaccacgcctggctaattttttgtatttttagtagagacgaggtttctccatgttggtcagactggtctcgaacttccgacctcaggtgatctgcccacctcggcctcccaaagtgctgggattacaagcatgagtcaccgcacccggccttaaatgaactctttcatgaacaaatactttgagaagttgcatagaaatctttgaagatgatttgaatcattgagaacttaaattatttaatgtgagaggatgctatatatttgaagtacagatgtttctaacaaggctcagattatcatagtagctatattttgtttcaataatgaaatacatgaagaactaatttcattttgtgccattaaaataaagatgtatcagggaagatatattcttgaaaataagtgactttatgaatacaaaacaatgtatatgagagaatttcctgggataacgatagtgttttgactttgtaagagtttaggttgcatacatgtatgcacttgttcaagtttatgaaatggtagacttataatttgcacatttcattgcatgtagaatttactgcaaaaggaaaaaaaggaataatacatgttaaattctagttaatgctatgcatgctggactgttgggggaaactatattaatgtgtttaacttactttgaaatgcattaaaaaaaccctaagatggattggtgaatggattaatcatacagaaagcatacagtatagtcatagtatagtataacaaatacagtaaaaattttaaatgcagagtctaagtggtgggtatatggatggtccctgtaaaagtctttcaacttttctgttgcatcatccttaggtaatctatagcaacacataggttgatgtcagatatgcaaagagagtatttcagtatggtattaatgttgttaatttttcttaaaatctgactgttaggctgggcatgttggctcatgcctgtaatcctagtactttgggaggccaaggtgagaggattactttagctcaggagttcaagaccatcctgggcaacatagtgagaccttgccactacaaaaaataaaaaattacctgggtatggtgatgtgtgcctgtagttccagccgcttgagtggtggaggtgggaggattgcttgagccctgaaggcagaggctgcagtgagccgtgatcatggcactgcactccagcctgggtgacagagcgagaccctgtcacaaaccaaaacaaaaaaacaaaaaatcctaactgttgtatagaatccctagtgtactctataatgagatgagaagtgaccatgagaatcatttgaatcacaagagcatctctgattatcttacagcaaagactgtaaaagaatcattgaacttaaaagatgggttagctgggcatggtggctcatgcctgtaatctcagcactttgagaggctgaggtgggtggatggcttgagtcctggagttcaagaccagcctgggcaacatggtgaaacccagtctctatgaaaaaaaaagctgggcatgtgtgaatttgaggccacttgcagtaagttatgttcatgccactgcactccagcctgggcaacagagtgagaacctgtctttaaaaaaaaaaaaaaaaagatgggtgaagcatgtttttttaaatgaaaagacaagagatgtcaaatttgctgacccttttttgtatgacaagtgactatgtaatctgcattgcagattaaacaccaagcaaccaaccaatcaatgcaacactgttacttcatttcttcaaggtaaaggtaatgttttaacaaggagtgaaaatgtaactgccttttctaaaggctgggataaaaacacagaatgtttttaaaatcactgtttggaatatttcttttatcatgtgatttttgttgtcaaagatatgtgtgtcttatgaaaatttatctgcactcttaaaaaatacttggaaaaatattttgtatactcttcaaaaatgttacaaatagagtttcagtcagtgggggggaagggggaataggggaaggagagatgttggtaaaagggtctcaagtttgttagacagtaggaataaattttggtgatttattttacagcatggtaactatagttagtaataatgttgtatatttcaaattgctagaagagtagattttaaatgttcccaccaaaaaaaagataagtatatgaagtgatagatatgttaattagcttgatttaaccattctacagtgtactataaacatatttcaaaatatcatcatattgaactccataaatatatattattatttatcaattaaaaatattaaaacaagcaaaacccatgatacatatctggtggcaaatgagtatcgtggtagaaattcatcaaactgctcagatgtgatttgtgtacttttctggctgatggtcatacttcagtaaaactaaataaatgtaagcaaaaaaaaaaaaaagtttcagtgggtttttaaaccagttgttaaaaatgttaaaatgtgacatgttttgattcgtctgccagaacaatcaattgacgtgaaggaagatcaataaaaacttttgcataattgatggaaggtattgaaaaatgcaagtagtaatttagttaagtccaacaaatgatgtatttctttaatttcaatccttgcatctttgtaattatccccttctcagcttacaattaagtactgaaataagtggaacttaggacctgacatttcaatcaccgaatcacaaaatatttacattattattttttaaagatacaatttggcttattattttcattattatcattgctctacttaaaatggtaagcttttatgagagcaaacagatcttttatataagtaataaatattataaaatgatttttaatgtttataatttttaattcatactttgtgtgtgttttatactctataggacatattagtaaaatagtatgttcataataaatatgcatatattggagggctgtactaaattttgttttgattgctttttttggctggtttgttggggtatgtggtcaaataagtttggagaactctctttactgatctctcataatctggcaagctattattgacaggagtaattatttattcttaaagtctaaatgatcattgtaaagattataaaccagcatatagttttaaatatgggaattttttttttttttttttttttttgagacatggtcttgctttgttgctctggctggtctagaactcctgggctcaagtgattctcttgcctcagcctctgggattacaggcgtgtgctaaacatttgtgttttaaggttgaactttgataaatgaagtttacctttagaccaaattctgaaacagtggttctcaaagtatataataacatcagcattacctgggaacttactagcgatgtaaattctcaggccatgacccagacctactgaaccagaaatgctggttaacaagctttccaggtgattctgatgctcactcaaatctgagaaccacatatctagatgatttagactcatgaatcactcctacttatttcttcctacttcataatgtatctgagacagtttctttattgtatgtcttagttttagcccagacttttttccctctcttagatttttttttcttttcccttcctctcctctccccttcctctcaatgttaaaaaaaaagttctttagtgttattttcacaaagaaatagtgcattggttctaaaaatttgggcgccacaactaatgtgacaaatagcatgtgtttaaaggagatatttctaaacattttcaaattaattttgttaactactgtattagttcattctcacattgctataaagaactacctgagactgggtaatttatgaagaagagaggtgtaatcgactcacagttctgcaggcttaacaggaggcatggttgggaggcctcaggaaacttacaggggaagcaagcacatcttattatggcagaacaggagagagagagagacagacagagacatcttactatggcggaacaggagagagagagacatcttactatggcagaacaggagagagagagagagagaaagagaaagtgccacacacatttaaaccatcagatcttgtgagaactcactatcatgagaacagcaagagggaaactgccaccatgatctaatcacctcccaccaggccccctcctccagtactggggattacaattcaacctgagatttggatggggacacagagccaaactacttctagttacacttgaatatggatataattaatttcctattatttcctgtctatactcttttgatttcaacttttataatctcaaaatagttttctgccaatgaagatttcaaaacagacatttcaaagtaggaatcacctaaactcaacagttgtttataaagcaataaatttgctttatttctctttctacacacatatatgcacacacatacacatttttatttgctgaactgtttgaaaataaattgtgtacatcagtacccttcacccctaaatactcttaaaaatatggattaaagtagcccttaatgggactagtgcaacattgttttgaaatgctaatttttaacaaatgctcaaccatttattaaagactcttaaatattttaaggtcctattataaatatcttcatgaggaaaaggtatagaatgccaagttatgatggtataaatgagtgaatgtttcagcctttctcaactagaagtttctcatctgaactacaaaatacagtggatgatttgagtgactattttctcaattcctccaaggatggtacataactagtgccaattcagatgcagaggggagaagttaattcattccatacaatggatgtcttgggcttaattctctcctgggaacccaggttagttggactgcatatatggcaaagtcttaaaaggattttgctttgactggcttgtgatgtttatctaaaaaactttttttttttttttttttttttttttttttttttttttagattacaggtccaccaggttgtggaaaaactcagttttgtataatgatgagcattttggctacattacccaccaacatgggaggattagaaggagctgtggtgtacattgacacagagtctgcatttagtgctgaaaggtatgagattttattttctattataatgttttacttttgtaacttatatacagcatgaaacatttacacataggttaacatttaccacccctcccccttgccttttttttttttttgagatggagtcttgctctgttgccgggctggagtgcagtggcacgatctgggctcatggcaatctccacctcttgggttcaagcgattctcctgcctcagcctcccgagtagctgagactacaggtatgcaccaccacacctggctaattattctatttttagtagagacagggtttcaccatgttggccaagctggtattgaacttctggcctcaagtgatctgcccaccttggcctcccaaagtgctgggattataggcgtgagccactgtgcctggctttttttttttttttttttttgagatggagtctctctctgtcgcccaggttggagttcagtggcaggatctcagctcactgcaacctccgcctcccgggttcaagcgattctcctgtctcagcctcctgagtagctgggattacaggcgccctaccaccaggcctagctaatttttgtatttttagtagagacagtgtttcaccttattggccagactgctcttgaactcctgaccttgtgatccgcctgccttggcctcccaaagtgccgggattacaggtgtgagccactgcgcctggcctaaattggtctttttataaatgtatcccagtagtaaatgaataaggaatgatagaatatcaccaaattacaaactctgacaatctaatggatctaggcatttaacatcacaaaaagatgacgagtcactggggtactttctgatggaagaacaatcaaatttgaatgtgatcaaggcttcagatccagccaccaatttacaacctagctagagaagagaggaacacatcaaactgctctagaaaatgcaattagcagaatccaaactgtgggaaataacagaacaaacaacttggtttctgtaacaaataaattgtaagattaaaaaatagttggaaggggaacctttggattaaaacagatttaaaagccttattgatcaattgctgtgtgattaacttatttggatcttgacttaaataaatggttaaaaaaaagaacagaagaataaacattgagactactggaaatttgaacatgaaaatatatttgagattaaagctggtaaagactggttcactcaaattgtccaagtactctttaaaatgccaatgactagccttcgactaacaagccaagtaggtattaaatagccagttatgtcataaatagctaatgttcaaatagctcttacaaaggtcctggggaatttgggtaaagaattcaaagattaagattatttttataacagcagttcagttcactgtaatggatttctgctttctttgcaccacatacaaaacagagtttaggatgtcttcttaaggaggaaactgttgcatgttattttattaccagtattacagttcagagcagtgtaaaaaccttatcaatgaattgggtgatatcagcatacatacagaagactagcaggtgacttgtctgcattttccaaatgaatttgtggagagtcttatgttttttgtctttgcatagagccttaattatttactttttgaatcccccatatttacttatttctccttcatatctttttctgccaatgtgcatgttggtatttacatcagaggcaggttggaaaatgaagaggtaatattttagctcctttgttggaattacgttgcatagttcacaaggagctcttatgaaggtcatttgagaataggggttgaactttatattgtatttggttttttattccattctccacaaggcttaaaatgagtgatcatctggctcacacatggaatggattttgaggtctggtgatagggccaagtagaataaaaaatatgaatgctctccgatatatatgccagatttggcattcttatactaccttctagtttgtcatggtgggtcatagaatggaactggccctgtagtgtctgatcacatttcattcattctgttacaggacagcttaacccctatttggaattatcaggaaaggttggccaatcggttaggaaagcttactgctgcagataactgagtatccaaagaacagtagcttaaacaaaaagaggtttatttctctcatataacaagacctgagtaggtggttgctggcactgggtcactcaggtctcagtgatgacagagagacctagggcatgcacattttcagacatcggattcattctgtgctcaagtcagtgtgaagaaaaagggccagctatatcttttatcaggaaagtgtacttttattcataatatctgcctcctcccatctgtggatttcctttttgttgcctgtagtcctcttgtagatttctcactgagtcacctctatatgtaaaaagaggctgggaaagtgaggggagaagatcgtcgtaacaatcatgatgagttgtctggttaatattgctgcctgaataaaactggggctctcatagcgaggaagaagtggaaatggatattggattggtaattaacagtttctgtcccagccccagctgtttctggacttagagaagaggtaaggcagggaaatatgagacgcaaaaaggactatgttgtagctctgtatgtgttcacattgtctccactttgtgcttgcaaagctagccggctaaccagcacaaatgagaaagtgtttaaaggattaatatgatgaaggattaaaggattcacatatatagaatttagggtacgtgagaaaaagttgaaaataatttcttcctataaatatctagatatctttttactaagaaggagagagaaatcaaaggaggaataaatacaaactacttaggtttaaaatgtattaaagagggaggagccaagatggccgaataggaacagctctggtctacagctcccagcatgagcgacgcagaagatgggtgatttctgcatttccatctgaggtaccgggttcatctcactagggagtgccaaacagtgggcgcaggtcagtgggtgcccgcaccacatgcaagccgaagcagggcgaggcattgcctcactcgggaagcgcaaggggtcagggagttccctttccgagtcaaagaaaggggtgacagacggcacctggaaaatcgggtcactcccacccgaatactgtgcttttccgacgggcttaaaaaacagagcatcaggagattatatcccgcacctggctcagagggtcctacgcccatggagtctcactgattgctagcacagcagtctgagatcaaactgcaaggcggcagcgaggctcagggaggggcacccgccattgcccaggcttgcttaggtaaacaaagcagccaggaagctcgaactgggtggagcccaccacagctcaaggaggcctgcctgcctctgtaggctccacctctgggggcagggcacagacaaacaaaaagacagcagtaacctctgcagacataaatgtccctgtctgacagctttgaagagagcagtggttctcccagcacgcagctggagatctgagaacgggcagactgcctcctcaagtgggtccctgacccctgacccccgagcagcctaactgggaggcatccctcagcaggggcagactgacacctcacacggccgggtactccagcagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctgaaaagcagagcgactttcctcctccaaaggaacgcagttcctcaccagcaacggaacaaagctggatggagaatgactttgacgagctgagagaagaaggcttcagatgatcaaattactccgagctacgggaggacattcaaaccaaaggcaaagaagttgaaaactttgaaaaaaatttagaagaatgtataactagaataaccaagacagggaagtgcttaaaggagctgatggagctgaaaaccaaggctcgagaactatgtgaagaatgcagaagcctcaggagccgatgcaatcaactggaagaaagggtatcagcgatggaagatgaaaggaatgaaatgaagcaagaagggaagtttagagaaaaaagaataaaaagaaatgagcaaagcctccaagaaatatgggactatgtgaaaagaccaaatctacgtctgattggtgtacctgaaagtgacggggagaatggaaccaagttggaaaacactctgcaggatattatccaggagaacttccccaatctagcaaggcaagccaacattcagattcaggaaatacagagaacgccacaaagatactcctcaagaagagcaactccaagacacataattgtcagattcaccaaagttgaaatgaaggaaaaaatgttaagcgcagccagagagaaaggtcgggttaccctcaaagggaagcccatcagactaacagcagatctcttggcagaaactctacaagccagaagagagtgggggccaacattcaacattcttaaagaaaagaattttcaacccagaatttcatatccagccaaacaagcttcataagtgaaggagaaataaaatactttacagacaagcaaatgctgagagattttgtcaccaccaggtctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggttggaggaagatctaccaagcaaatggaaaacaaaaaaaggcaggggttgcaatccgaatctctgataaaacagactttaaaccaacaaagatcaaaagagacaaagaaggccgttacataatggtaaagggatcaattcaacaagaagagctaactatcctaaatatatatgcacccaatacaggagcacccagattcataatgcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgagtgactactgggtacataacgaaatgaaggcagaaataaagatgttctttgaaaccaacgagaacaaagacacaacataccagaatctctgggacgcatttaaagcagtgtgtagagggaaatttatagcactaaatgcccacaagagaaagcaggaaagatccaaaattgacagcctaacatcacaattaaaggaactagaaaagcaagagcaaacacattcaaaagctagcagaaggcaggaaataactaaaatcagagcagaactgaaggaaatagagacacaaaaaacccttcaaaaaattgatgaatccaggagctggttttttgaaaggatcagcaaaattgatagaccgctagcaagactaataaagaaaaaaagagagaagaatcaaatagatgcaataaaaaatgataaaggggatatcatcaccgatcccacagaaatacaaactaccatcagagaatactacaaacacctctatgcaaataaactagaaaatctagaagaaatggataaacttctggacacatacactctcccaagactaaaccaggaagaagctgaatctctgaatagaccaataacagggtctgaaattgtggcagtaatcaatagcttaccaaccaaaaagagtccaggactaaatggattcacagccgaattctaccagaggtacaaggaggaactggtaccattccttctgaaactattccaatcaatagaaaaagagggaatcctccctaactgattttatgaggccagcatcatcctgataccaaagccgggcagagacacaaccaaaaaagagaattttagaccaatatccttgatgaacattgatgcaaaaatcctcaataaaatactggcaaaccgaatccagcaacacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaagaggcctttgacaaaattcaacagcccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccacttctatttaacatagtgttggaagttctggtcagggcaattaggcaggagaaggaaataaagggtattcaattaggaaaagaggaagtcaaattgtccctgtttgcagacgacatgattgtatatctagaaaaccccattgtctcagccgaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcacgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctgagccaaaagaacaaggctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatatagaaagctgaaactggatgccttccttacaccttatacaaaaatcaattcaagatggattaaagacttaaatgtaagacctaaaaccataaaaaccctagaagaaaacctaggcattaccattcaggacataggcatgggcaaggacttcatgtctaaaacacttaaagcaatggcaacaaaagccaaaattgacaaatgggatctaattaaactaaagagcttctgcacagcaaaagaaactaccatcagagtgaacaggcaacctaaaaaatgggagaaaattttcgcaacctactcgtctgacaaagggctaatatccagaatctacaatgaactcaaacaatttacaagaaaaaaacaaacaaccccatcaaaaagtgggcgaaggacatgaacagacacttctcaaaagaagacatttatgcagccaaaaacacatgaaaaaatgctcaccatcactggccatcagagaaatgcaactcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatccaattactgggtatatacccaagggactataaatcatgctgctataaagacacatgcacacgtatgtttattgtggcattattcacaatagcaaagacttggaaccaacccaaatgtccaacaatgatagactggattaagaaagcgtggcacatatacaccatggaatactatgcagccataaaaaatgatgagttcatgtcctttgtagggacatggatgaaattggaaatcatcattctcagtaaactatcacaagaacaaaaaaccagacactgcatattctcactcataggtgggaattgaacaatgagaacacatggacacaggaaggggaacatcacactctggggactgttgtggggtagggggaggggggagggatagcattgggagatatacctaatgctagatgacgagttagtgggtgcagcgcagcagcatggcacatgtatacatatgtaactaacctgcacattgtgcacatataccctaaaacttaaagtataataataataaattaattaattaaaaaaatgtattaaagaaaacaagaagaaaacccaggagatgatatacttaaaagcactttggaaaggtcagttctatttttagaagcaatgcactaaccaatttattttacatgtcttttagaagatagtaatctaaaatagttgttaatcatgcttgttcatcatagactgcaattgtatctccagactatttaacaattttaacaggtttgttgaacccacagcccgtgggccgcatacagcccaggatggctttgaatgtggcccaacaaattcataaactttcttaaagcgttatgactttttttgtgatttttttttttaaagcccatcagctatcattagtgttagtgtattttatatgtggccctagacaattctttttcttcctctggggcccaaggatatcaaagttggacacccttgaattagataattgtgtagcctggcgctaaccagactgagttacagggactgccttggggagaggggaatgctattcaggcaaagatctagatcctcttctgattgatccagagaagatctgctgtttttttgttgtttttttttaacctactggacttctgcttaagatctcatatagtcttaggcaccatatgcttgtatataccttgagaatgtagataaatagattaatccagtgacccatccccatattctagtctatgaaaattttggcaaccatgagaattccagtttacatgaactgaattaacaatatattgtccgtattagagacagttacaaaaagatggaactgtgggttaagaataaaaaatgaaggtaatatggatggcaaatagtaatagaagtattgaaataatgtttttggagaaataaaatggataaaggaaagtaaagttgggtcttagaactgcaaattgaaggggatcaataagcatgtgagaaaaactgagggatgtagggaagtaagagatgagagccaggactctggaaggtgggaacctgaggaggtaggatataggactggaattttaggaggtagaagtggatattcctgagttgtaatgaaatcagaaaagctttgaaaattgggaagacaattagtccagcaagggaggaagacattaatcaaataatcactaaaatgtgaaattgtaaatattataacttagtatacaaaggagaggtacttgtattggtagtgtgtgggagcaatggctaagcttagatctgaggaagctgctgtatttggtgtgcatgtcacctctcagggtgccaagttccccacagatagttatctttaacacctagcaaactacagtcatgtgctacataacaacatttcagtcgaggatggattgcatataagatggtggttgcataagattataataccataatttttctgtatcttattaaagtttagatacaaagatatttgtcactgtgttacaattgcctacaatattcagtacagtaacactctgcacaggtttgtagcctaggagcaataggctataccatatagcctcagtgtgtagtaggctatactatctaggtttgtagaagtacactttatgatgttcgcacaatagtgaaattgcctaatgacacatttctcagtacatatccccattattatgcgccatacagctgtatttagagtgtcattctttctggatttgtatataaaattggaggcatagcagggagtggtagtggccagccatgactcaggctgattctgaaggtaataccagtgtggtcttaagaccattgacatattgacatatttgcttgttggtataaatttggaatctttgacccagaaagaaacaataggggagataaattccctcttaatcatttttttgagatagtttcatgacactgggtaggttttcctcagttcagttccagctgccttatcatttgtgaatctaggtgaattagtggggagggagatcctgaaaagtttctcagatagaaagtagaattagtcataagtacttattactgtaacaaaggtttggaatattctggaatctgtaatgaattaatagattcatatcattatattcagtaatatatattgaatgatgaatgaacagagatatagtacgtatgtacaagaagctttgagaagcaataagcctacattttagcatatttatgatgctacattttaactaagattttggaaaactttttacattaagcgtatgttttatttcaagttggcatgtggtcactaatgaaaagcttttatttttccttttatataagagctatgaagtcacatagggaactaataattttgtacagggttttgctccttaattgacatatgccttttgattctggaactgattacgaaagaagtctatctgtatccatgagcagttaactctttccagaattggaatctttaaagtgcattgtagctatcaggtccaaattaaggcatagatagtcacttgccaggtgagatttgatggcaaaagaaaaactaaaatgtggcctagaacttctttttcttttaaaagaggagcacttctaaccattttctgaggcattctaccacagtaaatcctttgattgtgggattgatagttagcattatttgtgtatcagaaatgagtcgttctggcagtgggacattgagagtggatgtagggttaggctaagttagatgatatggaaggggaagttgggaagtcggtggtgttttacctcaggacatctccactagcaattgatatgcaaatgattcatccagggagggaggagattttagaaataaagctcttaataggttttcagggatattgttttggggtttgatggactaagagtataaaggtagcttttctgacagcatggccctttagaatggtactacctccattttatgaattagtagttatcagttgagggagtaaggcagacagtttcccctttagtaggtattttgggaatttgtaggggggtgcaagaagaaattttttttttacagtaataaatagatgtggtccagggatgctagccattctgtaatgtgagggtcattaagactgataatgctataaataatattttataaattagagcattttgcagcatgatataattgacattcatctcagttgatgcatacagcagcactgtcaggtaaggagcggggtattatgatcttcattttagaaataagcaaaatgggactcagaaaccatgtgatttgcccaagatcatatggctaataagatagctgagaggtgaactcatatcctctttccactgaactgtggttggaaaaaatgattgactccgagaaaagatccaagtagtgttttcattcattcattcagtaatgcctgtttgacatttgggctttctgtctatgaatctatctttatcccatttcccattgggcttctagtctttttattcttgatttgcagaagctttttgtgtgtcttctagatattgtttgtcagttttacacattgaaaatatctcctcctgctctgttatctgtcatctttgtagtgtcctttattgaagagaaatttataatttaaaaaaatttattagagacgaggtttcactcaggctagagtgcagtggcacaatcatagctcactgctgtctcgacttactgggtacaagggatccccttgctttagcctcccaaatagctgggactgtagacgtgtgctaccacgcctggctaattaaaaaaatttttttgtagagctggggtctcaccatcttgcccaaactggtctcaaactcctgggctcaagcagccctcctgcttccgcctcccaaactgcttgaattccaagcataagccgccatgcctggccagaaatttgtaaatttgaagttgttgcctaatggtattggttttcagatcttaattaacaagttttcccccactattagttatcaagatattgtcttacagttttttcctaatatagttatagttttatcttttatgtcaatatctttaatccatcagaaatccattaaggatatattttaaatttttgtataaactgccacattctcctctagaaatattttacataattgtatctcaaccaatagtactttgagagccttcatcactgtttttagtttctttaattttgtcatacttgcgggaaaaaagtgatagctcattgttttaactattgtgaaccaacatcttttcatatattcattgtccatttatatttctttggcaaattacctagaaatacactttgtccattttttcttattgatatatataaatactttgtgtattatggatatttatgtttatatgatttttttcctgggctataattctataatttatctttcaactttggttatgctatcttttgttatctatgatttctttggtggttgatctttcagattttgctttatggctgtagtttttaaagttttaattttcagggcccttaaactctaggtggattatatcaattgatatttatcatattaggaatttaaactggaaaatttaaagaatatttaactattatctattatgcagtaagtccattacatggtatgtgtttttttgtgtgtttgtttttgtttttgagatggagtctcactgtcgccgggcttgagtgcagtggtgtgatcttggttcactataacctccacttcctgggttcaagcgattctccttactcagcctcccgaatagttgcaattacaggtgcccaccagtgcgcctgccaccatgcctggctaatttttgaatttttaaattaaagacggggtttcgccatgttggccaggctggtctcgaactcctgacctcaagtgatctgttcatctcagcctcccaaagtcctgggattacaggcgtgagccactgtgcctggccattacatgttagcatattgtaccaaacagggctccattaggaaaatagaaccagtagaacatatattaagagagttattgcaaagaattggcatatgcagatgtggagttgtctgaaatccatagggcaggctgttggaaagggcaggctagaactctcaggcaagggcctaagctgtagtccataggtggaatttcatctttttaaaggaagtctcagctctgctgttaaggcttttcaagtgattgaattagcccacccagattatgtaggataatctctagtacttaaagtcatctgtttatggacattaatgacatctacaaaatcctttcataacaatgcatagattagtgtttgattgaataacaggagactgtggactagccaagttgacacaaaactgactgtcatatattttttgtttgttttttgttttttttttaagagacagggcctcgctctgtcacccaggctggagtgcagtgacatgatcatagttcactgtaacctccagctcccggacttaagagagcctcctgcctcagcctcctgagtagctgggactacagatgtgagccactgcacctggactttacatgtattttttatggaaaataaatacatttttgactaaaaaaagtgaaaaaagagtggcgttgttttatgtttttgcaaatctctttagtgtctgacttaatagaagacagcctgattctaatatctgcttctgcattcagtctgttgcactctgttgttttggttgagatatgaagatctggccttatactggttatagttggaaagggaggaatattttaatagtctcttcagataattaaagatatgcttctttgatactacaccaggaattgagtaatagttgcttagaggttagttgtgatatagaatctgaaaccatattattgcattttttctacagttacattaaaatctattcatctgtcttaggctcttaatggatatttacctatgcatgattttgtaatattatgcatttatcactcagaaaatattggttcactgtcttatggagttctaaatgttgacacattttattactcaatataaaaaaatttcattagtatctccactgatctgaacaaaaagtatttaagtattgggatgcagtcaaactcatggtagcagatgtaagttttttaggaatctgatttttcattaaaagcttgaattttatcattggcaataaatattgccacttgtttttcttgaagtgtcgggcttactttgctcattttgagaaaacgtctaccaaatacttaagtcagaaaaaccataacttatctatcaatcattctttcaagtaaaaatggtctcccatggaaaaagtgacttcttagtctgagaacccaattgtacagatgtttttccttgagacaatggttgtacttcagaatgtagtagaagtgcttctattttgtcaaacagaatattaaaaatatgtctgtgttctaataaaactctattgacaaaaacaggcaatgggccatagtgcacagtttgacaacccctgctttatttaactccttgagcaaatgtagaagattaataatagccgttttgaggtttttatccatgaatgccatcatatatataattttttaaatctgtttttattgactgatttttctcctggtaatggatcttttcctcttcctttacttgtctggtaatttttcaattcgatgttaaacattgtaaattttacgttgttggtgggtgctggattttaacatatgtttttcaagagtgttaggttttgttttaaggtacattttagtattagtttgatccttttgcaggttgcttttctatgttgttatggaaaaatcccaggtacagtcatgcttcgcttaacaattgggatatgttctgagaaatgcattgttaggcaatttcattgttgtatgaacaccctacagtgtacttacatgcacctagatggtatagcctactgcgcacctagactatatggtatagcctattgcttctaggctatgaacctgtacagcatgttactgtattgaataggcaattacaacacaatggtaagtatttgtgtatctaaacaaaggaaaggtattgtaaaaatatactatataagcttatgggaccactgttgtataagtgatgcatcattgactgaaatgtcgttatgcagcacatgactgtggttttttattctgaaacttatttagcttcactactaaggtaaaatccttctgaaaattctgcccaatgcccagtgtataataaggtctctttattcttcaccttgtgtaaacccgaactgttctcaccctgtgtgggcactaggaagtgttcagtctgatactttctggtggttctttcctcaacctcaagtagtttcccttcacacatgtgcagattagttctcaagtggccctctctgcagatctttgcagtgctcactctgcacacctgcttcctctctggtactctgccccataagttctagccaccttagctttcccaaactccgatccccatctcctcaactcaggttgtctaccaggctctgtttactttccctttcttgtgttgcagcctggaaactgcctctggagcaaactgaggtgattgtaagctcattgtgtttgtttcctttctctcaaggattacagtctcaagctttctattgttcagtacctgaaaactcttatttcatgtattctgtctgattttctacttattattttagtgcaattcatgtaccagttaatcctttgtgggctaaagtggaaatcccttctttcattctctcttgagttcactctatccaggcttaagtttccagctctataatgcaactgatttaaaaaattttatccaacccaatagcagcattcgaaagagttgatcactcactttttcttgaaaagctctcttcccttgactttttatttttttagacaggttctcacctaactctgtcacccaggctggagtacagtggtgctatcatggttcactgcagctttgacccctcagactcaagcaatcctctcacctcagcctctcgagtagctgggaccacaggcatatgccaccatgcccagctaattttttaatttttagtacagataaggttttggtatgttgccctggttggtcttaaacttctgggctcaagagatcctcctgccttggcctcctaaagtgttgggattataggcatgagccaccatgcccagcccacttggcttcttggaactattctctcttcttttacacctaccttcttggtcacctcctcctctcagtcccttttgctggatcctcctcatcattttaacttctaggctttggggaatcccagaactcagtcctaggaccttttctcttctatatctgtactcaatccctaatatcatctggtcttatgatctttaaaatcttttataggctgtaactcctattgatatctgaattctgagctttcccatgaacttcagattcatattcatttgcgtaatgacatggaacttggataggtttacatacatggatttcctgatatgtccaaaactgcatttttgtttcccccatgaaggaaataaaacatgcaaataacaccaataaccaaaacctttatgtgaatcttgtcttttctgcttcaataaagttgtgattccattcttctagacactcacccaattagtcaagaaattctttctttttttttttgagacggagcctcactctgttgcctaggctgagtgcagtggcgtgatcttggctcactgcaacctccatctcccagattcaagcgattctcttgcttcagcctcccgagtagctgggattacaggcgcccgtcaccacacctggctaatttttgtatttttagtagagacggggttttgccatgttggccaggctggtcttgaactcctgacctcaggtgatccgcctgccttggcctcccagggtgctgggattgcaggcgtgagccaccgtgcccggccaagaaattctttcagctcctcttttgaactatatcttgagtctagttacttctcatcacttgacctgttacttccctgggtgaggtcactaccagctcttaactggtcactaccagctcttatctgtgctagctgatctccttgctttcattcttgcccaagcctcttctccattgggcagttagagcagtccttttaaaaaaagaagtcagatcatgttgttcctgcttctaggcttcctattttgctaaataaaagctaaaaaaaaaaaataccactttagcaaaaaaaaaaaaaacaaaaaccacagacctaaaggtcttatgtgatcttggccttggctagctctttgttttcttttattctccctcttactctctgtgttccagatactttagtctctttgttgtttctcagacacaccaggcatctttccacatgtaagcttttgcacttgttataattctctattcttgtgtgctgtttcactgggtatccacatggttcattttcttatctcttttaagcttttgctcaaatgtcaccttattaataaggctttgtcagttcacctgacataaaatataaaatagcgctagccccacctgtcacattctattctctcatcctgcttcattttcctctacagccttattacctcatatataatatatatttatttgtttgtcttcctcagtagaatttaaaccctatgaggtaagggcttttctttttcttttggtagtggtggttgttcattgccatattctcagcacccagaacagtgcctggcatatagtaggtcctcaataaatatttgttgaatgaatggatcttagtgctcattttgaaaagaatgctttttataaacagatatccactagatggcattattttcaaactttatgtaattaatgtctgggagcaaatgataggttattttctgttttttgccctaaacaaaaaagatctttgcaatgaagattgtcacaagaagttactaggatgaatgtgaggcatgtcgaatattgcatttatatttggtttttgatttatatatttttagatgtttattataaaataaaaaacatttagagaaacaaaattacagcatattggtgtgtaaatgatccatttaatacagttatttagcatggtaactgtgaacaaaggttgttcatgtctatccattgaccaccattccttttgtgaggccttcagcaatggcaaagcagcagtaagttccagagcctttcattactgaagccactagtggaaatccagaaaattgtcagctgttcagttcttgttgctaatgagctaggtactctcaatctggttcctaatcaactgggcattcaaattttgaaaaatttccatgtttctagaagatgttgccagacctatcctgttaaaaactggtaggttctaagtgccagagatttttagctgacttctctgaccagcactaaactcagcaaatagtttccctaatcaaaaatttacacttttcccccaaaccctcaggatttggctgctctgcctgtgccaatgccatctcatttcttgatttcctcccttacctcatttccttcttccatttcaatccctgtgcctctcttaagctcttttcctggatggttatttgatccattttattctcactcttcacacctcttttggtactattccttattcatgaagtattttttcctcttcctgttcaacttagctatgtatatttttcttttcaaattgttcaaaaatacacttaaaaacagttgttgaagttctctcttctcttttcctgttttgggcttttctcttttatttctgatcatagcaaatgtaaggacttgttttggttatgtttttaaagttcccagcttcttctcagaactctaactatttagaaatgaaaacactgttcttttgtacttttgagtctctaaatggaaaacaaaatataggatgctttttgagtttacagcctctcctcccagttcccctgggatggctaagtactagggctgataaaatgtcatttcatttaaaatgaaatgtgatggttaaactcaaaacatttaaaatgaaatgagatggttaaactcaaagacttatatttttaacatttttaaccataaatatgagaaatttctagtaatgctttccatatcttataatatgaatgatggcattttaacttgtcactctcttgtgtttggcctactgcatgtattaaactggctttgaggccagaattcagtgtttagaaaatcatgttttgtttactaagaaagtattggaacattaatttatttgggccataatttaaaggaattattgcatagcattaatttgcatgaattgtttcaattgagaaagtgtatttttctggaatgagacatgaagacttactgatatctattataatacaatataccatatttgttcaaatatacttatttcattcaagaaaatgaaagcattcttatttagtaaacatatcttatagctgctactctaaatatcacttacaaaaaacatatttaatcccagaaagataaatctcaagagacattgttgtttgctcaagattagatgagatccaacagcccttgctggttgcatgctctgactgctaacctctgttagtgcttacaaaagagagcttaattctaaatctgtatattaagccattttgcttatacctgctctattgataaggcttaggagtttctcaagtaaaattaattagagattcagcaatgtggctttaagtagaattgactgttttcgtttgtgctatttttttcacccacagactggttgaaatagcagaatcccgttttcccagatattttaacactgaagaaaagttacttttgacaagtagtaaagttcatctttatcgggaactcacctgtgatgaagttctacaaaggtatgctgctttagattttgattttttagtaatgcgttgaaggtttatgttttatcttttatgtttcagcttctaagtgaaaaaagtctttataggttagaattatgtggagtaactttttcagtgttcttctttgttatagccttttggttgaagtctttcttgaaaaacaaaaaaaattaaatgaataaaatgttctgtatttaattaattaagtggtgtattatttatctattgtttcattaacaaattgtctcacagtttagtagcttaaaacagcaaatacatattatttcacatagtttctgagggttaagtgtctgggagtagcttagctgggtgtttctggctcaatgtcgctcaagaggttatagtcaagctggtggccagggctgcagttatcttaaggcttgactggagctggagtacctgcttccaagctccctaatatagttgttggaagccctctgtttcttgctggcagtgggcaagagacctttgttccttaccgtctgggcctctccataaatcacaacatagcaagttgctttcctcagagtaagtgacctgagagactgggcaagtgaaagagtacccaagatggaagctgtagtcttttataacccacactcagaaataaggtaccatgatcttgtcatatgcttgtggtcatacagatcaagtctggcacactgtgggagggacctatacaaggatgcaaaataccaagaggagggagtaagtgtgggccattttgcagactggctaccacaagtagttttaccccagaattggagcgttaacattatcttaggagaatcaaggaattctgaaactacacagaaacagtttgctctgtttccagaaaagtatgatatgtctacaagttaggtttactgaattcttgcaaatcattactgtaacttaggaaagaatagtttattgtttttaagttgcttagcctttgcaatacctttatttatttattttatcttaaatttattgactattttataaattcttcttttataggattgaatctttggaagaagaaattatctcaaaaggaattaaacttgtgattcttgactctgttgcttctgtggtcagaaaggagtttgatgcacaacttcaaggcaatctcaaagaaagaaacaagttcttggcaagagaggcatcctccttgaagtatttggctgaggagttttcaatcccagtaagtttttctttttttctcttttttcttttcctttcttttgtttcttttatattacattcactgacttatggtatcaaataataaaattagaggaaaatgtaaaacagatgactttttaaaggtagtacagtctaattgctatagcaaacatcgccatcatcttaaattagctcatctgctgagattattttattattttaataatttgagtctggagtagatttaaacgatgtttttaaaagttcctatagtccctccttttcttccttctcattgtttactctttgtgtgtgctttgtatcacatttctcacactgcagtaaatataaagtagtaaaacttcatgaaattgcctagatctatttctatataattaaaaaaaatactgcagttgttgttagttttgttttaagtattttaggtttagatactgtgttattgtgttcagcgctgttttgtgtacaataggatttggtttgcttcaaatggtcagaggtcaaccattaagagatgttggaatgatagtaatgaaagtgtcagtaagaaaaccttgaaagattatttgtggcatggctttttgtagcgggcattgtgatcagaaatctgaagatgacaggctattacaagggcttgtgatgtgtaacctgcaagacgtaagtgtgtactaagttacactcccatctgcagtgtgtcagggagttttagtcgttgttccacagcctcatcaacattcaggcttctcaattttagtcatgcttcatctcaagaaaagatagttccttaaactgagataaaatttggttatgattttataatttttagatttgtttttggaaaattaaaatcttggatctttgcaacataaagaatatgtataaataatataaactatcacacagcctttgaggtttataaaaccaaggaagaagtcaagggagaaaatatgacattcaaaaagttctgcatactttaatggctttttagtttatattttgaattaaagtcaagtgctgttaagtttgtcttgggtgatgttcatcttttacattttattgtagttggttaaaatgataaattcaaatttatatttttcctgatcaaggagaataagggaactttgaaatactgtataaagatacttgattgaatagaaagttatgtatatagttggccctctgtatctgtgggttctgcatccatggattcaaccaactaaagataggagatatttgaaaaagcaatgggtgtggtagtgtgcccctgcagtctcagctactcaagaggctgaggtgggaggatcacttaggcgcaggaggttgaggttgcattgagccatgttcatgtcactgcacttcagcctgggagacagagtgagaccctctctctaaaaatatatatatatatttgaaagaaaagaaaaggatagttgtctttgtactgaacatgtacagacttttttcttgtcatgattccctatagttaagcagagatttacatagcatgtacattgtattgggtattataagtaatgtaaagttgatttaaagtataccagagaatgtacatagattatgtgcaaacactgcaccattttatatgagggacttgagcatccgtggattatggtatctgcagaggagtcctggaaccaatcccccatggatacagggggatgactatatattcttattttattattaattcatactgttgcttgacttaattccgtgcaaaataaaattcactttttaaatgttgtgtttgtttgcttttaagtagtaactgtaggctaatgcttttcagtttttcctaaggtgatttattttcccaagtgagaaaggggcactgcttttctttgtttttaatagaaccctctgaaaaaataggtactgaatatcccatttctatgcctttggctttgtttctctatttagaaataaatgcagattatactatgtacttatataactgtgatatctgttttttgtgacaattaagattgtaagattggttttaaaaggattttgaaaaatatttcctttagaaaatgttggaattttcctagctaaattgatacatttaaatggaaaatctctcacacaggtccgagatttaattaaaaaaaaaaaaaggaaatcatgaacttttacacatttatactgtactttgaacaggcaccatagtactgttcaaattaattatgtcaatttaatatgttatatatgataatttgctaaattaaattattgcttgctatatatataagcttacctcacagattgtcttgaaatatgtatataaatataaatatataaaaataaaaaatatatataataaaaatatataaatatataaaatgtgattattcagcttttccccccctttctctatttgaactagtactagaaaacctcgtcttttgggaagggtgacatcatttggcccttatgtgcgcatgaatgcatttaagttttaagtatgctgttgcttttttctacgttagtccctgagaattaaagaggaattaatcgatatcacttgattgaaaacagatgtattaatatctttcagaagttttcaattataagatggctttactaatattttgaggctatcactgaaatgaaaacataaaattaaaaaattttcacagagaattttatagacctttgagtatgttcagactgcagttttgagaaacagttgtagaagtctggtagaatcttttctcctgaagtttatggaggaggtgtaagtgatactctgccattgggatggaagatgcggaacctttgtctttttaaagtgttcacactagtattgaaaaaacagtaggctctgaagctgtttagagatactggataaaagtaaccgaaaaaaatttaaatactgctttataaaataaattgtggttatggctatttatgttgactttatcattgacttctaattaccacgtacagaatagttattatacgtattgtaaattatgtatcagattaaaataataggatgtttttgccagaaaggaccttaaagaaaatttagtttggccccttcattttacagatgacaatgaatccgaaaagtgacctgatttgctccaggacactcaacataggaaaggacaaacagtgggtagaatgagagatcttttagctgccagtttggggatttttttttttccacagcagaattttctttttttctgagacatacagaattacggtggactgtaaacttctttttatttatttattattattattatactttaagttttagggtacatgtgcacaatgtgcaggttagttacatatgtatacatgtgccatgctggtgcgctgcacccactaactcgtcatctagcattaggtatatctcccagtgctatccctcccccctccccccaccccacaacagtccccagagtgtaaacttcttaatgacaggattatattttctgtttctctgatttccaggacctagcactgtggataactaatatttaggaggtaacagctaatgaaagtacaattaaggtttatgaaaatagtcttaccatatgtatgtcatatttacattcattggaatatttttctttatcttttaaaacataatttgaatttttttatgcttgctgctgaaattcttatgtttttgtttttaaattgacctttgtagtatgccatcttagttgtattctttttatttattttccattccagagttttataagttgttggaataaaagaaaatgaaaatgcattgcttagataacaggactttcaccttttgaaaattctttggaaatgctttttactggtatttccaaggtctacatttttactttttcagagaattcaacaaatcaatttcagttgttatatgaataatattgaacttttttgtctccccttaatcttcttctacttccttcatttcttgatattgtacaaatgttttctggtgtaaggggaggagtaccagttaacactatttacaaaagaggtttatggagataaatttggatatattattaaatattctaagagggaaatgccttattttcattgaaagttgttgttaaaatccaaattattttactaagatgtgcttataatccgtttttctgtggccatctgtgttcttgattacatgccttttgagaatatccattgctctaatttattgcttatcaaggtttttggaatattagtgattatttttatgtttaaagctgcttagacaaatgaatcaaaatatgtgcattttaaattttgctattttaaagacagttttaaatcattaacaaatggaaagaatttgttctggttttaaagtggacatataacaaggttaaattttttattattatttgagacaagcacaaatttttttttcctctttttaatggtgaacttcatgtgggcctggatttatttatttatttatttattttacaccatgagctgttccattatgccaagtgggtttaatttatgcaggattataccttgtcttagatactaataaatattcaaaatagaaaaataagaaactaggccacttcatttaaaataattaaggttttattaattataaattgggaatattgtgtttataactggtgagataagaggaaaaagaatgtatgtacccaaattcgacatttatttttatcttaaacataaatattcagaactgtcacttttgtgaaagcctgatgaagtcactctgattgtaaagtaggaatcctagacccttgatgtagacatagatatgccattaaaactgcagtcctgttttgctgtgtgtaacattgttgtatcacttttctagaaatgtaatttttggtttactcttattactttcatatttttactgaaaacaagcaccacaggacttctgaggtaagaaaagtcctttacaggatttttcttttccataaatgcttactgttggctcactcacatttgaaatcagattgttcttaaacctatcctatgttcattcaggtccctgaaactcacagtctagactaaacctttatcagttagtgaaaataattctagaaaaagtgtatctttcttttatgtagctctttatgacttctgaaactttgtttttattgtttctagcaaaaacctagaaacaacttaaaagttagtaagtaggtgattggctaaattaatgttgacatatccatacaatattatattgtgccactgttacaatgaatggtttagcccagaaatggattcataggttatgcaggcaagggttaattcagctagcatgggttactcatatccagccattcccaaaaaaggcctcttttcaggactgcccttgcctggctcctgggagatgagtgctgggccctgggaatactctgcctagtaagggtgttatatgcctgaggacttgagccacaggtactggtttgatcagattgtttatgcaaacagtgtgatttatggtgaagcctatttttctctggggatctggggactacaatctaaatagctgaggtcatctgcatgcaggcattgcatgcctagtgactgaccctcaatagaaatgctggacattaaggcttgagtgaactttcctggttgacattactttgcatgtgttgtcacacattgttgctaggacaattaagcacatgcatgcgactccactgggagaggacacctggaatcttgcacctggtttctcctggactttgcttatgctccttttctgtttgctcattttgatctgtatcctttttctgtaataagccataactgtgaatataacagcttttgagtcctgtgagtccttctagtaaatcattgagccagaaggtaatcatggggaaccttgacatgcaggggtgctaatagatatgtacaagagtatctatggcagcttaatttgtaattgctcaaaactggcaagatgtattgtagttaatagtattggcatcagtcttaatacattggctttgataattatggtttgtaagatggtgatattaggagaagctgggtgaagggcatttgggaactctaccctttctgcaactttttggtaaatctaaaattgtttcaaaataaaaagttaaaaaaagaaaaggaggtcaggtgtgctggatcacacctgaaatcccagcatttgggaagctaaggcaggaggatcacttggccaggagctagagaccagactgtgcaacatagcaagacctcatcttctcacacacacagacacagacacacacacacacacacacacacacacacacacacacacacaaaaaaaaacaattagctgggtgtggtgctacacacctgtagtcacagctacttgggaggctggggcgggaggatggcttgaacccaggagttcaaggctgcaatgagctatgaacatgccactgcattccagcctgggcgacagagcaagaccctgtctcaaaataaataaataaatagaaataaataaataaatgaaaaggagagtagggcgggttttatgagtagaagttggctctgggtagtcataaagaaatggcactggctgtatttggagaaggggacttgattttgatgcactggttctcttctatttagtcatctggtcccatacatattatctaatacctcttcaatttaaaccctgctcttcatctttcagcacatcctcttggctccgctttcgaaatacattcagtatctgattactttctaccaccttcattgccatcatcttggttcctggaggctaaaagtactggctttggagttagacgttggtttgaatcttagctccactatttgctaattttatgaccttgaataagtatttatcccagctctaacctttcgtttccatgtttgaaaaatgaggataacaatatctgactcatagggctgtgagtattaaatgagataatgtctgtaatgttcttcacaatgtttggcatattcagtaaaaagtagcctttaattattaattttactagttacctcgttccagatgcctggtgtattttatctctttcctcctaaaatattttttaacaaggctgcaagtgcctcagaaggaagaatcatgtcttattcactattgtatccccctctgtctgtcttactggtggatgctgttactgcctgaaccctcctttatctggttaacttacacttattttttggatctcagactctttttgtctttccttttcgattccacctacagcacttgtgtccaaaactccatgctaggaacaatgggataataaagatgaataaaacatagtatttgcccttaaggcttctacaaataaggtaattgtagaggcaaatcgctctctgtgatataatggagaataaaataagtatcttgtctactgttcctttcctgtttcttaaaatatgtaagtagcttgtaagtaacttctctgtctgtcctttgtttgggactatagattacacagagggaattaaagggaggtagtagagaccttcatagtctctcgggtaaaccctttatcatgtctagctttggtccttaaatgtcccattctttttttctttttattttttgagacaaggtctctctctttcccaggcaggagtgcaatggcgtggtcatagcttactgcagctatgccgagttctagtgatcctcctgcctcaacctcccaaatatctgggactagaggcatgtaccaccatgcctagctaatttttttgatttttagtagagacaggtcttgctatgttgcccaggctggtcttgaactcctgggctgaagcagtctgcccactgtggcctcctaaagttctaggattataggcatgagccactgtgcctggccagggttccattcttatttagaaagtcagtgctcttttggagactgataggtagtggttaaattcataaagcacatgcataattctaaagttgtatgctaagaaaacattggaaatgaaggccagttgtagctcttagtctttagcgttactttacgtatgttacacagtaccttgatttgttgtagaattttctaactgaagatcttaaggttgtagctgagtggcaatcttgttttccagtgagtacagggatgcagagaatgaggtgatttatgtaagattgcttaaggagtcatttggataattgaataatatcacttgccgcttccatcctgggttgttattgtagtatcttaatgggtctgcttctctcttttctgtatcggtaatagtacatatgggtacataccattgctacatcattttcccaaagtgtatttctgatcacatccctcctatgctcagaagcattgtatggtaccatgatgcttatagaattaagccactagactataagcagtatgggggcagagaaactatttgttttgtccacagttgtatcctttgaagctaggacaatgtatggcacataatatatgctctaattaatatttattgaatgattaagtcttagtttaggatatgatataatatttaaagttctcttccttctggctccaacctactcctcccatgttgtcatttctcttctgtgcaggctgctggtatactaccccgagacctctctatggctttttagctgtggatgtcctcttctttcatctcttcctttctaaatttttttctttcctatctgagctctcaagttctgtctctcctctgagatttttgtatcactgttttagccccagttaattctaccttcttttgtagtacacatggtcttaacttctaattggaactttaattatgtatttgccttgcagtgtcacttaaatatttgcatgtatatatctgagctcctcagttatattataaagccccctgaaaacagaattatgttcttatgcatcctccatagctgcctatattgaatagtgtcatatattgagtaggtgtccaatatatatttgtagaatgatgtatcacactttttctagttaggcaatttttgaaatgcatgtctaattagatgcctacttcaattcttacactacttaaagggaaaacattctaacattcattctaaaaattgaaaagatactgggaaactaaaacttaagtgtctcccctgcacccctttaaaactgaatgtagaagatttgttgataatttgacagctctgtacctttaatttagtatgatgcatgaacttctgtgagacatcaaccaagattttatacgaagagctgtgatcatcaaggtgggaatttaacatcagtgctctgtacacatagtattactgtaatgccttctttagaagtttaacaacgtcaggtgatattctatgttatgatttttaacttatcaaaggaaagcattgtagagaaattagatcatctcttgaatagaatctgataactgctcactgtttaattaaattcaaataaacagtttgaaatagaatattggctgtatgagagtttggtcaaaggatattttcttgagtttttcaaagacaaaatttgtttttttggttgatatttttacatatcctttgcgtttcttgaatgtagttcacttagttaatacagtacagttaatacagttaccttccaagtaaagctggagggaaaatactttctgataagaaaatatatttcaaataataaaacagtatgatactagcataaaacagatatatagaccaatggaacagaatagagagcccagaaataaacctgcgcatgtgtggtcaattgatctttgacacaggtatcaagaatacacaagggggaaaggacagcctcttcaataaacggtgtcaggaaaactcgatattcacatgcacaagaatgagattgggcccttattttataccatacacaaaaaataaattcaaatggactaaagacttaaacataagacctaaaaactaaaaactcttagaagagaacatagaggaaaagctttgtgacagcagccttggcaatgatttattggatatgacaacaaatgcacaggtaacaaaagcaaaaatagacaaatggaactatgccaaacttaaaagcttctgcatagcaaaggaaataagaaaaggaacaaacaactcacgaaataggagaaaatatttggaaaccacaaatctgatgataaagggttaatatccaaaatatataaataactccaaaactcaatagtaaaacaagaacaagcaagcaaacaagagacaatacaattaaaaaatgggcaaaagaactgaatagaaatttctcaaaagaagacatacatatggttcacaggtataagattcacaaagttactaatcataagggaaatggaaatcaaaaccacaataagataacactcacatcgcttaatacggttattatttaaaaacccacaaaagatagtaggagtgggcaggatgtgaagaaaagagaacccttgttcactttttttttttttttgagatggagtttcgctcttgctacccagtctggagtgcaatggcgccatctcagctcactgcaacctctgcctcctgggttcaagtgattttcctgtctcagtctcccaagtacctgggattacaggcatgtgccaccacgcccagctaatttttttgtatttttagtagagatgaggtttcaccatgttggtcaggctgatctcgaactcctgacctcaggtgatccatccacctcagcctcccaaagtgctgggattataggcatgagccaccatgcctggtcccttgttcacttttggtgggaatgtaaattggtgtagctacctgctatggaaaacagtttggaggtttctcaaaacattaaagataggactaccatatgatccagcagtcttatttctggccatatatccaaaggaattaaaatcaggatctcaagtaaatatctgaattcctatgttcattgtaggattattcccaatagctaagtcatggaagcaatctaaatgtccatccatggatgaatggaaaaagaaaatgtcatatacacacacaatgatatattatttagccttaaataaaaaagaaggaaatactactatctgtgacaacatggatgaacctggaagacattacgctaaatgagataagccagacagagaagaacaaagaatacatgatcccacttttactagtatatggaatctaaaatagtcaaactcatagagcaaagagtagaatggtgattgccaggggctgagaggaggaggaaacagggaggtattggtgaaagggtaaaagttttagttacacaagatgataagtcctggagacacagtgcctatagtgaacagtaatgtatacttaagcatttgttgaaaggtagatcttacattgtgttcttatcccatacactgtataaataaagagcacaggtggaaacttttagaagtaatggatgtgtttatggcattgaccgtagtgatggtttcacagtgtacattctccaagttgtatgcattaaacatacacagttttgtatatgtcaaacaaataaaaagccagaaaacaactttaattttcctagttagaatgttttccctttattgaatataagaattcaagaggcacttaattaactttgtaagattaaaaatatttcccaaacatttaagaatctatgtaaaacataacagctgtggtttaaaggttttattatcttccaatacaagtaacaaaatgtaaattagaggatattaaaaattatgtatttttcacttgaacattgtttcctaccccttttttgacttctgtttatctttgatattgaaagataaatattcttgttgattttacatctctattaatttagattcttttttttctttttttgagtcagagttttgctctgttgcccaggctggagtgcagtggcatgatcttggctcactgcaacctccgcctcccgggctcatgctattctcctgcctcagcctcccgagtagctgggactataggcacccgccaccacgcccggctaatttttttttttttatatttttagtagagacggggtttcaccatgttagccaggatggtcttgatctcctgacctcgtgatctgcccaccttggcctcccaaagtgctgggattacaggtgtgagccaccacacccggcctagattattttaatgttgactcagtttctgctgggaaatatcttcttaaaagtgaaacatttgcattagattatagcttttttaaccttaaggctattttgatggttataggagagaaaagtatgtatggctagacagagagcaatagttctttttgtattaccattaatggtttgaacctaagctccttttaaaattaaattttgattataaacatttgggctttgaagtcccttttaagatcagggtccttatttattgtctcagagtttgtgttaattgttttactggaaaaaataagtagtcattgacattgaaaaaatttctacaggtttgaaatgctgttaagaagaaatagctacatcttattgataactactttttttgtttcgggttctgtagtgagtacattttaaacattttccatttcatattctaaataagtttgtgaggtaggttatactattccctttttatagttgaagaaattgaggcttatagaggttaaataactttaccagagtcacttggctagtaagtggaagggcttgagtttgaatccagatatgtgtgattacaatgcatgtgttcttattcataatggaacactgcctcctaatgcagtagtcaaaattattctattcccttgctgcttatcatactaaaaacttttcaatacttattgtttcctctaagcctttttcaatggaaagtctctaattttgctttatgctttgattgctgcttgtaagtgtaaccacagtgttgcttctgtattagtgttatcagtatttaaagtaagagaaatatttgattatttgcagctttgattgctttttcacaaacatgcaaatcacacatgtaatgttaagagtataattaatgccttttatgtgccagtgaatatactgaagacttgtaggttttctgaacaatattctcagaattggcaaacttgtagcttaagtcttgtaataaggatgctgtcttaggaaaataatttcaaaatacttgcactttagacctctcttggggaacacatgaagtaaggctgcttcctaagattctgctttgaggttttatgaagacacaatacatgctgttactggacagaagacattttagtttcatgacattgccaaatgtatctcgtaaaattcactgttcatgaatttaattaaaagttcttaggagcttaaaacttaaagtaggtattttagactcatgactcaaaggatcttctttcagtttgtgtgtgtgtgtgtgtgtgtgtgtgtcatacacacacacacacacacataaatatatatatttgaaggagttacagttctaaactaaactggaataaagtaatgcccatagttattaagtactaaagtacagtattttaaagaaatgttgaaattgttataatatgaagtttcttagtgcccctagcttacagccactaaagttagttttatatctgataccatattgtaatgaatttacttttttgttctgtatgatctttagcttagtttactgggttgcccaataacatgggattgacctgcctgctaaccttgtgttggagtctgcttagtccctagttcagctaggtccaagtttttgtctcatgaccaagaagaataaggcttgcagccactggagagtaaatagagtagaatttattaagcgaaaggaaagctcttagcaaagagaggggacctgaaagcaggttgccagaaataggactgagttctgggtcttttatgtggcaagagcaaggaagccttctgtgggttctgcccaaaatgggagggctaaagttccctcctaaggatgttgcatctgtgcatgcctggggttgactccatcttagttattacccgtgagtgcctaagcgaaagccacaggggtactaaaaccacaatgcgaatgtcatgttaatggcattataatgagttgggccaagttaaggacatttaggttgacttattgcgcctgtgcctaagttgggatggtcccttctgagcaacatcctggcatgagggtaagttcttaatcatatttcttctcattagctacagggacagtgcaggtgcagtcctgtgggtatttttccactccgaagaccctccctctctatctgcctaaactgcctcctctgtcacttggaaatggcagtttactgttgaacaatagacctctccttatgcttttctcttccagtctttgggaatcacactctgaagattaaacatttcactgagacagcatgacgcagtagaaggtacccagaatcacaatacagttcacagtaacaaagatatggaatcaaccaaagtggatgattggatgaggaaagtgtagtatatatacacaatggaatactattcagccataaaaagaatgaaataatgtcttttgcagcaacatggatcaaactggaggccattatcttatgtgaaataagctagacacaaaaagacaaataccacatataagtgggagtgaaataatgtgtacccatggatgtagagtgtggaatgatagacagtggagactgggaagggtgggagggggttggatgatgagaaattacttaattggtacaatgtatgttattccagtgatggatacctggaaagtcctgacttcatcactatgcaatatatccatgtaacaaaattacactgtatcccatacatttatataaatgaaatgaaaaatgaaagaaaataggagtttaagtaccatatgtgttacaactagctgtgcaatcctggacgagtcagttctcatttctgagcctcagtatccctatctgtagaaagtggctaaaagttgctacctcataaggcttaatattattactaataatattaatagatgaatagtaatatatttccgattactaaactttatagaggtttttataatttataagcactttcatatataataattttatagggatgtatatttatctatatttctgaaaggactttgtaaattctgaagcactacgtaacttgttagttgatagttccataaccagctaaatctgatttagtgactgtttttatccttagttatttgaacaatgaatcagaattttctaagctcagataatgcacttaactcaatttgttcagctaaaataaaagttttggaatgttttttaactagtgttaagatttgttttaaaattagattgtaacgacatctggcttttatattattatttaaagatgtagaaatggtgatgtagtaaaaatcatgagtggttagtagttgggggctagtgtcatttttaggagttgcagtgatgaactctatccactaaatttagtgatggatcagtgtagttcttttaaaataaatatttagtactttatgtttacagaggaccctgcaattattagttagcttataccaatatttattgctatataaagggctgggcaagtgcctataatggccacctttggagaggatttacaggcacctttgagaaaacttcttttttttttgaagatggagtcttgctctgtcacccaggctggagtgcagtggtgtgatctcggctcactgtgacctccacctcctggattcaggcaattctcttgcctaagcctcctgagtagctgggattacaggctcccaccaccatgccctttttaacagctaatttttgtatttttaggagagatagggtttcaccatgttgaccaggctggttttaaactcctgacctcaaatgatctgcccacctctgcctcccaaagtgctgggattacaggcgtgagccaccgcgcctggcctgagaaaacttctaactctgagtttagttggtttgtctgtatactgtcaggaatctgcaaagcttatttgatcgtttatttgtaccagcattttccctgagaagttattctgaaaaatactctctctcaaaatgataaaaaccttttctgtgcatttgtttcagaatcttaccgcttctaggacctagaacttctttctgaagtgtaacctaaatatttgccttaagaagttaaataactaatatttttagtgtaaccaccatttaaggcatttaaaaaaaatgaaatagtctgctttcaagactcttgtttctattatggatataaaacatatttttaaaaagatcaacattataaggtagtagatagtaagtattaattaggtgtttgtggcagatactgttagttgcctacccaaaacttatttccattttcaccttgttaatagaaccctaatcgtgttttggtagctgtgtgcccagcctcagttcatgacagtcatgttttctgatttcccaacttcttctacaactgaggatagccatgtgatcgagttctggacagtgttacctgtttagctctccattttttttctttccaacttttatttaaggttcagggggtacatgtgcaggtttgttatgtgggtaaattgcatgttgtgggggtttggtgttcagattatttcattacccaggtaataagcatagtacccagtaggtagtttttcagtgcataccctcctcccaccagccaccctcaagtaggcccccgtatctatggtttccttctttgtattcatgaggactcagtgttgagcttctacttacaagtgaggacatgcagtatttggttttctgttcctgcattaattagcctaggataatggcctccagctccatccatgttgctgcaaaggacatgatttattcttttttaatggctgcatagtatttcatggtatatatgtaccacattttctttatctcgttcaccgttagtgggcatttaggttgattccatgtctttgctattgtgaatagtgctgtgatggacatatgtgtgcttgtgtctttatggtagaatccttatattcctttggttatatacctagtagtaggattgctaggttgaacgatagttctaagttcttcgaaagattgccaaactactttccacaatggctaaacttattaacattcctaccaacagtgtataagcattcccttttctctgcaaccttgctagcatctattattttttgagtttttaataatagctattctgactggtgtgagatggtatctcattttgattttagtatacatttctctaatgattaggaatgttgactttttttttttttttttttgagatggagtcttgctctgttgccaggctggtgtgcagaggtgcgatctcggctcactgcaatctctgcctcccaggttcaagtgattctcctgcctcaggctcccacgtagctgctaagcatgccaccacacccagctaatttttgtatttttttcatatgccttttgattgtgtgtttgtcttcttttgagaaatgtctgtttatgtcctttgcccatttttaatggatctgtttgtttttacttgttaatttcctcaaattctctatagattctggatattagatctctgttaagatacatagtttgcaaatattttctccctttaggttatctgtttattctgtttatagtttcttttgttgtaacagatctctttcatttaactagatcctatttgtcagtttttttttttttcaattgcttttggagcctttgtcatgaaatctttgccatcacctatgtccagaatagtgtttcctaggttttcttctatggtttttgtagttttaagttttatatttaagtctttaggccatcttgagttggtttctgtatatggtaaaaggaaggaatctaatttcagtcttctgcatatggctagccagttatcccagcaccatttatttaatagagaattcagtaaatgctgctgggattacttgttttcataaactttatcaaagatcagatggttgtaggtatgtggctttatttctgggttttctaacctgttctgttgttctgtgtgtctgctttggaccagtaccatgctgttttggttactgtagtcttgtaatatactttgaagttgggtagtgtgatgcttctggctgtgttataatatttttgcttaggattgctttggcttttcaggttctatatgaattttagaataggtttttttccaattctgtgaaaaatgttggtagtttgatagaaatagcattgaatctgtaaattgctttgggcagtatagccattttaacaatattgattctttcaatccatgagcatggaatgtttttccatttgtttgtgtcatctctgacttctttcagcagtgttttgtaattcttgttgtagagatttttcacctccctggttagctgtgttcctaggtactttttttgtgtgtgtggctattgtgaataggattgcattattgatttgactctcagcttggctgttgttggtgtatagaaatgctactgatttttgtacattgattttgttttctgaaactttgctcaagtcatttatcagatctaggaacatttgggcagagattataaggctttctaggtataaaatcatatcacctgcaaagagagatttcctctcttcctgtctggatgccgtttatttctttatcttgtctaattgctctggctagaacttccagtataggagtggtaagtgtgggcatccttgccttgttccaggtctcaaggggaatgcttcaagcttttgattatttggtaggatattagctgtgggtttgtcatagatgagtcttcttattctgcggtatgtttcttcagtacctagtttattgagggtttttagcacaaaaggatgttgaattttattgaaagccttttctgtgtctgttgagttgatcatgtggtttttgtttttagttttgtttatgtgatgaaccacgtttattgatttgcatgttgagccaaccttgcatctcaggaataaagcctggttgattaggtagatgagctttttgatttgctgctggatttggtttgcttgtattttgttgaggatttttgcatctatgtttatcagggatattggcctgaagctttcttttttcattgtgtctctgccaagtattggtatcagcatgatcctggcctcatacagtgagttaggagggagtccttccttctggatttttgggaatagtttcagtaggattggtatcagcttatttttttacatcaggtgggctttggatttgaatcaatctggtccagggttttttctggctggtaggctttttattactgattcaatttcacaatttgttagttgtctgtttagggtttcaatttcttcctggttcaatcttgggttgttttatattttcaggaaattatccatttcttctaggttttttagtttgtgcacatagtgatatttgtaataatctctgagggttttgtgtatttctgtggggttgctggtaatgtcccctttgtgtgttgtgattgtgtttatttgaatattctctcttctttcccttccttccttccttctttctttctttttttcttttttgacgaaatttcagtcttgttgcccaggctggagtgcaatggcaccatctcagctcaccacaacctctgcctcctgggttcaagcgattctcctgcctcagcctcctgagtagctgggattacaggcatgtgctaccatacccggctaattttgtatttttagtaaagacagggtttctccatgttggtcaggctggtcttgaagtcccgacctgaggtgatctgcccatcttggcctcccaaagttctgggattacaggtgtgagccactgtgcctggccctggatcttctctcttttacttattagtctacctagtggtctatcaatcttattcatttttttcaaagggccagcttttggttttgttgatcttttgtatggtttttcgtgactcaatttcattcaattcagctctgatttcagttatttcttgtcttctgctagcttcggagttggtatgctcttgtttttttggtttctctaggtgtgatgttaggttgttaatttgagatttttctatgctttagttctctactgctgcttaatattttgttataaaatatagtaccttaaaacaacaattataatttattatatctcatggtttgtgtgggtgagtaattcagataaggacttgtttctgctccatgatgtctgaggcctcagctagaagactcaaagactgaggctggagtcatatgaaagcttgttcatgccattttttagttaatgcttgtacctgctgggggtccagctggaacattcacatgtggttttaatattatcactgggtttttttatgaccctgcctccggagttatttagcatcacttctgctgtactctattagacaagactgttaaaaatctcctcctagacttacagggagagaatatgtccccttctgtcagttggaggagcatgtatcatgttgtagaaagaaagtattaaacagaataaatatattgaggtggtcatctttagaaaatacagcttactacagcatttaagggaaggtttattgttggggggctgtggcgctgttgggcagtgatgttttaggcatgatcctttgttgcttattccttcttcatgcctcaaaggagcagcaaccatcttgtgcccataaggtgataaatcaaccgctaaggattttgacatcattggaagtcagtcctggatgatccatttccaggcttctttttttcctgtgtggaaaaaaatacctatttgtttaaattactatattaaggattttgttttttaaaaccaatcataatccccaaatgtcatggttgtcaactttgaggatacataggaatcacctgtggggcttgttaagatacagattgcttggccccatgttagagtttctgattcactaggtctggcataggctcaagaagctggatttgtaacaggctctctggtgttgtcaatgctgtggtcttgggactgaggtatgggctttgagacttcagagaagagtgggtggctagggctgaccttaagggaaaggtggaacttgggaaaaatagatgagatttagacaggattagggaagcaattccaagtattacaaatggtatcaacaaaaaacatgatagcagaaaaagtgtacttttttgttttttaggatttctgtgagtaaattagcttacttggagcaggagttttgtttttttttttttaactgaggatgggagattaggttaaagggaaaataaggactggattaaggtccttggaagccagagagacatttgtttttttattttgtagctagttaggaactgctagaagttttcatagagagtagtgtggccacagcagtatgctagcagacacctatgtttggtggtggtagtggagtgcatttagttattaaacaaatttaaacaaatggttcttgagcatttgtgatgtcttggactcagttctatgaactgggaatacaaaggtaaataagacgtggatcctgccatcaaagagcacggtctagtgcaggaattctcagagtgtgggtgagtacccctgggggtccctgagaccttttcaaggagaaaagattaaaagtattttcataataatattaataattctaagaattctgagacactgtttacttttttgtcattctctttcattagtgtacaagtttttcagaggctttgtaacataggatgtcatcattgctcatatagctaatggaatacaagcttgtgtattaaaacttttgttttaatttcttaattataacttggtaaatactgatagacataaccccctaaacaaaagctctttggaatcttcagtaatttttttaagaggtagagtcgtgaagccataaagtttgaaaactgctgttccagagaatagattggaggagaaaacacatgaaaaacaaaagactaacactctagatgtgaggtaataagagcttaaactagagttataacaaatgaaaagtggaggaagagatattttgtagacactgaagagtggaaaaattgataatacctagtgtaaattatggtgtgggaaaacggatactgctagtgaacatgtaaattagtaccagccttttggaggaacaatttgacaaaacttattgcagactttaaaaatgaatctttcctgtgacttattctgtacttatcataaggaaacaaataagaatatatctttgcggttttgtttgtagtatcagtaaaaatttataagaagcctaagtatcagaggagtttgattaaataaattattacatcaattcaataaaatgctgtgtagtcactaaaaataatgatgtgggtgaatatttaatgtaaaaaattatatacttttttgttgttgttttgttttggattttttgagagagggtctctgttgcacaggctggagtagcgtagcacgaacatggctcactgcagccttcacctcctgggcttaagccagggactacaggcacacaccacacacctggctaacttttttaaaaaagttttttttaaagatgcggtctcaccatattgtccagactggtcttgaactcctgggctcaagccatcctcccatcttggccttccaaagtgttgggattacaggcatgagccaccacatgtggccaaaaaatactttttataaatacctcagttgcataatgttttctccattatcaacttgacaggcctttgtttaaggtttacggttataagtacttatttgtgtaaaatttaagatctatcaatatgtctaatttttcagaaatttttttcttcaacattttagcctttggcccattttcaaattgtatgtaggccaaggcatacacagtggacattgtgcagctgcgtatacgaatatagccaacattaagaggtcccttgcaataatgctgtttcagaaaggatgtttactgttcttttgaacatagttttcttgtttctgctttaacttataaatatttctcgggaggctgaggcaggagaatggcgtgaacccaggaggcggagcttgcagtgagccgagatcgcgccactgcactccagcctgggcgacagagcgagactctgtctcaaaaaaaaaaaaaaaaaaaaaaaaaaaaaaaaaaaaatatttaaataaaaataatgtttcactgaagaaattgtaaaagtgaactatatgttaaaaataatctaggaaactaaattactgctattccactttgcagtttgatattgctcattttttgactcgtaaagtcagtgtcgatgccttttaactttttttttaaaattttactggatttgtattttaccatatttgtgcagtgactttgattaggtaccaattgaattcagattaaaaagcataaacctacatctgaagatagcctagtataatttatattgtgcatcgttctgattttgaaataataattctcctttacaacgttagggctgaataaaagatagaatccttatgaaatagtgagcccaatgtcattttttttttttttgagtcagagtcttgctctgttgcccagactgtagtgcagtggcacaatcttggctcactgcaacctccgcctcccaggttcaagcatttctcttgcctcagcctcctgagtagctgggaccacaggcatgctccaccacacccggctaatttttgtatatgtatttttagtaaagacgaggtgtcactgtgttggccaggctggtctcaaactcctggcctcaagtgatccacccatctgtgcctcccaaagttctaggattacagatgtgagccaccgtgcccagccccagtctcattttggaaatagagcagagacagatggaaaactgttagcccttggtgatgttattgagcagtgttatctgtgggtttccagatgtgttaatatatgtattttcttattaagtcctttgcattgaaatggtggtgcatggactggcagcattagcattacctatgagtttgttggaaatgaggaattttagactgtaccctagttcaattgaatcaaaatccattttaataggatccccagataagtcatatgcacacaaaagctggagaagtattattttacaccactttgagttggatttttatttactcgcaactggatgcatcctgatatgacattctggagttgttgtttgttttcttgtttgtttttcctgaagaggtacaaccttctccaggcatgctattgtgaatattggaggggtgccatttctgattataatagaaacagcatttgttgagtcatgatacagtttaaatagttctcattatactttgatatgatttttttcatttttttaaatggttatttttagatgaaacctaaaactgtactctttactacttgtggtaaaaaagaccctaccgttatttttggcaagtcaggagatgtaaccttagctgtgctggttaaaagccagctttgagagttgcattttacctcccttagaattactccttcccattctttcctcagctccattcctatttcaactagatagttttgtactggacctgtgttccagaaccattactgtctggggagcgactcttataaactactgccttttagaccagatgtgtgtttcagttacatgaatagagaaaagaatgtcatccccctgctatagctgtgtatatgatagcatgaagaaattaaatccaccagcaatctaggaattttcagaaaatttattttcttctactctttatacaaagccaggtgccacattccataaaaagcaaagcatattttaaaattgtacttcttgtttgtccatttatttagagggcttaattagtctgtagccagatattttggatgattcaattcacaaattagattatcgttctgtaattaactgagaatgatctctctgtggtgtgctttatagtgagaattaccaaaggtctgtattcactcggaaaggtcttagttttaaaagcagtctttttaaaggaaatgtagctatgctcattgattttgttattgttgtcctttgagtttttatggtacactaggcattatgctaggtatatgaaaatatgtctctaatccctgttttagacatgataacattgaggctagagagattatgtaacatgcagaaaattgtatagttatatgaacccacggctggtgctcccaaaactcattcatccccttgaggagttcagattctactgattgggagagaaagagctcactgtaatagaatgcaaaatgtagtaaaaattttaaatgaagtaaattgtaaaagtagagatacaaacaatttagtgagaacacagaggaagaagggattaactgtgattaggaggatcaggaaaacataatttatcttctctcctacttctctaagtttttttttttttttgagatggagtctcactctgttgcccaggctagagtgcagtggcgcgatctcggctcactgcaacctctgtctcccaggttcaagtgattctcctgcctcagcctcccaagtagctgggactacaggtgcctgccaccatgcccggctaatttttgtatttttagtggagactgggtttcaccatattggccaggctggtctcgaactcctgaccttgtaatctgcccgacttggcctcccaaagtgctgggattacaggcgtgagccactgcacccggccttacttctctaggtttttaagctcctcctgacttcttaatcttttaatagtatcgtaagtttttcagtaatcaagatttaaatctttgactgtttgtcttcatattcttacatttcatcaatctgtaatgccttttagttcttactgaaaacagtttcttggtagttatcccctaccatttccactgctgtcaccctagttttacctattgctgtatcatctaggccagtgattatcaacctttggtggacctaagaatcatctaatggtgctttgtcaaagtataaagagattttgacttattagtttaaggttatgggtgattcatcaaagttgagaaatacttatctagggcagtggtcttcaaaatgtgatcttgggactgctgggtgtctctgggactttatcaggtatctgcaaagttaaaactattttcgtagttagactaagatgtcatttacttttttcattgtgttgacatttgcactgatggtgaagaaaatagtgatggataaaacttgtagtgccttagctcaaattaagacagtggtaccaaattagtaatcaatgcattcttcactgccacataccagttttgcttaataatgtctttaatgaatcagttaaaatattattattaatttttttatttttaatttttgtgggtacatagtaggtatgtatatttatggggtatatgggatattttgatacaggcatacagtgtgtaataatcacatcaaggtaagtagggtatctgtcacctcaagcatttatcctttgtgttacaatctagttatactgttttagttatttttaaagtacaattaaattattattgactatagtcacctgttgtgctgtaaaattcactctttctatttttttgcacccataaaccatccccacttctctgccccactctccactactcttcccaacctctggtaaccatcattttactctttatctccatgagttcaatttttttttttttgagatggggcctcgctctttcacccaggctgaagtgcagtggcatgatctcggctcactgcaacctccgcctcccattttcaagcgattctcttgcctcagcctccagagtagctgggatattaggtgcataccaccacgcttggctaatttttgtatttttagtaaagacgaggtttcaccatattagccaggctggtcttgaactcctgacctcaagtgatccacccaccttgccctcccaaagtgttaggattataggtctgagcccctgtgcccggccaagtgttttaatttttagctcccataaataagtgagaacatgtgaagtttgtctttctgtgtccgacttattttacacaacacagtgaccttcagttccatccatgttgttgaaaatgacaagttctcattgtttccttatggatgaatagtattccattgagtatatgtaccacatttctttatccattcatctgctgatggatacttaggttgtttcttttctcttgttgcttttaagatctttttgtacttttttgccatgcataaatttttatgtagtaaaatatatttatattttcttttattatgtctaaattttagtcatagttggagagactttcattgcactgaggttagagaggaagacactcatgttttctgcaattatgcatatacagttgatcctcatttttttgtagacttggtgtttgtatgtttacctccttgtcagagtttatttgtaacacccaaattaatgatcttgttggtttcatggtcatttgcagacatgtgcagagcagtaaaatatggagtcaccaatgtgcatgttcccatctgaagctgaataaggtgatatctaccttcttgtttcagctgtcatattgtaaacaagtgttctttttgtcggggatgccacctcttccaaaacacatggtctgagagtgtggaggaatagttttccaaaagaaatagggtatatcaaatactacatgttctcacttctaagtgagagctaaacatcgggtattcatggacataaagatgggagcagtagacactggggaccattacagggggaagttagagggtgggcaagggttgaaaaactaactactgggtgccatgctcactatctgcatgatgggattatttgtattctaaacctcagcatcacgcaatatacccttgtaacaaacctgtgcatttatacccccaaatctaaaacaaaagttgaaattatgttttataaaagaaatggggtatgtttatcagaagaagggggggattaggtgtcagtcagaaacaactgtctactgtaatacctgagtaagcttttattggatagatttgaattggtgaatgaataaattgggtcttggagaaaggaaagggcttgaatgagttctttcagaataggccttttcttttctcaaaagtaccagcaatagcttcccattttttcagaactgatacctctagctttattggcttttatcatctttgctggagggaaatgacgttgggttaagtattgagtgtgaaggaagatagcatgaggatcttgtttgcctgcagctttattcctgcctgctagacctactgccctttaaagacacttgaaagggcttgccccagctttcctcttgactttagggggcaaaagtatgtcattcttatataagagttggatttataagattgtatatcaaattacatactcaagagttggattttgtttgttagtattgtctaaagttacaacatgtaaatagtctgtgtccttactttctaagcctgccattacaaaaagaaaataatatttcctattagagcctgaagcttttttcctccctagctcttatttagggagaatatataatttaagtgtttgaataggaatagaggaagtagccaaacacttttcaatagtccagctaaaatacacaatagcacatgtttaaagtacatctttggaagaaagatttgaagatccttgataagataatatatcatgtaccacaaaggcatgccctgctaagtaaaagtgggaagaagcagtacatattctattagggggtcagaaatctttaaatagaagtttctctggcaatctggttcccagatagatagttgaaggctcaaagaaatttccaagcttgctagaaatttccatctgctggcttttgtgttgagttaaatgccatcatattttattgcctcatacatttgcattaacactttccctttaaatttacttaaagtattttttgttttgtttcatttttgtttttttttgagactggtctcactttgtcgctcaggttggagtgtagtggagctcacagtttacttcagccttctgagtacctgggactacaggtgcatgccaccacacctggctaatttttgtattttttgtagagacggggtttcgccatgttgcccaggctggtctcgaactcctggcctcaagtgatcctccttgccttggccttccaaagtgctgggattgcagacgtgagccacagtgcctgacagtaatatttttttttttattagaaacataagaacccacctcaaagcttgggcttggaagtctatggaggctttatttattttagccacagacatggataagaggcaatctaagttaaatatgtgcactttggtaccaggccaacctgagttctaaccaaatttttcatgttttagatgtgagacaagttaatcttctaggccttacttccttcatgtataaagtagttattattacttaattcaacaaatattattagtcactcttctatgtgttggggtattccagtgaataaaataatgacagtctttcccttagtgcagtttccattctaatggtagaggacggaggatgggggaggcaataaaaaggaattgtatgttaaaaataataattgctgtaagcagagaggaagtagagcagggtaagggagatactgaatacagaagaaaggaggtgcagaattagggtagtaagggttggcatcgttgagccagtgacatctgagcaaagacttgaatgcagttttaaaaggcttgctctggtattgctgagttgagaatagattgcagggcattaagaataaaataaaggagaatcattaggagcttttcctagtaacctaggcaacagattttcttaggctgttcttgcgttgctataaaggaatacgtgagactgggtaatttataaagaaaagaggtttcattggctcatgattctgtaggctgtacaggaagcatggcaccagcatctgctcaacttccgcggaggcctcaggggagcttttacttatggtggatggcgaagtgggagcaggcccatcacatgacaaaagcaagagcaagagagagagtagagggtgaggtgcccaacacttttaaaccaccagatctcttgagaactcactagcgtgaagacagcagcgagccatgagggatctgcccctgtgacccaagcaccttccattaggccccatttcccatgttggggattaacattcaacatgagatttgggtgggagaatattcaaaccatatcacagatgatgataacttaacgagtattatcagtgaagatgctgaggaatcattgaattttgtatatatttttgagattgagacaacaggatttcctgacgatttgagtatgttatatgaaacaaaaaggagtctatgtttttggctcaggaactgaatggatggagctgttatcaactgataagaggaacactgtggacagagcagatttgagggggaagatcaggagttcagtactatatatatatatattgagtttgagatgtctgtttggcattcttgcagagataatgacatctaccaatgggttggttgtgatgattaaatatggtgaatgtaaattactgagcacagaatctgaccattatctctgtgagatcagagaataaattgctacatgaaacaagaataagagattgcaaaagggagatacttagggaaaaagagctcacagaatgtgatagaaaaaaatttttaaatgatggatgggaggataagattgaagaaatctcccagaatataaaagccaaagagatgtaagaatattacagaaatattaaaaataatggagaatctactcaggaggcccatctcctttctaaaaagattttcagagagagagagagatcaaagaaaagggaagggaaataattttatttatttatttttttgagatggagtctcactctgttgcccaggccagagtgcagtggcatgatcctggctcactgcaacctccacctccagggttcaagcaattcttctgcctcagcctcccgagtagctgggattgtgggcatgcaccatcacacccggctaatttttgtatttttagtagagacagggtttcaccatgttggccaggctagtctcaaactcctgacctcagttgattcatctgcctcggcctcccaaaatgctgggattacaggcatgagccactgtgctcagctaagggaaataattatcagtgaaacaatgcaagaaaaatttccagaactgaaggacatctgtttctaaattgaaagtgctcagcaccattaatgagggggaaaaagacatattaccaggacatttcagagtgccagagagtaaaaacaagtcacaaggaaaggaatagggattagtggagtgtcagacttaactcaaaactaacactggaagctagtagacaaggaagcaataccttcaaagtgctgagggaaaattatgacaaacatagatttctaattccaaccaaatagtcaatcaattatgaggatagcctaaagatatttttttagcatgcaaagtgccaaaaaatttatctcctacacatctccccacaggaagctattgaagtatgtgaaagaaggcatgaaatctaggaaaatggggaatgtaacactggagagagagaggaagtttgcaagatgatggtgaacaaaagtccaggatgacagctgagtagcaagcctagagatgactagtacagattggagcaggaaggtggaaactccagggaagatgtctgtacaaaccaaattaaactgatgcatgtgattattctgaaagagtttcatagtttgttcagacattagggaataaactgtccctaacttaagggagcttacactgtaataaggggtacatgcaagtaggcaggcaattatagtattctgtgaaggttcgtaaagtttagtactgtaggaaaccagaatatgcctccccaaaatgtgaaggattctcgagctgaagacagttaagatgcagtagagctctctgcctaaaagcaggacacagatttacagagaaaaatgtcttgctgtcctccctcctccctttctcccctaaagacaggatgtaaattctttactggaaaaaaaccctttatcatctcagagacggcgccagaggaatctgcaagctgactttactccattagtgccttccatatatttacctttccacggtttcccacctctggaagtctgggactgctttcctttgccttgtcacttctctaaaatttattgttctttgttggatatactatataaaccagactcatgaaccactgccttgagttacttttcactgagggcttttcctgtgtgatatgcaccgtacacgttaataaacctatctgtttttctcttgttaatctgccttctgttatagaagtctgtgctaactacatacttaagaaggttgaggaaaaaatactttttctccccttcagttctctgctgctagatcacccatagttggaatggaggctcagaaacctagtatttagctcctttgagcatctgtaattgaactggcaaagcaagagcttggggctgactgttggattagctgaagaatagtttccgtcatattctagaaaagaaagctttttttttctttttctttttctccagggaatgagtggggttatccatttattgtagtttaaaggatttaaaatccatctatatattgataagcattcatcagtttttattttagtatgtatggtgctatcatgtttataagaatattttgtttttaaaatgactagagcggtacaaaggaaaaaactttagttgttaattttagatgaaaagcaactgaatttcttaggtaataattattttaccctcccaagatacgttttctgtactccattgacttatgccaataaagtaatgttcttccaatttaataatggattttttttcttgttgaatttttttcaactctaacgttattttgttgttggagattgattaaaaaatacaaattttactgtttaaagaatgttgcctaattagttataaatctatttcatctttgcatttttttcttttatatactcatataaaatgtagcagtttgtatcacatcagtatttctcttatataaatatggtttatggttatgtctaatctcatttctcatttggccagttaatatatgcacagataaatggcccataaagaaaaacttcaagaggagaaaaaggtaatctaaatgcatattattattttaaagttctaatactgtgtacaattttatgaagttaagtttctgtaatatgtggtcacccaggggtctgagaacattagttaatccagtcaacaaacattgatggcatatgtgctgtatgacaggctctgtgcttggtcttaggaatacaggacaagttagggcatcattcccaccctccgataatgcttagtccccaggaaaaaaaaattgacatataaacaagtagaggtggtaaaacagaagattaaaggtcctatagatgatatttaccaatgaataaagagagaaggctatcttaagaaaaatatgtagtaagaagaaagaaatggagatagagaacatttgaggaaatggcagacatttatttgtatttggttgtagcatagagtaatggggaagaccggggaaacattgagaaccatctcatagagcaggcatgctacatgctggagtttagtcagtttctcctggaacagtatttctcaaatatgtgtgatcatatgaatcactgagaaagtttgtaaacaaacaaaaacaaccctaacagattcctgaatttcactccagacctggaaaatcagagtccttagaggagggctaggaatccgtattttgttatgtcatgtcatgtcagacagggtatctctgttgtccaggctggagttcagtggtacagtcatagcttactgcagccctgaactcctgggctcaagtgatcctcctgcctcagcctccagagtagctgagattacaggcatgagccactgtgcctggtggaatctatatttttaacaagagctctggtaattattattgtaaccaatttattgaacaagtacaagctattagggtataagcaaatatttttccctcaaatgttctagttgatgtgagactttcctttggcatgtattaatgaaagcaaggacataacccacaaatttcctatgtgcatgtacatatgtgcacatcacacacacacacacacacacacacacacacacacacacacacacacacacacacattttgtggttactaaacagtctaggccaggataaaatttagggaattacagcaggtcctcaaataatgttgttttggtataacattgatgactgaaaaaacaaaaaacaaaaatcccagttcccaactggtgccactctctctgtggaatttgcacattctccccatgtttgcatgggttttctcctggtacttcagtttcctcccctgtcccaaagatgtgtgcattgggtgaattagcgtggcccctgtttgagtgtttatgggtgtgtgtgtgttagtgtgctctgcgatgggatggcatcccctccgtggtcagttcctgccgtgtgctctgactaccaggataggctttgctttcagaaatctccagataattagcttcatatatttctgtgttcaggtgctttcagtttctgcagctcagcaagcgtccagctttggatcaagttgccagtgtgtccttcttgcagatatcttcaccttgcaatctgtatgaccaattattttgaagtgccaacttaatgaatgacccttcgtggtgccagactcctaagctctcccttgccttctcttagttctctctttggtagagttggttgaatgcaccagtgagtttgttacttctcagcaaaccttgggggagatatctgaacctaattgttggtgttctcccttagatttgggctttattgcctcttgctgtcagctttgggccctagttactgattctggaaaaagtggaaaaataccccttaacatcttgttagattatgaataggtaagtttaggaaatattattgcaggtagaagaaaacctaacaggtttttattttctaatgtttaaagagacatttaagtaaaagatctcaatggaattatacctttctttttgttgttgttgttgcagatagtatgtacttaatttttttttttttttaaatttcaataggtttttcaggaagaggtggtgtttggttacatggataagttccttagtggttatttctgagattttggtgcacccatcacccaagcagtgtacactgtacccaatatgtagtcttttttttttttttttctttttgagatagagtcttgctctgtcgcgcggcctggagtgcagtggcatgatctgggctcactacaacctccacctcccgggttcaagcgattctcctgcctcagcctcccaagtagctgggattataggcgcctgccaccacgcctggctaatttttgtatttttagtagagacgaggtttcgccatgttggcaggctggtctcaagctcctgacctcaggtgatccacctacctcagcctctcaaagtgctgggattacaggcatgggccactgcgcccagccgtaatatgtggtcttttttacctcacctgcctcctgcccttccccttaagtccccacagttcattttatcattcttatgcctctgagtcctcatagcttagctcccacctgtaagtaagaacatacaacgtttggttttccattcctgagttactttgcttagagtaacggtctccagttccatctaggttgctgtgaatgccattgtttcatttgtttttacagctgagtagtattccacagtgtgtatggggtgtgtgtgtgtgtatatatatatatcacaatttctttctttctttttctttttcttttttttttttttttttgagatggagtttcactcttgttgcccaggctggaatgcaatggtgcgatctcggcttaccacaacctctgcctcccgggttcaaggaattctcctgcctcagcctcccaagtagctgggattacagtcatgtgccaccacgcctggctaattttgtatttttagtagagacggggtttctccatgttgttcaggctggtcttgaactcccgacctcaggtgatccgcccacctcagcctcccaaattgctgggattacaggcatgagccactgcgaccagcagtatatcacattttctttatccactcgttattgatgggcatttgggctggtttcatatttttgcaattgcaaattgtgctgctgtaaacgtgtgtgtaagtgtctttttcatgtaatgacttcttttcctctggttagatacccagtagtgggattgctggatcaaatggtagatctacttttagttctttaaggaatctccacattgttttccatagaggttgtactagtttacatttgcaccagcgtgtaaaagtgttcccttttcaccatattcatgccaatatctattatactttgatttttaaattatggccattcttgcaggagtaaggtggtatcacattgtggtttggatttgcatttccctgattattagtgatgttgagcattttttcatatgcttgtcggccatttgtatatcttcttttgagaattgcttattcatgtctttagcccacttttttgatgggattatttgtttttttcttgctgatttgtttgatttccttgtagattctggatattagtcctttgtcggatgcatagtttgctaatattttctcctattttatgggttgtctgttcactctgctgattatttcttttgctgtgcagaggctttttagtttaattacgtcccatctatttatccttgttttagttgcgtttatttttgggttcttggtcatgaaaactttgcttaagccaatgtctagaaggggttttccaatgttatctgctagaatttttatgttcaggtcttagatttaagtctttgatccattttgacctgatttttgtataaagtgtgtcttagtccatttttacgctgctggtaaagagatacccgagactgggcaatttacaaaataaagaggtttaattggacttatagttccacatggctggggaagccgcacaatcatggcagaaggcaaggaagagcaagtcatgtcttacatggaatggcagcaggcaaagactttgtgcagagaaactcccgttcttaaaaccatcagatctcgtgagactcattcactatcatgagaacagcacaggaaatatccacccctgtaattcagtcacctcccactgggtctctgtcacaacacgtgggaattcaagatgaaatttggtggggacacagcaaaactgtatcattccacccctggagcctcccaaatctcatatcctcacatttcaaaaccaatcatgccttcccaaaagtcccccaaagtctcaactcatttcagcattaactcaaaagttcacagtccagcgtctcatcagagacaaggccagtcccttccgcctgtgagcctgtaaaatcaaaagcaagttagttacttcctacatacagtgggatacaggcattgggtaaatacagccattccaaatgggagaaattggccaaaacaaaggggctccaggccccatgcaagtcaaaaatcaagcagggcagtcaaatcttaaagctccaaaatgatctcctttgactccatatctgacatccaggtcatgctgatgcaagaagtgggttcccatggtcttgggcagctatgcctctgtggctttgcagggtacagcccccctcctagctgccttcatgggctggcattgagtgtctgcagcttttctaggtgaatggtgcaagctgttggtggatttaccattcttcttttttttttgagacagagtctcgctctgtcaccaggctggagtgcagtggcgtgtgatctcggctcactgtaccctctgcctcctgagttcaagcaattctcctgcctcagcctcccgagtagccgggactacaggtgcctgccaccacgtctggctaatttttgtatttttagtagagacggggtttcaccatattggccaggttggtctcgaactcctgaccttgtgatctgcctgcctcagcctcccaaagtgctgggattacaggcatgagctactgtgcttgacctggatctaccattctggggtctggaggatggtggccatcttctcacagctacactaggctctgctccccagtagggactctgtatgggggctctgactccacatttcctttctgcagaggttcttctccataagagtcctacccctgcatcaaacttctgcctgggcatccagatgtttccaaacatcttctgaaatctaggcggaggttcccaaaccccaattcttgacttctgtgcactggcaggcttaacactgcatggaagctgccaaggcttgcggcttgcaccctctgaagccttggcttgatctctcattggctcctttcagccatggctggagtggctggaatgcagggcaccaagaccctgggctgcacacagcctgggccgcacacagcacagggaccctgggcccagcccatgaaaccactttttcctcctaggcctcctggcctgcggtaggaggggctcccatgaagacctctgacatgccttagagacattttttccattgtcttggggattaacatttggccccttattacttatgcaactttctgcagccagcttggatttctcctcagaaaatggattttcttttctatcgcattgccaggctgcacattttctaaacttttatattctgcttcccttataaaactgaatgcctttaacagcacccaagtcacctcttgaatactttgctgcttagaaattttttacaccagatacccaaaatcatctctcttaagttcaaagttccacaaatctctagggcaggggcaaaatgctgccagtctgtttgctaaaacatagcaagagtcacctttactccagttaacaagttcgtcatctttatctgagaccacctcagcctggaccttattgctcatgtcactgtcaacatttttgtcaaagccattcaacaagtccttttttctcttttaaaatagacagatcatgccagtgttgaagggatatgtttccttttttttttttttttttttttttgagactgagtcttggtctgtcgccacactggagtgcagtggtgtgatcttggctcactgcagcctccgcctcctgggttcaagcgattctcctgcctcagcctcccaagtagctgggacaacaggcgtgcgccaccacacccagctaatttttgtgtttttagtaggggtggggtttcatcatgttggccaggctggtctcgaactcccaactttgtgatctgcctgcctcggcctcccagagtgctggaattacagacgtgagccaccacgcctggcggagatatgttttcttaacactgggcaaagaatctcagtttatatagctcactggacaatttacagatcctgaggtcagggataatagtaagtatggattgtgaaaaccttcagtaactcatagattttagccaatgatatgttacaaagtattttatactgtgatattatttcctatgagtcatcccattcctgttatttaagcagtgctcaagatcactatggttcatatccatgaatgtatttcagggtagaataattcttgaatcttatttataagatatactgttgactttaaatgaaagctactcatttaaataggacaccttatataccttggatatggatatttgtttttttctctttaattgtcatattttatatatttatggggttcatgtgagagtttgctgcatgcatagaatgtgtaatgatcaagtctccatcatcatgagtgcttatcatttttatgtggtgtcatttcaagtcctctcttctagttactctgacatatacataatattgttactaagtgtagtcactgtggtctgctatcaaacattagatcttgtttcttctatctaactatgtgtttgtacccacaaccaacttctcctgtcctctccccttgaaccacccttccgagtctctggttatctgttgatctattctctatgtccatgagatgaagttttttagctcccacatgtgaatgagaacgtgtggtatttgtctttctgtgctgggcttattttgcgtaacataatgacgtccaattccatccatgtcacttcaaatgacatgatttcattcttttttatggctgaatagtatttcattgtatgtgtgtgtgtgtgtgtgtgtgtgtgtattatataatatattcattgtgtgtgtgtatatattatatatatacacatatataatgtgtgtgtcttttatggttccatacaaattttaggattttttgtctatttctgggaaaaaatgaatcccacttgatcatggtatgttatcttttgggtgtgctgttggatctagtttggtagtattttgttgaagacttttccatttatcttcatcagggttattggtctgtattttttttgttgtagctttgtctggttttggtatcagggtaatgctggcctcatagaatgagttagggagaatttccttctcttaactttttggaatagcttgaggaggactgatatgagtttttctttatacatttggtagaattcagcagtgactttattcagtactgggctttttttcttgagagactttttgttcctggttcaatcttgatactcattatgttcaggttttctatttttcctgattcaatcttgttggattgtattgatatggctccaatgaatggaggaacaccagtgtccttggtcttgcgctgatttagataaaatgacatggacacatgtggagtgattttaaggagcggagagtttaataggcaagaaagaaggaagaagctcccccatacagagacagagggaggggggctctgagagagaaaccatgtgtgcggtggcaaagtagttagttatattagcaggctggaggaggcggtgtctgatttgcatacagcccagggattggttttaccagatgtgtcattcatgtggcccgtgaaaaacctggccctcccaccttcgtcctttaatatgaaaatgcgggtcaccatgatgtcctgaacacgtgtgagttatctggaggcggccatgacacttggtacttgtggtgacaaggagaagagggcagcaatcgccatgttggccatgttgggtggacctagtttctaatcgccagaatttgcatatcaaagcttgccgtctttaagccgccttttctgttagaaaagaaatggtttgggggttgcttcttacaggaaaatttccaccgagaacctttaccctttctacctgcctaaaaattatttcttaataactcctatattaatgtgtttccaggaatttctccattttctctaggtttttcactttgctagcatataattcataatagtctctgatgatcttttgtacttctggtgtcagctgcaatgtctcctttttcatttctgagtttgtttatttgggacgtctcttcttttttcggttagtcaaggtagcggtttatcaattttgtttatcttttccaatgatcaacgttttgtattgtatttttagtctctatttcatttagttctgctctgatctttattatttcttttcttctgctaatttttggttttctttgttcttgctttttagttttttgaggtgcatggttagattgttcatttgaaatctttctgtttttctgatttaggtgtttattgctataaactcccctcttaacatacttttgctatgtcccacaggttttggtatgttgtgtttccattttctttgtttcaagaaattaaaaaaattttttatcttgattctttcattgacccagtggtcactcaggagcatgttgtttaatttccatgtatttgtatagttttcagagttcctcttggcattgatttctagttttattccattgtgatctaagatacttgatatgattttagctttggaaagattagttttatagcctaacatatggtaaatcctggagaattttctatgtgcagatgagaaaaatgtatattctacagatgttagataacattttctgtacatgtctgttaggtccatttggtctaaagtcccgtttaagtctgatgtttctttattttctgtctagatgatctcttaaatgctgagattgggatgttgaagtaccccactattattgtattagagcctgtctttttctttagatctagtaatacttgctttatgcatatcctcttgctggattgatccctttatcattatataatgaccttgtctttctgtgtcttttttttttgtgtttttttgttttttttaagaaatggggtctcaatatgttttctaggctagtcttgagctcctggcctcaagtgatcctcccgcctctgccttctgagtagctgggattacaggcaggagccatcgtgcccagcttctttgtcttttattattatttttgacttaatgtctgttttatctgatataagtgtaggtatttctgctcacttttggtttccgtttgtgtggaatatcttttttcatttatttactttgagtctatatgtgtcttcacaggtaaagtgcactgattgtaggcagcatatagttagatcatttttaaatcaattcagagagtctgtatcttttaagtggagaatttaatccattaatattcaaggttattattgaggttttgttccttcatattgttaattgtttgctggttttctatggtggtatcacttgaattttttggctttttcacttgtgtattgctttaccagttagttttatatttttgtgtgtatactttgtgtgtgtgtgtgttttttttttccactcccttgagcatttcttgaagagctagtctagtggtgatgaatttcatctgcttttgcttgcttagaaaagactttatttcttctttatttatgaaggataattttgctggatatagtatccttgggtggcagtttttttcttttggcactttgaatatataaccccattctctcctagcctgtgaggtttttgctgagaagtctcctgttgatgtaggctcctttgtaggtgactagacattttcctcttgctgctttaagacttttctccttgtcattgactttatgcagcttgaatacaatgtgtcatggagaagacctttcgcattggatcactggtcttcctgtacctggatgtctaaatctcttggtagacttgggaaaatttcatctagtatttcattaaataggtttttgagcatttttgttctctgtttccctttgaggatactgataatttatatatttgattgctttatggtttcccatatatcatgacgactttgttcattcttttttattctttattcaattttttttttggtctgcctgggttatttcttttttttttttcttttttttgagacggagtctcgctctgttgcccaggttggagtgcagtggtgcgatctcagctcactgcaagctccgccgcctgcattcatgccattctcctgcctcagcctcccaagtagctgggactacaggagcctgccaccacgcctggctaatttttttgtatttttattagagacagggtttcaccgtgttagccaggatggtctcaatcgcctgacctcgtgatccgcctgccttggcctcccaaagtgctgggattacaggcgtgagccaccgcgtcctgcctggctgggttatttcaaaaggcccatcttcaggttctgagactctttcttttgcttggtttagtctattgttgatgcttttgagtgtactttgtattttttcaaggacttcttcagttccaaaattttggtttgtttcttttttattctatcactgtggtaaactgctcctttatttcctgaattgtttttctgatttctttgtattgttttttgaaattctcttgtatctcattgggcttctttagtatcataattttgaattctttttctgggatttctttttttttttttttttttgagacagagttttgctcttgttgcccaggctggagggcaatggcacaacctcagctcactgcaacctctgcctcccgggttcaagcaattctcctgcctcagcctcctgagtagctgggattacaggtgcccaccaccacgcctggctaattttttgtatttttagtagagatgggtttcaccatgttggccaggctggtctcgacctcttgacctcaggtgatccatctgccttggcctcccaaagtgctgggattataggcgtgaatcacagtgcccggcccagcatttcttgaatttctttttattgggatgtgttgctggagaattattatgttcctttggaggtgtcatagttctttgctttttcatgttttctatatccttgtgttgacatctgcacacctggtataatagttgcttcttcaaattttttatttttttatttttaacttttcttcaacttttgttttagattctaggggtacatgttcaggtttgttacaaagttatattatgtgatgctggagtttggagtacaattgaacatgtcacccaggaagtgagcacagtattcaataagtagttttcaatctttgtcttcctccctccctcctacctcatgtattttccagcatctgttgttcccatctttatgtccatgtgtacccaatgtttagctcctgcttttggattttctttcataggagatgtatcaatggtgctagttgggtgggctctttggctttgattctgggtgcattcagttgtgtagtctctgtattatttctttagctataaacaatatctgtgttatctgtgatttcctccatggtttatggtgtggttattagtggagcttatagtgaagtttggtgggacagggatgctaggcaggccactttttgggccctattggtggtagcggtgggctgatcatacttgttcttaggccccagcacagtgtgcagtggcactagttttagtgggaccaagaggttcaattcttggctccccaggtggcttgctcagatgctgaggtggtggtggcagaggtggggtgggcaggtgagcaagttctcatgtccctgggaatttggtatggtgtgggtagtggcagcagcagtgaggagaagaccctctgggtcccaagcagtatgtgctaatgttgatggtggctgtgatgcagggtcactatccacagccccagacacacagctcttagacttgtccactcttggcagcaacagtactgtactgctatgccaaggaggggaggggccccatgttcacgtatgagtctaagcatggaggccacaccaccagtgggggcacagttactacttacagccccagacaggcagctcctccggcttgtccaccctggcccctggcaatagcagcagtggcagcggctgtagtggtgtgcagaggaggagagaggctcctgttgtatatgtgtaaacctgagcacagagaccactccattggtgcaggcagggtcactgcttccagctccagacagctattatgcttacccatctgggttcctagtgacagctactgctatggcaatatgcagagaaggggaggagatctttccacttgtgagcttgagcacagaatttgtgctgcctttccggtagaatgcacctttggtacactgtaactttttggtacactgcaccattccctgaggagtagtgttttccatgggctagaatactggggaccctggagcacctttgggtccagccagtgctatgctgctgtagccatttgagtcaacactggggttgttagtgggagatcccagaatgtggagatatggggcctctgatttccaggtcaggatgcagtcctatgacagctgtgctctcacagtagtgctctgcagtagcagcttaggccttgggggtgtgactgacccagcatgagttccttgtctggtgcaatgcccttgtgggtctccagatcaccacccttgctagtatcagggtttgtgtgggtagaggagctctcccatggtttggattgctgcagtccacagtggggacatggattgttaaggttctctcacttacccttccctatgataatgagtcccttggggctcatagctgatcttggctgagttggtcacttgcttccttctccttctttgcctcaggtgtttcctgtgactagatcctgttggacactagtgttctcttctagatgttctattataggtgtgattattttggttatatattagtaattttggttctttctggagagggtgagtgtccaatctctctagttagccaccttgaatacatctctgctgaggagttcaggaagagcagaagctacctctatgctcctgctgagtcaggcaatgcctatacctttaattctaccagaattgaagtaacaaatttgtctactttagggcaataaataaagtcaatatacacctgactacaaagcttcgtagactatcaacatcagttacttctgacagcttggttgtagatgtgaaaggaaatgggttcattgtatctgatgctgccgttagaccaagctggcaccacagaagacctggaatttgttaatactgcttaactttcatgtttcctggtacaatcaggatgaagggaactgtaaccactaggtggcatcttttaattagaaaactgtgaatactccattgctcactaggatccttgtggcctacttagcaaagcaattgcctgtgagagcagctggtggcagtctttaagatgcagatttcaaataggagagaaaggaagagataaagataaaaagagaggaaagaagtgggagggcaagagaagagaaaaggagaaagtaaacaggcgtactgtgaaggaagtagtaaaatgccatcagtaattagctcaggaaagtggtatttatggcatttgttgcttaccattgtttcatttctttatttatttgacacgtatttaatgggaattaggaattctggctgaggatacgagatgctgtttctaccctcagagagttgatagctaaagggagtttaaaatatctcaacttaaaatcttgacccccttcctgtagagtatgttaaataatacatgaaataataccttttatttttagttttatttgtttcgtattctctatttcattcccctatcagagaaaagagtttctggagtactctagttgacatactttgaaaattagccccttgagggcagggagtgtatattattgaggaatctggagcatgttgttccatccctgactcttattgatgggggggaatgtccatacgttgaacgaatggtaggatcagatgagaaacctcagcaaggtgtctcctggttatagtctacagccttcctggctctttgtagaatttaggcttctgactttgaatgctttcctgacagcaccatactctcctctgctatatagcacactatcatattgcctgtttacgaggcatttgtgtttctccacagtgatgaattcttttatggtagggtctgtttctaatttaatttatttatgtagtttcagtgtttagcaggtggtgagtgctcaataaattttggttaaatgaatgaataaatctgactaattatagtgtacttggtataagataaatttgtataggaatccttttggagagagttaatttttggatatgccagaaagaccatcctttaagattttttttacatatgtgaggatgattaggcaattactttgagtgtaagatatggtgcactttcaaagataaccagaagatataccagttgtatgctagagatggatttgtagtgccaattctacaaatacaactcttaaaaaagtttttttttcagagacagtcttgctctcttgcccaaatgggagttcaatggctcgattatagctcactgcagctttcacctcctggggttgggtgattttcctgcctcagcatcccatgtagctaggactacaggcacataccatcaggccatgctgattttaaaatttttttgtagagatggggatcttgctgtgttgcccaggctagttataaatccctggcctcaagggatcctcctgctttggcctcccaaagtgttgggattagaagtgtgagccactgcccctggccaactcttttaaattttaaagtggattctgttgcgttgtcttagataagtagcccagctgcagtcttcttgtttcttttttctaaaataataggcactgatgacatctattatttgctccttcaggatctagggcctgccgaggacttcatcttataaagatgagtatgagaactgagacaaggtcaagtagagtagtaaaaggtgggcagagagggatttcactatggcggaattctattataccagaggataatgtcagtaggccaacgtctgtttgttgaatgccagaactttcatattcaagaatatatattagaaaatagatgtcattttattaatagacctttttagaaaggtctatcttataaaggacacattataaaaagccttcaaaaaacaaaaattttaacagctttttgagatataatttacataccatacaattcacccttttaaggtacacaatatagggttctttttttagcatattgacagattgtgcaacgatcaccacagtctaattccaaaacatttcaccaccccaagaagaaaccctgtacccagtagcagccactctctcactctgcatttccaccttccccaagcccttggaaatctctatttgctatctctatagatttgcctgttatggacatttcatgaaagtggagtcatataatgtgtgttcttttgtgactggcttctttcatatagcataaagttttcaaaattagtgttgcagcatgttatcagtattcttcattccttttcattgccaaataatatactgttgtatagatagaactcattttgtttatccatttatcagttgatggacatttggtttattttcacattttgggtattatgaataatgcagtaataagcatccatgtacaagcttttgtttggacatatgtttttatttctcttggttatatccccaggagtagaattgctggatcatatggcagctctgtgtttaataatttgaggaactgtgaagccacttttccaaagtcctaccagcagcgagctagggttccagtttctccacatcctcactaatacttgtcatctttttcttaaaaattacaataatccttgtagtgcttgtgaagtggttatgtcattgtggtttttgtttgcattttctaatggctgatgatgttgagaattttcaagtgtttattgaccatttgtatatctcttttggagaaagtctatttaaatctcttgcccagttgtaattgggttgtctttttattattgtattttaaagtgctcattttatatgttggatacaagacccttaatagatatttgattttcaaatattttctcccattctgtccttttactttcttgatggtcttacttgtagcagaaatatgttatatacacatatatgtaaatgtaatatttatagcataatgaaataaagtagtttagaaggatttgcagtagggtgccatgaaggggataacagttgtcttttattgaaattcaaagctgagccctaaatccatatgtaatacaattatgggaagccaaaaaagaacagaagctgctcagagtgaaacataatgtcctacagcacatgacacaccttcttcctgtctttgtgatatcccagttacaagctagttagagaaatgatagggattggggtagtgagaaaagaatagttgtttcctttggtgtctcaggtaagatatactgttagagatatagctagaaataaaaccaaccggttctagcagagatgacgataattctacttttgtcaaatcaccaccagagaaatctcctctcagttgattaacatcatgtgccgcaggctgtttctttcttttactctaggtatagtgggagtaacccattggcaagaaaaactcatatttaggtggtaaggggaaggcaggtagagaaaatgaagtgtgtctttgacacagtatgaatggaggtgctccccattaggaattgagcaggtagactgtgttgatgaacatagagtaacacgctgggatggttgtggccacttgtctgtctcattggtccatctctcccagtattccatttgaaatccttcttcagccccttaccacagcttcaggttgatattgaaatacaatggtaatagtgagggtattttaaaagtggactttaaagctgagttacattaagaaatgggcatatctggcaagttacaggcacaggtaagtaacttttttttttctttttttgcattaggggtttgaaatagtgcaccgatggccttctgagaaaggtgtctaccttctcaaggtttttctatagaatgacttatcaaaatccatatggattcttgaccgaggcttttcagctggattatgtgaaaagctgtggattttgtaaagaagcctggcatgtgctccagtgtgtttcagtttttaaattttcattttttacagtgtgagaactaattccagactaataacatttatgtgaatagttctctaagctttgcttcctaaagtgtaactgttaagccttctggaataacaatgcagttctcccttcagaaagattctttatgttgatgtcttgtgactggcttaaattcttcaggcactttctctcctggttcctctccacacccagagagagattttagataatcttgtgcattgagcagaatcaagagatgagtcaggaaagttttctaacaaataatacttttgacggagccatacaacttaatttcgattttgaagtgacagtaattgtcagtattgctccttcaagtggagggactaatttgtaatcatgagcatattgcataatggcgacataattgagggcgtaggcctatcctttagaacatagcccccaagagaattgtgttccatacataatataaagatatgttaaggtggttgtgaaactccttgctgtgaaatagtaggggcttctcagtcattttgtgtatagtttgctttgtagatgatgctgtatttcagtagaaaacagttgatgtctcaatgtcatattggcatctgtggttgagaatagctcaaatactattgaattaaacttgtgtgcgtgacagtgtgcttgcccagacggactccttagcactgtatgactcttgagaaaatggtctcacttgacaatttcattgctacctaagatttttatttagtggctgaggaagtgaagtagtgacttatactgatttgccatctagggagataattggtaaacttgggcctgagaaaggaagagatctgttatgtaagaaaaatactgatcaaaagaacaatatttgttgttgttgttgaccagctctgactgtgaaacatttaaagtgtctgggctctaatttgagagactagttgaaaaataatcatttgacatttagcactctgctaggtaccgggaaattagagcaagtaagaaataatttcatatcttgaggtacttatattagggggaagacagacatacaggcagatatttttttctgatatattagataaaggctttactcttccccgcccctgcccccctccatgtggaaacacatacaaacaggagcaaaaaagggaataccaaattcattttaaatacatgtagatacccaatatgtaatatgtgtcatcttactctaggatgtgagctttaaaaaggtggaagccaaattgtgcatgcttttgtatagatccttgcataaactagatagtatatagaaaattgacagtagtaagtgaaatgcttgattccttttaagaaagaaaattccaagagttatgttaagaacttctttaaaaaaaggcaagagtgaaaaaaatgcacaattcagaatagtgatgatcattgcagggaggcaggtagatggctttcggtaggggcccatgtatagcttcactgggattgtgtttttagttagcttgggctgctgtagcaaattaccatagattaggtagctcaaataacaaacatttatttctcacagttctgaaggctggaagtctgagatcagggtggaagcatggttgggtgccctcttcctaattatgtcttcacatggctgttcccatcacagggactccagcttcaagacttaatcgaaccctaattacctccctaaaggccctaggtctaaataccattacattggggattagggttttaatacattaattttgggaggacacaaacatttagtccatagcagattggaaatattttaattcataaattaggtgctgggttcattaggtatatattctgtaattatgcctcataacatacattatatatatataaaaaaataaaaagtatatatataaaactgtaacatttgatagatgcatatatatatatatatatatatatatatatatttttttttttttttttttttttttttttttttttttgagatggaatctcactctgttgcccagcctggagtgcaatggcgtgatctcagctcactgcaacctctgcctcccaggttcaagctattctcgtgtctcagcctcccaagtagctgggatcacaggtgcctgccactgcacctggctaatttttgtatttttagtagagatggggtttcgccatgttggtcaggttggtcttgaactcctgacctcaggtgatccaccacctgccttggcctcccaaaagtgctgggattacaggcgtgagccaccgcacccagccttcccagtctgaatttcttaaaagcttttgcttaggttaagttgtgggagaaaaactgaactcacccagctagccaaactatctctctgttgtctttccactttatccatctattttttactttttttggaaacacaataacaatagtgtagaagtcttttcacattgcctgactctcctgtttgtgtcccataaggttccatgtactctgtccagaactcagcttattatgtcaaaggattctgtctggactggtcagtcagagatataagttctcattacctcagtgtgtgtgtttgtatctgtatttaatgatgtttgtgcttggcttaggctggggattttgaaatctttgcagagtttcccaatttgttgggcagttttagaaatgatagtatcagtaggaaaaaaaaaacacagaaaaatacaatttcttctttcatctatgtcccatattatacaaatgttcgctgaaagcaccaattttctgggaaaggttttgactcagacttttttcaccctttacctctactctccaattcatgtttccttcttacaacgtggtcatatgcttgcccaggcctggcttatgaaccgtgcagaatatttgtggggtttgttttttaagccctaaactgtgcacatgatgcagtatttaatttggaatgagctcttagtttagtcacatgtgcttcttgtggtgtttatcttggaatccacaagtaggagggaagtatttttgcattttatacatctggacattgttcatggtccttctgtaacttgggaattctgtgtgaggcaaaatccaaaaaaacagcattaaaaataacacggagttatgatgacatctgagtcaaaacccttgagaatacccttctgatcccagcagagtttgtttttgaggtggtgaactttttcaattgtgtgtggttcactgctggcctgaggagaatgctgggattataaggttacctgacacccttgcatgtagactaatgggtttccagacattctgaaagtctattgcagatttggcatagggggaagattttgctttttggcttagggggaggattttgctctaattttgcatggggtaaaataggtaaagtgaattctgctcactgttgctatgcctctgccacaagcattctaagagacctgtgagactgtccctatttctctcttaaacttgcctaattacagccagcttagagctaaagttgactctgagaatgcctcgggctctgtgtcaggactgggggtttagtaaccttatccttcccctgatttcacatgagaagttgttttaaacaggattggacatagagatatagcacagtacctcctccttttggctaggggtctgctaaagtggaaaaagtgggaaaggatgtacagaaactcctgctctttgagtgagtttgcatatggacagtattgctttttggccccagcctagttttctttcattcccatgtctcatcttttatgcagctgcagagagcaggctgggaaagcagaatgaaagcttcaaacagatttgcacttgaataaaagaaagagtgatttctcttgttcagagtacagaccagtttgggtagaaaactgtttgcttttttactttctgggtaaggactgtttgcttttctctctttaaatgtagtaaagagaggaaaagctaataaagtagttggacctgctggttataattcatagagaattttcaagtgtgtttaataaagtctctcatataattataacagaaataagtaattggaggggaaaggttaaaatcctgtagaggtttaagaatcagttaaatatgaggcagtgtgcttggatgagacaactaactaggagctgcttctctttgctgatttctctgaactttccttttgagattttttcctctttactttcgtaatgcattttgcaactttcattaaaaaaatccatcaatgtttaaacttctaacaaataaacatatcctagtcctattatggaaatcacaatgtagcagagaatagcttgacttcagctagagagaggttaatgataggaaccctaaggattgataccaagatcatgcttgtttagtgttttaatgactccagaaggaaatggtgaaatctgctgatgacaccaaattgtttttgctgatccaaacaaggatttctgggaagcttcttcagagtatttggaatagtagaagaattgagaaatatggtggcagacacactgaacttaaagtgaaggtttacgtgaagtagcaggagtaacgtcaatacgttgaagttacaaagcctgccaaatcttccaaaaggaagattacggagtctatagtttcatgaaaggaagacttaagacaaagaacatttatacatatagcaaatgaaaactattatgggaatagttgcaattataaagttcagtgacttaaaaatatgatgtctgaatttctttttaaatgtcagcagtagtatatctaaataggtgttgtttctctcgaaatggtcatagaagattatatacccattttatgcatgctcctttcttggtacgttcttttgtcagttttctgtggtggcaggtctttattttgcaggctgttttgaattttgaaacagtcaactgtcacttaaagccaagtgtgataaataagatgggtggtcaaactaagtaatagatttaaatatattaaatatattaaatgaaatataaagtagtaaaacttattttcttttattgctttcaaaagtgattctaaaggacattaccaatgagaaattgcaaaaatgtttgtgtactaatagtgttagattaagttcttggttgatagatttcacaaacatcacttatttagatatgtaagttacagggcttgtactaatacacattttattatattggagacaaaccatgtttataagtgacctttttaaaatgttttctttatgctccctaaatatacacttagggaggaagaaggaggttttgaattaactggagatttccctaatgtgttgaatttttctgactaaagcctacatttttgtaaagaaaaagaccctgtgggataaaaaatacgataggcactatcacaggagctgtgggctggccatctatatccatccatctatctattattccacccatccctccatccatccatccatttatttaattaagttatttttaacggttggctctggagttgacattcatttattttaaaagaacagtgaatcatagctcttttcctcaagatgcttgcttttatttgcatggtggcatattgattaagtactcagaacactatttgacatatggtaagccctcaataaaagtttgttattattatgactgtacttctcccctctaatgtatagaggtaaacattttggttcctattgtgacacgtgggttataatgagttagggcctacttaagaagaaagtggaaagaaagcgggtaaaattgttgctcagatactagcatgtgggtggagatatagatatagatataggtatagatatagatagtgtaggtatttacatctaagtatattgtataaagtgacggattctgaatttgctacatttctcatttcttcagcactctgggataaaaccagcaaaaatgatgtgatctgaacagacacagtagatggcgctgtaggacttagtttttaaagaaaacagtacagccagggggagtgggggcatggagtgggaagaaaactaaagcacattttaatgggctcttttgtaccaccaagacaatttcatcttagagtacgtgcctctaagaagtaaagatttttttttttttttttttttgacagagctggagaataattttaggaaaactaaatctccctgttgctatgtttgtgccagctttgtcacttggaaagtattagttgttttaagccacaaatatataaggaagttattttctttcaaaacattgccttatttatgagggttttgtttgtttgttttagctgtctttgtctctgtattttaatatttttgctcctagcttttttggccctttgttgtttcataaaaacgtggttgtaaagttaatttgaaccatatcaatatgactataatgtcatattttaaaattcagctatattttaataggccttaaaaatacaggtttacattaaagagtaacatagtgtttttgatactaccgtagtgtgtttatgtacttgatcttatttaatcttagtactaattgtatgaattttattattcacttttctaggtaaataaactatatcagagatacttagtaacttgccaagctcacatacctagtggttgaactagtagttgctgcaagagtttcgccagcatattaaagttgtattttttgagcacttactgtgtgccaggcaagctaaccactggaaatactatagtgtccaaagctgacctggaccctgcccttatggaccttacagttattagataccccacagacattttttgaaatctgctggattgagagtgggtcatgaagatgaatttgaatcattgtgattgttggataagccagagagccctttcaccaaaaagaaagtaagaatcatacctaccttgaatatattactgtattaaaatatttgttttagttgtactccctgtagccaagggaaaggcaagacctcctttggctacaatgagtaactaaactgtcttctagataagaatcaggaagagtaaggaaaatctggctatactataatgtcaaaattttccactgattaaatggtattaaaatatctaaagcaagaaggtgttagttagcagtggaagtctgagagattaatgtggtttgtgtacagcctaagaccatgttaacttctaattggcttctctagtgccatttggtgagatcttttagagtacagccagcttagtgataccccaaattgccaagtacccctttcatcttgggacattaattgtcaaaaatctttgaattgatttttcttcagaaagcttcactttattattttcacacaataccaagttctcatgatatttatgggtatgtgattggtgagaaaacagaccaagagttgttttttgtttgtttgttttttgtgacgaagtgttgctttgtcgcccagactggagtgcagtggcgcaatctctcctcccgggttcaagcgattctcgtgcctcagcctcccgagtagctgggattacaggcacacgccaccacgcccagctaatttttgtatttttagtagagatggggtttcgtcatgttggccaggctggtttcgaactcctgacctcagttgatccacccgcctcagcctcccaaagtgctgggattacaggcatgagctaccatgcccagcccagaccaagagttttaaattgaggtccatgattgggtttcagtaagtgtatggaatgtctaaaattatataaaattttatgtgtatgtacttagaattattctgggaagaaagtccatagtctgcacaaatttctcagtgagtttcataacccttaaaaggttaaaagtggttgtaactagactttatcaaaaggggtgttcaaaagtcactccagttcaggattgtggaaagataactgtcttctcaaataggcatcttagaggaagggctgtttgggttccttttaagaactgtaatcttgagatgtggagtgaatttgggatttgaaaatcccaaaatagagttttggaactctcagctcttagtgatatattctgttttgaaatgagggatacctttcggggaatttgaaaatacttttttctaattcaacttttaatcagataaatgattatttttgaaaaatgaaatagaaagtaataggaaagggggaaaagttgttatgtctcttcgtggaataaatagctaaagaaattaatttctaaattttaaatttcatccctggttaaaatagttcctcttttttgttgttgttgttgttgttgttttttgttttgagatggagtctcactgttacctaggctggagtgcagtggtgcaatctcggctcactgcaacctccgcctccccagttcaagcagttctctgcttcagcctctcaagtagctggggctacaggcactcgccaccatgcccagctgatttttgtatttttagtagagacatggtttcaccatcttggccaggctggtcttgaactcctgacctcgtgatccacccgcctcggcctcccaaagtgttgggattacaggtgtgagccactgcacttggccaaaagagttcttttagagaaaacaaaagtctttgatataagcaatatgatcatacaaatggatattgtgcttttttaaaacaaacaaaacacacaggtttaaggagagaaggtatggatatactacttctgtcttccctatcttctgccatattctaagctttgcatatgttctcctgaggaacaggatagttataacttaaacttgcatttatatatttctgattaagttgttaactatggttctagatagaagaataaagaagtaaaattagatttcttaatttgatatatttaagtcccttattttgatctaatatatttgataaaatagtaatcttttaatagtagccctgttatacataataataatacctatcagatagggttgtggtgaggattagaccatatagtaaatgtaacatgtctagtgctgtgccctgaacttaacacgtgcttattaaatattaactattgctattaccattatcatcatcattaataaacatctatattttatatccccatgacttaatgtacagtataaagcataaatagtaaaattacccaaagacaaagaggaatgggaaggtccagttgattagcttcttgtttagagaagcagattattccgggggttaggaaatagtttcctgtaaggcatgtttagctttcattcatggattgatggcaatataaatcgctcttttgatgtgagaaaaatataatgatggcattacatcaattataaatttcatgagggtagggactgtgttcggtttaccttgtgtccttagctcccattttaatgtctgacccatggaaggcatttcattaaatatttgttgtcatctgtctatgttttcttctttgtctttctttagcttccaaaaagagttgtttttatattcataatttcttatttcatcagtaatgtgactcccctagaagtattggttaaaatacagatctttcttggaaggagactgttttgtttgaagcaaatgacttgggagatgacttaagaacattcaggctttaggtgtttttgtagaaagactaatatttggtcctaaaaaacaaaaaaaacttatcttcatctgtcagaaaattcctaatgtttagcacttaagttgctttgtgttctgatgtatatattataatggaaaaatctgcagcctaaaaggtagtgttttcaattagatatttaagaaacactttctactctcctactttagaggaaaactttacatagcccatttatcttcatgtcttcttgagtcagcaaaacatttacaactataggaaagaagatgtttttcagaaatgaatgctgatcaaaaagaagtatagctactgtggcaaaattaggtaaatagttctatttgttaaggaaaaaatctgtcttgtggagttgtatataaagtacgaaattgaatatatagttatatgttagtgttcctattgcatactagagtctggatatacataggctcagagtaatttgttatggtccacaggaatatatattttaagatggactctcctaagagtgagaggtgatcctacagccagtggcttgcttggttgtaggatcagatgtgattaagttcagagaggagacattttgaacttctctggttgtagaaatgctgcctccctatttcctacaaatatacagtgaactctggatgtcttctgggacagagtagaaatacttgcaacaggaattggggtctggagatatatgcaacccagcagcactgttataaatattttggttttggtagcaaatttgcttacagtatacagccataccttgtagatatggtgggttccgtgtcagaccatcacaataaagtaactattgcaataatgtgagtgatacattttttttggtttcccaattcatataaaagttatgtttatactacattgtagtctattaagtgtgcaataatattatgtcaaaaaagcaatatataggccgggcacggtggctcactcctgtaatcccagcactttgggaggctgaggcaggcagatcacaaggtcaggagatcgagaccatcctggctaacatggtgaaaccccgtttctactaaaaatacaaaaaaattagccgggcatggttgtgggcgcctgtagtcccatctacttgggaggctgaggcaggagaatggtgtgaacctgggaggcggagcttgcagtgagctgagatcacgccgctgcattccagcctgggtgacagagtgagactctgtctcaaaaaaaaaaaaaaaaaaaaaaaaaaagcaatgtacataccttaatttaaaagtttttattgctaaaaatgctagtgatcatctgagccttcagtgagtcataagctttttgctggtggagggtcccctctcaatgttgatagctgctgactgatcagggtcgtggttgctaaaagttggggtggctgtatcagtttattaaaataagacagcaataaagttcattgaatgatgcttgaatcaattgactcttcctttcatgaaagatttctctgtagcatatcatgctacttgatagcattttactcacagtagaacttcttttaatattgggatcagtcctctgaaaccctgccactgctttatcaactaaatttatgaaatattctaaatcctttgttgtcatttcaacaatgttattagcatcatcacccggaatagtttccctctcaagaaaataatttctttgctcataccttatccctcatctgttcaagtttggtcatgagattgtaacaattcagtcacatctttaggctccacttctaatttgagttctcttgctatttgtatcacatctacagttatttcctccactgaagtcttaaaaccttcaaagtagtccatgagggttggaatcttcttcgctcctgtcaatgttggtattttgacctcctaccattaatcagaaatactcttaatggcatctagaatggtaaattctttccagaagaatttcaattttctttatccagatccatcagaagaatcacaatctatggcagaaatagcattacgaaatgtatgtcttaaatagtgaaacttgaaagttgaaattattccttgatccatgggctgcagaatggatggctgtgttaagaggcatgaaaacaacattaatctccttgtacatctccagcagagctcttgggtggccaggggcgttgtcaatgaattcttttcaaaatattttgaaaagaatcttttcttctgagcagtaggtcttaacagcgggcttaaaatattcagtaaaccatgctataaacagatgtcctgtcatccagaccttattgttccatttctagaccacaggccgagtagatttagcataacttttgggggccctaggattttcagagaatggccagtgagtactggcttcaacttagaaagttgccaactgcattagcctctaccgagagagtcagcctatcctttgaagttttgaaaccaggcactgacttctgctctccagctatgaaagtctgaggtggcattttccccccacctagtgtgaggctgttttatctgtatggaaaatctgtcgttcaggatagccaccttcatcagtgatcttagggagatcttctggataacttgctgcagcatctacatccacacttggtgctttgcttgcacctttatggaatggcttctttccttatacctcatgaagcaacctttgctagcttccaacttttcttttatagctttctttcctctctcagccttcacagaattgaagagagttagggccttgctctggattaggctttggccttaaggtaatgttgtggctggtttggtcttctatccagacatttggtcttcttatcagcaataagactgttttgctttgttagcatttgtgtgttcactggggtagcagcacatttaatttccttcaagaatttttttgtttgtattcacagcttggctatttggtgcaagaggcctagtttttgccctgattcagcttttgatacgtcttcctcattaatcttaattatttctagcttttgatttaaagtgagagatgtgtgactgttcctctttcttgaacatttaggggccattttatggttatttcattttttttccatttttttgtctaacgtgattcagagaaatgtagagttattaaatggactaattttcatatttttatgtctcagggaatagggagcccaaaggcaggcagcaagacaggagaatggctgtcctggtggaacagtcagaacacatagacttatctattaggtttgacatcgtacaggagtgtggttggtggtaccttaatagtaatatcaaagattgctgatcacagatcatcataacaggtatgacaataatgaaaaagtttgaaatattgtgagaataagcaaaatgtgacacggacatgaaatgagcacatgctattggaaaaatggcagttatagacttgctcagtgcatggttgccacaaaccctgaatgtgtaaaagaccacaatatatgtgaagtacaggtgaggtatgcctgtacgtagttggtgcctgtagttttgtatccattgaaatatactgtcactcattgggtctgcaattgggtgtaataataatatcattttattgttaatgggctttgagtcttcctctttcttctgtgatagtttgccattgtcaagttaaatttttatgagctttttcagagcagaaattaaacattaaatggtttattaaccaaaataaggcaactgcctttagactttaatgtagtacccattttttcctacagcttatcgtcttcccagtttaaaaggcttaagcagaagagtaacagtatagttaaaagtttttaagttacaaagttggaacttgcctttttttgattatatgatcccaagagtcacaagagagtaggcagaaagattactgctttatcaataggtgaaagttcaggtttatctgaatttagaatattaaattgtactttaaccataccacatgtttttataacatataaatcataactgacttcatactattctgttattttatgaggtgatctgatgtggctgcaaagttgttaaagttaaccttgaagaaacctcctatggcttagtgtttatttgcaaaatcaatcacattttttcttctgccttattagactgatgaaatcattttctagcatatggaaacattcctggacctcctgttattttgcgtaaataaccccatgtgactcacaaatgttgaaaaagcagtagatatttccaaatgctattagaaccatcaaactaatacaaaaaattcttcggtgggacaaatgaagaccagaatgaagtctaagtcactgtttccagtgaagattagtcactttttccactctaattccagaatttctttaatttttcttgcttatgttagcaacagtattgtcacaaaagattcaacagtcatctcctcaggtaaccaattgttacacaaaccatatgtagaaaatgctcactggcttcatttatagaaaaaaaaaaagataactggaagttagaaacagttgtccaaacttttgaactataataagctattttgaagtgtcattgtcaatacaaagtacataccagtgtgagattttaagcagtaataaaatctatgtgtggaagagtaaatgaagcgtttctgcaatattaatgaacggacagatatatgggaagaagtgatattaaaccttgccatacactctgacaatgtacatgaacagagccagtttgcttgtaaagattagtaacatatcattgcaatagatgtgcatcctgtggtctaaacttattcctaaatgacatcttgaagtttggcctgtccaaaaacatcttttgaggaaggacagatgctatagctgctttcttcaaggaaaaaaaaaaaagtaagtgacatcacaccttgttttaaacttaatgaagtgaagtaaggatgtcctctgaaaaactggccggaagtaggagtagtaggagggggaggaaaaggagaaggaagagggaaagaagctctttaagaaatagaactagttgaaaatattagtatctaatattgtcaggaacatgacatataagagattattggcagagtgcaacttcagaactcttagaggattctaaaagcaaaggaaaaaagttttttagtttagtttagtttagtttttttgttttttttttaataaatgcttactacttctgaatcagacattctttggcatcttaaactgaatgcctgtaattacattagctgttttgtgagacttacatatattctagtcctgtctagtacagaacactatgctaagcattgcagaaagagcaaaatggatattacttctgtcctcagagaacttatctaggaagaggtagaatataaatattcaaacatctatagaaaaagcagaatcaaccatctaagaggactgtgtagacaagacagatctaatccttttattaacataagtgcttcatgaaggaagtagatgtgaactggacattatggtgtgtgttgaatttggacagattaagatgggattggggtaggagttaggcttttgacaaagaaaacagcatgggcaaagatggagcagaggtggagatgtaggggatatttgggaacaggaagcctgatttagggtgaagtataacttttatagaggagaatggtgggagataaaatggcaagtaaagcttagagccaggtcatggagggttttaaaaatgagaatgaagatttgaactttattctctagcagtggggagtccatgaagactttttagcaagggcttggtaggagctagtagctgtgctttagaatgattaatgggaaggatatagtggagtcgggagaggttagaatcaagaattaaaattaaggggccattgcagaggcccaggtgagagagaataaggcctaacataaggtgtggcagtggagacggaaaagaaaagtgaagcatctggtagacagaatcggtagaactgagccatgattgtatgtgggaagtgagggataagagaattggaacaatatttgcatctgagtaactagggcactggttgtaccattaacagaaagaagaaaattaggaagaggagctgatttgggaaattaagaagatgtattaagtgtttgagatgaatgtgtaggggcatatgagaattgcaaagaagagaaagggacaggaagaaaagactgaaaagaaatgtgtgctttgagaaatacacacatttttgagtttgaatagaagaaaagaaggtggcagaagtggtcaaatcagggagaaagaaatcaggacagcatattattaggaagtctctcttgaggtgtgtgatcttgttttactccaactactgtggttttcattgtccttgcagactcttctgtactccatggttatagtaacgctctaactcaaattaattccattgttctttctattgaatcatcacagaagctgttaggactgataatccacagaatgatatgagggatcagaggcttacattctcaatgccaagattatatatactattcctgaccttaccaggtaggtaagattctttgtgcttaattccgcactcaggacagacttggtgagtctgttgcttattttcctgtatcttattagtgagggaaataatattagccattttgtaggtttggatgctgactctcgtgtttgctttctaaatcagcacctgatctggaaaccaagagatgaaagaatttcagtgagaggctagtcagtagcatcatatggtccactctccagaggagaagacagatgaaggttaagaaaagactccactaggtttggtggttttgaggtcactgatggcctttaagaagatagttttaatactatgatgtgggtgaactaatccaagaagttaaagaataggtacattttaaagaataaactttccaacacagactactctttcaaggatttaggagatgaatgggaggatagagatgaaatgttagctataggatcactagggtcaagggaagacttttttcttttctctttaaattgaaaaaagtaagcatatttgtaggcagaggtaaaggagtatttggagaagaagagaaagaaagtactggggagtagggggttaactgttggctgatagatcttggaggaatctggaacaaatgatatcaagtatataggttgagttattgaccttgggaaggaatgtttagagatcagaggagtaagaggacaggagatgggtggaggtatagggagaggacagatgctgagggaggatatatcagacctcaggcatctcattaaaaaagataaggccattggccaagaatgaggaaaaaagagataggagaaaaggtgtaaaatagttgcagtgggaaataattaaaatgaggtaaactcagctgaggacagatagttgattttatttcttgcctttttctagtaaaattcagttttactagaatttgtttttgcttaagaaagttccatgaaaggctgcattcagaaatatgaagaattttattgtcagctaattcatgctgatgtacatatcttagatccagaaatataaatgatgatagtactattactacttagggctggatcacaaaaagccaatatgcacttaggatttgaaggtactttcaaatgttataaggaaacagtttcatcagggagtagttgtaggaatgtagtttggaattttgtcaagcatatcttttctgtcaatcaaaggcatggttttgtatgacacagtgtctaactcttgcttctgatttcttctgtttatatgaaagatatttctctaggtttggaagtataccaaattacatgcctaatgtgtaaaagatgtttgacttaattcaagaagaccttaattttcagaattggtgatgataaaaatgaaatactacatatatcaattgctgatagttcagaaaaataaaacatattagattctatgtagctaaaattaattgtatttaatgaacttgacaaacactatagaacaaagcagaatttaccagcttagaggactgtgtagacaagacagatccaatccttttgttaacatgaatgtgtcattaagaaggaacatgtgaactggacgttggagtacatgtagaatttggacagatgaagatgggattggggtaggagtttggcttttagcaatgaaaatagtgtgggcaaagatggaacagaggtggagatgtaggagatatttgggaacattctttccctagttcctttcctgaaagtaaggactttaggtagctttttgacactgtggtggatactcagttcaggtaacatctttttttgttttactttaacttggttgtctgttttttagttttcacttgttatacttaaactgggaagaaaatttaaaaaaacagagacaccagattctttaaattttaagagtcagtattccctttcagtttaactgaatgttaaatgttttaaaatgttaagtatctggccgggtgtggtggctcacgcctgtaatcccagtagtttgggaggctgaggtgggtgaatcacttgaggtcaggagtttgaggccagcctggccaacatccctactaaaaatacaaaaattagccaagtatggtggcggccacctgtaatcccagcttcttgagtggctcaggcaggagaatcgcttgaacctgggaggtagagattgcagtgagccagatcatgccaatgtaccccagcctgggcgacagagcgactccgtctaaaatgaaatgaaatgaaataaaataaaataaaataaaatgttatgtgtctactatctataagatgatgatgagcaagataaaattccttttctcgaaaagtatgtaatctgttaagagacatttcacgtaggaaatttgaattatttcagtaaactatactttaaagggcaatcaatatattaaacaatataatcaaaccaagtcatgcataatatcttatattcctattgtaactaagagttgcactgtccaatatgttaaccactaactgtatgtggctattaaaatgaatgaaaaataaaattgaaaatttagtttcactagttacatttcaagcattcagtagctacatgtgattagtggctagtgtagtggacagcatagatagtgagcatttccattattgtagaaacttctgttgggtagtgcagctctagagctatagaacatattttaattgttttggacaggcttgtccttcatctcttcaacaaaccttcattaaatgcctaccatatgccaggtgttgtgatagagtgagatgataaagtcctagttcctccttacacaaacctttcaatcttgtgggacatcaagtcagtgaatgggtgaataagatagaatgtgataagcatcactataagaggagagatacaagaggatgtgaaaatacacaaggaaaagtacagaagcaacacttaaggtttccttttgtagaaaggtgagtaggtgttggcatggttaagttggagataaagcagaatccaactgcaggaaatgcttggatgtgaaagaacatggcacatttgagggactgaaagttgttgactgtatctggagcccagataatttctaaggtctcttaattcacagtcattattaggatacatctaaactatttaaaaaacactccttcctttttcaaaaccaaagggacaaagatccccatgcaccttccatctatttggggagcttcttatttttatatctgtggatcctacagtcaaaggaaggcaagagaaagtgaaaagaaaataaatttgaaaaagaaggaccaaagaaatgaagatggccagaggaagttttagagaaataaaacaggtaacatttgatggagaatgatagtaccatttataacactcggatcgctgtctccagtcagaagtgaacaccaaccattccaaaagctagtgcccccaaatagtttacttggtatgtgaaatataatatgtgagaatattttttgatatgggatttaaaaattgaatttctgccctggttcatttcagcagaaatcatagtagaatttgctttactgtaattttcgtaaatgtatacctttgtagtgtatgcaatatggaagaaatttacattctattattttgtttttatagaatacaaaatagtcacagtcaggttaaaacttacatgagaagtcagagagagagtaggatcaggaaacaaaagaattgtacgttcattcagtcctcaccaattacagagaatattatatgtattatacaaaatacattgcacataataaatctctcacattttgtaaatatttagctgttgttgatttatttctgggctaatggcagccgtcacgtctctggtctgtgttgggaatgtctgtttatatgtctgtgtcacatcatctgctctagcatggaggcttcatggaagacaggaaccatgtctgtttattttgtgtgatagtaacatggagctctatatatgaagctttatttttatttgatgatgatgatggtgatgattttctgtatgaatttctttcctggcttcagattgattgaatcttctgatcactattaatccagtggaactcagaagtggagtttacttttgagtgcttagcctggctaggcagcaggcttttgcaaacacggctatatgagatcttatgccaccacaaagaggcactctcttgaaaaaagatgaaaaatacagagaagccacccacattggttttcatcaaggaaaagtttggtgtctagtcttaccaccaagtgcttgtcaaataaacttggtttgaagtcaagactgaatacagtaaacaaaaaactcagataaaagctatagtaaaaaacaatatttctctttattttcattccttttcttatttgggacaaccttttgaatagtgtgggatgattgaatgtaaagttgatgaggtgaaactgtagccaagtgaataaggtctcagtgctttttaaggatgccctagctctaaacaaattttactattgtatcctacctgtaaaatatttgtctttgtaaacttgcatcactctaaattataaaactgggcatccaaagtcattcatatggacacaactattaagtttagttttatttgttagaatgttcaagatactactgataaggaagcttttaaatatttccttgaaaacctttctttcctctttcaccttgcctctactgccctttctctagatcgatcatgaatttttctattatatttcaaagaatctttagggtttacttgccacatcttctattggagtccatttttcacatcacatttttttgtattaacccattataaatgatactacttcttgtattatttgatttctatgttcatttttatgttttattctataacctattgaggtttatacatataaaataataatcacctgctagtgttaccaatgctgattatgatttttgaatttttagaatgtttgtgtttgattctcctgatttcctttggtcaatatttttttttttttgagacagagtcttgctctgttgcccaggctggagtgcagtggtgcgatcttggctcactgcaagctccgcctcctgggttcacaccattctcctgcctcagcctcctgagtagctgggactacaggcgcccgccaccacgcctggctaatgtttttgtatttttagtagagatggggttttaccgtgttagccaggatggtctcgatctcctgaccttgtgatcctcctgcctcagcctcccaaagtgctgggattacaggcatgagccaccgcacccggccaatactttcttttgaaatttatgttagccttgaaaaataatggtaagccgggtataaatatgctgatctaaaagtgttattagttgacatagttaaagttgataaaacagtcaaaatttaccatgctgtcttctttctagcatatctatattttgacaatgaaaatggttctttactaattatatatttgcttattcctgccaataataagacattctttgtaaaagcactttaaaacttcatagaaatatgaccgggtgcagtggctcatccctgtaaccctagcactttgggaggccaagacaggtggatcacttgcggtcaggagtttgaaactagcctggccaacatggtgaaaccctgtctctactaaaaatacaaaaaaattagctggccatggtggtggtgggtgcctgtaatctcagctgcttgggaggctgaggcaggagaattgcttgaacctgggaggcggaggttgcaatgagctgagatcgcgccactgcgctacagcctgggcaacagagcaagactccatctcaaaaaaaaaaaagaagtgtgtgtgtatgtttgtgtgtgtgtgtataatagaaatatgcaaacataacgttctatgttaagtgtataaatatactacttgacagaaataatactgtttctgttgagcagatgcagaatcaagttcagagaagttgaattgcttgttcaaagtcatgtaatagtaggagctgagcctcaactttataaatggtttgacactactttacttgatctttctataacatcatttcatctcttcctttaaaaattcagaatcgttatgattgtttcctttgtcacctttattttcttagtcatcaagaagactcttgttgttttcagctcagcacttcaggagagcctatagtttttatctttcactttagaaaaatagatttttgttctaggaccctgtcccaagattttaggaatttgatagcatcaacatgagtttagatatagcagtttacccacagtgtatctaggataaaataaatttaagataaatatatttgcaagaacactggatagaacttagatatattaattaacaatttgccacactcagaggaactgccttttttctttctttttctttttttagagacagggtctagctctcttgctcaggctagtgtgcagtcttgcagtcatagctcactgcagcctcaaattactgggctcaagcaatcctccaacctctgcctcccaagtagctggaacaacaggcacctgcctttatgcctggctaattttttaattttttgtagagacagggtctgactttgtggcccaggctggtctggaactcttggcctcaagcaatcctcccttcttggttcccccaaaatgttgggattacaggcatgagccactgtgcctggctacagaatttcctaagttattatttgttcgtttgttcattcattcattcatttattcaagacagggcctcattctgttgttcaggctgagtgcagtggcatgatcatggcttactgcagcctcgacttcctgggctcaagtgattctcccacctcaacctcccgagtagctggggccacaggtgtgcgccaccacacctggctaatttttttatttttatagaggcagagtctcgctatgttgcccaggctggtctcaaacttctgggctcaagcaattctcctacctctgcttcccaaactgttgggattacagacacaagcgaccatgcccagttggaatttccttttttcgatacagttttgatgaagaaattttctgagggctatacttgctaaagcttgaaacagaagaacaaaattggtcactaagaaagtaggagaggttttcattcatatccactgtgtatctgtgtctcagacaaagatatgctggctatcagaatgctgacattgcttactttcctatttttcaaagactgaacaccatacacatagcttgaggaaggatattattcttgtatacattttgacataaagatgtttagtccttggctggatatttcagttctctgaaaatgtgtagctatcctgtgagaagcaaacatcttggaaacagtatagtatagttgaaggaaacggtcctaccgtttccttgcttagacaaatcatttcatctcttcttttctcagtatttttttttctggaaatctactctttttctagaaatatgtatacaacatttaaatttgcatgtgtctgtcaacatcagtgtgtaaacatattatgttcactatgaaaacatttaggaaattcagataggcaaaaaggaaaagagatcgctgactacagcagaaaactataacattctgataaagttagataaaagccttttgggcttttatagtacatgtatatgcacacatacacatagactcacacacatacatgtacctacaaataacatcttaaaatgagttcatattgttaaaaagtgagtttatatagctaaggaagcacatctgaggacaagaacacctctattgcaaaactaacagatgatatagaactagtatggaatacaatagaggtgactaaaaatttaatggtttggagtgaaagcgtggaataatcacggtaaacacaggagtaagacacaaagatgaaagcaatttggttaacaatgatctgatatgaagttgaaaggattactggtgtctttgaggaagtggacccaacaaatcaaactaaaaaagtatttggagaagtgatatagcaaaacttcactgaaatgaggaactgaacctgcagatcaaaagatacattgaatcctgaaaattggtagagaaggttcaacatcatgtcatatcctgattgttgccaaacaagagaaaggtttcttcagtcatgtaagcaaaagcaaaagttatctataaggaagaaaagcaaaagttatctacaaggaagaagtttagactggcctcagacttcacaacaatgtgcaatactacaggagctatgtcaacacagttctgataaaagaaattacggcccaagaacagtgtacccagccaagttgttgttgaggtataaaggccacaggcgtatcctctcaaatgtgaaagaacccagagaatatagtatctgtgagacctttctgaaaaagaactaattgttgaaatttagccaaccaagagaggaatcaaaccaaaaaagtgttgtgatattaaataccttcatatatatatgtaagatttagatactgtagaaagtgtggcagtacaacagactgtaaacactctacatcatggcaaagtaaaacaaatatatacaataaaaattggaaggtaggtagaagggaaatgggaatgagagattattaatcttattcatagcaacaattcaatcagaactgtctcaaatgtaaagtagtttaaaagtaatgttaatctattctttgtggttttgatcatttttcttaaagttagagggactttttcacaattaatgtttcttgagtgaagaaacatttgtctaagatttaaaatttcttcagtttcatttcggcttctgttaattgcaggtaaaattagaattgatattttttatttttaactgtgaatataatctcatcccagaaagaatacatttatttctgtccatccattatctatgtgtatatgtgtatccatgtgtatagaattgatattttttatttttaactgtgactataatctcatcccagaaagaatacatttatttctgtgcattcattatctatgtgtatattccagttgtctggaataatgtcactaattgctaatctaatacctaatatttctcaatggtgagattttggatgatttaatgcatcttttctgtgtattttttgtagtatttgaatttatataatgagaatattttaaagaaagtgatacaatgaatttattgctctgaaaaatgaataaatacttacgcagttttatagcctcatttcttttttaacttatcttgaccccttttctcttaccatcattttaaatagttgcacagtattttatggatgtgttaatatatttcttctttcattcctgatctcagtttcttcatctgtaatgacagagctgaactagattagccggttgcaatctttctctttaaactatgaaatccttccaagaaataaacagtttataactcttggcttaggcatttcccatagaatgtagtttcaaagctgtacagattagataatttctgaggcttatttcattttaccaccaaaaattagggtttttcttttttttaggatttttttgagtgactttttcatgtgtttaaaaaaaatcggtaacagacataatcttatgaatcagaattttaaagtgaaagggactttgaaaaccatctagtatatttgcctaacttttatacatagggaaaccaaatttaagtttttaaactaacgtcatacagccaactgaaatgaatgagacttgagtgcacatctcctgactttctatgctgttcttttccctacagtacacataaatatatatacatatatatttatacaatgatgggcaaacaagatgacaattttattgtactcatgtcacatttaaaccatcatgtaaatgtcaggaaatatgcttaatttatagtgtatttattttcttgttcatgaaaagagatcagtactgcagccattattgaactcctagagttagaaaggaaagtgagtgggattctggcgagaaagaaagcatttacttgtcaaagatttggaatttactgtggttaccaaaattaaaataaaactaaaacttgacttggcagaagattaaaaacaaagcagctccaaagtgtgtgcacatcatggagaagatgccattattccttcaggcagccaaaggggaagggaatattgtttctttgcgttgctggagctgatttatttagttatgatttcaacatgcctacagggcacaccccagaaaacattacacaacaacattaaccagaacaaatggtgctttctttttctgtatctcctcctaaggttttttaacagcagtgaggttttttctttttctttttttttcccccatattgttaaaatggctctgattatgtttgactattgggtgtggcaggttttagaatgttaagtggtagtacaggttcctgaacaagaaagagaattagagttgatgtgacttgattattggaatgtgtagaatgtaaagttgtgagacatacgacggtctaccgcaggttgctcttagtaatggaccttcttgttaaaagccctgttattattgggaatttattttggaaactactaaagaagaaatttgacagaaaagtaaaacaaaccaccttgtctcatatttcctttctacacaggcactttgaagagatatcttaaatattgtcaagtctcaattatcctggcacacgttagcattatcaccattctcacaaacttgaattaaatgcacatggtattgcagcaggtgcagcacagagaaaattggcaaacaagatccttatccttttggagctcagtaagggttgctatcctagtaagtagttcaaccaatcccaaactaatttttccggatactctccaaacaccctccctcccttcctatatcctctgtcttcattagtggcctctccatcctctcagctggaaacctcacattcatcttgagtctttatgttcccttggtcttcacaaccaatctgtcaacaagtcctgtttcttctatcactaaaattgctttttgactttgtttgtactcttccctccattctcctagccattgccctgtttaggcccttttcatcttccatttcagttcttggagagctgcttatctacttttaacctttccattttctaatccatcctccatactcttgtcaaatctctttctttaaagacagttctaatcatatcactctctggtttaaaaacctttgatgggtccccattaacacataagggataaagtctaaactccttagcttgtcatgccagggtttcagagtctggctctgatctacttattctcatctcattacctgccataatttcccccttaccgtatttcccattgccagacgcacacacacatgtacatttactccattcccacaagcttcctcataattccctgagcttgctatgtaattgtgcttttgatcatgcctttccttgccccatatacacagaacactcttccctgacaaactcttgcttgtatagaggaactgaggaagccaagattttacaaagagtactcttgacaaaagaaataaaccacgtgcatagaccaagcagtagggccaccgttagagcagagttcagactagtggctgccgactagtttctcttgggcaaaccaggaagaaggactcaatcccagaaggtactggcattatagcagtgattaaattggtttgcaatagtattaaatgaatgcctccttcctatttatacagccaagagttagcatttacttttatagctaaaggatagagggaaatagctacagtaggtttctggcatagtagttaatttcaagaattaaaagaaaactcattacccttatctacctactactcctaccttatctcatgttccaaaggtgtaaagaatgattaggaactcacaggaccacgagccttcacactcacattggtgctttttaaaaatcaccaggatagagccagagatgatgggtttaaggggtaaattgaaagagggaaatagcagctctttacctcaagttactgaggaagcagaggcctttttcatgctctgcctagtcatgcttctccctaaccattgcatctttctgctcaacctttgtcctttttatccacatatgattcttttaaaaaattagttcttactatataagtattgtattaacatagtatcttcaaaacatgtggaatgtttgtaaaggcttctctgacattctctcaccaccatcatccccaatcccagctgcctacccaccaatgccagaaaatgacaactattttcagtttggttttctgttgcttcagacctttctctatgcattgacttagagatacatgttgtggatagacaaataggcttatgaaatatagtattgctgtgtgtgtttgtatgtgtacgtgtgtgcttgctttcctcacagaatcagtatcatacttactctgcctctcagtttgcaaacttgcttttttgactctgcccgtagatcttggatatctttcctattagtatgtagagataatttatcacagttttttcaacttcttacatacagtattatatttaggtctagcttaaccctttcctcttctcatagcaatctgatatggacaattagaagagaaaaaaattttagtaactgtgttagtttgttttcatgcagctgataaagacatacccgagactgggaagaaaaagaggtttaattggacttacagttccacttggctggggaggcctcagaatcatggtgggaggcgaaaggcacttcttccatggcgccagcaagaggaaaaatgaggaggttgcaaaagtggaaacccctgataaaaccatcagatcttgtgagacttattcactaccacgaaaacagtgtggggaatactgcccccatgattcaaactatcttccaccaggtccctcccacaacacaggggaattatgggagtacagttcaagatgagatttgggtggggacagagagccaaacctcattcagcctctggccccctcaaatctcatgtcctcacatttcaaaaccaatcatgccttccttatagtcccacaaagtcttaactcatttcagcattaactcaaaagtccacagtccaaagtgtcatctgagacaaggcaagtccctttcgtctgtgagactgcaaaatcaaaagcaagctagttgtttcctagacacaataagggtacaggcattgggtaaatacagccatttcagatgggagaaattggctaaaacaaaggggctacagggcccatgcaagtacaaaatccagtggggcaaattctaaagctccaaaaagatctcctttgactcagtgtctcacatccaagtcatgctgatgtaagaggtaggttcccacagtcttgggcagctctgcacctgtggctttgcagggtatagctcccctcctggctgctttcacaggctggtgttgagtgtctgtggcttttcaaggtggaaggtgcaagctgtcggtggatctaccattctagggtctggaggatggtggccctcttctcatagctccactaggcagtgtcccagaagggactctgtgtgggggctccaaacccatatttcccttccacactgccctagcagagattctccgtgagggccctgctcctgcagcaaacttttgcctgggcatccaggtgtttccatacttcttctgaaatctaggtggaggttcccaaacctcaattcttgacttctgtgcacctgcaggctcaacaccacatcgaagctaccaaggtttggagcttgtactctctgaaactatgcgctgagctgtaccttgaccccttttagcaatggctggagtggctgggatgcagggcaccaagtccctaggctgcacttagcatggggccctgggcccagcccatgaaaccattttttcctcctaggcttctgggtctgtgatgagaggggctgccatgaagacctatgacatgctctggagagattttccccattgtcttggggattagcattcagctccttcttgtgcaaatttctgcagccagcttgaacttctcctcaaaaaatgggtttttcttttctactgcatcatcaggctgcaagttttctaagttttatgctctgtttccttttaaaaatggaatgcttttaacagcacccaagtcaccttttgaatgctttgctgcttagaaatttcttctaccagataccctcaatcatctctctcaagttcaaagttccacaaatctcaagggcagggacaaaatgctgccattctctttgctaaaacataacaagagttacctttgcttcagttccaacaggtccctcatctccatttgagaccacctcagcctggactttattgtccatatcactatcagcatttttgtcaaagccattcaacaagtctctaggaggttccaaaccatcccacattttcttttcttcttctgagcccttcaaactgttccaacctctgcctgatactgacttccaaagttgcttccacattttcaggtatctttaaagcaacgccctactccaatggtaccaatttactgtattagtctgttttcatgcagctgataaagacatacctgagactgggaagaaaaagaggtttaattggacttacagttccacttgactggggaggcctgagaatcatggtgggaggtgaaaggcacttcttacaaggtggtggcaagagaaaaaaatgagaggatgcaaaagtggaagcccctgataaaaccatcagatctcatgagacttattcactatcacgagaacagtatgggggaaactgcccccatgattcaaaccatctcccactgggtctctcccacaacgtgtaggaattatgggagtacaattcaagatgagatttgggtggggacacagaaccaaaccatatcagtaagcaagtactggttctgattaaatgcaaaaaatgttgcaattgttggtttcaggaggagtgttatccttaaaaattagactgtcttagaaacacttgttggacccagttcaaaggacttcactagcattaacactctctctcctttctttctccttaacccacttctacccaattactgacattgatgggagttaaatgtaaccaggactctttgtttatatatacatctggttttccctgttccgtatgcctaaatcctccctccattgcttctgtttagcatttaatgtaaatttccaaattaattcaagaagaaaatttgaaatatataagatgagggcattaggtgatctctgagggcttttacagctctaggattctattaggttattaataatttatttccagaggatacattctgataaactaagaagttttctgtgcttgatttagcttttacttaattaggaatataaataactaaatatttaaatagataaaacttatgctatttgtcactttttcttgaagcatatttataatgatcatttaatgttcaaagtaaacctccaaaaggacttggtaactgccaaatattaccaccaaactgtagactaatcaattagaccactagtatttgaatttttttcttttactatataaaactaagaaacgtggactgaatcaaagtgaatgggagctttggataaaatattggtaagatgtttgcacttactgtctgcttttgaatgttcagatatttaagaggtaccatcatataccacgaacaaaaggttgggagtcaggaatcagggaattagtcctagctcatcactgtctcattttgtgattgcaggtcatgctttgctcttaaattttcccatctttagcatgtagtagattatttctgacccttaacttacccagggatgttttgtgaaataataaagataaccactgccagttattttttgctgctcagtaaagattctacacaaattaatggtagcagtagggtggttatttcattatttaagaaagttcttcaaagtgagagaactacccagcataggtcatttggaattgctgtttatttgttcttttaggccagcaaaagtgttctatgttaggtagaacagtgctaaaaacttacataaaagcaaaggttttgtaagttgtaggagccagtccttggtggatctagttctttccaactcttgtttttagtcatctgcttttataaaagtgagtggtcttaccttttagttgttttttttttcctaaggtagatttttatttttatgtttattcatatattctgtatgagttctgtcatcttgataaaccttggaatagaaagtcatatgtaaaatttgccactttacttgaattctaacactttttgtgatgttaacctgttagattctcattctaaattccacttctcaccttcttgtgattggttgctgtttgttaggaaaacatgtaacagattcttaccctctttgaaaaatcactgttgttctttttgttgatgcagaacagcagtaattttttctctttaaaggaaaaataatttagacaaaggagatacttgagaaaagagtttaaagaaatttactgttttctcagtgtacttcttttcaaaatgatgtcaccccaagtgttataattctttcaaagcttagtgtccaactggtgaacaaaactaacagttgattgcctcaagttcagcagtgtttgctgtatattttctacatctgtggactattctgttatgacataaaagctattaaagattataatttttaaactatatatttcactaagtatttataaacacgtatgaaactcgttctaagtataacctgtactgaaatgaactgttcatgtttatgactcagtaggtaaattgctctggagtgcttcagaccaggctcagctgaagcaaagcattttgaattgatattgttaggaaaggttttttttccttattcaacggttacatgcgaattttaaaagatttcttgtgtttggttagttctaaatttaaatttgttatacttcttatactagtagaatgtttcctttctatctgcagatttgagagttggtcttggaatatggctttgcagattaaaaaaaggttacttttaaaattcctcttaaactttataattcaaatcagtcaagtaaccaagaagagaaattagagaggataccattgacttgctttgtatctgttgttcttcctttccttctctgcaaaggtaaactgaattgcagctttgtacttagaagtaaattactattaaaataaagacagtttaatagtattttagaaaatgtggaaaatggaaagatgggaatgaactataaaagatagaatttgagctgagtcttgaagaatacattgttcttgatgtattccagacttccccttagacgttttttattctttgtgactgttgtgtgttatgtgactacttaggtcatcctccctcagggggaatagttggacgtttattctccaactactatgtaagcaccatcttaatatttgcccttggatgagtcacatcactctgctttgccttaatttctccatctgtaaaatgataatggctatataattttagatttattgagttcagtggaggcaaacctttaaagtatagagatggctttcactgtgaatgaatttaagataaaagatagcattaccacaacagtgcatttttctacctttaacacatatgttaaccacatttttgtgggggcacaaaaataaggatttggcatacaagataatttgagtgccttgtacgtgttctagctggcaataatcctaacccttgtactcagcatctggtttattcatgagatcccctgtaattaaccagtagtacttctcagtcttgtcttttaggaagatttatggtatacctcaggtggtgtcagatagcaggcagaagacagatgagtagctagttctctttatttagaaaaaaattctgtctccttgacaccaatattgttaaataagatatgatttctaaaaagccattttccctgtttatttgacatgattggcagctctactatctgaacacctaagaagtttaagtttcttaggtgtggttttagagtcttaggaaagctgggaagggcctagactttagaggcgacaggcttatggtgtgtcctggagtgttacacaaggaagaattattagggccaggtgcctttcatgtctatgtctgccaaagtaaaaaatgcagaggcaagagtttgtctcagcaatagtttcatacattatctacacagagaaaagtgactatttaatactggcaagaattcaaatactttctatgtaatcaatatcaaaagagggtaagtttgttttttgattggttatcaagttgatatacagtcctattgctgtggtctgcttaacctgtaattatcagagaaatcttgtcaaacaagattttctgaaatgaagcctgttaattatatcagatcctttggttttatgtggaactattatcatgtcatgaattgggaaccgtttgaacaaaatactgatttggaaaactctttatctcaaattttgcttgaaacccatgacatctaatggaaagggcatggtgagaggcaacactaaatttctaagctgaactcttttcctaaacatccctcagtgatcattctcttgtatgagtagatcccaacaagggtagggattggttagtttcagggcatcttatctaaacattcgtctaggggcaggtctatgctggttagacacatagaaatcaaaattatcaacacagtgatgacaatgtaattggccatatctatcagcaacttataatcaaccatatctaaggctgctgaaaggtacaccctggtaaaaattctggctctacctttgactttcattactgaccctaaggattttggactgaagtctgtaagtgagcttgaattcaacctggaatctgctttgaccttgtaggtaaatagtgtgcaaagttaggaaattagaacaaaataaaatttactttacagctaggataaattgtgataaaatgagaaattggcagcaagaagttttagtgaataggaccctcaaaggaaacttaaacaatgttgaagtgatgtttgctgccatcagacagcacacacacacaaaaaactatgtctaaactgttaaagtggattttatgtaaattgttcatgataaacatttgcattatatattcctattcctttgtacttcccatttgatgaagttttcaaactgtggtttgctggaggggaaaaagaaaacccaaatccaaaccacataggacaaattgaattacaaacctggtgtggtcccttaactcaattacatctaatttgtgttattttagtcatcctgggtggcagctgttctgagtaaatgcccacaaacattttcaatgtaagaatttgtcctgattacagctctttaagatcagtagtagcctatttatattttaagtggcaaagttttagattaatttggtgtatcaggaccattttaaaaattcaaaatttagttgtttcacaaatagacatttaaaaagcaagcatccaatgtttattttaaatgttaatttttgtaacttcacctcattttcttatttcttatgtttctacttatgtttcttctaaacatagccacttaattactttattcaggcatttatcaacttgcatatacaagggaatatggaattttagattcagataaatgctttgacattccaagtcaaaatttgagatgatctgggaagaaaaacatgaaataatatgggttcaggattgttcagttcaatataattaaaacggaggtttgtgttagaactaagttaagattgaatattaaatacaaaagaaatgaagaccttgaaactcatgaaagtcttgtggaaggaccttgactagtgttctaaggtagacaaatgggaccaggctaaattttagggaattacaatgaagagatactatccagcagagacagtaatgaaagaaaactcctattacttcaaaaatgatagatggtacatgaatatgtttaaaagccattgtttttctactaaattcagtaactttcagttagcaactgaatatcttttatggactagatattgatctatgtactgagacttcaaagatgaataaactaaaggttcctactttggaggaacttatactgtagttaggatggggaacatgtaaataatttatagcaacatatggtaggtgatatgataaaggtttgaataaattcaaagctttttcttttgtcataaggagggtataggcctaaagttagggtattagatcaaaacaagtgaaatttttgtttaaacttactacagtacatgagacttatacttcactagatatttaatcagttaatggtcgacccatagacttaggaatataaattgtttaaatttgaggtgtttatcagttgtgtacactttttccctactcattctctttttatggaaaaaacaatttggtaatcaattatgatatgtattttcttgtatatctcttataatttttaattagttgtgaactgtatcaactttaataacattttaaaagatgttcatcatcctatattcctcttttatatgtgatactgactactaatctactatttatttttgaaattatttttggtcttcagtggtagtgtgctttttttggtttctctcccacttttggagagttgatatctgctttgctggcttcacatctgtattagttatcaattgccataacaaattaccctaaaacttagccgctttaaacaatgaacatttattacctaatggtttctgtgggctagtaatatcgtatctgtcttattcacatgtgaatgatgaacattcagacatccgataaatattattgaatggtgcacaaatgaatgctgttattcaagttgaggttcttatcacttagcacctaatgggctccaccatcttctttgctggcttccaatccttacccccatgctgtttgtaaaaccaccctttcaaaagaaatttatgctgctgcttcccttattaataaccagttgtgactctcattggcctaatcaaatttctgttggtctccttggcattcaaagccttccataaaccagccttatcatatttattcaaccataaaccttaacagatatacctattttacttaaactggttgtttatactttagacctgttaaaagacaatccttaaccaaattaaatataactcagtttaattgagcaaatctggcggcttcttgaacccgagtagtctgagagagactccattgcagccacgtgctggaagatttatggacagaaaaaggaaagtgacgtacagaaaacaaaatagaggtacagaaacagctggattggttacagctccgcatttgccttatttgaacgtagtttgaacagttggccccctttggccaaaactcagtgattgtcacaagagcagattacagtctgtttacacatccttttagattatagttcacactgtgtagagaaacctttaggctgaatttaaaatatgtaaggaggcagctttagggtaaacttgatttaacagaccaaaccttatccccatccctaatatcatgttcagttttactttcttacctttattaatgctttattccctcatctgtaatgcttatattccttgctttttcaaatgttgttgattcttgttctccactcaaattctttatgtttcttgcacctctttcataaacccagtttggacttttctggcccactccagttgtttttgttttcgcttgatttttttttttttggttgttgttgtttgtgttttgagacaaggtctcactctgctgtccaggctggagtgcagtggcgtgattatggctcactgcagcctggacctcctgggctcaagcaatcttcgtgcctcagcctcctgagtagctgggaccacagatgcatgctaccttgccaagataatttttaaaaattttcgtagtgatggggtctccctatgttgcccaggctggtcttgagctcctgggctcaagcgatcctctcatgttggcctcccagcatgctggaattacaggtgtgagccactccacttggctcaactctagttttttgttttttgttttttaattttattttatatatttttattattattatactttaagttttaggatacatgtgcacaacgtgcaggtttgttacatatgtatacatgtgccatgttggtgtgctgcacccattaactcgtcggattaaagacttacatattagacctaaaaccataaaaaccctagaagaaaacctaggcaatacaattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcatcgtacagaatgggagaaaatttttgcaacctactcatctgacagagggctaatatccagaatctacaatgaactcaaacaaatttacaagaaaaaaacaaacaacctcatcaacaagtgggcgaaggatatgaacagacacttctcaaaagaagacatttatggagccaaaaaacacatgaaaaaatgctcatcatcactggccatcagagaaatgcaaatcaaaaccacaatgagataccatctcacaccagttagaatggcaatcattaaaaagtcaggaatcaactctagtttttaatctttgaattctcgttgcattaacactcagtaccaaacagtgcctttctttatttttaattagtttaagtgggtgaatatgtctttccaactagaattccaattttctgacagcaaaatccttttacttctcgcatctttattgtagtgtgctgtgagtgtatcctggttgattgaaaaactagaaatgttgattcacctgtatgtaaaaaatcctttttgagtgaattttaactgctagagacattcatgaggatgagctgggactgcaggacagtttggaactacattttattattttcctgaagaaacattgctgtatgaagagattaactttaaaaagttccctccggccaactatcagaattggcttttagccttgaactatcaaagcaaaactttcagtgttgcctagagcagaacaggtattaagtagcaagcaattcaaggtctctgatccctagcctgcttcagctatgggcctggccaagccctttggcaaagataagttgaataaggaatttacttttatcttctccctcttggaagttttatggatttgattcacaaagaaagggcaataattgaaattttgtgttagcttcttcttgttattcaccaagaaaagttaaagtcaggtaatgatatcaatcaaaatgtaagtacacctactgcctaaaaataacattgtggttaattgtgttccataatattcttggcatactttgcacaagccctggagaacaaagcctgagagcccatgggaaataaagctccagttctttcggccactttaaatttagttctgtgatcttgataagatatcattgtatttacattgttagtttctaccagcattcccttgtatcttcttttatggctttttctatttctgtgcctttttgttcctcttccttattttccccctaaagccataggtagaatgtttggttttagagttttataagaggagtatttgacttttccttatagcgatctcagatttcattaagtttgtgttttaggatgatttataatatcagtctatgatttgggctattatttgcacatttttggctttcctgtggctaaactactggtgtttatataaaaaagatttttttttatttatttatgcatgtaggggtttcagccaagattcctgtctttagtactggaatatttgaattagagaaattaagaaagtgaaaaaggctaaagttcttgattcttaccttttatccttatagttaatgacttataaatatatttctttgggaaaataaagaatatcaattgactgtcacctcagttaatccctccagcctctgcgttttttcctctaggtgacctgtaagggcctgctcaataaagccagtgtgatgatgttagctttgttgcatcttttagttttcttctttactcatcccacacttcccatacatatcccgcttcccttccctggtgtgtttaaaggtaaaagaagtaaagaagtgggagaagagacagtgtgaaggaggtgcagaggcagacatgaaaaagtgtcaggaagaagtctgagtgtagcccttaaaagactattgctttctctagccactaccctattctgctttgttcctgttgcccctactttaatatttctaaaaggagtttaaaataaaaatgaaatccatttgaatttcagtcttgaacactcaaataaaagtgcttttctgaaaatctacaatgatgtttttaaaacaccttccttgatcactctgctgcattttatgcaaagatgagcatttccttctgaaaaaaggaaaagacttattgactaacttttgccacatgaaactgtataatcaacctcatttgaaagtgcacatttcatttgatggcatttgcaaattgttccttccccccaccaccagaacttgcaatgtgaaaatgcttccatatgctaaaagctagtctactaattttactgaaggagaagaaaagaaagtatggctagccattttctaaacatgaagctacagtgtgggcagatttggcaatgggagcccctcagagttcactgtaaacaactctgcaacccccaggcctcactactgttcaagatgagtgtagaaagttgtttttgccccacaaaagtaaatttttaaaaatgcaattgtaatgtgtatatagttttaaaatatctaaatgcagttaaaatatagtattaaactctgatttctaatagatttgaacattttaagtgaagaaatacttttgctttcagattctttgtgtatctcaagacattttaatagttttcaagacatttaaactgagtcttcactctgggtggtgggcccccaacccctaatgcgtggcttatagcaatagttttctccctgattttcctaatattagtcattctcccttttaacactgcgctacttggtgctactaggataatctttcataaataacattatgccttttcctgttgactgatctcatttaccctaatctcaccaatatttctcccaaatctgatttataattttctttaaggagtcttcgtagtaatcccatctggccccatttttcaacagtacttttgaaccaagcttctactattattattttcatgttgatttattaaagttttttaaaaaattgtattatgtctgttctttttttcccaagtagatatcagtgtgatggaaacactatcttctatatcttttgactggagtcttttatacttctgagtacatgatagatgttaaatatatactctgttaatacatattagcaagtttaaaatggtggctgtttgtttaagtcacataaattatcaaacaaaagagctgagtgatggtacctgcacaatgcttaatatatagtagagatgataaaataaattctactgaagtctgtacttcatctttttaaaaggtttattgcttagcttttagaattaatggttttatctttgaaatagagaaacaggtctagggttcatgcagttataaataaaaattccttaattttatttctattactgtagcatcttatgccaaaaaaaaaatatcgtaaagaggaagaagtggccaggcatggtggctcatgcctgtgataacagcactttgggaggccgaggcaggtggatcacctgagatcagaagtttgagatcagccttacccacatggcaaatccctgtctctactaaaagtacaaaaattagctgggcgtgctggcgggcgcctgtaatcccagttatgggaaggctgaggcaggagaatctcttggacccaggaggcagaagttgcagtgagccaagatcgcgccattgccctccagctgggcaacaagaacgaaactccgtcttaaaaaacaaaaaaaagtggaaaaaattagaggactaacattacctgattttaagacttataaagctagagcaatcaaggcagggtattggcataaagatagagaaacagatcagtgggaaagaatggagagtccagaaacagattcttatgtacatgggcaactaagttttcacaaaggtataaaggcaattcacgggtgaagggccaaactttttaacagatggtgctaaaacaattggatattcatgtgaaaaaattatttatatcacataccatataaaaactaactcaaaacagatcatagactaaaatgtaaaaactaaaactataaaactccttaaagaatacatagggagaaagtctttgttatcttgagataggaaaagatttcttctatatgcctccgaaagcacaacccataaaagaacaaattgataagttgaacatcatcaaaatttaaaatttctgctcttgaaaagagaatgagaaggcaagccacagatttgtggagatgatatttgcaaaacatattatgataaaggacttatattcaaaatatataaggaactctcaaaattcaataaaaaatcaaacaacccaacaacaacaaaaggtagacatcggatagagtatggtggattacatctgtaatcccagcactttgggaagccgaggtgagaggattgcctgagcccagaagttcgagaccataagcacatgaaaagcccaatgtcattaattgttagggaaatgaaaagtgtactgcaataccacatcaaatattacttccttttctataaatatgtacaattattatgtgtcaactaaaaataaaagaaaaaaataaaattaagaagactaaccatatgaaatgttggtgaatatgtggaggagctaagtcttataccctgcgggtgggaatgtaaaatggtataaccactttaaaaaatagtttggcagtttcttaaaatgttaaccatatacccaccgtactcttcagccatgtcagttagctttttacccaaaataattgaaagcatatgtccatgcaagggcttgtacataaatgtcatagcagccttatttataatagccaaaaatgaagtcacccgcatgtccatcaacaagtgaatggataaacaaactatagtatatccatataatggaatactatttacaataaaaatgaattaattattggtacatgtaacaacatggatggcacttaaaataatcatgctgagagaaataagtcagtcaaaaaagactgcgtgctgtttgatttcacttgtataatattctaaaaaatgaaaaataattcatactgatagcagatgggtggttacctagagatggggaatagaggaggagaaaggaattacaaagaggcacaaggaaacttcaggaggttaaagaagttttaactatcttaactgtgatgatagttttgcaggtatatacataattcaaaggttatccaattgtacactttatttatttatttatttttgagacagagtctcgcattgtcactcaggctataatgcagtggcgcagtctaggctcactgcagcctctgcctcccaggttcaagcaattctcctgcctcagcctcccaagtagctgggattacaggcacacaccaccatgcctggctgttttgtatttttagtagagacggggtttcaccatgttggccagactggtcttgaactcctgacctcaggtgattcacctgccttggcctcccaaagtgctgcgattacaggcataagccaccatgtctggccccaattgtacactttaaatatgtgcagctttttatagcttagcaaaattatacttcaatttaaaaaaagaaaaaattgtaaagaggtgttaaacatgcagttcaccattgaaagcaatattatttaacatatgcactagcatattataagtataataaatgtaaatataatttatgtatttataaacataaatataacaatgaacatatacattattgaagagtcccatatgtcaccttccatcttgggttttatagttactaaaatgttatcaaaggagaagaccatttcataaaggaaattattacaccttgaccatccaatacttcagtctttcattttgcgtggaagttctgtatcagctaccatagtcattttttaaaaataacagcaatcttcgttttttgaaaaactatcataggccatctcaatctttatctatcaatattttccttctttcactttcttgataaagccccatattttgcttctgcttctatgtttttttttaaaaccaaatgattactaaacagggagtgaaggtccaggtgtggtggcttatgcctttaatcccaggattaatctttgggaggctgaggcaggaagatcacttgagcccaggaatttgagaccagcccaggcaacatagtgagacacgaatatctacaaaaatttaaaaaattagccaggcatggtggcacgagcctgtagtctcagcactttggaggcacaggtgagaattgcttgagcccaggagtttgaggctgcagtgagctattaccacatcattgcactctagcctgggtgacggagggagaaagaccctgtctcttaatctgtagaaactgtctaatactattactactgtattagttaaatgactcatttacagcataatttgggaaaggaaattcttggattttatcccaagtgaggacttagaaccaagtgatatagtggttaaaataagagtctcagccaactagagggttagaattttcttggtatttaatgtattgtgcttaatttatcattatgtaagtaagctcaaatctcattggtctctttatataaaaaggaaaaaaaggaaaaagagcagaaaagataaagccccatattttgctgcttctgttttgctgctattgacataagaaggcctatgtagtcctatgtaggcctttttatgtcaatatcagtctgagtaaaagcaaataatgaatttatgctgaggtacaaatataccatttggacagttttatattaacatctgacaatgtacaaaagttatacaaatttgttagcattttctcactgcaaaatattatcaaattaggaaatagcagacactagggatggtttttactatatataatgatgtttaagaggtacttaaacttgatttaaaagctctgcagtgatttacctaagatgagcctgaagagctaatagtctagtttttgttttttaatttttatttgtagcaacaagcacattaaccatttgattttttttatattttgggagaaagttgtgaccatgtggcagtttggatttgaaataataatggcaaataagtggcctgtgctgaaaattgttaggcatatctctttatggaaaactactttggtgatataaaaccaccgaggtctatagttatataatttaggcaagcagaaaaatcagacagggctggttttttttttttctttctttcttttttttcttgacagtgtctccctctgttgccaggctggattgcagtggcgcgatcttggctcactgcaacctctgcctcccaggttcaagtgattctcctgcctcagcctcccgagtagctgggacaacaggggcgtgccaccacacccagctaatatttgtattgttagtagagacagggtttcaccatcttggccaggctggtctcgatctcttgacctcgtgatctgcctgcctctgcctcccaaagtgctgggattacaggtgtgagccaccatgcctggccagggctgggtttttattaaagatttagtttcgttcttagaagttatgtcaatttctgatgagtaatctagtaataacttaatctgtctttctgaattaattctgcaaaacactgccacatactgattgttgtaaacattgttggtttcaagacactttcttattttaaccctcctaacctttcaaagattcctcattacttatggtttaagtcattccttcttgttttttatattcaagacctttcacagttgatcactgagctgtcctttaatcctctgtgtcactgcttttcagtatgaattgctaaagtttctatgatttttctgtttctttgccttttgtcaatctttgttcagtctggactctctgcctttctctcatctctacctactcttctaagccctagaatgcttcaggtaccacataaaccacatcagcataaaaccttccatgacattctattcatacatgttgtaaatgcctcttttgtgccgagctgtcagtggtcaccaaggtaaggacaggagcaaaggatgctccgtggtactccactctgatggacgaggaaaaatgataaatttacaaatattttatctcatcctatatacattttactttttatttatgtcttataatgtaagcaataaattggtacccaaatagaaagtgtaaaataattaaaatacatatgttgagggagtgcatgcccaaaatgttttactgatggggtatagaacaaaaagttaagaaaccaccgatctaattgtcaggtctgtttccgcatttgtaaagttaggtcaaggattggactagataatttccaaggtcttttttaagcttaaatgttcatggagttaaaaaaattattttgaaatctttaagtatacagaagagttgccagtgtagtacagtcagctcccataagccattcatgtggttttatccactgttaacattttgccatatctcctccttgtcttctaatacatatatatacatattactatacttttgttctggaccatttgctagtaaattgcagaggttgcaaccctttaagctatgtagtttagtatgtgtcccttaagaacaaagacattccattataagatgttatgtaagagactcagcacaaaagaggcatatgtaacatgtaggaagagaataacagtaattgatcaagttcaatataccataatctaacatagagtccacattcaaattttgcctattgtccctttatgacctttatagcagttttttcactaatctaaggattgagggaataggaattttcttgccatgtctatttagtttcctttaatacagcagctttttagcttttccttgacttttgtgacacggacagctttgaaaagtaaaggcccaaccagaaacagtggctcatgcttgtagtcctagcactttgggaaaccaaggcggggtagatcgcttgcgttccagaccagcctgtgcaacatgatgaaaccacatctctacaaaaaaaaaaaaaattcaaaaattagcttggtgtggtggtgcgtccctgtagtcccagctacttgggaggctgaggcggcaggatggctggagctcaggaggcggaggttgtggtgagctgaggtcgtgccactgcactccagcctgggcagtagagccagaacttgtcttaaataaataaataataagaaagaaataaagaaaagtaaaggcccttaattttgtataatggctcatttgggtttgcataagtgtttccactgtaccttgatttgtgtgtgtgtgtgtgtgtgtagtttaattctgtgtgtgtatgtgcatttgggtgcacacaatgtgcacgtacgtgctatggtgctgtgtgcgcaagttgagtcctcttttccaaaatagattgtaaattccttatagacagagatgatttatcttggtaatttttattccccacacttctatgcacgtatgatacttagcctatgattcaaattaaaaatattcataagtcaaaagttcttacatatcccatgggttaaggagatgatttaaaacatacagggaagaacatatcagattaattaactctcagtgattaaggatgccagagaataccatggtaacaatagaagcattatgttttattttattgaatcttgaaggaaattggatactccaaagtataatataatatggaacatgcactgtgaatactgtactagttgacatgtgtaatttcttttcatcatttctctgtggaaaccctttgcaataacgtttgaccttttttccatatacagagtcccaaaatagtattttcatctgacatgtgtattttaatgggtagttagcacgaaagatctttgtcttttaaaaatatgtttctcaagattgggaatatcttcagttgtcagtaaaagatctcttattatccttttattatcaaataagcatagttgtaagacagtgactcatccaaagatttgttgtggctgcttctatctatggtttttttgtgagatggagtttcgctctgttgctcaggctggagttcagtggcgtgatctcgactcactacaacctctgcttcccaggttcaagtgattctcatgactcggcctcctgagtagctgtgactacaggcacacaccaccatgcccagctaatttttgtatttttagtagagatgggattttaccatgttggccaggctggtctcaaactcctgacctcgggtgatccacccaccttggcctcccagtgtgctgggtttacaggtgtgagccaccacgcctggcccccttcagtctattttttatttttgtgggtacatagtcagtgtatatatttatggggtacatggtatgttttgatacaggcatacagtgtgtaataatcacgtcatggagaatggggtatctatcccctcaagcatttatcctttgtattacaaacaatacaattacaatcttagttattttgaaatgtacaattaagttattattgagtatcgttaccctattttgctatcaagtagtaggtcttattcatttctaattattattatttttgtacccattaaccatttccacctcccgctaagtccccactacccttcccagcctctggtaaccaccattctactctctatgtccatgagttcaattgttttgattttaatggttagtacaagtaagaagtttttcattttaaagtcagcatctgaaaagatacattgtagcctttagaggctctgatttccttgaagcctgttacttatttgtaaaggtccatagtaagattgaacttactatttggaattttaaattggtagcttcaagaactcttagaagatctttttttttcctattttaatgaagaacatttaatatacaggttttcttagtattgactttcataagtattttctggggcaattactatctcagttgattatctctgaaggcctattttaactctacatttatctgaacttaactgaataactcctcattactcagcacatattttagtgaagagattcttaggagtaacggctgacattcaccatattgtggtttgtctgtgtgtatgttcctgtggataacttggcaatcgcttcctcagcgaaataacagccagtgtggttcagccaaagtttagaggaataaagtaactgaagtgggaggtttttctgtaatgccgagtgattttattcttggttctttctttttgaattgctcaggtagtgtttgccgtggtaggtattaaaaccaaaccaagcaaacaaacaaacagtaaaaacccaataacaaccaacaaacaggaaataccaggtaattcagattatctagttatgtgccatagtatgaacccaagaactcttcctgtaactccaaaataaatgtatgcttaggtcagaatctgagttagaaatgaaaaacaaggctaggtgcggtcgttcacgcctgtaatcccagcactttcggaggtcaaggcgagcggatcatgaggtcaggagttcgagaccagcctggccaacatagtgaaagcctgtctctactaaaaatacaaaaattagccgggtgtggtggcaggcgcctgtcatcccagctacttgggaggctgaggcaggagaattgcttgaacatggtaagcggaagttgcaatgagccaagattgcaccactgcactgcagcctaggcaacagaacaacactccatctcaaaaaataaagaaataaagaaataaataaataataataaaaaagaaatgaaaaacaacatcttgtctattttttccaggatcaggtgtaataggaaactggtgatgcactaagtttttcacagacatggcttgagaatattttctattttatatgcttgttaattttttaaaaataggattgtttgggagcttatttccactgcagcaggaagaggcactgtgattcactgaattgtgtgaattaaaggcatgatcaaggaacaggccattgaaaatgatggccctgcagtattaaaagtgctttgatcttctgttttgacacattgaatttatctttaattatatgtgatgacatttgattactatacacttagactattataatgtggtttgtaaaatatagtttgtaatgtataataacttcaacaccgatttttctgtagatatgaatttacagagtcatgttttagttttgtttaagagaaaactattagacttctgaattaacagacatttaaaaggtaaatatttagtagtcaggcaaagtatgattcctatacaataagtattaggactgtaccctgtgggactcagtgccttattttaatagaggtaatagaattctatgtggtggtttcctgatctatccactactggctgctttactacaggtaaatcacttagttctctgagcctttgaaaaatgaaagccttagactacatgatattcaagattttaattctgaaattctttgaatctattattctgtgacgtctttgatggacataatatagaattccatagaaattactgacacattttctaaaagaaagatatttttaaaatattgtgtgaattaatgggttttgaccttgcatttaaatatgaaaatgaggccgggcgcagtggctcatgcctgtaatcccagcactttgggaggccaaggcaggtggatcacctgaggtcgggagttcaagaccagctgaccaacatggagaaaccccatctctactaaaaatacaaaaaaattagctgggcgtggtggcacatgccagtaatcccagctactcaggaggctgaggcaggagaatcacttgaacctgggaggtggttgtggtgacccaagatcatgccattgcactccaggctgggcaacaagagcgaaactctgtctcaaaaaaaaaaaaaaaaaaaaaagaaagaaagaaaaaagaaaaactttaaaaatgcacttatgggacagtgggttggggggcaaccccccacaggccacaactgtagagagaactttcattcggaatttcctttattatgccagtaccttagccttgagggtgtgagtctttctttgaaattgtctgctttgcttgcatttacatgctcaaccctggatttttcccaatttaggcagttttattccccagcaatgagagtccttaagagtttgaacctgatcctaattctctaggggaaattacaaattattctttcttttcaaatggtagccatatacagtgattttacttttaacatcttttttttttttttttttttttgaggcagagtctcgttctgtcaccaggctggagtgcagtggcgcaatctcggctcactgcaacctctacctcctgtgttcaagctattctcctgcctcagcctcccaagtagctgggactacaggtgcacgccaccatgaccagctaattgtggtatttttagtagagatggggtttcaccatgttggccaggatggtcttgatctcttgacctcataatcctcccgcctcacctctgaaagtgctgggattacaggcgtaagccaccacgcctggccattaacatcatttaatcaattttgtcaatgtccctaatgggatagtcaggcaaaaacaaaccaacaaaattctgtaagaaaagtggctaattatacattatcattaggaagcataatatttcatgtgtttttatcctgaactttgtttctttttgccatacaacccgttccttactttgtagggaggacttttattgtaaaaaaaagatctgcctcacacaattattggttatgactatttatcacctaagaactaaacagtggtgctttgatttgagtttgtttactcgagaggcagagtatgttttatctgtaagtactttgggatttcttttgaactaaaaatatacaaatacaattattggttatgactatttattgcctaagaactaaacagtggggctttgatttgagtttgtttactaaagaggcatagtatgttttatctgtaagtactttgggattttttttaactaaaaatatacaaatatgtatagtttgtggtaagtaggtgacagcgtgaaaagcaaaactggaaagctatgatcctacagctacatatcaagctaccctttttttctcaaagactattgctgtgttaagattttattatagcatttgtttctttttagagagggtagaagggtgaagccttactcgaaaccatttcagagtagttaactccagactatatactaatggagaagaagagtaatacagataagttaaaacattagataatgattgctctttattgctttaaaaaaacatggggaagagcagttgggaataggacccaggcacttaaatctgggaaactcatttttggtctttttttcccactgctgcagtagcctgggcaggatccctagagacacagccttcaggcaggaagatggaggagagaaagcagatcacagaccctaaacatctgtaggttctctctctttcttgttccctacagctggtgaatctgaattgaatccttagtaaagtttcatattaggtgatttagtagatgctagttaaggaaaaatgatgatctctaagaattagcctgattttattaaaaaaactttgtggagattaacctaatttccttcttcttaggaaggctattagactgttgatcacagcagacaggggtctgaatttcatgaagttttttgacatggtccatcatgatatcactgtgggcagaatggatgagagggatatgatataaaaatacggttatgttgttatgcagctggctgaacagccatctgaaagagtgatatttaatggtctgtgttaacctggaaggagaactctgggataccataggaatctgtcttcaccttcattatatatatcaacaaagagttaaaagaaatatagctggcctactaattaaatttgtagataatatacagttgaggaaggatggcttaaattattgggtgatatagacaggagtcaaaattattgggtgatatagacagtctcaataaacataggagtgcagatatctctttgatatagacaggagtcaaaaaagctctaaaaatatcaggatgataggcttaaccagcaagataaaatttactgagaacaagtttataatataatatataatgctatgtattacagaatagaggagaaatggcttagatgtaggggtaggaaaaaaggcttaacgttcctaagttaacagaaaacttaatatgggcaactttgtcatgtttctttcaaaaaaatgcattgtgatcttaggaatgtctagaacattaatagaatgtctagaataagattagtagtagtcccgctttattctatgcatcggactattttgttctgattatcgcagtctgagagtgataagcttcaagcacatccagaagaaaatggctaaagtttttcacataacaaagctacaaaaagaagcctataaggagtcataatagctgtctcctgatatttgatgggcaaccctttggaaggaaggttagaatgagactgtgaagctccagaaggtaaagtgacaaccaattgttacatgaagatggattttgactccatataaagaatatttgtctggtccttaaagctgtctaaaaaatgaaatagactgtgctgggagttaagtagtgaattttccagggtgttgccaaactaccttaagggtatgtggtaatagaagaaatttattcatcagaaagggggtaaaactagttgatgtttagattcagtctactctttttggtggtgtgtttcctacttgtttataccaatttactctctgtcgtttggctaagaggcagagaatgtctttgaccataaattgataaacaggattcatctgtatatgttattatcaaaacatgcctgttacttttccaagaagctttattcttatctactcctaaaatatctttatgaagttaaaaggacttaacataagtatttagaaggaaaaatgttttttttttctaggaagcattatttatatttggcacttttttattagtgtcaaaaacaaggtgatcacactgcagctataagaagatagtgctatgaaatgaatatgtgcagatacatcagagtaaccaggttcattggtttgttcactcatttgttttttactcattcattaatttataaatattttttcggatacctggtaagtgctggtcgctctgctaggtactaggaagttgatatatactatagtttctctgaccatttacctaaaaatctgttaataggctccatttcttctaatcatccaagaaacatttttttaatttttaatttttgttggtacatagtagttctgtatatttatagagtacatgagatattttgatacagatacacaatgtgtaataatcacatcagggtaatcatgcttgagggtatggataccccatcttttagttattttaaaatgtacaaaaaattattgtaaactatactcaccctgttgtgctatttagccctatattttattaattctatctaattatatttttgtagccactaactatcccaccctccctccatcccgctacactccccagcctctggtcaccatcattctactctctatttccatgagttcaattattttaatttttagctcccacaaacaactgataacatgcgaagtttgtatttctgcgtctggcttacttcacttaacataatgaccaccagttccatttatgttgtcacaaatgacaggatctcattcttttttatggctgaatattactccgttttgtgtatataccacattttctttgtccattcatgtgttgatggacacttagggtgcttccaaatctcggctgttgtgactaggtctccaataaatatgggagtgcagatatctctttgatttactgatgtcctttttgtggatgtatacctagcagtgggattgccagatcatattgtaactctatttttagtggttttaggaccctccaaactgttctccatagtggtggtaataatttacattctgtcaacagtgtatgagggttctctagtaaacaattattactttgttttttgtgatgtaacctctaaagacaagtataaaagaaacactggaaaatactgatttttaacgctgtatgctagctattctaacaactatatgttaataacttaatatataactgttagtatatataataacagctgtattataactattaggtatccataaaaatatcatgcctttatgtactttaatattaatattgctttgaaactgaatgctgaggtagaatttgttttttcaggtttctgtttactgttaagagttttctatattttcttccttttccttttttggactgttgttaatttccatattgctttttgaaaggagaaataagatattgttaaggggcccaaaaatatacactaaccactgtttttttcaagaaaaaaaagccatttttttctcttagataaatattttttagctggttttaattttaatgtgcatcattgctaggtaggcaagaatgatcttgaaaaagaaagcttttgtaatattaagccaacaaagacattgcctgcaggataaatgaatagttgaacatattcactggttacatggtcaagttttatctttaacttattttaatataagatggttactatgtttcatattaagagtgtacccttttaacagtaccttataaataattcttaagcccaggtagggtgagttagaagtatctagttttacaattagaaatatgaaatgagaaatcagtgctcctttgtatgactaagctcaagcaggatttaaggcagggaggggtcaccactgattgatcttcaaatcttaccatgtctaagactgttgctgctgccatttgtctttctctggttttctaggattctttggcaaaatgttagctccttttcatcaatcttcccatctgcaactgatgattttctctagcatttcccataatcatctcaagattgcagagaaatagaagagatatttctacactcatgtttatagcagtgttagacacaataaccaaaaggtggaagcaacccaaatgtcatcagtagatgaatgaataaacaaaatgtggtgtataaatataattgaatattcagcttttaaaaggaaaaacattctgacacatatacaacacgatgaccttgaggatgttatgctaagtgaaataagccagtcacaaaaagactaataatgtatgattccatttatatgtggtacctagactgcttagcagattaagggatcttcaggatttggagtataagacacactcggccgggcatggttgctcacacctgtaatcccagcactttgggaggctgaggtgggcagatcataaggtcaagagatcgagaccatcttggccaacatggtgaagccccatctctattaaaaatataaaaattagctgggcgtggttggcacgcacctgtagtcccagctactcgggaggctgagacaggagaattgcttgaacctgggaggcagaggttgcagtgagccgagatcacgccactactccagtctggcaacagagcgagactccatctcaaaaacaacaacaacaacaacaacaacaacaacaaaaagaacacactcacaataggatataactaagtcatctactccacatgtccaaaactgggaacttaggatctttttctcacacatttatccttgctccttccatcccaagttagaaatatggatgtcaacccatactgcttttttcccccctctgaatactattggagaccaagccctgctgattttatattctttttttttttttttcttttgagacggagtctctctctgtcacccaggctggatggagtgcagtggcgcaatctcagctcactgcaagctccgcctcctgggttcatgccattctcctgcctcagccttccgagtagctgggactacaggcgcccgccaccacgcctggctaattttttgtatttttagtagagacgaggtttcaccgtgttaaccaggatggactcgatctcctgacctcgtgatccgcccgccttggcctcccaatgtgctgggattacaggcatgagccaccgcgcccggcctatattcttcatttttaaaaaatctgccttctctacattactggtacaatttattcattcaaggagtacttaattatatagtattccagatggtgtcagttctgtgaaaaaagaaaaagtagggtgggatgggagtttgggagtgtgggaggtggggagagagttgcaattttaaaaatggtggtaatggtggtccaggcttggtgcagtggttcatgcctgtaatcccagcactttgggaggccgaggtgggaggatcgcttgagcccaggagctcaagtccagcctggggaacaaagtgagacccggcctctacacaaaattaaaaaattagctgggtgtaatggtgtgcccctttggtcccagctacgtgggagcccgaggcaggaagattatttgagaccaggaggtcgaggctgcagtgagccaagatcatgacactgcactccagcctgtgttgacagagtgagattctttctcaaaaaataacaacaataataaataaataaataaataaataaataaataaataaataaaagatgttccataacggtgaaatctcagcaaaacctgaaggaagtaagccatgagaatatttggaaaaaaggcttgccagatagagagaacagtcagtgcaaaggctgcaagatgagagcatgcttggtgagttcaaggaactccaaggaagccaatagatctgaagtggagagagcaggaggaagagccatgggaaatgaggtcttagaggtaacaatggtctgcttatgtaggggttttgtgaggcactgaatggatggatgcattgggcagagaagagacacctaatttatatttttaagagatcactggctgctggttgatactaggttgtatgagcaagggatgaattagacaagctaggaggttgttggaatatttcaatcaagagaaggtagcttagacagagtggtcagtgacagtggaggcagtgagctgtggattctagaatttggaagatagagccagcatgagtttctaatagattagatgtaggatataagagaaagagttaagataaatctacgtttgtttgtttgttttttcctgtgtaagtgcattttacatcaacttagatgggaaggaaggctgtgggtagaacaggtttagaggggaagaacaggacttgttaactttgagatgtatgttaggtatctaagtggagttattgagtaggaagtcagatatatgagttcagaatttcattggaagttaatttgggagttgtatgaaaatacatagtatttgaaacaaaaaactagatacaatccccaagagaatgaatagacagagaaaaggaacaagaacttagcccagggcatttcaacattaagaaatatggattcaggcaaagtaggggaaaagagggaaccaacaaaggagactgagaagaagcaaccaatgagataagggatgaaatcaagagtatagtattctggaagccaagtgaatgaagagtatcaaggaggagagagtgatgcattattgccttagtttaggtcttagtcacagtcacgtcctaaattatgacagtttactttggtctttcggcctctagctgcctccaaccccttctctatacctcatctttttcctattgtctgtgatcaaaatgttctttaaaatgaacacagatggttttctttctatttatgctgtttgtcatttgttgagatgcttttacctgttttttgatattttgtcaaatatggtaaatttttggccattaatttttcacgtactgtcctgccctctcagcctacccatggtactgtatttacatgtaagttcaaccagttaatactgttccacagatcagcgaatctttgctaattttatttgtcttttttctttctgtgcctcagtgtggatattattgtgtgcttcaagttcattatctttctcgtgccaaatctgctattaatcccattattaatagtaatatggaaattgtgaatgtgatgctgatgaatgcagaactctattgtctttctgtaaagaatgttgagctttcttctaggaagtagtttgagtgaattgtggatcagtacaacccttttgacacttgttagagtttgtccagagttgtttttactctagggcagtggctctcaaagtgtggtacctggaccaacagtatcaatgtcaccttggagtgatgcttagcaatctgtgttttaatacatctctaagttattgtgatgtactcttaacttttaaccttttacccctttagaaaatataagtgcagcttactgccagtgcttttttaacgttacataaacatgggtctttgaggctgaagcaaatctgactgattttcaatgtggaaataaaatataaaaactgttcttagagttatttttaaactgaactaacatcagaatcacctgaatcatcagaatcgtctatttcggaaaaattagattcagccaataactgtttgagaactgtgttaacatcatgtgtaggaatgctatgttttctaggatttgacatttttggtgattgagaattactacattttgtaaatggatatatcactaccaaaaacagaatggtacaaatagaatgatgtattttgtttccaaagttgatatactagagcaatgtgaaagtaataattaaaatgagatattacatggcaaagttatctcagggtaaacgctgcagccgcaagtgccactggtgagtattctctgggcagatgggaaaaggatcaagaaccactactctggagctagttcagccttactactaggatgtaacccttctggagtctctgtgcagtgctctagatattcaatgaggtctctctcctttaccttgtcaaaatgtctcacagtcttatatgagtactgggaattatttagattaacattcatggtactttgtttgttcttatggaatttactctatgtatgtgcagcttaattttcagtcatagtctcaaggggaaccctgtgtagatttcctgagctcttctctgcatagctcttcctctttagcactctgccctgaagagtccatctctttcctcctctttaaactctgaactctgtcaccctaacttagtaagacctctgtactctgcttggggttatcattccttgtggtgcattccagaaagtgcttccagacagacatcagggcgaccttgttcattttccttttctcagggatcacagtcttaacactaacttttgtctgaggtgtgacagtaacttttttgtatatttttccagttttttcagtgtttacagtaggacagatctggtactagttattctgttatagctggaagtccaggtacttattttttatggtcatgaggctacatagaagctcattatatgaggaaaataaatgctgtactaatttcttcacatgatttcaggcagcactagagtgctatatgatacatattaggcactgtgctagcataggaggattaaaacccaaatgggatagtgcctttgtcttcaaagatctcatgacctacaagagtggactggtatataaacaacacattccaagtcagtttgtgataaaggcagcatgaaattatataaaggccatagactttgaaatcagataggctttggttaaatcccaactccatgacttactattgtattatgcaacctctcacatctttagttttccaactgcagaatggagataatagtacgttataggacttctgagaaggttaaattaaaattcttttataaagcacttgacttggcatatcatagaggttcattaagtattaggtttatttcccgttagaatacacataggatagaggagcagttaatttttattattactatagaaatcttcagggaggaaatgatatttaaattgtgccttgaaggtggagtagggttttgatatgtgttagatgggttccaaggacattctacttttaaggaactaaatgagcaagggctcaaaggtgtaaaacgtggggaaggctgtaaatacacttatgaatgtcagcatagtccagaaccttaggaaaagcaatttaggtcttaaaaacaaacaaacaaacaaaaagacaacaaaaaactagtagtaggaatgtaaaaatgaagaaaaaaagaacaaacagaaagtctaaccccatagtaaaagtatacttccttaggccattcctatttattgccatgactaataaatttgggaatgcctgtggaaaattcctgtgggctgatcttttcttaaccactattcaagactgctttacgttgatagtctaagccgatcatttcattaatattaaactccagagctcattcccgagtttccaagaatttgctgaattgcttttctctgttatctgcttctttgggtaacttccatatttttctttcttgccctgtaaaaattgatttcctaggttttccaagtgattgataatgtgacagtactataaagacttttcttagactctggtatgttcgcatttagtacaaatactgtcaagggttttataaagtgtataactaatatactttctacatatcttttactagggaattctaaacttaagtattttatttcattgaggttaaaatatgtcctgttaagattttttttctcttttaaattattagtgttttgcattgttaaaaatcagctggcttcttggattgagtttacttcacttttccagtgggtaacttttatctgacctttaggtctgtaattgtttggtttgttttctgaagctatggaatgttttggaaaaaataagcctcatggagaagggctattatccctgaaaatgatgagaccggaaatgagaaaagcaaaaatcagatatcacccttgaccatgtggatttcagtttttaaaaagtctttatcctctgtctctgagaaccattatttggaagtctgtttctctgcctctctgtgataagttctcaccaaagatcctcttgtgtttttattagaattacatcgaattcataaattggggagaatttatgtatttataatattgaatcttttcatttatgaaaatggtttatttctctatttaggtattctataatattatagacttttgtcctcaaagatcttacaaatcataatttggttagatttattcatgggtttttaatagtttttaaaaaatgggatctgtttttattatgtaatccaatcagttcttggatcagaaaattgatttttatatttaaagtccagcaaaactgctttgcatgcttattaaaatggcttgcaaactatcgtatattttctatggaatcatatatgcagtagcagtttttcttctattccaaacctcatacttctttattcttgaatagaagtgtcatagtgggattttttcttattcctgatttccggagactccaatatatcatttttcattttagaaagtttatttttcttgctatattggtggaagcttttttcttaagtgatgaatcaatgtaaaattttatacttttttattttggaaatttctagtttattagggtcctcttttaatggacaaggcagtagagactcaaaaaggtaatggagtttatttatttatttatttatttgattttcaacttttaagctcaggggtgcatgtgcaggatgtgcaggtttgttgcataggcaaatgtatgccatggtggtttgctgcatagatcatctcattacctaggtattaagcccagcatctgttagctattcttcctgatgctctccctcttcccatcccccaccatccaaggccccactatgtattgttcccctccatgtgtccctgtgttctcatcatccagctcctacttacaagcgagaacatgtggcgtttggttttctgttcctacattagtttgccgaggataatggcctccagttccatccgtgtccctgcaaaggacatggtctcaatttttttatggctgcatagtattccatggtgtatacgtaccacattttcttaatccagtctatcactgatggacatttaggttgattccatgtctttgctattgtgtatagtggtgcagtgatcatatgtatgtatgtatctttataacagaatgatttatattcctttgggtatataagcagtaatgggattgctgggtcaaatggtatttctgcctctaggtctttgaggaatcgccatactgtgttctacaatggctgaactaatttacactcccaccaacagtgtaaaagtgttcctttttctctgcaaccttgccagcatctgttgttttttgactttttaataatagtcattctgactgatgtgagccattgtggttttgatttgcatttctccaatgatcaatgatgtggagctttttgttatatatttgttagctgcatgtatatcttcttttgagaagtgtctgttcatgtcctttgcctactttttaatgtttttttttccttgtaaatttgtttaagttccttgtagatgctggatgttagacctttgtcagacagatatattgcaaaaattttctgccattctgttagaaactataatcagcttgatgatagtttcttttgctgtgcagaagctcttcaattagatctcatttgtcaagttttgcttttgttgcaattgcttttggcatcttcatcatgaaatctttgcctgtgcctatctgctgaatggtattgccaagattttcttcttgggtttttatagtcagggttttacatttaagtctttaattaatctcgagttgatttttgtatatggtgtaaggaaggagtccagtttcaattttctgcatgtggctagccagttctcccagcaccacctattaaatagggactccttttcccattgcttgtttttgtcagatttcttgaagatcagatggttataggtgtgtggtcttattcctgggttctctattctgttccattggtctatatgtctgttcttgtaccagtaccatgctgttttagttactgttgccttataatatagtttgaagtcaggtagtgtgatgtctctagctttgttctttttgcttaggattgtcttgggtattcaggctcttttttggttccatatgaatttttaaatagtgttttctaattctgtgaaggatgtcaatggtagtttaacgggaacagcattgaatctgtaaattgctttggacagtatggtcatttacatgatattgattcttcctatccatgagcatgggatatgtttccatttgtttgtgtcatctgtgatttctttgagcagtgctttatagttctccttgaagaggtccttcacttcccttgttagcctgggtattttattttctttgtagcaattgtgaatgggagttcattcatgatttggctcttggattgcctgtttgtgtataggaatactagcaatttttgcacattgatttttatatcctgagactttgctgaagttgcttatcagcgtaagaagcttttgggttgagaggatggtgttttctaggtataggatcatgccatttgcaaacaaagatagtttgacttcctctcttcctattcgaatatcctttatttctttctcttgcctgtttccctggccagaacttccagtactacattgaataggaaaggtgagagagggcatccttgtcttgtggcagttttcaaggggaatgcttccagcttttgcccattcagtatgatattggctgtgggtttgtcatacatggcttttattattttgaggtatgtttcttcaatacctagtttattgagagtttaaacatgaaaggatgttgaattttattgaaggccttttctgcatctgttgagataatcgtggtttttttctagttctatttatgtgatgaattacatttattgatttgcatatgttgaaccaactttgcatcccacggatgaagcctacttgattgtggtggataaactttttgatgtgctgctggattgagtttgccagtaaaattttgtaatttttaatatctactaagataaatcatatggcttttttatcccattaatgtggtagattatgttaatggcttttgtagtgttaaatcatccttgcattgccaaataaactatacttagttatttaaaaagaatatattgctgtaatcccagcactttgggaggccgaggtgggcggatcacaaggtctggagatcaagaccatcctggctgacacggtgaaaccctgtctctactaaaaatacaaaaagaaattagccaggtgtggtggcgggtgcctgtagtcccagctactcgggacgctgaggcaggagaacggcgtgaacccgggaggtggaggttgcagtgagctgagatcgcgccactgcactccagcctgggcaacacagcaagactccgtctcaaaaaaaaaaaaaaaaaaaaaaagaatatattggtggatttttttgttactattttgtttaagaattccttgtagtttttgtttgtagtaccgatttttctttctagattatagaagaagctcagcagctttcttcattttctattctctggaaaaatttttataacataggattttctcatcatgaagatatggtaaaacttatttccacatcctccatacttgatggagtttctaagtaggagggcttttaaaaataatttataaattgaaatataatgtatttatgggaaaattgcacaaatgataaatgtagctgtagctcaatgaattttcacaaactgaacaatctcatgtaaccagaatccagatgaagaaacaaaaaattaccaatgtcccagaagcccccactgtgtgccctttcagccactgccttttctgagggtgaccacctactccagtttctaaactgtgtattttaggggggtttggttcgtttttgaactgtatacagatgaaattatacagaatgctttttttttggtatatggcctttttcactctgtagtgtatttgtgagattcatcatgttgtattgtgtagttgtggttcattctgtttgctgtgcagtatactattttgtgattattcatacaatagaacatattacatatttatgtatccattctaccattctactgtgtgtgtgtgtgtttttttttttttttttttttttttttgagacagtgtctctctctgttgcccaggctggagtgcaatggcagatctcagctcactgcaacctccgcatcccacgttcaaacaattctcctgcctcaggctcctgggcagctgggattacaggtgcatgccaccacgcccagctaatttttgtatttttaattgaggtggggtttcaccatgttagtcaggctgatctcgaactcctgacttcatgatctgcctgcctcgacctcccaaagtgctgggattacaggcgtgagccaccatgcctggcccattctactgataatggagttttgcatgccttctagttttagcctagtgtaaatagggctgctatggacattttggtggacttatttgcacatttctttcaacctaggagttgaattattgggtcatcagttatgcatgtatttagcttagtgatgttgccaaacagttaagttgttgaactaatttatattcttaccagcagtgttggagtactggttgctgcacattcttgttgggcttcgtatttaactactatattttagctactctagtgggtatattgaataacatgtagtatgctgttaacttgcctttctttgatgattaagcacattaaacacttttttcatatacttattggttatttgtataattttggtgaagtgatgtattgcttctcgacatgctataaagaaatacctaatactgggtaatttataaagaaaagaagtttaactggcttatggttccataggctgtacaggaagcataacggcttctggggaggcctcaagaaactttgaatcatggcaaaagacaaaggggaagcaggtgcatcttacatggcaggtggaagagagagaggagggatgtgctctacacttttagcaggaggaagagagagaggaaggaggtgataacacttttaaacaaccaggtgtcgtgagaactctatgaggagaacagcaccaaagtgatggtgctaaaccatttatgaaggatccacctccatgattcaaacaccttccaccaggccccacctccaacattggggattatacttgaacgtaagatttgggtgggacacagatccaaaccataccaagtgcctactcaagtttttgtccatttgagttgtctgcctttttcttaatgacatgcagaagttctttatatattataaataccaattctttgttgattttatgtactacaactagcttctctatgggtatatttttattagttactcagtttttaaatagttatccaaactttctatttccttttgagatctttttaataacatttttccagaaagttgttgatttatcttaatttttaaacctactgataaaaagttgtttaatctatttttggtatcctttcaattattctagaaaattattagttgctatcgctttaaatattgcatatacaagtatatatgaggatgtgtgtgtatttttaatataactggtagcatactttacatactgttttgtaccttattttcttcacttaatatttcttggaaatccttgcatttcattatataaggagtgcatcatttaaaaaatactttcatagtatttaataatattatgtgataatatatttacccaattttttattgataggaatttgaattactgctagtcttttgctgtaccaagcaaagctgaaattaggataaatacataaagtggaatttctggtcttataaactcctgggctgatgatagagtattaacttttatgtttatgttccatttttaatgttttaagtcttttagaaattgagatataaatgacatgcaataaaattcaccattttaaagtgtacagttcagtggtttttactttattcatggagttgtgcgatcactaccagtatataactccagaacattttcatcatcccagaaaaaacccttagtagtcactccagattcctgctttcccccagctcctggcaccctctaatctattagttttctgtcactgtgtattcgtctattctggacctttcatataaatatagctatacaaatgtgatcttttgtgcttggtttcttttacttagtataatgttttcaaggctcatctatattacaacatgtatttatgcttattttcttttatgtatggtcaaataatatttcagtgtatggatataccacattttatttgatggttatttgactcagttttactttttgtctattatcaatagtgctgctatgaatacttgtatctacgttttgtttggacatgtgcttttaattctcttgactctatatctgggagtagaattgctgggttctatagtaatcctatgtttaactatttgaggaactgccgaactgtttttctcagtagctgcaccattagcactgtgtgaggttccaatttcttcacacttttatcaacgctttttattttccttacaaattaaaaaaaaaattatacctgctattctaacgagtatgaagtggtatatcatggttttgattttcattttcctaatgtctaatgatgttgagcagattttcatgtgctgattggatatttacatctcttctttggcaaactgtcttttcagagcctttgcctcttgtttaattgggtaatttgtctttttattgttgagttgtaagagttctttatagagatacttatattatgtgtgttgataaagggcaaatatctccatatgaagtgttcctttatgttaatgagagtaaaaatgctaacttccaaatagaaaaatggccaaataatacaaaaaggaattcacagggaagaaaaacaagtagctaatagtaaaaaaataaagaaaaagcaaattacattactgaaataaatgcaaattggaatgatgacttttttgcgtattatatttttaaaaatatgattttttttgtgggtgagtatggggtgaaactctcaggtaacataggaaatgtaaattgattacctttgtagaggatatttggcaacattataaaattatatagaatatgtctatataatttgaatcagtagttttacttcttggaattttttctgagaaaataatcattattttgcatatagattacatacagtgatactcatgccagtatcatctttaatggcataaatttataatcagcaagaggatggttaattacatatagtacaatattttaccattgttaaaatttatattttaaaatatagacaaattgatcttcatataatgttaatgttaagtgaaaagtagtaagatacaaagctgtgtaaaatgtatgataacaattcataaaaagcaacattcacccacacaaaaacctccaccaccacacacacacagaaataagagtgaaaataaacattccatcatattgacagtgattaccttcgggcggtgtaattaaggttgatatttattttctcctttatgtagttctgaatttcccagatttttaagattaaatatgtattgctctctaactagggaaagaagtaaaataattataaataagatagattaaatggattattatggtgcagtgagaccttttcccattggccctgggattttcttcctttggtttatgagtttaaagtgttgacagttgtgaactagtttgctaagtgataggaagcagtgttgaaatgaaatactttaaatcctgaagatttatgaggaagaaaatacttgggcaaatagtgtcaatgagtcctgatacgtattgctaacttgtcactagttcactttacatctgtgtagtgataactttgttttttcctccctcattgattatagtctctcatcccaccatttgccaaggccgtgtaaatagtttgctgtcgtagagatacgcagcaggcccatttgagtagttctctttcactctgatctccttagaaacctatcacttttacctttaaatgatacatttttaaaaaactattgttgttgttgaatgggatttccctaaataagaagagccatctccctagtttcaggattgtggcttctttaattgtaatggagttttaatattatatctacggtggaaatcagagtcaattcaatcttattttgcatcccctgtatgctatcatactgattaggggtgtaacaaagaatggactgtgatttttgccattttgtggttttcactggagattttatagtacagagggagagaatggcatagtaaataaaagaatgagcttagaagtgagactttgtgggtttaaatacctgctctctaatttatcagtttgtatttaacttctcaatatccttatctgtaaagtagaaataacagcactatcattcatcactttctatttccttatctttttgccttttcttcatggaagttttcacttccaagacattatgtttttcttcatttatttacagtaatgtaaaatcctggaatacatgtacctttttggttcactcatgtatttttagtgtctagtgtagggtttgctacataatagctcctaatattcgttccttctactgggaacttcttccaacatgaatatccatatagcttatccccatgctttatttagttccctgctcaagcatcacctcactagagagaacttgctagacgacctcttctataaaatagcaccctttagttttctctattttttcctgctttatttttcttcataatactttactgactgctaagtagtaacatcaatttatttttatattttcgagtgccttgcaaaaattagggtcttcataaatgtttgtttaactgaaattaattatcttagactattctatcttattctcatatgtaataaattaccagcttgtgactgtttatttctaggctccttcaacctattcatttgtttctatgcttatttccacttcttttttcactacactaattcagttaactgccacctgttttgtgaacaattgagtagtttctcaattttgttttgttttcctccagttcctcaacctgcacaaaacatctagcttactgctcttcaaatatgctattatcatttcattctttttcaatggcttcccataatccattgaattaaatgatattcaaatctctttatatctaattggaacctacctttccatagcactaaggagagttgtaaggaggtgagtacttggtgtaaaaattgcttatagatgtagttagcttgctatgagattaaaatgatttttaaagtacagagaaaaataagaaataactttaatgcaagtcaatatataatcaactgattatacgtgatttagtccacagatttatagaaattcagataaaaagatcattgaaaccttggctcatcagagagagcttcattagaaaaactgatagttgtttggggtcctgtatcatttattcattttatttattcagacccaatttctccctgtttttctaatacaaatatataagattttagagtaatggattctgttttgttaatataaaaatatttcttgtgtcagaagaattcagatgcttatagatattcttgtaaaatgttattatttttaatgagattgggtcttattccattactttgaaaatgtatacaactgagctgtttcttctgatcagcttatactatggacacttagtttgaagtcatattggaataatttggagaaaggtagaatttagtagatattacagaatttaggtatctattgtaaaatttaggttttatatagggcatgacattttttaagcgaatttataataaatagggctttttcaattatacagtaatgtaggttccaaagtgctattttgtgggttttctgtgtgtttagctgttttgtctgtacttatatttgtatttgtattgtacaaaggatataagtttctttgtagtttggataatcttttggatgaaagaaaggtagtgagtcatacaaaatagtgaaaaaaatcagatattttgaaataatacttctaattttccaaggatttaccaaaatagaggatgttaatttttagtatgaatttttaatgattggattggttttctgatgactgttttaattagttctgcagggcatcccatttctatcaacatagtgtgtgcaacaccttatttaccagtaatcaactcatatctactctcagtctgtaaagaggggtgtatatgaacctttacttgttattttttacttacgtaaatttatttacttttacattcctggtcaaagtgaataaacattttttatacagatgagttcatttcctcactcccatatccattccagtttctaagagccttctgattaacaggctccccaaaatttttcccttccaatttaaatttaagtaattagctttttcctaatttggaaccttggttagaaaacacatttgtttgatttgtcattagtttgggcatcttacttcaaatgaggtcatgtagctttgagtttagatgatcacagaagtgttcactgagcagcatcttcgtagctttgaggaaacagaaaaacaacttttttctactttgattatgattctttttgacagttgctttaactacagttaggtactggctgtaccagttccagtttaaacaactggactctgaacctgtttttgttctgattaagaagtttatttatatgttcaggaatacagcggcacaacctgttaacagctgtaaatttgcttgattaagctgtgtgtagacaaatttactagagggaactgttccctaaaaattccagttcacttacatatgaagttagtctggctgtttctcaccagtttccatcatttcctgccaagaataataaacattttcttgcaaagcatcgacactaaaggttagaagtgttcagtgttttatcaatcacactgggctgtcatgaatctcaataaacaaacacagagatatctatgtggatgcctggagaagccgttagaccctagaaaaataatttctttcagacagtatcctagaccttttcaaagtagataaatgtcaattatgaagagacatttattgtaatggaaataatggattcttcggtctagattttcatttactgacctagttcagggaagcttgtacttttagtggataataataagctagagcaagaaagtgtgttttcttaatttcatataactgtagatgctattatgagtattataataaagatgggtttattaatttaaacttatagtattaacatttctctaccatggtctgtcaggcaaactgtggctcacgactggtgcacagcgtgttattgtagcactcacaagttaagaatgggtttatagttttaagtgattgtaacaaacataaaacaaagaattttatatatatatatctagagagagcgagagaggagagagagccctcaaagtctaaaatatttattatctggccctttaagataaagtttgccaaaccctggtctatattagtagtaatagtttactaccagcattcaaaacgtgccagcaacaaagcaggatgaaattatagtcttagtgttagggtattttatttcttatttagtgttaggatattttatttcttatttgcatgtggtatataaaataaaaatataacagtatccttatagggttattgggagcattaaatcataactttttgtggtgcttcttacacatggaggacaataactgttttgttagctgttgctgttgttatatgtcagatgcctgacagttgtttcaactttgttttatgtgtgtatcttctgtttattctctgctctatttgcattatgtttaattttgtaagtcttttaaaaatctttttgattttagttgcaatgcaaattttaaaagtatagcagttttattgttcccattcctgtggctgtgtaacagattaccccacaacttagtggcacaaagcaatcagttattatgctcacagattctgtgggtcaggaattcggacagggcacagcaggaatggcttctcttagttccacagtgtttgaggctggaacctcaaaggctaggcactataatcattcattcatttatatgtctggcagatgtcactggctgttggccccagttcctctccacatgggtctttccatgtgatgtctccaaatgaactagtttgggcttccttaagtagagtgtctgggttcctcagagcaaacatttcaaaaagagaaagataggcagaagctatatccttcttatgacagagccttggaagtcacagaacattatttctattttgctctgttggccagaataattagaaatccccctaggttcaagaggagagaaatagactctaccatgtgatgggtggggttggcaagattctggaagagcatgctggaccagaaatacggctgaagccatttttggaaatatgatctgccacaatgatattactttatttaataattgcttatgtagcatttaatctatatgctagggactactgtaaatactaaacaaatattaattcatttaatccataacagtcttattttacagatgaggaaactaaatcagaatattgtattacgtagaatataactttctctgctcttgatggacaacaaataatttactatgattttaaaaacttgtctagtattatttaaacattaaatattttggatgcaaatttgcatttcctgcatgcatcatattagaatagacttgagaggtgcagtttctattaagtaatgtcttaaataagtacaaaggtcaggcatccaggagctcatccttccatattcttagaattgggatgtgataaataagtcagaattttttcatgaagcagtgcccagatgagtacatgttatcaaatattttatttgataataatgcaggactgactgaccaaacttgatttataaattagttccatgtccttttatgagaataaatacaatatcttggtcttgttgtgataatattacctaatggctatgttttccttcattggcattgaaatcagaactgatttttggtaaggttagtaatttgcgttatttttaaatctccattattatgaagatattttatcagggacaaagattgccttttctctctccctctccttttcttttctttctttttttttttttttcccattaacagttgatggaggaaggtaactttgtatgagttattgttggacatgcaagccctgtttttttacatttgttgattctgctttggagatttatcagtctctgagcaagttgctttgaagcatttcagtcttctttgtctctcagaacccattagtgctatcttcaggatgtgccagagtgacttttaccctggtacatttgtgacacagttacaccatatctcctactctctactcatcactgtatagcaagtacaagttaccagatagaagcatattcttgttggattatcaaaactcaggtggagtgtttaacatcttttttgaatatttaaatagtgtttttctttctaattggcaaattttgggtattctttaaaaacaatatttgattaggagatcatggagaaatttgtatggtcaaaacttgccaaatttgagactcacttatttgtttaaatttaaggatcagtaaaaataaataaataaataaataaataaatgtaggaatctaagatagagacctgtactattctgaatgtgaatgaactgattacattgattggaatacgtaatttaggagcattcattattactttttgacttggaaacaatataagaatgaatgcaaaaaaaaaaaaaaaaggagcatgtggattcattgctatcttgtttactgctcagtcacttatttgagagtgccaaaccctacccactagggccacccgggatgctttgtttatttgagagggggtgtggaggcatggtgaagggcaggagctccagagttaggctgactgggttttaaacccagccctcctgccatctgtgcaatcttggtccagttacttaaaacactctgtgattcagtctgcttttctgtaaaatggctgagttttctcattggtagaaatggcatctacttcatggtgttgtaaacattaaatgattaaatatatgtaaagtgcttaggatagtgcttagcacattataagctcataaatgtgcgctcctattcattaaatcattctttcattcacttattaaaagcatgacatttatttaacacctactatgatggggatacaaaggtgactactcaggagatatgaatattataatagggggaggcagaggtatattatagtcattacaacatacgatggtgtattagtctgttctcatgttgctaataaagacatacctaagactgggtaatttataaaggaaagaggtttaatggattcacagttccacatggctgggaggcttcataatcatggtggaaggcgaaggaggagcaaagtcatgtcttacatggccgcagagaagagggcgcgtacagaagaactgccctttataaaaccatcagatttcgggagacttattcactatcatgagaacagcatgggaaaaaacctgtccccgtgattcaattacctcccactgggtccctcccatgacacgtggggattatgggagctgcaattcaagatgagatttgggtggggacacagccaaaccatatcaggtggagagtgatataggttataaaacaaatatgtcaaagtgccatgaaaagaagaggacaaaatttttgatagccttaaacaatcgtttcacttttctctgacaccatttattcatttataaatgccttaccttttatggaacttttacagttcttcagcaggaaataatctctcctttattggcatccctatatcattttgccttatggcaattattattttctatctttcttttggcagctgttgatagtaatcattttgtatcttgttaaatcattatttgttcctatcttgtccattttacttgaagacagttcacagtcactcaacacagtacttatcaaaaatgcttcaaaaatatttactgagtgagtcaggtaacaaaacgattaaaatgcttagccatcagcgtatgcctctattttttaagggctttttataagcaaatacgggtagaaaaacattggcagtttgagagtaaaataaacatatataactcaccaactgactgatcaggataattatctgggagtctctgggggtaaaaagcccccagtttgttccattttacaactcccaccatggcctcagtcaggccaccaacatgatacaactagatgtggagtttggaagggtgtgcactggaacaccatcatatagtaatcctgccaactggatacaatagtgtaagcaaccccaagagcacagataatagtaaaatgtccaacatatttaacaaatgaggtgttttgagtatttattatctttgttttaatataatttttatttattggtacatttataacatttagctttaaatgatggctgtgtttaacaactggcttagaaaattcctgaaaatttagtagtcagctcttgtgaaagagtacaagccaactcacatacacttttacccaggctctgctgactgtgtaacttttgctagtaatttcactcctagaatctgtgctaaggaaattatctgtgaattggaaaaagcacaaagatgtttatcatagcattagtagtaacagcaaaaagttggaagcaacctaattgtttaaagtgagctgtggttaagtaaattcactggaatgttttctggaattaagtgacttctttgaagactttataacaacaagggaaaatgccataaagttaaatgaaaaagaaaaaagaaagaatgctaaatatctaatttatatagaatgatcaaaatttaaaaatatagacatatgctaatggaagaaggaaatgtcagtgtttggagctaataaggacatggctttttttctttaaccctttcttcattttccaaatttctaataatgagtatattttataattataatgaaaagatatatcatttttgtcacaaaaccaaattctaatttatagctctagttttttgttgaattacaaggcattatcaaaataaatcttttttattttattttttttgagatggaatctcattctgttacccaggctggaatgcagtggagtgatctcagctcactgcatcctccacctcctaggttcaagttattcttctgcctcagcctcctgactagctggaactacaggcacgtgccaccatacccggctaaatttttgtattttagtagagacaaggtttcaccgtgttgcctagggtggtcttgaactccggagctcaggcagcctgcccaccttggcctcccaaagtgctaggattacaggcgtgagccaccacacccagcctatcttttttatcttagaaatttaatattttcctctaacaaccaatagagcatataccaattgaatttgttttttagagatcaatgctgagttcattttgcccctagattttatttacagtctatcatagattttcatggaggattttaaagtttgaatttttcaaaagtatcctacattacaaaataaattttaggccaggcatggtggctcatgcctgtaatctcagcactttgggaggccaaggcaggcagatcacgaggtcaagagattgagaccatcctggccaacttggtgaaaccccatctctactaaaaatataaaaattagctgagtgtggtggcacgcacctgtagtcccagctactcgggacgctgaggcaggagaatgacttgaacccgggaggcggagattgcagtgagctgagatcgtgtcactgtactccagcctagtgacagagcaagactccgtctcgaataaataaataaataaataaataaataaattttaactgcagaattacctatttaaaaagctgcttagtagttaagtagctgattgtccctttaaaacaattgatagttatattgttctaaaattgagtctgggtctgtgtgtcccacattcgtgtctaagctatgcattgttaaaattttatttgaccatttatagcttgtctcactttgtgaaggaatttttcagaccttttcaaaatacatttaaatataagcagataatctaattttacacacttcctgtcccctttttaatcagtaattggttaacttcaatagacaatttagacaagctaagcttctgtgtaatttttctccctaaagattaagatttgatgaaataaataatctgtagcgtaccttgtagaaggaaaatgctttcctaattactttttaaaggtactaatttaaatgtcacagcaagttctgttaaggttttacttctattttaaggttgtaatatctgttaccactctatttacttggtgtgggcgagtttcaacaaggattagattttttaaattaattctctatatttttatgggggagaaattgaagcattccattatattgtaggaattcccggaacttcttagtattccttttctaccttgttaaaccattaatttgtttctatcttattcattttacttgaagacttaaacatttctgtatcactgacagccactcaaacagtactcataaaaaatgtgtcataaacatgtactgagtcaagtagcaaaaccttttaaattattcagctttttatgtgtctggattttgagtcatagacttgtgtgtgccatggggtataatgaatgggtaatggactttggagtaaataagcctaagttcaaagtctgattcttccatttaccagctgtgaaaacttgggtaattattctttgggcctcagacgcatctctgaaatgaatataataatccctagcttgtggagttgctgagaggattagagataaaatatgtaatgttccttgcatatagtaagcattcaatacatggttagttattaggcattcagtaataattgagtggatgactgcttcagggaaaatttggtggctgatttactgaaacacccagtaaacatatatgaaaaaaaaaaacacaccaaaactgacttttagttagaacagtttagagaaactgagagtcagtttataaaggagccttgcaaggaaactgaaaaggtgaaatagacgggaacaaaacctacagagtaccgctgcagtggagaaaagaagtttcagaatgctagaatggtggcagtggcaaattctatagtgaattcaaacaagaaggtcaataattggtcatctctggatttggtcacctttgttatttcccaatttctgtatattctttttatgatcatggttgacaaaagtatagcgctgaacataagacatgctaggaaggaaaatgatttaggaggtacagttgattcttgaaaatcatgggtttaactgcatgggtccaattatatgtagatttttttcaagcaaatttccattgcaaatacagtatttatgagatgcaaaacctgcatgtatggagggctgacatttcatatatgtgagttccagagggtggactttggaacttgagtgtgtgtggattttggtatatgtggtgcaggagtggccctggatccaattcccagtatatgccaagggatgactgtgattttatcagttaagattaggatgactgcgtataacaaaaaaagagacatctatcttatttcttgttcgttcttaccgtattgccacattgtccaatatggctgctagagattcagccattgcatcagtattacagctggcaggaggagaaaagaccaaaaagaatgtgccccttccctgtaaggacatttctgggaagttacacattgcactttctctttggctaaaatttagttctatggccacagctaactgcaagaatgacaaccagaaatattgtcttttggctgagcatagtgtacccagctaagctttggggttcttatttttaggaagcagaggaaaattaccagatcataacaaggtgatgagcatggcctctaatcctgcttttcttttctttctttttctttaacggggtctcactatctcacctagactggagtacaatggtgcaatctcagctcactgcaacctctgtctcctgggctcaagcaatcctcccagctcagcctctcgagtagctgggaccacaggcacgtgccaccatgcctggctaattttttatatttttcgtagagcccagggtttcgctatttgcccaggctggtcttgaactcctgagctcaagcaatctgcccatctcagcctcccagaatgctaggattacaggtgtgagccattgcaccagcctctttgcttttttaatgttttaactctcagcgtcttttaaaaacatcacttaaagttactttaaaattacactagaaatacacttccttttagaaaaaattaggaaatatagaagactaaaaaataggaaaaaactacctaaaattgtccactattaacatttttggtgtatatctgttcagactttttctgttaatatgtaaatattcatattacttatatatatagagtttcagtttgggatgatgaaaaggttctgagatggatgttgttggttgcgcaagactgtgaatataggtaatgctactcaactgtacacttgaaaatggtttaaatggtaaattttatgtatactttactgcaatttaaaaaacattgattgtttacaaaaaggagatcaaactcaacatattattttctaatctgctttttagaggtaagagaatacctttccatgtaaaaatatatatgtttgcagcatgatttttgtggctgaatatttattttatcctttaggtgtaccaccttttattgacaagagtgttgaagcaaataaacaggagtgttagttctttccttgttaagtggattcacagagagctttgtgatgcatgagagaggacctggggaaataaccagatgatggaaactgaatacccccctgggaccttacactgtgtctgccttgttcaagtgactctctaaataaacagttttactgctctgaggacaatatagtacccttttgtttttttcacatataattattatttttagttcatctaaaagaatgtcccaactaagttaatgttctattagaggactcagggcaaaagagagggataaagggagaacattgcctcctgagaaatgatgccttcacacgaggatcagatgccagtgatggcagcaatgtctgcaatttcgatattgctaagccactctcaggaaggtttttcctgattggaggtctggctctcccgtgagatggtgtttctcttacagccagaatgtttgtcattttcccatatcttcactgtcacagggtcattgtccttctaagtcttccctgccacttttagaacgtcattttttcacctactataaaatactctgcctctttgttatatgggtaaacaaattgctacctagctaaactaagtgttatttcttttctgtgctgttattgacatttgtcccccaactcccttccactttactcttcatcttatttacaggcataccttggagatattgtgggttcagttccagactgctgcaataaagcagttatagcaataaagtgggcaacacaaaattttttgtttcctaatgcatataaaacttatgtttgcactgtacggtagtctactaagtgtatcatagcattatgtctaaaaaatgtacaagccttattttaaaaatatggttaaaaaatgttaacaatcatctgtgccttcaatgagttgtaatctttttgctggtggagggtcttgccttgatgttgatggcttctgactaaacaggctggtggttggtgaaagttgggtagctatggcaatttcttaaaataagacaacaatgaagtttgttgattgactcttgaatcagtttatttgcttggtaataagagtagtacccaataggtagtttttcaacctatactcctctccattcctcccacccctagtagtccacagtgtctattgttcccatgtttatgttcatgtgtagtcaatgtttagctcccatttataagtgagaacatgtattgtttggttttctgttcctgcattaatttgcttgggattatggcctccagctttctccatgttgctgcaaaggacatgattttattcttttacatggctgtgtagtatttcatggtatatatgtaccacattttctttatccgatccattattgatgggcacccagattgatactatgtctttgctattgtgaatatcctggtgatgaacatatgagtgcctgtgtctttttggtagaatgatttattttctttcaggtatatccccagtattgggatggatgggtcaaatggtagctctgttttaagttctttgagaaatagccatctgttgttttttgacttttagtaatagccattctgactggtgtgagatggtatctcattgcggttttgatttacatttttctgacttttagtgttgatgggcattttttcatgtttgttggctgcttgtctctcttttttttttcttccaactcttatttcaggttcaaggggtacatgtgcacgttcattacatgggtaaattgcatgttgtggggtttggtgtctagataattttgtcacctaggtaatcagcataatacctaataggcacattttcagtcctcacccttctcccaccctccaccctcaagtgggctctattgtctattttcttcgttatgtcctggtgtactcaatatttcacttgtacttatatgtgagaacttgtggtatttgggtttttgtttctgcattaatttgcttaggataatggtctctagctccatccatgttgctacaaaggacatgatctcattcttttttatggctgtttagtattctgtggtatatatgcaccccattttctttatccagtgcattgttgatgggcagctataataggttgattccatgtctttgctattgtgcatagtgctgcagtgaacatacatgtgcatttgtctttatggtagaatgatttatattcttttgggtatatacccagtaatgggattactgggccaattgacagctctgttgcaggttctttgagaaaccttcaaactactttctacaatggctgaactaatttgcagtcccaccagtggcgtataaacattcccttttctccacaatccacaatctcatgaacatctattattttttggtatgtcttctttttttttgagacagtctccctctgtcatccaggctggagtgaagtcctggctgactgcaacctccgcctcccaggttcaagcggttctcctgcctcgcctcctgagtagctgtgattacaggcgtgcgccatgaggcctggctaatttttgtatttttagtagagatggggtttcaccatgttgtccaggctggtcctgaactcctgacctcaagtgatctgcctgcctctgtctctcaaagtgccaggattactggtgtgaggcaccgcacctgacctgctttttggtatgtcttcttttgagaagtgtttgttcatgtcctttgcccattttttaatggggctgttttttgcttgttgaattgtttaaattccttatagattctggatattagacctctgctggatgcagagtttgtgaatactctctcccattccgtgggttttctgtttactctgttgatagtttcttttgctgtgtggaagttctttactttaattaggtcccacttgtcaatttttgttgttgttgttgcatttgcttttgggggcttagctaaaacttctttgcccaggttgatatcaagaaagttattttctgggttttcttctaagacgtttatagtttgaggtcttacacttaaatatttaatctaccctgagttaatttttgtatatggggaaaattaggagttcaatttcatttttctttatatggctagccagctatcccagcaccatttattgaatagggagttcttttcctattgcttgttgtcagtcttgtcaaagatcagatgattgaatgtgtggctttatttctgagttttctattctgctgtattgatctatgtgtttttataccagtaccatgctgttttggttactgtagccatatagtacagtttgaagtcaattagtgtaatgcttccagctttgttctttttgcttggtattgctttggctatttgggctctaaaattctatatgaattttagaatagttttttcctaattctttgaaaatgacattggtagtttgataggaatagcattgaatctgcagattgctttgggcagtgtgaccattttaattatattgattcttccaattcatgatcatggaataatgtttcttcatttatttgtgtcatctctgattttttcagcagtgttttgtagttgtccttatagagatctttcccctccttggtttgatgtattcttaggtattttatttactttgtggctattgtaaatgggattgtgttcttgatttgattctcagcctggatgttatggttgtatagaaatgctactgatttttatacattgattttttttaaaatcctgaaacttttctaaaactgtttattagccctaggaggcttttggcagagtcttcagggttttgtaggtatgaaatcatattgtcagtgaagagagatagtttgacttcttcttttcctatttggatgcctttttatttattttttatttttttgcctgattgctgtggctaggatttccagtagtatgttgaatagtagtggcgagattaggcacctttttcttgttccagttctcaaggggaattgtttcagctcatactcattcagtatgacattggctgtgggtttgtcatagcttttattattttgaagtatattcctttggtgcctactctgttgagggtttttttaatcacaaagggaagttggattttattgaaagctttttctgcatctattatgatcatattttttgcttttaattctgtttatgttgtgaatcacattgattgatttgcatatgttgagctagccttgcatctcaggaatgaagcctacttgatcatggtgtattaaatttttgatatgctgctggattcagtttgctagtattttgttgaggatttttacacctatgtttatcagggatattggcctgaagtttgctacgtttattatgtctctgctagattctggtatcaggtaatgctggcttcatagaatgagttatggaggagtccctcttcctcaattttctgaaatagttttagtaggattggtaccagttcttctttgtatgtctggtagaatttggctgtgaatccatctggtctaggctttttttttttttttttttttttggttggttggtagggtttttaaaattattattattactgatttaatttcagaactcagtattggtctactcagggtttcagtctcttcctgattcaatcttgggagactgtgtgtttccaggaatttatccactttctctagatcttctaattagtatgcatagagttgttcaaagtagtctctgaggatctttcgtttttctgtgggatcagttgtaatgccatctttgttatttgtttactaatttgatctctctcttttttgttaatttagctagcagtctatcagtcttgttgattctttcaaagaaccagctgttggttttattgatctttcgtatggatttttatgtctcaatttcattcagtttttctctaattttagttatttctttttttctgctagctttgagggtgtgttttttctgttagttgtaaagttagattgttaatttgagatatttctaacttcttgatgagggaatttcgtgttataagctttcctctcaatgctgttttagctgcatcctagaggtttttggaagttatgtttctattttcattattatcatttttttatttctgccttaattttgatgttcacccaggacttattcaggagcaagttgtgtaatttccatgtatttgtgtaattttgagagatcttgttggtgttgatttctgtttttattgcactgtggtccaagagtgtgcttgatatgattttgaattttttgaatttattgatacttgctttatgatcaaacatatggttgatcttagaatgtattccatgtggagatgagaagaatatatattctgtggttattgggtagagtgttctatagatgtctattaggtctaattggtctagtgtcgaatctaagtctagaatttctttattagttttctgcctcaatgatctttctaatgctgtcagtggggcattgaagtccccctctatttttgtttagctgtctgagtcttttcataggtcaagaagaacttgttttatgaatctcggtgctccagtgttgggtgggtatatatttaggatagttaagtcttcttgttgatgtgtaccctttatcattatgtaatgcccttctttgttcttctttgttattgttttgaagtctgttctgtctgatataagaatagtaactcctgcttgtttttattttccatttgcatgctagatctttctttatctctttacttggagcctgtggatttcattacatgtgaaatgaatctcttaacagcagacggttgagtcctgtttttatattcagcttcccactctgtgtcttttacatgggatgttcagctcatttacattcacggttagtattgatatgtgagattttgatcctgtcatcatattgttgcctggttttcatgtaagacttcattgtatagttgctttatagtgtatgtaggcgccatgcttaagggtgttttgtggtaacaggtgtcattctcttgattccatgtttagcactcccttataggcctcttataaggcttctctagttgaaatggattccctcagcctttgcttatctgagaaggattttatttttccttagtttatgaagcttagtttggtgggatatgaaattcttggttggaatttcttttctttaaggatgctgatagtaggtcttcactctcttctggcttgtaaggtttctgcttggaggttccctgctagcctgatagggttctgtctgtacatgacctgacccttctctctagctgcctttacaatttttgtcttttacattgactttggtgaatctgatgtctgtgtgcctcggggatggtaatcttgtatggtatctagctgagcttctctgtatttcttgaatttacatgtcaacgtgagattagggaaattttcgtggactgtatcctcaaaaatattttccaagttgcttactctctttttttctcactcaggaatgccagtgagtcatagatttgatctctttacatgcgctcatatttcttgaatattttgttcattttttaaaattcttttttcttggtgtctgactgagttgattcaaagaactggtcttcgagttctgggattctttcctcagtgtggtctgttccactgttaatacttccaattattccaattatgaaattcttgtagtgaatttttcagctctagaatttcagtttggttctttctgaaaatggctattttgtctttcagctcttggatcattttactggattccttggttgaggtttcaactttctgctgaatctagatgagcttccttgccatctagattctgaattttatatctgtcatttcagactggttaagaaccattgttggggagctagaggactcatttgtagttaagtggacactctggctttttgaactgccagaattcttgcactgattttttttctcatctgggaagtttggtgtttctttatctgtgatgcaggttgagtatagtcagttggcgtcatttctgggtattttcagagggtcaggactctgtacagggtctttgtggctgaattcttgcccctggtttcatggagttaggggggcatattaccaaaatatttttggtggtgtacttcaggctgtgatctggtagatggcacttaagagtaatgatcagtagctaggcttttattcatctgtgtgtcttctttgtatttcctcatgttgcagtcatgccctctgtcaccagtacgttggggagagagatgacctttccaccaggtttgcttctgggccttgggggagccccctctgatcactgttaccatgcctgcctttcttttgctaggtgttctgggccatgaggctctcttgggcagaaaccatggcagggagataggccacaccctttctatattgaccttgcagagggatgcatgccctgcttttatgccaacccagaaacccacacatctcaccccctcagtgctctgtgagtatgggctcctcctctgctccagtgccagccacataactcgacttggcactcccgagctgtccaccacagccctggggtgccgggactaacttggggctcatctgctggaccctcagagttgggttttggatattttgggggatctgaagtgctcccaggctgctggaaatgtactcaagaggagcagagcatccaggctggacaggagaggctgcactgcacacatgctcttgcagtggggggtcagggaggggccctggaaggagatggcaggcaagtggtcctgtagcacagatgtgcccccatgctggccctactttctcctgcctcagcggtcagctgggttagagcttcttggagggagatggggagccctgggagatgggtgtctatggctgtgctctgctggcctctcccacgcacagaggtccttggctccatgctggctgaagccctgattctgtctactccctgggcatatccctttgccagctcaaatatccatggtggatgtgggttcccctgtagctaggattccagaggtccacagtgatagtgtgcagtcccacagtctcttcattaaccctctcccgtggagctgttcagggctgggaagtagccctaggctttgggtagctcacacagggttcccagcttcctgtctcatcagtctcagtatctctgtcacatctccatctactttcagtgtttcttctctgaagatccgttcaaattgtgttggtttacttgaaattttggtctctcttgtggggagcagtgcttcttggcttcatctagtcagccatcttgtcctttttcaaactttttttaaaatttgggtcagtcctctgaaaccctgccactgctttatcagctaagtttatggaatattctaaatcttttgttgtcatttcaacagtgttcacagcttcttcgccaggagtagtttccatctcaagaaaaaaagtgttatccataagatagatccataactctttttggtaatccataagaaataaatgcttttctctcttttgttcaagttttatggtgagattgcaacaattcaatcgtatcttcaggctctacttctcattctagttcttttgctgtttttcccgcatctgcagttacttccttcactggagtcttaaactcctcaaagtaatgcatgacagctggaatcttcttcactcctgtgcatgttgctattttgaccttttccagcgaatcaggaatgttctgaatagcatctagaatggtgaatccttcccagaaagttttcaatttgctgtacccagatccatcagacgaatccgtatctgtggcacttacagcctcttgaattgtgtttcttaagtaataagacttgaaagttgaaattaatcctcgatctatgggctacagaatgggtcttgtgttagcagtcatgaaactgctattaatcccctggtacatctctattagagctcttggttgactgggtacattgtcaataagcaatactattttgaaatgaatctttcttctgagcagtaagtctcaacactggacttaaaatattcagtgaaccacactgtaaccagaggtgctgtgatctaggttttgttgttctatttccagtgcacaggcagagtagattagcataattcttaggagcctcggatttttggaatgacaaatgagcattggtttcaacttaaagtcaccagctgcattagcccattttaaaaaaagtcagcctgtcttttgtagctttgtagccaggcactgacttttcctctcaagctatgaaaatctgagatggcatcttcttccaatagaaggctgttttgtttgcatgaaaactctgttgtttagtgtagccaccttcattaatgatcttatctagattttctggataactttctgccggttttatatcagtacttcctgcttcaccttgcacttctataatatgttatggaatggaacggcttctttccttaaacctcatgaagcaacctttgctagctccctacatttcttctgcagcttcctcacctctctcagccttcatagaattgaagacagttatggacttgctctgaattaggctttggtttaaggtagtgttgtggctggtttcatcctctgtcagatcaccaaaactctccatatcagcaatacggctgtttcactttgtattatttatttgttcactggagtagcagatttaatttcccttaagaacttttcatttgcattcacagcttggctaactgtttggtgcaggaagcctagctttcagcctatcttggcttccaacatactttcctcactaagcttaatttaaagtaagagacatgcaactcttcctttaacgtgaacacctagaggccactgtagggttattaattggcctgatttcaatattgttgtgtctcaaggaataggaaggcctgaagagagggagagagatgaaggggaatggccagtttgtaaagcagtcagaactcgcacaacatttatcaattaagtttactgtcttataaggtgtgtttgatagtgcccctgaacaattacaagattacatctgtattagtccattttcacactgctgataaagacatacctgagactgggcagtttacaaaagaaagaggtttattggacttacagttccatgtggctggggaagcctcacaatcatggtggaaggcaaggaggagcaagtcatgtcttacatggatggcaggcaggcaaaaagagaacggggatcaagtgaaatgggtttccccttatcaaaccatcagatcttattcactaccatgagaacagtataggagaaaccaccctcatgattcaattatttccacctggccctgcccttgatacctggggatgattacaattcaaggtgagatttgggtggggacacagagccaaaccatatcaacatcaaagatcactgatcttaaatcaccataacagataaaacaatgaaaaatttgaaatattgtgaaaattaccagaatgtaacaaaaacacatgaagttggaaacatggtgccagtagagttgctcagttcagtgttgccacaaaccttcaatttgttaaaataccagagaggctggggtgggaagatcgcttgaggttaggagtttaagaccagcctgagcaacatgaagaaaccctggtgtctttaaaaaaaaaattgttcaatgaatcaatgaatgaacggcagtttcagatattttccactcttctcaaacatcttacatgtcatttctatcttgatcctcagcaaataactatttccaagtcaatggtaagaatagaaatctgagatggaaaatttcttcctcatttaccatcaaaactacaaatattctcccatgattattttcctctgttgcttctgctctgaatgatatgactttttttcttttcctaaaaccctaggttccatccacattcaccttagaaggattttgatttttctctgattctatctttctcccaaattctgtatgtagcctagtgattatgagcatggactttacaatcaggctttgtgtctgatttgactcaaatttgtgtctgttactatgaaatcttgggcaaattatgtatctctcagcctcagttttcttgtgtgttgaagataataatacctaggtcatggagttgtcgtgaagatcaaaagtgatatctttaaagtgctaagcatagcaggtacacagtaagcatgcaaaataaaggtccttgcattatttttacctccctttctagtggctcctaaccttattaagagtctcttgtcttaagaaattgttctactacttcagtatttagcactctctctctctcttcaccatcacagctattctccactttttatctcctatttattttggctctcacatcagcctggcttcccaagcatttcaaattttatttttaatcttatttcttttccacccctttctctccaaatttgctctgcttccaataagttcatctatcatggctcaaatcagaaaaatagcagatgcccttgttcttttgccctctctacatttaatcatcaaacagagttctgataattctgctgcctaaatagttcctaaatttttctacatctcttctttgggtgctaccatttcagtccaaggcactatcatctcacacagtattgtgacaatagccttctactattctcccctttgccacactattccatactccacactatagatagagtgataacaagaaatgttatttccctttataaacattctaatgagttttcttgctcttagggcagagctcttcttgatcaggtcttatttatctcttctttcagctctatcttataccactattaccctgtgcatgccctagctctgatgagtttctttcagtttcattcagatctcttatttcagcttttccacatagtgttcctctgctgccttcctgatccttcttggggatcattgctacttggcctctggtttcaacctaaactttacttccttgagtgaccttcgcttaggctaggtacttctgtggtctgttctttattaccgtatcatcatggtgctcatgacattttacagttccttatctccccccaagattccagaaggcaggagccatgtctttttcattctctaccacaatgcctggcctatagtagacacccattaaaattttgttaaatgttgttaaataattaaagcaagagaaaaatcatcctatataacatgttagggtttagaactacatatggtattcctgtatttaactttgaatatttctttaaacataagtaaatgtggaaaataataatgctgcttttcagcacatgctcttatttttctatcttcacacattccctaattttaaaatctctttatgtttgtttttattccagactacaaacatcaaatcttttttttttctatttggatgcttttaagtataaagtgtcacttaatatcagcacttctgccaactcttattcatttttccagctgtatttggacaacatttacatagataattttgtgaaattttcaactagaagttgagttgagataaatcatgcagttttcaattcagtgtatcctgaaagataacgaaactcactgagctgcctggttttccaacaagctacatagaaagcatgaggagggcagaaggctatggcttccactgttttgaccacttcacagcccttcccgcagactgcttggagatggctcaagtggaacctgttgataaattaatgatcctctttttcccagtcaccattgagccaaagtaggctatggggctgaatcatcccagacagggatgaatgaatgttctgaaaagctgaaacataaactgtcagttaagatgcattttcttcaagtttatttgtgacagatgatggaaggtagttgatattgactgagtttgattgtttcttaggaacaatcacagtcatttgattgttgttcctaagaaagtagtctttttaaaaaaacaaaatctgagatacaaatgaatcactatatgttaattttccttgcccttcttaggtgaccactgactatattttaccagttgttaatgtagctttgggggggattttgttcatttttttggtgcaccttggataaaaaataattggaaatatttctcattttgcaattactgacttttcatactactggaatacaggatttgtcagagttcttatctgacccagaatagattagacacgttttaagatcagtaagaatcatctgctttttttttttttggtggtggggtgggaacatggtcttgctctattacccaggttggagtgcagtggtacactcacagcttactgcagcctctacctcctgggctcaagcaatcctcctacttcaggctcctgagtagctgggactacaggtgcttgccaccatgcccagttaattttgtattttgtggagtcagagtctcactgtgtttccaaggctggtctcgaactcttgggctcaagtgatcctcatgccttggcctcccaaagtacaagtattgcaaatgtgagccattgtgcccagcctatttgtcttcttaagcctacaataagaatgttgaaaagatagtttatttatataaccccatttgatacaaaattcacatcaaatagagttaattaaataatggatgtcccttgttcatcatttcaggcagatacaaataccacttttagcaaaaaaggtaaatctcttgttttaagttacccagacgaagattatatagaaagttagggtaatgacattcccaaggcaaaagttcttcagggaaaaatagtaagccatttcagtttctcaatttctggagggcttatctgaagggattgggatgtctaatattgcaaattaggcaaattgtgcacatttatcaccatgcaccttggatttcaagcagaaataagaggaggatttgactgaagggaattaactttggtcttccaaacttaaatatataccagatgtgtactgtggaaggatcttcctggttacagtataacctctggttcttttggactcttgctaacttaatttacccagttcttttcccgtatagaaattagactgtggattgtttctgtggattatactcatggatttctgtggattatactcatggattttattgttttatcttatttacagattctgacttttttcttttctttctctttttaaaaataacttaagatgtttgtttggaagattggcaggatgttcgttttacagtgttcaaaaatgagttgtttgtgttttatgtatatgcccaaatactctgtgaaaacataaactgataaaaggaaaattaattcctatctttataaagtgaagaattgtttttttttaacaaattaacatatcctgagttacattcttgagtgagatatgagaatttaaacatataacatgaatacccccagttttgagtgctaatatgcaaggaaaggctttcctcattactgttttacaacttttatgctccataaggttgattctcagtgctagttctctttcagagagaagattcagtaaaaaacactgtataccagtccttaataacttaaatgcaaatactggcatatatccagaagctaaggttcaattaggtgtagttgtttcatcttacaaaattattttaccagcaagaaatcttggcagttatattgatgatttctcatgaaagaggcaaatgggacgataaagaggcctgaagactattttttaatactaattttctaattcctcatttttttaaatgtcagaagccaggccttagaaatcaagcacctgagttttcctctgattttctaatcattactgtggttattctagttgtctcttatctgttcggaagtcataatgtgtaatgatggcataagtgaatgttaaagaagtggaaatttgatatgatctagatggcagtttattggtttagtttcaaagacaattttacctggaaaataaataagaaagcttatcaagcttttccctgttatccgtggtttatctgttccttgtgtttcatcttgaccaccactggtcttccagaaatcgctaaaatctctcctgcctatgtcatttctttttccttacaagatcaaagcttttatgagcattatttattgtagcctcacaatattctagagagcaaagtagaggttatgtgtctccatctttatttttaaagccaagtgaggaacagataaatctcttcgctaacgttacaaaatgaagcagtggtagaggcagaaataaactcctgaggcagaaacatctcctaattctggcccttacgtctaagatgcagtagactgtttggcctttctctaaacaggcctttgacatttagggtatgtggaaagtatgtgctcccgtcagagtttcgctgtttagttattctttgcctgttaaagtaatgactagaagactggagaaagcagaaagaacatccaagtcttatttcagcctctgcgtttagtacatgtgagctttggacagagagtgcctttatttcctgggaattaacttttctctctttatacttagaaggaatttttctttggggcactgctgatattgagaatttgggggaaattattatttttttcattcaagttttatgtgtgaaaacatatattccaatactagaccacactgagaggatttggggagatgactgcaaagttttacattttaaaatgtaggtttagtgccttttttttaaacctgaaagtcattgcaaaaatcgattaaattttaaaattgacttaattcatcaatctatattgctataaagttttttaaaaactaacaacttgtttgccctatgacaaatatttttaaaaataattttcaactgtatttttatttcaatatttatcaccctgtggttattttattttatgattttagctgtttcacttttttttttctttagtatccataattgctgattgggaatttttaacacaagacaggaattgttaccctccctccccccctcccttccttccttccttcctccctcccttcctttatcctttctcctttctcctttccctcccctcccctcccctcccctaccctcccctaccctaccctccccccctccccccctcccctcccctcccctcccctcccctcccctctcctctcctcccctttcccctcccctcctctcctctcttcttttctttttttcctttctttgtcttgctctgtcaccaggttggggtgcagtggcacgctctcgctcactgcaacctccgcctcctgggttcaagcaattcttgtgcctcagcctcccgagtagctgggattacaggcacgtgccgccacacccagctaatttttatatttttagtagagacagggttttaccacgttggccaggatggtctcaatcttctgacctcgtgatctgcctgccttggcctcccaaagtgctggaattacaggtgtgagccaccgtgcctggctgcctctttctttttttaaagggctgcttttcatattgacctacatgactaaacctgagttataattcagaagaaacagttgaactattgtgtgccatcttgtcataaagcgcaggttagcacaaatgtcttgccaatgtcttaaatgttgcaatttttgtaaaatcttccgtgtgcctccaacatctccagttggtgaacagatctcactgtatttatccctgttgtgttcttccacatgtttgttttgcagcataataacacttgacagttgtaaatttttccgtatgttctgttttgtagagataaacaatgtactttctgtgtatttccctgagctttgaagacttaacttttgaaataaacaattccataggattttataggaggctttggtacgttattcacacaaactattctccttgaaagggaaggtagttgaatgttcatccttttgatataaactggttaactgaacttttccaagggatcaagcacaacttaactgcttttagctttgcaaccagggcaatgcagaccagaccagtgtttgaaagtctttaaaagtattatttgacatcataaatgaccattctgtggaataagctctctaattctctgagtggtttacttcagttagagggattagtgaattagctttggatttgcttataatttcctcttttatcttttacaaattaaaaagttggtatcggcatgtaatgatagcatctaaaacatttatgttgtggtggttgtatcatagaaaacattctttaggattcaattataagcagcctccttccattagcatgtcaagtttttctgagcagttttatttgtgaaaaatcagtacagatatttttattcatagcttgatatcctttttttttttcttactcaaatgaatatctgtttcctacctttctccctcaagatgcagtggtgcttttattatttgattttgtaaagcctgaagggcagaaatatttcttaagttttccattgttaactacaaacttggctatataaaatatacaaatcataatatctgtatggttatttttattgtcatttctttaacacacaaaatttatcacatttatgcaagaattttttaacttagaaaactcaaaattgatatgtaaattgggtggtagcaacaatgtgtgggatgtggtacgtggccaatgatgtgttggaggcagcccccaccagctcccaagatctagtgattaaattttcagaaattttgtgagccagttatcagtaaaaattaaactatataaacttacaattaaataaattatttaaaaacaaagataatactcaaaactcagtaattatgttttactacattttattatctatgctcttgaggttatttgtgtctcttgtatctgtattggaaatactatataatggtgtatactattgtatatctcttcacaacttcatgttcattaacatcatgttgatagcttcaaattagccatggtagaagtattaacaccatgaaaatcagcaaacacaaccaatcaggggctgatttattgttttgctgattgtctagacttaagaaagtgatggaaaaaatgttaataacacatattaaaaagtgtgttatatctggccgggtgcggtggctcatgctgtaatcccagcactttgggaggctgaggcaggcagatcacaaggtcaggagatcgagaaccatcctggccaacatggtgaaaccccatctgtactaaaaataaaaaatttgctgggtgtggtggcgcatgcctgtaatcccagctactcaggaggctgaggcaggagaatcgcttgaacctgagaggcgaaggttgctgtgagccattatggcgccactgcactccagcctggtgacagagcgagacttcattccaaaaaaaaaaaaaaaaaaaaagtgtgttatatatctataaccattatactatgaatagcaccaaaaacttgagaaaatattctttcaggacagtatttgaaaactattatctaattcattggagaagtggttcacgtcacagacaagtgaatgactgaagtttgggcatatgcctgtgtttaccttttatttattaactaaacaaacccatcagccttctacagcaaaattgtaagaatgagatgttgcttcaagtacatcagacattagatgctacatacatcaggaagccttttatagttctcttttgaaaactgtactactcataatatgctgtttcctactcacctatgaccctagacttcctgtttgctctaatggttgctgttaaaggtatgacaaattcagctgtaaagtgtttagttatccacatccatctctttgaccacaaattacctaagaatggtgttacactacttttgtgggaaaagagaaacatcataatactggatacataaaatcatagcttttcctttccttgggggaataattctgttatctacccactgttgggaggtagtttagattggttaatgtaagtatcaagggggaaaatggctgtattcaacagaatttgtttcccttaatcttatggatagcttcacaattcatgatagcatagttatgcaacatatatgaataaggatgaagatgagtatcatttgattaaagtatagcttctaagacttaaatgaccagaaagaattgaactgcgtttaaactctaccacacacctgctccttatagtaggataatctggtcaagcccttgacttcaaggagcttgctaaccctggtattaattgatgtttcccaaactttagtcaactgagtatcatcctcaccatatttgttctatctctgtaccgcttgtacttttatttactttgtaattttttaaattaactttttcttttaaacttagctttatcctaagtgataatactcatgaaatcttgggtttaaggtaatagttatgttttttctagtatctattaaaatattgcctaacaattacaattttagaaagacttttctttttaccaccaatggtatgtctattttgctttgggaactattgtgctagtgatgataatagctaggcattaagttaaattgtcttgtttgttcctcacatcaatgtgataagcgttgctctctctattcagtaaatgaagacaccaaaaaatcagagaagttcaacaacttgtccaggtcatgaggcaagccagaacttacctgggtaaggtccatatgagcccttggtcctcacagcattcttagagaatcacccgggagctttttgaaaatgcaaaatctctggcctcactccagacctcctgaatcagaatctgcatttgaacaagatcctccaggtgattctcatgcacattaaagtttgagaagcactgagcttaacatttgggtattctgcctcccgtaggagaagatgggtgactgggtcattagtttggttgttctgtgatctggtttggctctgtgtgcccacctaaatctcatgttgaactataattcccagtgttgtgggagggacctggtgggaagtgattggatcatgggggtgaatttcccttttgctgttcttgtgatagtgagtgagttctcatgagatctggttatttaaaagtgtatagccctttccgcctttgctctctctcctgttctgccatgtgaagatgtgcaggcatccccttcgcctcctgccacagttgtaagtttcctgaggcttcctcagccatgcttccttaacagcctgtggaaccgtgagccaactaaacctctttctttataaattacccagtctcaggtagttctttatagcagtgtgagaatgcactaatacagtctccttgtctctctgtagtgttattttcttcatgccatgctattctgagctgcaactatttttgagccatgtgatattgatgctaaggtagaagataatattctcaatccttttgattattttttctctcctaaagtcataatttgtccactttccttccttccttaattggagtaccaggactagcctgagggtcaacatttatactctcttttttttttttaatccttgttttcttccccagcagccacaggtcaagttcttgccccttctaatggtctggtcatttcttttcctgtctgcctgaaactggcagaccctgagaactgtctacaggcctatagctaattctcagtttttcctggatagttttaatagtatggatgtcatcctgactcttagcttcttttccttctcccaccagttctctgccattcagctattttaccgctgcttttctttttactaagatgtgcctatctctgcatccatgaggcctctgtttccattctaccttgcagccatctgcttctcacttttgctgttgttgctcgtaattgtaagtttaatataagcagcagcctcaggagaccccatgaaagcaatcttctggaaacagtcaaagtgctgggaatttgatggttggatctgggaatatcaataatgtctacaactgatgaatgtagctggctatagattctgaagtactccagtgcgtcatcagcatttcatgagtatactgtctgtgtgattttttcacagagtttccctttgaattttatgtctgcagagtttctaaacactgcacctggctcatacagttacaagccttctttctcagtatttatatagttgtttattcagtctccaagatgattagttatttgagatgagtagaagttgcatctattcatgtaatcagagcttgttttcttgctcactggtggccagatacaggtcataatagtattttattttcttaactttgaatagcgttaaaggggagtggactcatttgaattacaggaggtactgaaagaaaactatattattcattacattttgtaaagcaaggaacaaagaggaatagttgtttcctaccatggtaatttcagactctgaaagatctgtttataagccaaatgtagacatacctatccctaacccagatttttttatggtcttcaattttgtaattatttagaattgaagggttttttttcctttctgccacatatttttgtacacaccctttctccctcccctttcccatgcttttgtttccttgagaaaaggagcgtccctcttagagcatagaataaacattctttgtgaagtgtgacttatttatgcttcaggggttgtcagtgtatacacaatagagaaggtgatggaggctccgaggcatgccaagtcagcactttgtgcatgttgaggccaaagagcatgttaagcaggcttaaaaaattttaacaagtcagaacattttacaatttccatatttatcaaacatgtcaggggatgggatcacaaagccttccagggattaactgcctctctgacttgaactgttttattaagatggaagaagccaagttctcaacaccctgtgatttgctctaataaccacaagaatcagaatgtaggtgatccttgctgaatgaaagcaatcctaaggctaaatgctctttgaatggggaaaaaaaaaaactctctcaacagatgaactatgtgtgaaactttctaacagagcttaggagtttgaagtttatttacctagagcttcagttttattaattctctggttggtggttcttgacctttgacacccaaggacttagactgtgaagcctaaatagaaggcattcagaaacctgaagacattctcaaagaggggtggccattggcttttttggggttggcaaaacatcctagagttattatttgtttttacatgtttggggtttggcagatcctaagatgcattttgccaagcactttcctttgaattttagtacaggaatatcttgggtggaatttaattcgtgattcatttgcattatactgatcagaatgccattttggaaaagatatctgatgactgagaaatattaggagatttacaatttttaagtaccaactttttcttagatgggaagaaaaatggaattcaagccccaattattttcagtgagatttggaacttggaatcttgaactaagtagtagtttccaaatgtgtctgtattactttctctacaaaagcgaaccagactacttccctggcttgatctgcaaatctttagaaaagttacagagctgatatgcaaccttgggctggtatttaatttgaaaactaatgttaaaaaggctttctgataagtaagtagggagagtaaccctcttctgaagaaatagattggaattaaaaaacaaactaagactaagcataagtgagatcttgggtttgaaagccaaattgccaaagatggcaaaacccctagagggctaaagttatgtgaagtgccatgaggtagcttttccattactgtttgcagaaaaggttgtaaaagaaggaactgtgctgaaactttacaaatgagtaccaaaccataaactttttaaagaacagggaaagcacatagctaaatatggtacccaacattattgcccatcaggctgcaacaaagcatgatgacaaaaacaggttttttcttgtctactgtcagcttcctattgtttgtaactggcccaggaaaagcagtgccagcaactcaaatgactgctctcactgtcttcttgagaaaacagcagtgcaagcaagcgtccatcaggaaaagaaagaagcattttaaacaaatttacatggatatctttaggttcaaattattttgaaaccaaaggatatgaagtgttgggaattctagttctgaattctataaatcagtgtaaggagaaggacagtgtgatagagactcttttatttgcttcaaatagtggggtgaataagttataagagtatcactgggccagtgttgatgattttcttttctctcttgttccccatgttcttcaaactgcttaaaagtcaaaacacaagatgtattttgagttcttgaccttatcctggccctgacttagtttgtcagaatattaggttgtctacagagatccaccctggtttccatctaaatttttttagattttggtcaactttctatatctttatttaaataactgtaagtattcctttcagtataataaaaatttatgtttttcttcttcttaaactttggtccttgtccttgttactttaaaacagagaacttagtaaagataactttttcttttatttctcatttttctctttctctctctatacccctctttgcttgcccccgcccccaaccttgtctctttcttactggctataatctaattagtgaatgcttatcaatgaccaatgagaacattgtcacattttacattttgcttgttactgaactgtaatctctgttgcagaaagcaggatttttgtgaggttgaaaggaaagtgtggcatcccatgagtctgatgctattacgttttagaaaattgaaatgactggccaggcgtggtggctcacgcctgtaatcccagcactttgggaggccaaggcgggtggatcacctgaggtcaggagtttgagaccagcctcatcatggagaaacctcgtctctactaaaaatacaaaattagccaggtgtggtggtgcatgcctgtaatcccagctactcgggaggctgaggcaggagtattgcttgaacctgggaggcagaggttgtagtgagccaagatcgcgccattgcactccagcctgggcaacaagagcgaaactctgtctcaaaaaaaaaaaaaaaaaaaaaaaaaaagaaaagaaaattgaaatgacttactacattattgagagcatatcttagctttggataataaagaatatagataaacattttaagagcagctcttgtttcatacttcttatctcacacacagtgccttttacacaataagggctgaataaaattgttacccattttagttcagttaatttttgaatgtgagggcagatcatttaattccgtatcttaatatataatccaggactggtgaataatacttcctgccaaaaatccattaaccttacaggaaacaaaacccagtgaggatcatagaagtaaaaataacttaatttagatttcataagttgttatttttttagagaaaagcataaaatgttctgtacctgcacatttgaaaataaaatcaagaagcaaaacattctcatgagtaagaatatgaaacaataatttgaaaataccaaaactcagtatttattactgttctacagtagatattagtgactagggaaaggacaaggtggctatggggtagtagaaaagggagccagatatgcaaacctttggggatgatgatttaactgcttcatgacagttaagaaaagatttattttttttagggtttaaaattactatatttaaaaatatataaatatttgagttttttcctcaagtctggaagcagaagcattcctcagtctttctctccttcgacatggcagcaacagcaacagcagcagcagccaccgctgctgccacggccctggctccacctagggaaattgcagaagaccctatctcattctagtgaggaaggttctatgaagtagatagttcatcttgtagactttttagaccattgctgtaaaagacttttatattttttattttttgagacaaggtctcactctgtcacccaggctggagtgcagtggcacaatcatggctcactgcagccttgacctttcgggctcaagcaatcctctcacttcagcctcccaagtagctgggactacatgcacatgccactctgtcagctaattctttttgtagagacaaagtctgactttgttgcccaagctgatcttgaactcctgggcttaagtgatcctcctgccttggtctccggaagttctgggattatagatgtgagccaccatgcttggccctaaaacttttagagccatcttcaaatgttgtgattgtctagctggacatggtggctcatgcctgcaatcccagcactttgggaggccgaggctggtggattgcttgaacccaggaattggaggccagcctgggcaacatggtgaaaccctgtctctgcaaaaaatttaaaatagttggggatggtggcgcagcctatagtcccaactactctggaggctgagatgggaggatcgctcgagcccagcaggctgaggctgcagtgagctgtgatcatgccactgcactccaacctgggcgacagagtgagaccctgtctcaaaaccaccccacctcccaaaaatgctgtggttttctgtataaaatgggactaactattgacacttctttataaatcagataaaattatattgaagtccagtttaagctcattggatgaaggatattgcatttcagtgtagtgtttataagaagtctactttaaaaatatatttttaaaaatgattgtaggatcctgtttttttgttttgttttgttttttgctttttgtttttttttttattctaacatttcctatgttcccacaatattaagagaccatttcacatcacagtctcactgctggagacttttactataatatatatttatctaaataaggttttatttatttgtagctgcataaataaggtttctacttagaaggaagcctcttgagagcctatatttgttttttgtacattttaaacttctgttctttaacaccagaaagcaaaagaatgaatagcaggtgaacaactctaaaaaagtagagataacaagtagaaggaaaataatgtttatgagaagaaaagtggtcttgttattgagggagccaagctgctaaacagagtgggaagagaacatttgttcagtctctacttgctggggcaataaagccttctatctgcccctgttctgtgtaaaatcctgttaatattagatattttaaatttatgatgataaaagaaatgtgcaccttttgtgggaaattcgaaaagaacgaggaaaaataaagaagggcaaccacctctaacaccaccacccagaaataatgacagctttcaagtgtgtttctttctaatcttttctgtgtaatttaacataattgaaattatacggaataaacagtttcttggcctgctattgttttcatggactacaattttgtactctcattttgagtaattataatgtgccaggcactgtgttaaacattttacaaatattaatattatctcttctcagcactatgagggtgggtatagttataccttgagcttatatttcagggaatgtctacaaatgagtctactgctttaagtaggcttcactgtatgaagaaaatgcagacagcagaaaagaaagctagacgtttttcatggatgcttctttctttctttttcttttttttaggttttattttggagggaaggaagaagaacctgtcttctttaaaaaatgaaatatttttaaccgaaatgttatctagtgtttagtgtgtcaacaagttctaaattgtggaaaagtcttatcagaagaaaggctgctttgaaaacgatatggaaatatttgttgggtgttcactccttcaacgtctaaatgaaatacactggggagtaactgaattttacagtatttagatagctacatagtgagcaatcaaaacattctttaagtatttaataagaggttaagatcggcccgcctaaagcttatataatagaactgagtcagtgatgatgagcattttttcatgtgtctgttggctgcataaatgtcttcttttgagaaatgtctgttcatatccttcgcccactttttgatggggttgtttgttttttccttgtaaatttgtttgagttctttgtagattgtggatattagccctttgtcagatgagtagattgcaaaaattttctcccgttctctaggttgcctgttcactctgatagtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtgtaaggcaatcagagaaatgcaaatcaaaaccacagtgaaatatcatctcacaccagttagaatggcaatcattaaaaagtcaggaaacaacaggtgctggagaggatgtggagaaataggaacacttttacactgttgatgtgattgtaaactagttcaaccattgtggaagttggtgtggtgattcctcagggatctagaactagaaataccatttgacccagccatcccattactgggtatatacccaaaggaatataaatcattctgctataaagacacatgcacagatatgtttattgcggtactattcacaatagcaaagacttggaaccaacccaaatgtccaacaatgatagactggattgagaaaatgtggcacatttacatcatggaatactatgcagccataaaaaatgatgagttcatgtcctttgtagggacatggatgaagctggaaaccatcattctcagcagactaccgcaaggacaaaaaaccaaacactgcatgttctcactcacaggtgggaattgaacaatgagaacacttggaccaggaaggggaacatcacacactggggcctgttgtggggtggggggagcggggagggatagcattaagagatatacctaatgtaaatgacgagttaatgggtgtagcacaccaacatggcacatgtatacatatgtaacaaacctgcacattgtgcacatgtaccctagaacttaaagtataataaaatatatatacatatgtataaagtaatagaaatgagtccaggaatcagtaacttggatactttgttagctgttcgagaccctgggccaggccaacacttcctaaaggtgccagagcacacagagagcatagagattgcactgattgcaaacctatccaagggccccagctcctctgctaacacccaaggcctctccacctgtttttctccgagttgctcgtcaccctgtcctttaccttctagattccccagggctcctggtctccttggaattaagactttgagattttgttgtaagagtttccaaacaattcttcacaatatctcttgggtttgtccttgtttatccaggcctttgttactcccacagcctccttgccagcctttttgatgcatcctttgctgctcactgccttaatacccatgccatctccaggtctgtatttctaaaacatttctcttgtgtcattcctctgctccaagaaggccttgaatgtcaagcctgtttttcagcttgtcttttgaggtcttctgtaatctggctgtacacaaccttacacttttatttccggctccaacgtaaagcttcctatgaagtccagtggtgtgaatttcaacttgtataccttgattgtatttttcacaggtctagaaaatccttactttacaatttatttaaatctttctaatcttaagttctattttttctatgaagtattccctgattcagtctacctaggtcttttctttctctgtacttctcttacaggcagtatcataaagatgaagtcatgtttttatggaagccatttttccccaacgagattatagctgtgatggtaaagctggtacccttcaaaagcttattcctttcctttccctttccctttcttctgttttctcttttcttttttcttttcttttcttttctacctctgtcctcttccccatcacccccttgatattaacatcattgcactatatatccttttcctcccatcatctttcattttctcctgactcatcaatataccagcataacataggatgtatcattttttagtcgacaacaaaaagattttatttttttcttcatagcattgcataatatattttcatgtaatacagttttgaatcctacagaaaaatatgaagaaataaaagtacctgaagagccatcactgtgagtagtccaccatcaaaattttgataactgtctttttaggcatctctattcacacgcatgtgtgtgtgctcacacatcgacatgagtaccatactgctttctcatgaatatcttttttaaaatgcagattttttttggagaaggaagtttacctgccctcttctcttccccctctccccaccatctcttaacgcatttatgttaacaagctgtgtgtttttgcattcatcaaacccattttattatatgcaaatacattatatataatggtataaatggggagggggagtgtgttttgccaaaatgggatcaccttatatacagttatttggatcttgcctttttttttatttatttataattatatgttaagaaaatccttctaagaaaacattttatatccaactccaggagaaatattaaaaagggaaaaatttgattggatgagcagatattaaatatatatatatcaataagattttctctgtaccattaaataactaactttaaaaaataaagaataattgtcattcatagtagtgtcaaaaatctttaaaatgcctaagaataaactaaaagggaaagttaccagatttctagaatcctgattttcttaaaaactggataaaataatgttaaaatttatatagaaaaattaatatttgaaaagaaccaagaagttcatgaaaaagattatctacttcttaaatttaaataaaaacatatattgcctgttttcttggcactactaaattattctacaacatgacttaatgactgcagagtatttcaacatcggaatgtactctcatttattttactagtctacttttgaaatttaggttgtttgtttgttttcaacatatatatttttgctatataaatatgctgtagggaatagccttatggacaaattcttatatacaaccctggttgtttttataaaataaaaacctagaagtgaaattgctaggtgaattttcacatttttaaaacttttgccacaggagtgctcattattgcactttgctaataatagagtttgttaatctaatttttttttttttaagagtcaggatcttgctttgttgcccaggctggaatatagtataagcatgatcatagctcactgtaacctcagactcctgggctgaagcaatccttccccttcagcctcccaagtagctaggactacaggtgcacatgaccatgcctggctaatttttttcatgtaattttgtagagatggggtctcactgtattgtccaggctggtcttgaactcctggcctcaagcgattctcccatacgcatatatatcctcccacatatgtgtgtgtgtgtgtgtgtgtgtgtaaaatgcagtgtttttaggaaaaatataaagaggtcaacttactagctttcaaaactaagaagaaaagaagaacactcccttgaggtttaaggcattttgacatgtaaattgtacaccaatagataggcacattacatgtaataaccagaccatagactcttaattttgttgaacatgcccaaaagctctgtgtctctttatctcagtctgcttcagtcactagggcaatgaggacattaactatcacatcttgaagtaacttacaaacaacactttgacatttggagcattctataccagaaatctcttaaattacaatttgtttcttaggtctagcatgagtaacaccatcaaagtgtatttctttggcttctgctataatcaacaataatagtaataataactaacatttaatatatacaacaaatgctgtgtcaggcactgtgcactgtaactgaggtggtatatttacttttttttttttctttttttaactgatgaggaaacttacccgtaagagcatttaactaatttgccaagccagcaagtgaggatagagccctggagttggtcccattaccactataatcacttcctctagtcattctttccttactccaaagtttacttcatcatctctagccatttctagatacctttattcttttcttctcttgatgtcttcattttatctgtctcacttccatgacttcttcttcttcttcttctttttttttttggatgaggtctcactctgttgcccaggctggagtgcaatggtgccatcatagctcactgcaacctctgcctccgaggctccagcgatcctcccacctcagcctccagagtagctgggactatgggtgtgtgccaccatgcctggctatttttttgtgtttttttttttttcttttgtagagacaggtttcaccacgttggccagcctggtcttaaactcctgagctcaagcaatctgcctgccttgggctcccaaaatgctgagattacaaacgtgagccaccgtgtccggccaatttcttgtatggataccaaactgtgtcttatcctgcctcttttagttctatgtcttatcacccattagttttacaggtagccatatttatatttaacctacgcaaacttgatcttcatctgcagaaaaagggaatcaaatctactgctcatttcattggaaagaatatttatttatcttgatgtttaatcgagctgtgggctctgccttttaaatactgattagttctccaatagaacagttcttttgggaactgggaagcttttattttagacatttagggtatagttttgaattaaaggctatttttccataagcggttctgaaaggttaagttttgtacgaaagaatgggctctagaaatttactttggaacttagatcacttcattgggaatgcctaagtgaatctttgacataagttgtccaggtgtctttgctttattctttggaatgaaaaaatgtatgggtcaaacagaacccatctgtttggaatatctttagtatccagactctgacctccatgtttttggttgtgagaatgtcagcatagtacctggcttctagaaaatgctctataaatataaattgcctgggtgaataactgaattaatgagtgacttaatgatagagactgagaatgagaagatagaatggttgttctggaagtgattgcttctctccagctaagcctttaactctgggctgtaccatcagtagtccttgcatactgaagtcagacttttctggtcaagaagaaccttttaggttcttgataaaataccttttattcttaattttcctgtaagtacctgaatgtattatcttgaataactccaattcaggtccttagattcctcacgttacttgaaattctttgtttcctctaagagttcactgtatctcacaaatatcctgatataattctgttggtaaatattgatctcactttgctctgagatcaggctgatgtatatgtgtggtaggtaataatccctatttaggctgatacattgttcacatatgcacatattataatacacgcaaacatacagaaatacacactttttccctctgaatttttggaattgaagacatgatactcctttatccttaaatgtttccatgcatgtttcctgaaaacaaggacagtctcttatacaaacatgatgtaattatcaaaaccaggaaattaacattgatacaatactattatctagtctgcagactgtatttgggtttttccagttgttccagtaatggcctttataacaagttaaaatccctgagcatgtgttgcattcacttgtcatgcctcttaatctttagtctggaacaatttattctttgtcccctgcaacttgacattttttatgagtgtaggctttttattttataaaaagctgctcttttgattttctctaatgatttcttattattagattcaggttatgaatttggggaagtaacaccacagaattgatattttgtttttatctgttgttatgtaaaactatgaattcatattgataactacaatttcctttcagcatcacactattcattctgtgattcctcccttccatgtttttagcttccttcttcaacagcaagaagcctggttccattaccctcaataaatttacttatttactcaatcctagatatgaaaaagcaacttcagaattgctaacccatacatctttaaaaaggaatcctgttaactagtattcagtatttgtttagggtgctttttggttttagtctgaggacatatagtgtaaatactatctttaaataaagttacttgggttagtttttcgttctctcttctacccccaactctgtccgttggaagcataggcaagacaacctggggcttgtgattgatcatcagaagtttggtggggggcggttggtcttggggactgagccctcaaactatgggatctgacactatctccaggtagagtcagaattaaactgaagtagtggacacccagctggtgtctactaaagaaccgattgcttgcttggtgtgtggggggaaaatccccacacatttggtcacagaagtcttcagtgttgatggtggtgtgaaaacagaagaaaaacagtttgtgtttttccactcagtgtattataataatcccccttaacaatttaggaataaactgatattcctgacaagcaaaaataacttatctaaacatgtaatcatttgggctttagttttcacattcataaaaatgaaggcattggtctaggtgatctgtaatgtgctttccatccttaatatttttgaaaaaatatctgtgacatgttcagtatagctaattttgattaaataaacatattttaaacctatttttagaaccagttttggggagaatttttgcctttagtgatagagaatttttcccttaatgtaggtagtaaatgttataagattatattgtttatctacaaatcagcaagtataaccagggttctgaattctcatgtcatatgtaaatcagtaacctttcagagattaaatgagagcaatcatgtgatagcagcagcaaaagatcaatatgcaatgctagatatagaaatcttcttgtatctttaatatatatcttaattttagtccttgtattactgatcttgtgccatgtaacaaattaactcaaaacatagtgattaaaaacaacattaatatgtatgagcactcatagtttctggctgggtacttctagcattggatctctcatgaggtttcagttagatataggttaatgaaacacgcatctgacagcttgactgagcatggaagatcttctgtgttggtcactcgtaggctggcatgttgatgcttattcttaatgctggctctacacagtgagcaaagagacctagtgttagaagtcacaaaacgtgagttttatattccattggtcacactgaccaactccaattcaatatggaagaaaaactacccaagagcatgagcatcactgggagtcatcttggaggctgggttttagtgtctgtccttgtttttgttttcagtagaagaaatgacttttttagtgcccttgaaataattgctaaaatggtcctcaatgagatataatccttttgcacagataatggtacatttttttcttactagaaactagagcttacttactatatttacttactagtcctagagctcagtgttatttgctaaagaaaagttttcttttgttttgtttttgagacagggtctcgctttgtcacccaggttggagtgtagtggcaagatcttgtctcactgtaaactctgcctcccaggctcaagtgatcctcccacctcagcctcccaagtagcagggatgccaccatgcctggctaattttttgtatttttagtagagatgggtttttctcatgttggtcaggctggtctctaactcctgagctcaggtgatccacccgcctcggcctcccaaagtgctgggattacaggtgtgagccaccacaccaggacttaaagaaatatttgtggggctaggtgcagtggctcatgcctgtagttccagcactttgggaggctgagacaggcggattgcctgagctcaggagtttgagaccaacctgggcaacacggtgaaaccctgtctctactaaaatacaaaaaattagccaggcgtggtgatgtgtgcctgtagtcccagctactcgggaggctgaggcagagaatatcttgaatccgggaggcagaggttgcagtgagccgagatcacaccaccacactccagccttggcgacagaccaagactccgtctcaaaaataaataaataaataaaaataataaataaaataagaaatatttacggccaggcgcggtggctcacacctgtaatcccaacactttgggaagctgaggcgggtggatcacctgaggtcaggagttcgagaccagcctggccaacatggcgaacatggtgaaaccctgtctctactaaaattacaaaaaattagcccaccatggtagcagatgcctataatcccagctactcaggaagctgaggcaggagaattgcttgaacctgggaggcagaggttgcagtgagctgaggttgtgccattgcactccagcctggacaacaagagtgaaactccgtctcaaaaaaaaaaaaaacaaaggaagaaggaaatatttattgggttgggtggagtaggctcagagccatgaatgttccaaatgatagtaaaattggatctcagcttcctattttatggcaaacgaggtgattactggtaaaataaatgaataaataaaaaataataaaaataaagcctttaaagagaaaatgtaatagttctttccaatgatctttagattttttaccataatcatcagaattatctttgatggtttctaaaatgtgttgtattaatgtataatgtaaactttaataaatgtgcttttaaatgccagttgctgacattaaaatatatctataatgaagttcaaagataaatggaactttctgaaaactcctttgcaagttaatttagatataggaggtaggatttgaaaacaggatcacattataaactcaatagtcctagaattattatttaatatataaaagatatcaaaatgcatttgtaaacatttgaaagataacagaattggaaaattattgttcatttaatacaaaaatgctttcagaatctcttagctttttttgtcatttactagaaaaattgctggtttctgtattttttctttttcttcttctaactttttaatttattatacatcattgtactaacagtaaaggaaatttaaatgatgaaaataaaatctgccatcttatcaagttcaatgtgactgtaaccttttagttctttgtgtgtgtgtgtgtgtgtgtgtgtgtgtgtgtgtgtttggttggcttttattgatgtatataaaaagattacagacagcaagagaagataatcagaggccttttcgttcttatcaaattaagttgctttatagttgtatttttcttttatattttaatatgcatttgtaattgatagaggaaagaatttgtctttcctctgtctcctctaattttgtgccaaggaaaatctggcacagaattaatcaaatttttgcctaatttttatcatgatataattaaaaaattgagtatatgatactcaattttatctttattgtattttattagcaagggcttatttattaatgtatactaggttttggagaatgactttcaagtataatctgtttatttattcacaattggtttaccagtttcctgatgtttctgtccctttgcatttttggtcacatacctttgaccctttttggcctttccagtagaggccaactatagatggagaaaaaattcaatgcatcatttgccttccagtttaatcagtagagtaggcaatacgtgtacattttttgtttgttttttaaaagtctctctgccatgacatttccaatcccctagctccctctttaccactgttatcagtctcagaattatacttccaaagataatctgtgcacaaacaagcatgtgtaggcatatctgtttttcttgtacacagttagttgcatatcatacatactcttttgcacctcactttttttacttataaatctgactcattttttaaggttgtatagtataccatcatatctctttggtatcatttctttaaccaaacattattgctggacatttaagttatgttttgattgttagtgaacaatgcagtatgtatatccttttaaattcttagtgtatatatgtgagattatctgtgagatgaattctgaaaaacgtaatttctagtcaaagaacagtgcacatttaaaattttgttagattctatgaaattgcctaagaagttgaaccaatttatatttccaccaataacacataggcatattcttttgccaacacctgccaattgaagatatttcaagggccagcatttgatgtcatacaagagacatcaaatataccacttagtgaaaaatactttgttctatcccaaagaaaactattgataacccctctaagcctccaccctcctaacttttttttctttcatgggttattcatggctagtgtcctcttccagcaagcttaagcccccaaatcagtccctttcttttgtcctccacatcacttatgcgtgatcccaattggatttcacctctgcatttagtacctcctttccatttccactgccactgccctaattctggcctacttataacatctttggattattacaaagccaactaatcttccgttaaaaaaattctcccttctgtaattccttctcccaagtgctgtagttatcttcacaagatctgagtatgtaactgcattactttttaactatttcttacccacgcctagagttttcacgttgaccttcaagacacaatggcctggccttacctttccttttcaactttattacccactactctctctcatgtcttccttgcatgcacacatagctgcaattattctggatttttcatcatttcctggatagccctccattttcctgcgtaatccctttgcttttgttatttgtaacatatgcccgtaatattcccttttgcatttctgctaggtggaattctactttttaaaacttaggtcatatacgactccttccatgacatcctgtttccctggccaaaagtagttttttctatatgcgtcataataatgtattttgagatattgctagtatcaaacatatttcattatgtattttagttgtacatgtctttttccctcaggagatcacaatcactttgagagcagtggcaatatcatatccattttcatatacttctctatcccacacataatgtatgtttctagtaaactgaattataaatcctgtatttaaaattttttattttatagtgattttagagttttcctctttgttacagtttttagaatgctttaaaagatttaaaagtttagtatgtgcagagaagaatgtctgaattaaaacctgaaatatctttcagattcagtgccagaaaggcagtgtgatgccagaggaagaataaggtcttggaagtcatgtatatttagacaagagtcccagtgccatgaccactttttagctatgattatataaaaacccgaacctttttccttgtctttaaaatgaggtgactggagtaggtcagtgtttcttaacacatttctgttataaagcatatgccagattatatgtatgcacatgttcccatcagcatacttagattttgatagaagataaaagaattaaaatgttttaattttaattggattttgtagttaccacaactatttctgctatacttggtatagcagtaagtggccgacttcagaatgcagcacaggaaagatagattgctagttatatgtgagcctctctcttgcttcccagtgagctgcagctactttctcagaatgcaagtgggttagtgaggttgttataggaataactttgaatgtaatctaagttatgcagacattaatcaaaacagtcatagtattttaattatttataggaataaattacttcttacagttgatcttggctcctgatcttgttacattgttatgagctgctgaacaagaagatcttgaaattttcgtccaactttccaattctgattgtttattctcctttccaaagtatagttgggaataagaagacactgaaagttttcagcagttctttttgacctgggcttatggtaacgtaataggggaaaaaatgctttcagttaaagtaattggacatctaattagcatttcctattgaaggttaaatattaaatatttttcccagcaccatttattgagaagacaattcttttcccaatgtgtgtttttagtgcctttgtcaaaaattagttggctataaatatgtggatttatttctgggttctctattctcttgcattggtctgggtctgtttttgtgtcagtaccatgctgtcttggttactacaactatattttaagtaaggtagcatgatgcctcaagctttgttctttctgctcagaattgctttaggtatttgaggtctttttttttttttttttttttttcttttcttttgagacacagtcttgccgtatcacccaggctggagtgcagtctctcaatcttggctcactgcaacctctgcctcccgggtttgagtgattctcatgccccagcctcaccagtagctgggattacaggcatgcgcgccacacccagctaattttttgtatttttagtatagatggggtttcactatgttggccaggctggtctcaaactcctggcctcaaatgatccacccaccttggcctcccaaagtgctgtgcttacaggtgtgagccaccacgcccagctatttgagatcttttggggttctatacaaatttgaggattgtttttgtctaattttgtgaaaaatgtcattagtattttgagggggatcacactgaatctgtagattgctttgggtaagatggtcattttaatattttttagtctgtcaattatgaatatgggctgccttttcatttttttgtgttctcttcaatttctttcaccagtgttttatagtttccattgttgagatttttttcacctcctttgttaagtttattcctaggtattttattttattttatagctactgtaaatgggattgctttcttgatttctttttcagctagtttgttattggtgtagagaaacactcctgagtttcgtatgttgattttgtatactgcaactttactgagtttgtctattcattctaagaggttttttgatggagtatttaggtttttctatatgttaaattatgtcttttgcaaacagggacaatttgactttctccttttcgatttggatgccttttatttctttcttttgcctgattgctctggctaggacttccggtactaaattgaataaaagtggtgaatgtgagcatctttgtcttgttctggttcttagagggagaacattcaactttttcaccataaggtatgatgttggctgtggatttgtcagatatggcctttattttgcttaggtacattccttctatactgaattcattgacagtttttactataaagggatgttgaattttatcaaatgctttttctgcatctgttgagatgatctttttttgttatttattctgttgatatgaggtgtcatgtttattgatttgcatatgttgaaccattcttgcatccatggaacaaatcccagttgatcatgatgcataacctttttgatgtgctgctggatttaatttgttagtgttttattgaggatttttacatctgtgtttatcaggactattggcctgtagttttctcttttggttgtgtccttgtctggttttggtatcagggtaatgctggacttatagaatgagttttaaagaattcccttcccttcaatttcttggagtagtttcagaagaattggtgttagttcattgttaaaagtttggtagaattcagcagtggaggctaggtgcggtggctcatgcctgtaatcccagcactttgggagggtgaggcaggcggatcacttgaggtcaggagttcgagaccagcctggccaatatggtgaaatcccgtctctactaaaaaaacaacaacaaaatacaaaaaaattagctggccatggtgacaggcacctgtaatcctagctactcaggaggctgagacatgagaatcacttgaacctagggggcagaggttgcagttagctgagattgtaccactgcactccagcctgccagcctgggcaagagtgagactctgtgacaaaaaaaaaaaaaaaaagaaaaaaaaaaaagaattcagccttgaagccatctggtcctgggcttttctttgtagggagactttgtattgctgattcaattttattactcgtcattggtctgttcatgctttccatttctttctggttcaatcttggtagatcgtatgtgcccagaagttgatccatttcctctaggtttttaatttgttagtatgtagttgttcatgattgtctctaataatcatttacatttcttctgtattagttgtaatgtctccattttttattttattttggggggttttctttctctcttttttggctagctaaatggtttgttgattttgtttatctttttgaaaatgcaactttccatcttggtcttttggttttttaagtctctattttgtttatttttgctctaatctttattatttctttctaatatgatttacatatttattcttggccaaatctcatgttgaattgtaatccccagtgttggaggtggggcccactggaaggtgattggataatgggggtgaatttctcatgaatggtttagtttcatcactttgttggtgttctcatgacagtgagtgaatttttgggagatctggtcatttaaaagtgtatgggggctgggcgcagtggctcacacctgtaatcccagcactttgggaggccgaagcgggcggaaatcatgaggtcaagagattgagaccatcctggccaacatggtgaaaccctgtctctactaaaaatacaaaaattagctgggtgtggtgatacacgcctgtggtcccagctactcaggaggctgaggcaggagaatcacttgaacccaggaggcggaggttgcagtgagccaagattgtgccacagcactccagcctggcgacagaatgagactccatctcaaaaagataaataaataaataaaaaggtgtcaggcacctcctcttgtaggaagcatatagtcggatcttgttttattatacattccaccagttcatatcttttagatggggaatttaatccttttacattcaaggttattatttacaggtgagaacttactcttgttattttgttatttgttttctgctgttttatatgtcctttttgtctttttcctttttcttaattgtttatcttgcagtttggtggttttttgaagtgatatgttttgattccttttcttttctcatttgtgtatctgcactgtcagtgttttatgcttccccatgttttcatgatggtagttatcattcttttgcttacagatgtaggactcccttaatcatttcttgtaatgccagcctagtggtgatgaattctctcagtgtttgctttcttaggaaagactttatttcttccttatttctatagaatagctttgatcggtatagtattcatggctagcaatttttttctttcagtgctgtgaacatgtgattttattctctcttggcctgaaggtttctactgaggagtctcttcttagtctaatggggattccctaatatgtgacctgatgcttttcctatgctgttttacaattctttctttgtctttgacttttgacagtttgactataatgtgcctcggagaggaccttattggtttgaaattttctagatttttgagcttcctggatttagatgtctatatctctcccaagacttgggtagttctcagctattattttattaaatagtttttataggcctttttccttgttttctttttctgggattctcatagtattaatatttgttcacttaatggtgtcccaaagtcttgtaggctttctttgttcttttttatttccttttcttttcttcctgttttttctcttttattcttttgtctgagttatttcaaaaacttgttttgaaagtcagggattcttttttctgctttatctaatctgttattgagatttttctgttctatttttatttcatccactgaattcttcagctccaagttttctgtttggttctctttttattatgtctatccctgcattgaatttctcattgagataatgattttcttctattttatcgaattgtctatttgtattattttgtatcttgctgagtttaagatttttgctttgatttccttttttggcaatttataaattttcattttggtgggtaaattactggggaattgtgtctcattggtggtgtcatgtttcattgcttttcatcttggatccctgtgttgatatctgtgcatctggtggaacagttgcctattccaattttgtagaggggctttcgttggggaagactttcacctgcagatgtgttttagggtctcagttgggtggggtatgttgctttgttttgaaggggtagcatagtgtagtctccatgcagtttcttcagctgtagtcagtgttggcaaatgcctgcaagtgtctcagtggcttaagctgcagagttgtgtgaggctggcctacctactcagggtctcctcccttgagagtggggcacttggttggttaatgctccagggaagtgtggggctggtcagctgacagcttggctcaggtgctactcccctggggccatgtgctggcctggtctgtgctcagggaaaacatggaaatggttggcctacctcttggcttgggcactgcttccctaggggtgaggtgtcaggctagtccattctccaagggagtgcagggctgattggccatcggaatggcttggatgctgctcgcctaggggtgggataccagggtggtccgcactccaggaaagcagggagctagctggctggtggttctgcttggatgccagtcccctgtgggcagggcacttggaccaaaggtgttcttgtggatttaggttttgagtggctgggattgaggtgctgcaacccttgggatggggaatatggagcaccctgggcagcttgttttcaggagtttggaagctgtatcatctcagcttggtacacacttaaaatttaggttttgtgttttggttatgtttagacataatgcctaatactatatatgatatgggaactctcatatacttctggttgggaatataaaatgatacaactttactggaatgtaatttggtgttataatatcagaagctttacattgtctcatatatcttcttttacttcataattatttgattagaaaatatgtcttgagggaataattatatgtatataaatatttatctgcaaatatatttattgcattatttatgattaataatctaaaacaacccaaatattcaacagtgattaaatattattttatatttatacagtatagtcttatgaagtcattaaattatttacaaaacattttaatgatgttggaaaacacttacgttgtaatagtaattaaataaggcaggataataaaactgtaaagaacatgatttcatatatttgagagagaagagagaaaatttgaaagagtgtgtttgagtgtaatgggggatttggtaaaatttaaaaaaaagattctgatttagttttcatttctattttctgttttaaaatttttttcctctaaagtccatgtacaattttcataataagaaaagctaatgcatcctatttttaaactaacattgttagaattagggagaagatggttcatttataggaaaggatatcatgtttgcaagaaaatttgtaatggcatgaggaaacataataaagggagaaatctacgaaagtattaataatgcattgacaaaagtatagaagggaatacagaaacatattagtctttcttctggttctgtaatatgataaaaacatttataaagctgggcatgctggtatacacctatagtctcaactacttgggagagtgaggcaggaggatttcttgtgcccaggagtttgagtctagcctgggcaatgcaatgagaccttatctctaaaatataaaacaataaaaatataaaatttaaaaaatttttctgcttttcaatttttctggaaagaaatatatcttaattaaaggaaaagaatttaaaagcaggctgatactcgagcattttgaggtcatatttgatgtgaaatgacattcaaaatttcagggagttaatttttttctagcagcacattgaatgatgctaaaaggaaacaaaatgggaaaaaatggaaagagcattagactgttgcacaacgttgatttagtatattttgtttattcatatggaagggcaaactcattcagcaaactttgtaagagtaccttgtaggtgcagagaaaagtactgctcacttatggaatgaagtgggaaaaaagtaaaaacatttttacttttccatttttctggaaagaaatacataatgttttggctggtcatggtggctcatgcctgtaatcccagcactttgggaggccgaggtgggcagatcacctgaggtcaggagtttgagagcagcctggccaacatggtgaaaccccattttctactaaaaatataaaaattagccaggcgtggtggcaggcgcctgtaatcccagctacttaggaggctgaggcagcagaattgcttgaacccaagaggtggaggttgcagtgagccgagattgtgccactgcactccaacctgggcaacagagcaagactccatctcggaaaaaaaaaaacaaaaaaaaaaaaacaggaaaagaaaaagaaatacatcatgttttaattaaaggaaaagtattgaaaagcacactgatactagagaattttgaagtcacatttgattatgcacaaagaaggcatgatccttgttctcaaggttcgtactattcagtatggaagataaaaggtattcacaaagaactaataaagttaacgtatttaaagtgacatatttgggtggccaaggattgcttgaggccaagagtttgagaccgtcatgggcaacacagcaagaccccatctttacaaaaaatacaaaaaaattagccaggcttggtggtatgcacctacagtcctagctactagggaggctgaggcaggagaatccctcgaacccaggaggcagaggttgcggtgagtcatgatcatgccactgcactgcagtctgtctgacagagcgagactccatctcaaaaaaaaaaaaaaaaaaaaaaaaaaaagaaggacactatggaaatagtggtatttgaatgggctcttagagaatgggtctgatttcaacagtttttcatgaaaaggatgtgcatttcaggtagaggaaagatatgagcagagaaacaaaggtgacaaggtatgggagcaatttttagatcaatgaaaactttttttaaaaccagcttttaaataatactttcaatgtacaatttagtggttttttagtatatttaaagagttgtgcaaccatcaccaatacctaattgtagaatatcttcatcactttaaaaagaactctgtaccattaatagtcactctgcatttcttcttctctctcacccctggcaaccacatccattttctttccctgtggatttgcctattcttgacatttcatagaactctatcatacaaaatgtggccttttgtgactagcctcttttctctttgtagaatgttcactcatgttttagtatttatcagcactttatttttatgacttcactgccaaataatattccacaatatggatataccacatccatttgtttcccttttcatcaattgatagaaatttggggtgtttcaactttttggctgttatgaataatgctgctctggatatttgtttaaaagttttatatggacatgttttcaattctcttgggtgtatagctgggtgtttacttcctaggtcatatgttaattttttgtttaaatttttgaggaactgttaaattggtttccagagtagtggtaacattttatatcctcaccagcaatgcatgaagattccgattcctccacatacacaccaatacttattattgtatatcttccatggttacatgacttggttttctagtgtaccttggagttggagaatggaagatgggaatagagaaaattaaaatgccatagagctctctattcttagcaagattcactcatttttcttgaataaacacttctcgattattgcaagtctttggttaatttccagagctccagaagaattgattctgacaattttgctggtgttcttgttgcttttaggaaacagcagattttctaagattcttacactaccattctaaagttgctttagtattcttctaaagttgaatactcctttttgttcgtttttatgccaaaggtaggttgatgccagacattgatgagaattgctctttctttttaggctactgagcaggggtatgacctgctatgccttgatcagagctatggtttataaattggagcaaggaataaaggcctctgtatatttagaggtgctttggtttttgttgttggtttttttcctttccaacttttattttaggttccagatatacatgtgcaggtttgttacatgggtaaattgtgtgtgtgtcacaggggttttgtgtacaaataattgtgtcacctgagtaatcagcataatacccaattaagtagtttttaaaatcctcaccatcctcccactctccacccttaagtaggtcccagtgtctgttgttcccgtttttgagtccatgtgtactgaatatttagcccccacttataagtgagaacatgcagaaccaaatactgtttttctgcattatatcttaggattatgaccaccagctccatccatgttcctgcaaaatgacatgatctcacttttttaatagctgcatagtattccatggtatgtatgtaccacattttctttgtctaatctaccattgctgtgcatctgggttgattccatgtctttgctattgtgaatagtgctgtgatgaacatatgcatgcatgtgtctttatggtagaatgatttattaatacatttctttgggtatataccagtaatgggattgctgggtcaaaaggtaattctatgttaaattctttgagaagtctccaaactttctacagtggctgaactaatttacattctcaccagcagtgtacaagcattccctttcctctgtaacctcaccagcatgttattttttgagtttttaataatggccaatctgactgatgtgaaatggtatttcactgtggttttgatttgcatttccctaatggttagtgttattgagcatttttttcatgtgcttgttggccatgtgtatgttttttgagaagtgtctgttcatgtactttgcccgttttttaatgaagtttctcatttttggcttgttgatttgagtttcttatatattctggatattagaccttggttggatgcatagtttgcaaatattttctcccattctatagggtgtctgtttactctgtttacagtttcttgccattcagaagctctttagtttaattaggtcttacttgtcgatttttgtttttgttgcagctgcttttggagtctttgtcttgaagtctttgcatgggctgatatccagaatggtatttcctagattttcttttagggtctttatacttttaggttttacatttaagtctttaatccatcttgagttgattttggtacacagtgaaggtaaggatccagtttcaatcatttgcatatggctagccagttatccccaaaacatttattgaatagggagtcctttccccattgcttgtttttattgactctgttgaagatcagctagttgtaggtgtgtggatttatttctggattctctaacatgttccatttgcctgtgtgtctgtttttgtaacagtaccatgctgttttagttactgtagccttgtagtatagtttgaagtcaggtagtgtgatgcctccagctttgttctttttgcttaggattgctttggctattcaggctcttttttggttccaattgaattttagtgcttttttttttttctaattatgtgaaacatgtcattggtagtttgataggaacagcattgaatctgtgtattgcttttggcaatatggccattttaacaatattgattcttcttatcaatgaggatggaatgtttttccatttgtttgtgtcatctctgatttctcttagcagtgttgtgtaattcttgttgagagatctttcacctccatgattaggtgtattcctaagtattttggtttttttgtggctgttgtgaatgggattgctttcttgatttggctctcagcttggatattgttgatgtatggaaatgacattgattttgtatgctgaaactttgccgaagttatttatcagatctaggagcctttgggcagagactggagtttcccaggtatagtatcatattgtctatgaagagagatagtttgacttcctttcttcctatgtggatgccttttatttctgtatcttgcctaattgctttaactaggactccctgtagtgtactgaataggagcagtgagagtgagcatccttgtcttgttctggttctcagggggaatgcttctagtttttgccccttcatatgatgttggatgtggatttgttgtaaatggtgcttcttattttgaagtatatacctttgatgcctagtttgtttttagcacaaaaggatgttgagttttatataaagcctttcttgcggctattgagataatcacgtggcttttgcttttagttctctttatatgattaatcacatttattgatttgtgtatgttaaaccaaccttgcatcccaggaataaagcctacttgattgtgatggattagctttttgagggatgtgctgctggattgagtttactagtattttgttgaggattttttacatctatgttcatcaggaatattggcctgaagatttcttttttcatttcatctcttccaggtattggtattaggatgatgctggcttcatagaatgagtaagggaggagtctcttctccccagttttctggataggtttaataggataggtagaactcttcttcatctggtaggattctgctgtgaatctacctggtccagggctttttctggttgatagtttttgtattaccgattcaattttggaactcattattgatctgttcagggattcaatttctttctgcttcaatcttgggatgttgtatgtttccaggaatttacccatttcttctaggttttctagattttatatatatatataattatatatatttatataaatatataaatatatataaatatataatatataaaatataaaaaatatataaaatatatatataattatatatatattttatatatatttttttctaggttttatatatatattttctaggtttctaggttttctaggttttatatatatatataaaataaactcctatatatataatgcttaataaactgtatatataggagtttattaagcattatatatatataggagtttattaagtattaacttacattatcacaaggtcccgcaataggctgtctgcaagctgaggagcaaggagagtgagtccaagtcccaaaactgaagaacttgaagtccactgtttgagggcaggaagcatccagcatgggagaaagatgtagactgggaggctaggctcatctcgtcacttcatgttttctgctttacattcgctggcagctgattaaatggtgcccatgcgattaagagtgggtctgccttccccagccctctgactcagatgttaatctcctttgacaacaccctcacagacacatccaggatcaatattgcatccttcaatccaatcaagttgacactcagtattaaccatcacaggtactataaactttcctcttaatactgctttagctctgtcccagagaatctgctatgttgtatcttgttttcattagtttcaaataatttcttgattcctgccttaatttcattgtttacccttaattcattcaggagcagattgtttaatttccatttaattgtatggttctgagagattttcttggtattggtttctgtttttattgtgctgtggtctgagaatgtggttggtataatttcggtttttaaaaatttgttgagaattgctttgtgttctagtgtgtggtcaattttacagtatgtgccatgtgcagatcagaaggatgtatatgctgtttttgttgggtgcagtgttctttagatgtatgtttagtgtatttggtcaactgtcaagtttaagtctccaatattctgcctcgatggtttgtccgatactgtcagtggggtgttggaagtttcccactattatcatgtggttatctatgtcttttcgtaagtctctaggaattcatgttatgaatctaggtgctccagtgttgggtgcatatatatttaggattgttaagacttcttgttgatttgaaccctttatgattatgtaattcccttctttgtcctttttgatcattgttggtttaaagtcagttttgtctgaaataagaatagcaacccctgctcttttttattttatgtttgcttgttggatctttctccatccctttactctgagcctttactttcccactgtatgtgagatgggtctgttgaagacattatagcgttaggtcttgcttatttattcaacttgccactttgtgccttttaggtgggatgcttaacctgtttttcttcatggttaatattgatatgtgcagatttgatcctgtcatcatgttgttggctggttgttatgtagacttgtttgtgtatttgctttatactgtcgatggtctttgtatttgagtatatttttgtagtggtcagtaattgtccttcatttctgtagtactcccttaaagatgcaaggacttcttgtaaggcacatcactagataataggtaataaattatcttagcatttgcttgcctgaaaagggtcttatttctcctgaagctagtttggctggatatgaaattcttggtttcaatttattttccttaaggatgctgaatataggcctccatactcttctggcttgtagggtttctgctgaaaagtctactgttagcctgatgtggttccctttgtaagtgacctgacccttctctctaggtgcctttaatattttttctctcacattgatgttggaggatttgacgactgggtgctttggggatggtcatgttgtatagtagctcacggcagttctttgaattttctgaatttgtatgtcaacctctctagtgaggttgggaaaatttttgttgacaatattctcaaatatgtttttcaagttgcttgctctctctttctctctttcagggatgccaataagttgttgatttggtctctttacataattccatatttcacagagactttgttcagttttttaaaattcttttttctttatttttgtctgagttaatttgaagaactagtctttgagctctgagattcttttctcagccttgtctattctgctgttaatacttccctttgtgttatgaaaatcttgtagtgagtttttcagctttatcatctcagtttgtttctttcttaaattgagtgttttgtcttttattctcttgaatcatttgattggattcgtcagattcattggaataggtttcaattttctgttgaatcttgattaatttcattgccatccagattctgaattctacgtctgtcatttcggccacttccttctggttaggaaccattgctggggagatgttgtagtcatttggaggtaagggagacactctggcttttagaattgtcagagttcttgcgttggttctttctcatatgtgtgggctgatgttcctttaactgcgatgtaatttgagtgtagtcagttgacttcatttctggatgtttttagagggccgaggctttgtgcagagtctgtatttgtgcctgaattcttgtccttggttccccagaagcgtatattagcaaagtatttttggtgttgatgtttgggctatgatccagtagatggtgcttaaacataatggcctgtaggtaggttcttgctcagccatgtggctcctctgcatttccttgcatgtgcagctgtgctccctttcagtggtctgagaatgtcagctcctctcacacttgagtgctggctgcagatctgtttggcagtgttgtgctatatactgtagccctggatggagctcaggctttgtgctccctcccaagcttggaaccttggcagtggcgatggcagagagcctttcacttgtttcttgaggctccaccccagagaaacacaaagctgcctgacaatcagaacaatcaacctggggtggggtgggtgccttgtaggcccaagccaggaaggcttgcctggtgacaaacagaggggagtgagagattcacagggaagaaagacaggcctcttccttgtagggtggctgtggcatactggaggtatgagtaaagtactcagggtctttatttctttcccagtccgagggcagcaagggtagtaccactgcagtggtactggcagaggggctttcagttgcctctgggagctccaccccagaaaaacagagctgttgccagtgggaatgttcagctggggttgggatgcctatgctgcagaaccaagccaagggctctgcctggtgaagactagggaggtggaggctgacaaggaagagagactgggctcccctccacatggtggctgcggtgtgctggaggcacaagtcaagcactcatgtctttgttccttcctcagtctgagagcagtaagggcagtaccactgcagtggcagtgacagaggggctggcagctgcctttgggagctgcacccctgggaaatacagagccattgccagtgggaattttcagccagggggtgggatagctgctttgtgggtctgagccaggggcgctgcctggtaaagaggagggggtgagggctcacagggaagggagactgggctcctctctgtatggaggctgtggtctgccggcaaagcaaacaggcaaagccctttgttccttccccagcctagagcaataagggcagtcctgctgcagctgcaatggcaggggggctgtcagttgtctctgggatgtcctctcctgagagatgcagagttgctactgaccgaattgttcaggccaggccgagaggccctgcccactgaggagtaacatgggcagggtttaggggtactttctacagactaatgaaaatcatttcatggggaaatcatggctccatgacacactggatggacctggggttaggaaaggaaatactgaggagagtatcaagctttactattgcttgtttggaattgggcttctatgtgtcagtttcctaactgggatgattttacctctccatccagaaatattctgttggcctagagaaactttttcaatgccttgtcttcacagatggaggagctataagtagagctttctttagtaatcacatctcagtaaccatgtgcagaaatcaattatcttaatatataccttatcaagttaatttttcaagaacaggtaagaatgagtgagcttagaaagtttaattgggaaaagagtgaatataagaaggtgataggatacctccttcaaaaggctaaaagattaacacatggaaagtaaaagaaacttatttaaatttctgtagaagatagaagtaggaccagtggatcaaagttacaggaaggtggatttttagatctatctaaaaaaggaccaagaaattagaactggcttcttctgttcaaatagtaatcagtgtgagtcacttagggaggttgtcaaagaaattcctgattgggagttgtttgaactaacacacccaaggacctttcttacttgaagaatatgtatgatattttacatgtattgaaacagctgtaaagagaaatgactcgccacaatttcttgcttaaagctttagttcatttctatttattacccaaaagtgtaattttcatttaagaatataagaaatgatacatctcagaattcaaggaaatattatatagataggccttaaaaaaggagggaccagtatggttctgagaaactcagctgagcctttcttttaatgctctaccactgagatgtttagcttccagttgacagtctatgtgcctttaaattcaaattctcaaatgagatactctaatttatttagtttaagttataagtctacccttgattcaatcatctgtagccaaaggagtaagggtcatataacagcaacagggttaaaatggtggtagggatgggcttttttctctggatggtggtcagttgctgctctaagtggagagatgaagtaagtcatgggctagatatctcataagatatttattagatttccaaaaatgttaatggtagaagactatgatttagactgtttgttgtcaatttcacacaaccagtatttatcatatggctactatgtgtaaggcaccatgctggatgattgccagaatgtagaatacaagatattgtccctgccccagggtatttacaagcactctgtccagtagactggtcattatttaataaatcatcctgcttaggttttactttggaagggctagctttctgattatgtagaaaggtgccttattaacttttgaaaaagtttcaagttgagtattaaagatgtttgccttttctaagcatacacacatttaatgtttgtgtagaccaagcctaaaagaccatcacaagctcatactccgagaacaaaaccccaatccgttctccccaaacaaacaaaaatatgagttgaatatcttatttgctagcagtatgttacattaaaatttgtgcttggccaggagtggtggctcatacctgtaatcccagcactttgggaggccaaggtgggcggatcacctgagatcaggagtttgagaccaacctgaccaacatggtgaaaccctgtctctactaaaagtagaaaaactagccgggtgtcgtggcgcaagcctgtaatcccagctactggggtggctgaggcaggcgaatcgcttgaacccgggaagtggaggttgcagtgagccaagactgcgccactgcactccatcctgggtgacagtcagactccatctcaaaaatataaaaaataaaaaatgtgtgcttgttcttatatgtacataaggtggaaggtaaacattttaagtgtctgtgagctacctagtattctaggcatgtcatatatgtaacatgcatatgatatgcagatagtgtatgcactattataataatataatccaattatagtctttattttcattatcttaaggatatttatatagttcaattgagtcgctaggaaataaaaaaaagttttttaagggtggggccttgctatgttgtcctggctgttcttgaactctgggcctcaagtcatccttttgcctcagcctcccaagtagctgggactacaggtatgcaccactgtgcctggccaagaatatttctttgtttcctgtttctgtgtttaagctgcatttagtttggcagtgtttgaaaggtatcatttctggtttacattcagctcttgtcctttctaccagctgagtgacttatgaacagaaaattatagagtaaaaataatatgacatatatgttaggctctaagcccttcaccttttttttttccttccaaataaagatgaagcagcttgtctaggtgcaatgccatgttaatatcctgtaaagataattagtagctgacttagcatattgcttggaggtttcctgagagaccaactttagctataatgcaagagatatttgatttctattaatacttgaataagtcattggttttatcaagatcctatatttaattataacttggggctggacacggtggctcatgcccgtagtcccagcactttgggaggccaaagtggaaggactgcttgagcccaagggttccagaccagcctgcgcaaaagagggagcccctgtctctacaaaaaaataaaaaattagttgggtgtgatagcttgtgcctgtagtcccagctattcaggaggttgtggtgggggaattgcttgagcctgggaggttgaggtttcagtgagccatgatggcaccactgcactcccgcctgggcaatagagccaagaccctatctctaaataaataaataaatcctggtctatttaaaaccctggatttgttttaaatagccatctaatttttatgctacaaaagagttaacatactttcttgtttttggaatctctctgaccttagaaccatactaactttgccatggatatttcttggggcctatttttccaaaataatcattctctttttttagagtctactgttcattttaattaaattgtttcccactatgctggtatgatttcaggaaaggagcatttaagtcatatgttcaatcaaaacttctgcaggtaaattataacccacttttcttttttatttcatgtggtcttggcaaatcatgttttaattgtggtcaaaatctgcatagaaacatattgtttcattgatttgcataatattttggggcattttaaaaatatacatcaatccccagagatcttaagctctacttgacagtatttagcatttacttctgcttaaactctgatatatttgagaaagcagaaggtaccacagtataatggtatttttccctttattattagttgtagtatataatattactagcagtattggtaaatattttagaatgtgaatgagcctgcctttcaaatgaaatctaaatctttatgttggtttttattttattactactgcatccagtgttatctgaatatttaaagtatattaaaaacattaaagacaaaaagacaaaagttttttaaagtatatattttttctcactgcataggatattagactacatatgtgccatctattttaaaactaatttcattcatcaccatctgttttcaagaaagatttaaggtggcgtatgtgcgctcttgtacttggtctcacaggctctgtctctctaacatacaaatctcctggaagtcaaaggtcatgtcttttcttctttctcctccatcttttacatctggctaaaattatattctgtatgcatgaaaatgataattacatattacctggtagttatcagatagttcacaaatttcctggagaagacataggaacaaaacagggccttctgtgatgaagaaagatgagaaaaatggagtatgacatcaggacacttagccttagtgttcttactcattacttttgtaaacctgtaacattttttcccatgctgttcccttttctgcttcatgtcttgattttcccatttgcaaaataaggatggaaacagttgcttcctgtttatttgatggggaatttaaggatgaatgggctagtgtttccttccccagatgtatcaacttaatcttatttattttctgtccatacttctgattccataatgtccaattgtatatgtgttttcaattcttttatttacattcttttccttttctgggattcttcaaaatcaaagcatgttaatcacatttcatagtgcacttgagtacccaagatactcttcagatatgggctaatgtttgaatagctctatttgcttttgagtgtctatcaaaacccaggccccagaccatcaaagcatgtaatatgagaggtgtccccagcctgaaatgcagatcagtttccaaggtgttaaagctttttctgaaagcctcactttggtctgctcagatgccttcttttcttttaacctagttgagcagttatgaaccaatgccatgatgaacagttgggtttgatcagtgcaggggtctattcaggagcattaactgaaaagtctactttctcatctgaaaaacagatgttttaccgtgatcctcaacatgtatgtgcctggcctctctgatactgattgagaaaaagaaaaacagtttagtagtcaatatctggggtcttcatcagctccaaataaactattaacagttaaatttcaacataagaaaaaatagagggccttgggactctgaaacaaaccactcattgatagaatttcactgaagatcagagccaaagtaatgcctaacaatttataaggttgtgcaggggaagaaaactggtcctgatctgatgtagggagtccagtgagagcaagcacttagttggagactcaaagttctgtagcatggcctggaagaaattagcttgtcctagaagattttgaagttaggcgctaacaattataagcatctatcactttgatatggctctcaaataattaaagaaattttgtcctataatgaggtgcctaaaggatataattgtttagtaatatttgagtactatagaatgtcttccagagagcataggttttgggttgccataactgatactgagttgttttttgtttttctgtctgaagtggccagagattcaaatgcctcttgagcctcctcctcgcatgtgcaagtaggactgtggtcctggcccacaggagcctcttcagctttcctccagctgtggcacaggacatgtgttcggttcactcgatcacattattaagtaacataggtattatttaaaaggagaagagtgagggcggagtcctattttatggcatttaagtttggaaccacttatgtcaaaactcatttctgtgtttatatgtacttcctaatttatttataataagcatgttgaattatgaaggagaatgttatttcaaaattctattggaggctacttagaggctgtggtgacactgaatgagagctctgaaggaaatcatagtgaaacaggaaaagttcccttgtccccgtcgcagggcatgcgacaagggggagtggcttgcttcttcagtgccccactgctcaaacctctaggggagaacacagatgggcaggctgtggggctctgaccccacggcagtgtctaggggtaaatgtttacagctgaagccccagtgaatgttgaagaatacgctttgacctacatattgacagaatttactgagttatagagtgataaatacttatttttttttcctaacaattatgtgatgttttggcaaataatatttcttttttctttttctttttcttttttttgagacagagtcttgctctgttgcccaggctggagtgcagtggtgcgatctcggctcactgcaacctccaccttctggattcaagtgattctcctgcctcagcctcctgagtagctgggactacaagtgcatgccaccatacctggctaattctttgtggttttattagagatggggtttcaccatgttagccaggatggtctcgatctcctgacctcgtgatctgcctgcctcggcctcccaaagtgctgggattatagatgtgagccactgcgcccggccgcaaataatatttcttaatttcagttgcatttatttttaaataggaaatacattcacctggttcagaatttcagaggttacagagctgtacgtaggaagaagttttgttttctcccaattccgcaagccatctgattagcccccttgaaggtagctcaagttactagtttcttttatttccttccataaatatttgatatgcataggagaaagatatatatatatatatgtatttatgtatgtatgtatgtatgtatatgtatgtgagaatgaatggataaataagcattcctctttcatacagttacttgcttaccatacctgctgttctataccttgcttaatttcacttaacactatgtcttggaattcattccatgttagtacataaaatgctgcttttttctttcttgtggttttgtggtatctattgtatagctgtattataatttttttttaactaggtccttactgatggacatttatgttgttgccagtcttttcattacaatgactaatgttgttttcttagttttcacttttcaattcatttcctaatttagtctgagcctacatattagtgccaagaactgaggtatttattgtgttctgacacatctgaggtatttgcatatagacatctgggtacatatgcacactgctgaactgtctaataatagtctctttccccaggacactctcctaaggtaaaacctatatattggaattcttatgctgtacatatatgctggatcacaactcttactgtcagactagagagtttcaacttttaacctgtgatttcagttattgtgacatatcctatgtttcaattagaagagacaaactttatttggtgagattcaaatagcgttcatgaaaacggtatcttttaataaagtgaggttaaaaaaatgggaaccacctaagatcttagagtgagaggagtagagattatgaaagcagttttactttttgattttagggtctttctatataatttcagcctgtatcagataattccgtttaggacacagctggtacatttaatgatcacaaactctgaaggtagtaactggatgcaataatcacacaacaaagtcattgagtaggtttgttgacttatgtcagattactctaaatcttgatgatattgcctggagcacaaaaaaggaatattgtcacagcaagcaatggaggttttgatactcgatcactggagtattcttttcccctaaattttgcgctcgttgtatcataactgctggtttcttagcctactctgatgttgtgcagaaaattgtacaatacttaaaaacgtgatatctaggaaagaaaattagtagaaaaaagccattagaactgatatatattagcattggtttggtggttacttattaaagataaaaatggagaatatttcatatttcttgatagaaaaaaagtaagttgccattcatgcaagtaaatcatattaatttaggtttttggcattttttttgttttctgagagaaacatgaagagttctgcttatttattttttatcttgagaatgggaacacattaacaagtacaagcgacaataaaacttactccataactacattatgaactatattaacttactctacaactcgataaccaacattatggttggttaaataaagagagtgaaaaagacagagagggaacgtgagaaagaaacaatctttttgtttcccaaagctgtaagaagcaatgataagacattgagtgtgtacgtgtgtgcatgttggggtattttagtattgtgtttatttttgttgggagtgagcagaaaatgaagccttcagtaaagaaattaataaatcttattagaacttgttgtaaatattttttaaattcctaaagttggaacactaaggcattatttaaactttatctctgttttttaaaatctgagaaacccattaacttttaccctagaaaatggaaagtgtcatatctcattttacagaggaagttaacaggtttattgtcttgttgtaacatcctaatcctgtgacattttgaaatagtgcttttggtagtgccttgtttttgaaactatagacctctggggcactatggacattttgtactagataattccttgtcactgggggctgttctgtacattgtaggatatttagcagcatctctgacttctacccactagatgccagtagcagcactcccttgggggacaaaattgtccccagttcagaacaactgctgtggacatacatggtggtcctacacaactggagtttaaatatggatcctgaacagctttcatcagtctgatgcacttccccaatatttgtaatcatgaggagcagagcaaaacaaaggcataaatgttggggtaatattttgttttccaaagaccactgctcaatttgggggaaatttttgaagaaacagcaaaggtaacccttggagtctggattggttggttggttgattgattcattcattcaacaaaaatatattgaacccctgctatatatatgcctgcctcaatactgatgacttgtacgctgctgtgtgtgtcttatggcagtatgttaaaaaaaatccgtggataataagtctgatggtagaccagttaagaagctgctagctataacattggtgagaaatgatggttgcctgggttttggtagtgacagtggaattataagaaattttatacagagatatttagaaggtaaaacattaggatttggtgattaactggagaaaggaaggcgtcaagaataatttccaggctttcattaagatgaggactagagtaggaaaaactgtcctttcttttggaataggagcagataattgacttcagcttttgacatttccaattggagctgcctttgagacatccacaaggaagagttagacagtgaacttgggaaataaatggattgtgtctgttttgttccttattgtacctcctgttctttagacagtgtctgcatttctagagacacagagagatttaggctggatgtatagattgggtgttcttcagggtatatagctagtttaattgaaatcaaggaagtagataacattatccaaggagaatgcatagagaagagggcctagtatagcaaccttatgagcagctttttcaagggactgaagagaggagggactggagaagtatgaggaaaatcaggagtgtatagttaaggaagccaaaggaagagagagtttgaaaaagaagggagtgttttatggttctgaattcagctaagagttcaagtaaaatacaaaaagattgtttaaattaaaaaagccattggattttgtaactaaaaagcatcagtggccttttagaagcctttttggtagtctggtagtttcaggagttcagtaaatttggttaaagagttaagtgggaggtgattggataggatcatgggaggtgggaggtcatactttcatgcattctggctacaaagaagagactgaagatggtatgtgaaggtggtattgaaatgggaaaagttcccttgtcccccttgcagggcgtgccacagtggggagtggctcgcttcttcagtgtcctgctgctcaaacctctaggggaggctagatgggcaggctgtagggctctgaccccatggcagcgtctaggggtgaatgtttacagctgaagccccagtgggcgtgtgtcacagagtgctcttttagttttgccgtctgtaggcggcttctgttagctcagttagactcccttccttatctcaaggacagagggctttctgtatcctggagttcttgccttggtgtaatggaataattgaatcactcgtgggcttggagaatgagcgcaaggttttgagtggaggtagctctcagcagatgggggaagccagaaggggaatggagtgggaagtttttcccctggagttgggccgcccagaggccggggctctccaacgactgccccagccaaactccgcgttgttggcttgccggtgtgctggtgcctattagtgcgttcctctcgctgtccagctgcccgtgtgttcctcggctcgtgtgctcctctcaacgtccagccaccatgtgtccgcctgctagggtctcggggtttttataggcacaggatggggggcgtgatgggccagggctgtattgggaaatacaacatttgggcaccaaggcagaagtgcctatactcacctaggcctgtgggcccaggtctgggggtagagccctcgccagggaccacgcgctccccttcccatcacttccctgccccctttctgtatgggatgcagggagggcatgtgggcttgagtatatttaaatgctgataaggagtcaaggatagaggttgatacgagagtggagaaaatggggcaacttgagatgggatgaatccaaagcacagggagaattaatcttaggatggataccctccaaagtcaagggatgttattggtgatgagaaaggcatattctgttaggattaatttctaatattgggggcttcttgagggaataatacttctggggtttcctgaaagttcagaatggcaggcattaaaagatgcctggggccaggcgcggtggctcatgactgtcatcccagcactttgggaggccaaggtgggtggatcacctgaggtcaggagttcgagaccagcctgaccaacatgatgaaacctcatctctactaaaaatacaaaattagctgggtgtggtggtgcatgcctgtaatctcagctactcgggaggctgaggcaggagaaccactggaacccaggtggtggaggttgcagtgagccaagattgcaccattgcactccaacctgggcaacaagagtgaaacgccatctcaaaaaaaaaaaaaagagagagagagatgcctgtgacagcccatactatttctgattccctagggtccactgatccccagagattccattaatttgataatgctctttattttgggtagctggcatataccagaattggaccctgaacctatggattaagtttgggtttggggcctaattctagtctaataatcagagtagcagggtgttctgagaccctctggagacttttcccattgtcaaagtacctctagccagtctaccttaattagcaaagatatcattcccattatgattcatcatgattgactggtctatatgatggattactgattgtagaaaactctggattattatagtattatgcttagaaaaccattctgttcaaatgttaaagggttgacaacagctcactttcttctgtggtttaacggaaagaaagttcgctgtggaaccagaaaaaaaatctggctccatcggtgattgagctatggggccttgaacatcctgtgaggatgttacagagtcatttactctctgtaacattacctggtaatgcctaatgtgcatcatggttagaattgaaggtcatgtatatgtaccattacattgttgatattaaataaataagaactgatagtatttttattgacttaaaataattattttattgacttaaaaataatatttttaaatatttaattatataattattatatatataattatataatatattatttatataattatataatatattatttatataattatataatatattatatataattatataatttattattatatataattatataatttattattatatataattatataatatattattatatataattatataatatattattatatataattatataattatttaaataaaaataataactattatttactactctagggccctaagtgagcacttattgttagaatttattgttagaattccagatcaaaatcaaggatctcatttctccatgaatctaagagctattattggtgatgtctttggtataagtttttgtaaggacaaaggttttgttacagtcctggccctactaaaacgtcttttattgacctgcatgctatcatagtaaatagagagaaaagagataaaattctagactttttaaggtatatggaaataaatcaaatttacttacttacttttttaccgtgaccaatttggatcgctgtcattttccatgaatgtgtctcaggtttttgtttttttaatagagagagttagctgtttcaacctctctttctttcgtctaataactcctcatttttttctccctcttttttcatcttcttcctttctttcagattattggaaactttctcatgttgcagcatttgctgctatcaattatgccagaaaagctttctgtgtactagcagtgttatgggatcgtgtgtgtgtgtgtgtgtgcgcgtgtgtgtgagacagagagagagagagagacagagagagagaggtgggggggagattgagatggaaagagtggcgggggatgaaggaagtgggggagagaaataaatggtgtctggggtaattgtgctggtgttttttcctgcatgagagaagcttcagatgtctgtctggctttggctcagttgctgtatgggcgtaactgaagaaggaggttggggtagaggagaaggcaattaaaactttgaacaccttaaatgcccttcctaattaagtggtgaggatggaaaatgaaataccttcttatgcttcatttctgttctccgtttaaaagtctgtggagggatcagagctcatgtccttagaaaggacagaactttcaaaataacaactctgaaaaacaagtttaaaaaaaatttctcatcattttctgcttttcatgaacttttaatataaagccatcattatttttttttcctgggcccccttacctatatcctctccccactctcattagtcactccaactttgaagcacccaattctctggagtattaatggagacagttcaagtatctaactgctgtttcctttgttcaagttgcttttggtccttgctgggaaatgctctgaaaactgaaccagctactgaacacaaaggctgacggtgttgtccctcctggtaatgtactgtgtgatttgttcccctctcctgttcatgactcattagtctctaagtacagaaaaggttgctcctctggaataaaaggaacggacccagctcggagtcctttttcgccttttcctgtgttttatatgggtgcactcacagttctccatcttcattagtgacccagcagggggctggcacagggttgagactagcttttgctggttccctggggtgtatcagagacctcagaactcaataccctactataaaaataaaatactgtgcttcaaacgaccttttgatggaacaaagccatacatcccaatctgcctgggcctctcaaattgagaccatgccaagtgccagatttgcattttgcacatgccctcccaccatcccctttcccccttcctctaaatgtggttcttttggtagcctcagtgtcaggtaaatgtttatgtgtgtgtgaaaacgcagactttggcaaaagaccttttgtatttaaattacacttcaagatagtagtttcttgtaagagatgtaggcagcagatatttgtgggcttttatgccctaaatgatatcattttagatttatatatgtgggcttttatgccctaaattatattattttagatttatatatgtgagcttttatgccctaaattatattattttagatttatatataaagtttaggaaagtaagcggaaactagaagtgctataaaaaactgagttacatattaaaaattcaagttattttttctggttttccagagtggccaaattattttcttatttaaaacctaggcaccctagagccatgtgtgtgcatgtgaactctactaaagtgagacactgacatgaacatagagtccatcagacctttatatcaagagcttggagtactcagagcatcgtatctcgttaatcttccagcattgatgtgctttagctcttgggaacagattactatacttattttaaagcaacagggcaaataaaaatagggatcttttggtattgaatgaccagcataactttagaaaatccaactctcttatccttcatttttacatcatagttacagtaacaggttaagattagcttttaacagattgttctaaatttctttaggtttcaaaacatattgctatgacatttaagtaatacttttaagactgtatgagacttagggccttggtttgtagagaatattcagttatttaagaaaagttcactttgattctatagtaaaataatgtacaggtgcaaatgtgtgatgttatttttggtttgtacttcaggtttgcaaacataccctaattttttacagaaagtatatggtagactctttattttaaaaaatgttcatagtctgggtctgtatgattttatttattttatttatttatttattattattattattattatactttaagttttagggtacatgtgcacaacgtgcaggtttgttacatatgtatacatgtgccatgttggtgtgctgcaaccattaacttgtcatttagcattaggtatatctcccaatgctatccctcccccctccccccaccccacaacagtccccagagtgtgatgttccccttcctgtgtccatgtgttctcattgttcaattcccacctatgagtgagaacatgcggtgtttggttttttgtccttgtgatagtttgctgagaatgatggtttccagcttcatccatgtccctacaaaggacatgaactcatcattttttatggctgcatagtattccatggcgtatatgtgccacattttcttaatccagtctatcattgttggacatttgggttggtcccaagtctttgctattgtgaatagtgccgcaataaacatacgtttgcatgtgtctttatagcagcatgttttataatcctttgggtatatacccagtaatgggatggctgggtcaaatggtatttctagttctagatccctgaggaaccaccacactgacttccacaatggttgaactagtttacagtcccaccaacagtgtaaaagtgttcctttttctccatatcctctccagcacctgttgtttcctgactttttaatgatcgccatactaactggtgtgagatggtatctcattgtggttttgatttgtatttctctgatggccaatgatgatgagcattttttcatgtgttttttggctccataaatgtcttcttttgagaagtgtctgttcatatccttcacccactttttgatggggttatttttttcttgtaaatttgtttgagttcattgtagattgtggatattagccctttgtcagatgagtagattgcaaaaattgtctcccattctgtgggttgcctgttcactctgatggtagtttcttttgctgtgcagaagctctttagtttaattagatcccatttgtcaattttggcttttgtggccattgcttttggtgtgttagacatgaagtccttgcccatgtctgtgtcctgaatggtattgcctaggttttcttctagggtttttatggttttaggtctaacatgtaagtctttaatccatcttgaattaatttttgtataaggtgtaaggaagggatccagtttcagctttctacatatagctagccagttttcccagcaccatttattaaatagggaatcctttccccattgcttgtttttgtcaggtttgtcaaagatcagatagttgtagatatgtggcattatttctcagggctctgttctgttccatcggtctatatctctgttatggcaccagtaccatgctgttttggttactgtagctttgtagtatagtttgaagtcaggtagcatgatgcctccagctttgttcttttggcttaggattgacttggcaatgcaggctcttttttggttccacatgaactgtaaagtagttttttccaattctgtgaagaaagtcattggtagcttgatggggatggcattgaacgtataaattaccttgggcagtatggccattttcacaatattgagtcttcctatccatcagcatggaatgttcttccatttgtttgtatcctcttttatttcattgagcagtggtttgtagttctccttgaagaggtccttcacatgccttgtaagttcgattcctaggtattttattctctttgaagcaattgtgaatgggagttcactcatgatttggctctctgtttgtccgttattggtgtataagaatgcttgtgatttttgcacattgattttgtatcctgagactttgctgaagttgcttatcagcttaaggagattttgggttgcgacgatggggttttctagatatacaatcatgtcatctgcaaacagggacaatttgacttccccttttcctaattgaataccctttatttccttttcctgcctgattgccctgaccagaacttccaacactatgttgaataggagtggtgagagagggcatccctgtcttgtgccagttttcaaagggaatgcttccagtttttgtccgttcagtatgatattggctgtgggtttgtcatagatagctcttattattttgagatacgtcccatcaatacctaatttcttgagaatttttagcatgaagggtcgttgaattttgtcaaaggctttttctgcatctattgagataatcatgtggtttttgtctttggttctgtttatatgctggattacgtttattgattttcgtatgttgaaccagccttgcatcccagggatgaagcccacttgatcatggtggataagctttttgatgtgttgctggattcggtttgccagtattttattgaggatttttgcatcaatgttcatcaaggatattggtctaaaattctctttttttgttgtgtctctgctaggctttggtatcaggatgatgctggcctcataaaatgagttagggaggattccctctttttctattgataggaatagtttcagaaggaatggtaccagttcctccttgtacctctggtagaattcggctgtgaatccatctggtcctggactctttttggttggtaagctattaattattgcctcaatttcagagcctgttattggactattcagagattcaacttcttcctggtttagttttgggagggtgtatgtgtccaggaatttatccatttcttctagattttctagtttatttgcatagaggtgtttatagtattctctgatgttagtttgtatttctatgggatcggtggtgatatcccctttatcattttttattgtgtctatttgattcatctcttttttcttctttattagtcttgctagcggtctatcaattttgttgatcttttcaaaaaaccagctcctggattcattgattttttgaagggtgttttgtgtctctatttccttcagttctgctccgatcttagttatttcttgccttctgctagcttttgaatgtgtttgctcttgcctctatattgcatttacaaaaaagtagattgtctcttcctccttgctactgcaaacaatgatgtgaggaacatcctggtactctccagggtatgtactgaggggtaggattgtagggtcatcaagcatacacaccctgatggtcactaaatcctgccagatttcttcctggaatggctgcaccagtctgcagcccaccagttgtgtaagaacactcctgctgccctacttctttgccaacattttatatgtttagactttctcttttttccaaactaatgggtgtaaagtggtatttaattttaagttgcatttctctgattactaatgaaattgagtacctctttatattactagttagttatttggctttttattgttgtgacgatttaagatttcatgttgatgtagatcttaattttgagttggtcaaacatatcactttttaaaatcttatactttataattttagggcccagggccacagagttattttctgacgttttgttttctgttagtcacatttacattcaggccttgattcatcttgtggtcacctttggttatatcagcatcgtttgaggtagcacattcacactctcaaatacagtgtgatagtttggtatgcactagagggccatgctgtatcatggattcattttgaaagagtatttaatgaaaaatataaaagaaggctattcatagcatattgccatttatgaaaatttaaaacacacacacatatatgtaaaacaacacttaatatttttcaaagaaacactccatatccaaagacagatgccagacaattaagtttttgcttatgaaggtttaggaggaaatgggggagtagtgataaagggggtaaaaaaataaaataagccaacagaggccttggacagactgataataatagtataccctgaattgaggagtatgattatccccacagtcagggtgaatataatttaggagagatgacctcctaataggttagtgatgagcaaagctggaaaaagttaattgaagaaaagtagaaatcaaatatttcagttgttctgaatcatgagtaagatgcctataaggaagaaaaattctcctaaatgactacatctggtcatgccttcttagcttttaaagtattttgtgatacacaggaatttatgtttttttcctgaggtgaagctctctgtaagaaggaaagcagatgtttctttttaagtgcttgtatacacctgccacaaggcagactgagtagttcatatggagagcaggctcgggttattttttatgttgcttgtgaaattaaaattcttttcctggcaagcataggtttataattaagtaatttatcataagagttcttttagctatatcaaaaatttgatgatatacagaagcaatatgtgagtggttacttagaaattagatgaatgagttatttcattggcatttatcatttgatgtgtaggtttttcctatttataacaaacattgaacactgactaattacctgcaactgaaagagggttaaaaaaaaaaagtcttagttgagaactgtattctcaacttattttcaacccaccagtgctcttgaagagtatgatgcactccgattaatagaagttgtgctctcttgggatcatgcttaattgtgttacaatataaagaagtcttcctccatggtatttatgggtatgaaaaaaaaagaagtctttctttgccagatatggattttgtacttccctcccttcaatttcatgtatactgttttttgtttttatttttctgattagttcccttggtatctgccctgccccatccccattcattttggtattcacatacccaataccatagtagcactttatatttactttgtttacgcctaattacagcctgcatattctagataaaacaaacagactcagccaggcacggtggctcatgcctgtaatcccagcactttgggagcccgaggtgggcggatcacgaggtcaggagatggagaccatcctggctaacaaggtgaaacaccatctctactaaaaatacaaaaaaattagccaggcgtggtggcgggcgcctggagtcccagctactcgggaggctgaggcaggagaatggcgtgaaccagggaggcagagcttgcatgagccaagatcgtgcctctctccagcctgggtgacagagtgagactccgtctcaaaaaaaaaaaaaaaaaaaaaaaaagaaacagactcagaaaggttaagtgatttttcgagggccatagagtaataagtagcagaaccagaatgtgaagccaagtctaactctaaagcccatctttttcatacttgactatcctatatttttcatggatattctacaaaatccatatttttatagagtatgatgtcttcattacgctcctcaatctttgaagaggattttaaccctgctctttggttcagctattgctgaatattgacacctttaagctgcaccatagaaaatttgtattcaggctccttttagagatgagtacttcgaactctctgctatccagttgctcaaaagtctgtttccaaatgtatttatagaatattgtgtgaatgacttattctccatccatttttctggattgtctgcattttagtttcaggccaagtcgtaccgtccaagagctatgtgcttaactcagctgcttttacctcttgcagaggtactttcttccttcctcctactccttttcgatattaaatcactggccttcaatgatggatgttatagcaaacagctgaataaaattcagtattctttctgtggttgagctttcattgaggagcccacctagtacaccacatcccatcgtttttgagaggacttacagatgaaattcttctcagatctcaaggtcaggaaacaacgattcatgtttttaaaatgcttattatgaatcttatatttgattgtattttcctctttactttggttgccaggaaggctagagccaaatttgcaagatcatctctaatagctgcaaaggaataaatgatatgtgtgtgtgtgtgccagtcttactcctggcattattttcttatctatgttcctgtttgatttcatctttcttaattatttattttgtcagtaatgaatgaattgtcataaactgccaaaaatcattatgctggtgatggatgcaaatatataaataacatgtgtaaggacaattaagctttcctgacttgatagttaaatctcattcctcctagaagtatcacatgtatacatccatcttcctcatttgtttttctcctttattttacttcctacacattttcagttgtttattatggatttctctcttgatgaatgcattcatacaattttagaattgttgagtatcaatataaaaagctattttttctgaaaattagtctccttataatttgtatttttcttaagttcatattttttagtaaaagtgtaaatttcataatttttattaaaacatttgcctccctaaagaaatttaactattttggttttttttttaatctgagaataggagtagggaaatttggagtctctaaggcatgccatgtagaagtttttgaacatttatatagaatggattgactttttctgcttgttcttctgtctgttgcctagtagatgtctctaactggatattcaaatgacacttcagaccatctgaaacttcacgtattatttccctcccaagtaaactagtcacccaaaccatatacacaacagtcagactcatttgctcacagctttaaagcaggttcttttccatttccactgctattacctattccaagtgccttgcacaactttgcctaaggagacactaagaattcttcattgaagagatgaagaaatgaatgaatacagggatgagttttcttcatttcattgcttctgtctagaccactggaaaaacgtatcttcctttattctgacctcttctaattcatgttctacaaagttatcaaaatgttattcttaaaatgcaaatcattcttaaaatgatatacaaacacacatcattccaggattcatttagtttagtgccaaggcctttcatgctaagttccctgcatctttctggtcttacctcccaccatgtctctttactgactttgttgcatcatcacgtggctgcatactccatttcctcccatgtgctgttcattctgcagaacatctcactgaagctttacctggagaactctactcactttgcctgtcggattcagatgtctttcctacttgttctcatagacatttatgtacagtctcgtgactcttttcatattaaactgttatcatgactgacttacttatctaggggctttctcttaatcaacacaggttctttattcctggatggtatccaacattccctgaataaccagtgattgtttattggctgtttgactgaatatagaatagaataagtctgtagcttatagtccattctaaccactcattcttttcataacttttattgagtgcttactatgtgccagcttttgtttaagagattggcaatactatagtgaacaaaatagtacctgcccaggcaattaaaaagtaagcaattagacatacaatgttgggtagcattatgtgtatattaatccagtttcactctgctgataaagacatacctgagactgggtagaaaaagaggtttaattggacttacagttctgcatggctcgggaggcctaagaaccatggtgggagatgaaaggcacttcttacatggcagtggcaagaggaaaaacgaggatgatgcaaaagtggaaacccctgataaacccatcagatctcgtgagacttattcactaccatgagaacagtatgggggaaactgccccaatggattcagattatctcccaccaggtccctcccacaacacatgggaattatgggagtacaattcaagatgagatttgggtggggatacagagctaaaccatatcacagtgttaggaagaaaataaagagggataaggaaattctagagcatatgctcaagcaaggcatatctaaagagggagcctttgagcagagacctgaatgcaatgagagacaagttgtgtccatggcggtgttgctggggaggtggttctgggcagagagaacagcatttctgtgctcctattatgtaccaggctctgttctaggggttctggagacagcaatggagaaggttgttaaacatcagcattgtttattatttaaccatgcagtctgttctttttcaatattatgtcatagttcaaaactcctcctttctttaattgctaggtttaacgaagttgaaaaaccctaacttgggaaagtctctttgttctccccagctgctaatcacttcctactctttgttgtggaagagaacacataaagtcttattatttagaggcccctaacagaataggatactggtcctggggacagatccccaactatctgaatttaatcatgatgctcagggatgtgtgaaagtgtcttaggtgttcatgtctttgacgtttgacctaggttatagatgtctgtgaaattctgtcaccataattagatatagatactactgatttccttttcccagtcttccaacccagcctatgaccctgagtaaaaccttcttaaattcttttacttcagtagcacacaaaaaatcataattttggatcctgttccttgctctgtcacctgcttgctgcagttaagtctgctctgtggcagttttccatttgcaagcagggcacccttccagttaagttgtaaaattttatgtttaagtaagcccctgtgcccttgaagaataggagctacaggaatgtagagtccaaagagaaaaaaaaagaaagagcattcctaagaaaactgtgtaaatttgcaaattcgttttcttctggtggcagctgacaggtggaatgacaacccaaccaagtaacactaggcccttgtgataggagggaacttaatgctgcggttgttctgcttagatggaattgtgtggggctgtgccaatgcctgtattgagaaagcccagtcgagcagaagagtttttggtttctgcatttagaactgccgaacaactgaggaaaaccgattaaatctggaaggtggcagctcacttgacaggcttctccaggcacctttgaggagaatcaaagataaataaacacattttatgagaggagtatggggtgagagggagtgtttggacaagagttaaaatttcaaagggagggggaagttctttttgacttttctcctgattagactcttgcctcatgtctttgttaatgtacaaattagagtttgtccctgtctacatgggtaagcttgatgggaaaggaagaagatagaagtatattttcaaagacctcaactatagaaggtagaaggaaactgatcaaatatgaatttctttattagaaaaaagtggctttaaaaactattttataagtcatattggatactcatgtgcctgtggaacatgcaaaaactctggcctgttgcacagaggtttgattttgaaactgtctaattttatttatttaaatttttttagagacagggtctcactgtgttgcccaggctcttgaactcctgatctcaagcaatcctcctgtctcagcctcccaaagtgctgagattacaagcatgagccactgcacgtggcccaaagtctgtaatttttttcagtaaagattgatggactttcattacggcctggtctagtgtgcagtgagttgccttgaggtcaggtagtacttgacaccccttatttactgggtatggaccctgttctctcatccttccattgtgctttactctttttttctccgtgaacaatttttacttgagcttgacttacctcaaaggggctatgaatattgaattggctaaaaataattcataacattctagatatatggagccttagagatcattgccctcttccccattttgcaaagagtaaataaagtgaagcccaaaagtgttaaattgctgctggcctaggggcattcagctaccaaatatgtatgcaggaactccacccagatcctgaccacactattagtctgttctcacctgctaatgaagacatacctgagactggtaatttataaaggaaagaggtttaattgactcacagttctgcagggctgtggaggcctcaggaaacttacagtcatggcagaaggggaagcaaatatgtccttcttcacatggtggcaggagagagaagaatgagctaaatggggaaaagccccttataaaaccatcagatctcgtgacaactcactcagtatcacaagaacagcagcatgttgtaaccacctccaagattcaattacctcccaccaggtccctctcatgacacatggggataaggggaactgtaattcaaggtaagatttgggtggggcacggccaaaactttatcattccacccctggcccttcccaaatctcatgccctcatacttcaaaacataatcatgccattccaaaagtctggcaaagtcttaactcattccagcattaactcaaaagtccaagtccaaagtctcatccgagacaaagtaagtcccttctgcctaagcctgtaaaatcaaaaacaagttagttactcctagatacagtgggggtacaggcattgggtaaatacacccattccagatgggagaaattggctaaaataaaggggctacaggccccatgcaagtccaaaatccagtaagacagtcaaatcttaaagttccgaaatgatctcctttgactccgtgtctcatgtctaggtcacactgatgcaagaggtgggcttccatggccttgggcagctccacccctgtggctttacagggtacagcctccctcccaggtgttttcacaggctggtgttgagtgtctgtggcttttccaggtgcacggtgcaagctgtcagtggatctgcctttctcaggtctggaggacagtggccctcttctcacagctccaccaggcagtgccccagtagggactctctgagggggctccaacccgacatttcccttctgcactgccctagcagaggttctttatgagggctccacctctacattagacttctgcctggacatccaagtgtttccatacatcctctgaaatctaagtggaggttcccaaaccccaattcttgtcttctgtgcatccataggtccaacaccacatggaagctgccaaggcttgggacttgcactctctgaagcaatggcctgaaatgtaccttggccccttttaaccatggctggaacgaagcagctgggacacagggcaccatgtcccaaggctgcatagagcaaggaggccctgggcttggtccacaaaaccatttttccctcctaggcctctgggcctgtgatgggtggggctgccatgaagacctctgacatgccctggagacattttctccattgtcttggcaagtaacatttgactccttgctacttaagcaaatttctgtagtctgcttgaatttctcctcagaaaatgggtttttcttttctattgcaattttttaaaactttatgctttgcatcctttttaaacatagattccaatgccaaaccatctctctcaagttcagggttccccagatctctagggcaggggcaaaattccaccagtctgttttctaaagcataacaagagtcaactttgctccatttcccaaaagttcctcatctttgtctgagaccacctctacctggacttcattgtccatatcactatcagcattttggtcaaagccattcaacaagtctctaggaagtttcaaactttcccacatcttcctgtcttctgagccctctaagtctctaggaagttccaaaatatcctacgtttttctttcttcttctgagccctccaaactgttccaaaccctgcttgttaccacttccaaagttgcttccacattcttgggtatccttatagcagcaccccactctactggtaccagtttactatattagtctgttcttatgctgctaataaagacacacccaagagtgggtaatttatgaaggaaagaggtttagttgactcacagttccacagggctgtggaggcctcaggaaatcatgacagaaggggaagcaaacatgtccttcttcacatggcagcagaagagacaagaatgaacaaaatgaggaaaaagccccttataaaaccatcagatcatgtgagaactcactatcagaagaacagcatgggggtaaccacccccatgatgcagttacctcccactgggtccctcccatgacacatggggattatgtgaactacaagaaaagatttgggtgggcacacagccaaaccagtcaacccccacaccaatgcatgtcttttgagttgcttagagctcaatattgcataagtggactatagcagtttactttattgacttataaaacataattaataaaataattaaatgtattccctgtataattcaaaacctcaggagttatcataatagtttcaatctctttttctatcatacctcttatgagaaactagaaaataaattaccactttgagtttcagtttgtgtttattttcttgccatgaagagtatgatgataaaaaaacataaaatgaagtggcccagaggcaggcaaccagaaggtgaggaacaaaaccaaaagtaatagattattagatgccagtaactaagattctaaattattactcttacgaatatagtgtgggttgctttaactatttcgttataatgtttatgtctgcacccatttctcatttctttttcctagtgtgcaaagttaatttaaagtgttagtacaaattgaggaagggaagtctctccagatttcattagaggatagactgaataagaacatgtcctacccgcaaggacaaaggagaagaaaatatattcttgactgtttcagaccacttcagataaggaggagacaatttaaaaaattaatttaaaaaaacacattaggatcaaataacccctccaaagaaaggtgttctatggatgagaaatgtaattactgctgtaaaaatgtagggaattttgcacgtttaatatagtttgtctcctattagaagcactagttggcatttttcagtattagggttgtggcttgccaggcccaccctcctgctgtgtttgtttcagggaatagaacttacccagtcgcaggtttcagaagagctgaggtaacctccttcaatgtgacacaagtactgtttatgttggagacaaatcccagaaactcaaggtaacaacgtacacagagtgagagagtatatgcaagagatttttatttggcatttttactgctaacagtctacagaagttttagtatttagtgccagttcaggcttaaggggtagtttctatttctgtgtgattttgaaaggtttaaagaatcagcaaattattatataatagataataaagaataaagattctggcttctatggaagcttgcaaagatatgagggagggcaaacaactgcttctacgtgttttgttttgttttaagaactcaaaaaagcatggtaggttctttgagcaaggccttagttgtcaaaagtttctgaagccctcaaaccaataaatagtattattactaattaaaagagcagataaactgagaaacaaagcacttagacctagggtgacatggtgagaccaaaactgaattctgtgtcttaaaattcagttatctaatctccccacttcattgcatattctactagcagtcattcagtaaagtacctttcatcactgcaggagtctctctgaacacagtggctttggaatagggttatctccagacattgttgacatcatgtctctgctcacataccaattgagtgaatattggcccacatgattcttgtaagtggattacaagaaatccacgatagacttcattcacttttgatgaaaccaagaactttccctcttgagctacctaatgagatactgttatttgtttattatgcagggtacaggttggggcttgttagctctctgaattcttaagcactcaactgaggaaatcaaatgcatgattttactatgcctgcacaggagttggagaaattcataaagtttatactttactagttttcttaagaatacagatgtaaataggctgttaagtctgcccaggcagaactgttgtttcagatgaaacttaatgaccacaccctcccaccccaatggagattgaaacagttggagaaactttagtttgaaaaatatttactttaaactaaactccaggaatcttttttttttttttccccttggtgagaaagatattctcaggtctattcggagatagcaatatctttaaaatcatgcaagaaacaaaatttcggagcttctcagtggttaggaatagcttcggacaatttacctaattgggcttcagtttcctgacctgtataaaacaagaggattggtaaatgctctccaacattgcttgaagctcctaggttctctggttactttgttatcgtcataaaatgataatttaaaaattgatgtatatgcatgattttatgtatgtatgttatatatgtatgattgattatacttgcctatgtatggaaaatttcaggttgttaataagaaactcgtttcttttggagaggaggactatgggcctgggggtcaggatgggagaattttgcattattttatactttctgtttgcttgttttttactaagtatgcattgtttaaagattttaaaaatagattggttttgttattattttaaaaggatgaaaggaagactttcaaattattgtaaaatctatacccaggataataataattggaatttcatttcagactccaagtttaaagtatttgtaattataagtagacttttgcttttattatagtaagaaaagtcttttaaattctcttcttcaatgaaagcaaccacttttgtttggtgaaacaagcagcatttacaagcacagaaacaaggtttagcaatattagtgacaggattatataccttctatttattgggtcctctaaaagatcatcttcctttgatttgcaactatgggaatgaaatagaagtgggaaaaattagcttttaaaccaattagttagtaatgactagtgccaagtttaaagtgtttcagagtgttattgcggtgttttaaatgtaaaacactagctccctcttaatctttttagaagataaaactgcaggaaatgaaaaagtggtcagttgaaacagcagaaggcattttagaggctgcatatagtaactggacttggattttggtttgagcattcgttttgttctattttcctatttttacaaatatttgtattaggttttgagaaactataagaacccagaaactagatgtttctagcttgacatatttgtggggttctttttatttttatcatttctacttttgtttcttacttaaaaaaatgaacttaaggaaatatacagaaaaaataactcaacaatcattttcatttaaaaaaaattagagtactttctagcatggttaatatatcattataatcaatatgaagtagatgtggtaggtttttttatttccagttgttctgtcaaaccttgaacattttgccctatctggcacaatgttttctagccttttccatattcaacaatgtcaagtaagtaaaagttaatttaaaatgaacttcagtgtttgtgtcacattggagttgttaaagttctcctttgttctttccaggtttgcattgcctctggctaaatttatttgtatttccattccatgcagggtatggtagcactgtgattcagcttacttagtacttcattggaacgttgggttatttatgctaaagtcaataatctcatagtgatgatgatgatgataaccattgctgtcacttattgagtccttacttttggtagatactacattagacttttaaaaaactcatttaatgggtattcattgaacaccttttatgccccaggcattgatttaggagccaaatacataatagttaacaagacaaagtcctggcccataaatatattgtttctaatccacataaaaccttgcaaggcaggtattgtcttaattttatagatgagaaaactgaggctacagaaggagaacaaagttttcagcattttatagcctgtgagtgaccagtctatttaattccagtctgtactttgctctgttctcctgcctcaagatagatcagtattatttccctcttcattaagatgtttataaacattcaggactggtataaacatgcttggctatgacacagttaagctgacagggatataggatgtgaagtctataaacaattattccttttttaccttagtgctccatgagagctagaagagacgctaaaacctagtacttttcacatcaaaaaacgtaaaatactaaggaataaattgaacccccaaaagtataagatttgcacactgaaaattataaaacattgttgaaagaaattaaagaagcctaaataaatggaaagatgtcatatattcatgaatcaggagacttaatattgttaagatggaaatactatctacgtggatctacatagtcaacaaaattcctatcaaaaccttaaccaatactaaaattcactgggatccagaatagccataacaatcttcaaacaatcttttaaagaagaagaaagttggaagactcatattttccagttttaatactcagtataaaactatagtaatccaaacagtgtggtcctagcataggataaaaatacagatccatgaattataaatgagagttgggaagtaaactttttcatttttgattaattgaatttttacaagggtgccaagacaattcactggagagtagtctcttcaacacataatactgggacaatttacagccacatacaaaagaacgaagttgaattggtactttacagaacacatcaaatggatcagacacctaaatgtatgatctaaaactataaaactcttagaaagaggccatagagcacaatctttgtgaccttgaaagacagtccacagaaaagaagaaagtaattgcaaatcttacatatgataagggtctagtatccagaaaatatggagaacccttataatataccaatagaaagacaaataattaaaagtagattaataattttaatagattttttccaaagatgatgtgcaaatggccaataagcacatgaaaatatgctcaacagcatcagtcattgatggaatacaagtcaaaaccataataagataccactttttaccactaggatggctatgataaaaaagatagacaataacaagtgttggtaagaatataaaaaaaatgggaactcacattcctcaaaaagttaaacatagagttaccataggacctggcaattccacacctaggtatatacccaagagaactgaaaatatgtttacacaaaactttgtacataaatatccatagcagcattattcataatagtcagaaagtggaaacacctaaatgtctctcaactgatgaatggataaacaaaatgtggtatatttgtacagtgaaatattatttagtaatgaaaggaataaagtagtgatacatgcgtcaacatggatgaacgttctgttaagtgacagaggctaatcacaaatagctagatgttgtataattccttttatacaaaatgttcagaataggcaaattcatagagacagaagagagataagagattgccaggatctagagagaggcaggaatgggaagggacagtgactactaatgagtatcgggtttcttttcagagtaatgaaaatgttctggaattagatattggtgatggttataaaactctgtgagcactctaaaaacactgaattatatactttaaaagggcgaattttatgatatgtgagtaatatctcaataaaattgttacgtatatattttttaaacctattaatttggcttcggtggtttggatttagtccaccacttcaattatctgtttgtgtctgggttattgcaattcaagtacaatatagtctcaacctttattgtctatgaggatcttcaattttcattattttatcaatctgcttgtctattgccttactttataccagctagacttattatatacaggcaaaaactgatacagagcaatatgatatattttcttcttgattccttttttaaaaacttaatgttatattacttttcaaaccaagagtggcatattgttgtaattatatcattaaaaaatgtgtttattttcaagagtatggatttgatttagaaactgcttttcctgcattctctattattcatggcatttgatgaccacacacttgaagtgctccctggccagagcgtaagagtcttgggggtggggtcagtatagaaatgattaatggtttgttaaaatgcaggcaagttgaatatgacttttataatgtggctgtgagaccagcttatggtatgaattcatacatgtctctctcttttgtaaacatgttatcgaagtaggttttatttcttgaatgctctggcctggtgctaatgagatgtgtgagtgtcctacccaaagcattatgtaacaggaagcaaagttttctgagggaaataagaagcttactagaaagagaagataaaatctttgctggggaatggttcttttccattagcattcccagtgcatttctccagaagtgtgcctaggaatcctctgctgtagttgctagataatattccctctttttcagggtgattggagaaagaaagcagttatttggggcctggagtatatagatagcaaggagccatggttctgaatgtggtgattggcccaggcattcttgctagtgatggaaatagagggctgaacaggaaagagtgggcagcagtacttgataacatgaggcactggtaataccaacttcatgtctggtcttcccatttaaaatggattatattttagcctctcgtcagattgaatgctaagtatccctacagtcaatgcctgcaaaatctttggcgtacttacttcaaccaaaacttaaactcaaagaggaatatagtgtaaactttggtttaactgaacatagaaagatcacacagagagccctggttttattgcttggaaacatgatgagatgtaagtactgtcaatagattggagactctaggcccaaatttcactgaagttcataaatgtctgctaatttcagggaccatcatacttaggagctagtatactaagaaattggaaagtaagtttaacatgtcttttgtgaaaggtggaaatttaagatagggacacagctgtctgcaagggacagtaggcttgttttttgaggcactctgtggcattcaagatcctaggggatttgaaactcagagaatggtacagtgaacataagaggggtggaaaaaagtggaggatgaagtggttatctgtgtcaaaaggaactgaaaggtgttcatactgttccacaatcccctcttcttaccattattagttaggtaaagagacaaaactgaatggcttccctttctccatctgtctcaagattgtttcctgccttggttgaaaggaaaagagggagggagcaaagtggcattacttactttggtctctctttttagatctttgggtcccaaaagtcttattggtgagaatatctggtttcataagcagaagtgggaaaaataattattactacttattgaacataagaactgtgctaaacaccctaataacattatttaatccgtacaacttttttgtataagcatttatctataagttaatacatgtgaagcacttagaacttagaatgagagcccattaaatgttaatacccattttggagataagagaactataccttagcattggtagaattttaatacatgattgttaaactcaaaagcccatgatctattatgcgatactgtggctctcttccttaagaactcagcttcctttacaaaaatcttccctgatattctcctctatatgcatttagaatcatacctgtttttcaattctatattttgactaattccaggttgtcagtcctaaatcctcttactctccctgcacttatccctgaggaagttcattcttcagattatcaaggtctggaccaaatttatttagtgagaatgtggaatttttcttacaagattttaaaatgacaagtaagataattacatgaaaggatctgtctaggctctttttgcattgtagggggtggaccaagtaacctttggatcacttccacttgtataattcaccatttcggcaggacagtaacatttcaggccaaagttcaacttttttttattattaaattcttttattgtcgccaggaaactagagaaaatgaattcttcacagtatgcttgtgcatgcaacttgaaacggtttgcacactaaatgaaattaaatgaaagacagctgtttgagaaagagctgtcagaaactgattgggttctattagagaagaatagaggccaggaataagttttcagaaacaggatatcagtggttttaaaagcaagcaaatttatacacacaaaagctctcatgtggttgtgctgttacatgtcttttcagttcatccatcttaaattatttgcttttggtgagtaggtgtctgctttcaaggctttctttcacatattgaatgtgtgacagttctctcttttctgagaagtaaatacaacacaaccccactacaataccatcctacgtactttggttttgggtaaactgaaaatccagtaatgttcaccaaactacttcctttgtccagtacctctctgttcctgccaaaatacaaagggaaaggaccatcttgggcaggttgccagaagtgccacctgggtctcctgaaatggctgtcagcaagaagggagcaattacatcccataacagactcaaagcagatggtcacctgcggtgataagtattacattattaagcctttgatttgtgattgtactttgtgctttccaggcactgaagttatgttacttgtgcgatgttcctctctgttcccctagacctcattgctcgttgtttggccatgtgttcccatggcttatcctccaaaaagctttattctgcaatcttctaactctcctgcaagaggctagctcataataggatctctgccaggccctccagcagtaggtatggtgttattacatggagttacctttaaaggaatttttaaaagcctttggggctttactgtggaagcataacttagtcacagtataacctcatataggaaattcagttagtgttcagagttaggagtcctagtataacattgcactcattgagatttagtctctggagtctcttcttccattgaatttttatgttttcagccctatttaacaatggtcttccataatgcattgaggctcaatctcaactgtcctcctttgagatctcgcttgccatcccctccacaccttctttattttctgaagatttagaatacaaatttatagtctctcctatagctgaagttaggagtcacttgattcatagggtgcctagctccctggactaagatagatggcagaatgtgcgtagagatacatgatgacacagtcacaaatctaattcttcatgcagatagtctttcaaaattcttagcaaattttaatttttaatattgtgagcctcagctgtagtaattcagatttaattatcatgtgatcatgctggggtgattgtttttagtgcagacataggaaatcaaagttggcagctgggctgcagctgtgccccagctggttttatctgagttgaattcagagggagaagtggcagcatgctcaccagctccagaagatagtcttctttggtcatacaaagcaatacctgctagatgctttttgagctagtgcaattaacacccaattagtgagacttcactataaaggtattaagaacatagtccatgtgtagtggacatgtcatcattgtttctttacaaattaaataaacttgctacgtagaaaatttactttatataattagacagtgttttccctaaattacaaaaacatgctcttaaatttggctgtcttaaagttctctgaacttgtaagattttgacctaccatatctaatttttgcctgaaaatattttatagatgctgagtacaatagcatatttatgtttaaaaatacgaaattggtttattgattttttaaattaattcttactagaatttacatcagctacttctggctttcctgcaggaaaagaattcttgcagcttagattaatcaatattgtccctattgtaaaagacactatattgaaagctgtaatataattttcaccatgcataataacaaagagtgtctaatatccataattattaagaattttacccatcgaagaaaacaactcataagaaaaatagctaagagttttgaacaagtagttcatagatgaagaattataatttgcaaatcataaagtcactaatatttaaagaaatgcacattttagtatgttctacaagaaggctcttcctcatgcattaaactctcaatgtaaatgtgatacttaatgaggctggtgcaaataaggaaaggttccctcataccaggcattcctacaaattctcttgggaatgagttctcacagtacgacttctggttgaaggctttcccatatacaacatattcatatgatctgtgcaacatgaattctctgctttatgattagagctgattactgtgagaaggctttatgactttcaggaaacaaataagtttttttttccatatatgaatgctctgatgcatactgagaactgattatctggataccagggtgactgaatggagcccttatcacagtcactgcattgataggctttatcttaagtatgagcatgctgggtttcttcatatttgacatttgaaggcttcctcacagttagttcacatataggtttctctcctgtatgaatttagtaacgtagttgaagatgtgatttcttagcaaaagacttctcacagatgccgcattcatgaggtttctctgaagtatgaatcttctgatgagtaggcaactctgatttctgtctgaaggcccaccaacattcagtacaaacaaagagtttctctctagtatgaatattttctgggatgaaagaagacttaatcttttggtgagagttttccacactgaatacatatatatggtttttctcctgtgtgaactcaactgtgccctaggagttgtggtatcaggcttgttttcttattttattctaaatgcttgtgatcattgctagtgacagccttctagtcctgagccacagccaacccttcagcctcactgaacaatgtgattggtactagattatatatatttttgttttatatttgaatatattaaggtgaagttggattattttctgtcacataattgaaatggttccacattacattattggaaaatcatttgttttatactgacccattacctgatattttaccattgaatggcatttttagtatctttgtgtgattgtctttcaattgaagtttttgagggatatatgcagcattttgtcattaaatttgtgcagatacatatgatggtttctctgttatattttataatatataaaacgtgctaaaattgttacagcaagaatatttgttttcttaatcttgttactctcattgtgataagtttcttattatcaaaagtggcctaaatagttatcaacttatgtttcattgtcatgggtttaatgtacaaatagagatattattaatagtatttcccaagtctttaatatttcatttttattggatgtgagatcatctgccagagataattaatttcatattatttgtgtaagtattatttattgagtgttaatacatagcagatactgtgaagaatattttatgtaccatctcatttaatcatcttagtaatttttagtatgaaactaggttttcttaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataactcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcgtgtcctttgtagggacatggatgaaattggaaatcatcattctcagtaaactatcacaagaacaaaaaaccaaacacggcatattctcactcataggtgggaattgaacaatgagatcacatggacacaggaaggggaacatcacactctggggactgttgtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataaaaaaaaaaaaaaaaaaagacaccaccattcagaacacaaaaagctacagaaggtccaggctactgaaaagcatcaagaccaagctgttgtaagtcaaactgcttttatgattgcattctttgatgaagacaatcccagaaaaagaaggtcatattctttaactcaaagtgcgggaatcttgtgtcagggaactacatattcaacaccacatacaaaacttgagaaagcaaagtcttcaacagcagatgccaaagtggtttctttgtctttacagactagctctgtgcatcacagagtggggcatggtgttccacatgggaaactgttaaaacagaaatcagaggagccatcggtgtcaatacccttcctacaaactgcattattaagaggttcagggagtcttgggcacagaccaagccaggagatggataaaatgttaaaaaatcaagcaacttctgctacttctgaaaaggataatgatgatgaccaaagtgacaagggtacttataccattgagttagagaatcccaacagtgaggaagtggaagcaagaaaaatgattcacaaggtaaataattgaaatttgagtgtgatcttagttgttgtgtggtgtatttgactggtggaaattattggagagtcagcatgagatgttgtcatgcagtcagtggtatgtgaattttagggttttattagggaactgcaagactaacagtaagaccaacatgctttgtgattttatttgctgatattctgaatttacctgagtttcatacataaagctctgtacatttaaaaggttaaaaaaaaaaaaaaaaagaaactaggttttcaagttggtaatggtttcagactgtctatgtaaagcataagtagcatgatttgaagtgattcattcaaaaaatgtataaaatcagagtaatagaagctaaattactcaaatcttgctcagatataaaattttttttcagctttcataggaatctgcccttcgattagtgagaaaatacggtcttctgttgaagcagagaatttgacagtcatgacattatattgtgaacctttaagttttactgctttattttctgtaaattactacatttctatagtaatttcgcagtgtaaatgctgaatgaatgtgattagctatatttgcaggcttagagcatctgtgaatacttcctggtttttggttagttgtgtttattcctagttctatgtcctattgaattggactttgcttatttaaagaaaagtctataaagctacaggcaagaaaagttggaatttcttccttggggaaatctcaaatgtagagttttaagtaaatattaaggttcaaaatgggcaatataatgagcacatttgaggaatttgtaagtatttatgtaacacttcatgtttacaaaatgttttacagccatattcattaatttacataagtcccttggaaggtaacaatgttattacatgtgttttattaagcaagacaggtaaaatttaggcaaattaagtggcagaaaggaagagacattaaaacatttattctgtgacttgcgcctatatcatagagcgtgctcctgcattagggaaataaagaaataaaatgcttctcttttgttatagacttgatcatggtgcctatttgggtaattgtttatatatattcatatagttttatatattttttattttttgattatgagacacaaaggccttccaacacaaatttcaatgtatgaaatatctcaacttaatagctgaaggataagatcctgggttataaattctccattaaatgttgcagttatcatgatcaacagattggtgaatatgtctggtggctgctcagtattggtctagatagaatatactatgggaccaaaaaagatatgaccgtggagagctcactttggtggccacacactgcctgcaggctgcttgttctctgccactctgttttttgggaggactttcctttccctctcatagaatagcaaatttctgctaaaaagtaataaatttgctcaaaatatcaaaaaggtacgattagaatatcttccatagtaaaagagattaaaaataacctagactcttgcattagaaagcagagggagacatgacaaattattgcattcaattaacttttcttttacttactgagtgcccagaaattgctttaacaccctgaggtgtgaccataaggtaatgaggagtgatttttaaaaataaatataccataaggtacactgtttaaatgagtgctattcttcaatgtagccactctttacactaatccaacgatgctgtcattgcaagaaatatttttagaacttgtcctttcgaattgccgttagaagccatttatggactatagaagaaaacagtctcacattgacttaaagtcgcactacattttttaaatcaacccctcccctgcaaagaaatttattacccaaatagattactgaccttttcactaacctttgttctgcatttttttcttttcaaaatcagttctataatttaaaaaataacaatttgccatcaacaaggatatttatttcctttttattttgaaaagagttattaaaaaatctatatcagaaaacagtagacaaaatagtagtttccatatatccttcacccagttccctctaatgttaacatctaatataagtatagtacagttaccaaaatcaggaaattaacaccaataaaatactatttggtaatcagtagacatcatttaaatttctccaattttccccactaatatcctttttctgcttcaggatctaatccagcatcccacattgcatttagttgtcatgactccttatgctgttccaacctgtgacagttctaatgaggacatttaaaggaagtgtgcccctcgcccaccaaaaggaagaaagagccatagactctgaatgtaattccaaaaatatctttgtctctgtagctgtcttgtcaactatgtcttttatttattggattttttgtaacctgtgtaccaaatttatgcagattgcagcaataagaagaagggtaagatgtgcttgggcacaaaggagttgtgaggacaacacatctgtccatagccattgtgcaggtgtattttgagctctgcggatttttttataatgctttcacatttggttcaaaatattttaaaatcttcattatgatttctcatttgatttgatcctcatttataatagctcgtgtgtgtgttgtgtgcatgtgtatgtgtgtgcacatgtgtgtgtgtgtgttcattcatttcaggaactttatctgttaaaattctttgaggccagtgtttaaagtatgttcttcaagggaagattcctatttgctcccatcagatgcttgtgaacacttcaaatgcaggggaaccgccaaacaagttctttttttttttattgagacaaagtctcactctgtcacccaggctggagtgcagttgtgcgatcatggctcactgcagcctcgacctccctggcctcaggtaatgctcccacctcagtctccccacgtacaggcacgtgccactcactaatttttctaatttttttttgtagagacagggtgtcaccatgttgtccatgtagctgagactataggcacgtgccaccgtactcaactaatttttccgatttttttgtagagacagggtctcaccatgttgtccaggctgcagttcttgatgttaatttctttttttttttttacaactattttatcatttatttattttttattttattttattttattattattatactttaagttttagggtacatgtgcacaatgtgcaggttagttacatatgtatacatgtgccatgctggtgtgctgcacccattaactcgtcatttagcattaggtatatctcctaaagctatcccacccccctccccccaccccacaacagtccccagagtgtgacgttccccttcatgtgtccatgtggtctcattgttcaattcccacctatgagtgagaatatgcggtgtttggttttttgttcttgcgattgtttactgagaatgatgatttccaatttcatccatgtccctacaaaggacacgaactcatcattttttatggctgcatagtattccatggtgtatatgtgccacattttcttaatccagtctatcattgttggacatttgggttggtcccaagtctttgctattgtgaatattgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgtcattctaactggtgtgagctggtatctcattgtggttttgatttgcatttctctgatggccagtgatggtgagcgttttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgtgaaaattttctcctattttgtaggttgcctgttcactctgatggtagtttcttttgctgtgcagaagctctttagtttaattagatcccatttgtcaattttggcttttgttgccttgatgttaatttctaagctgcaggtttttaggccatataagtggtttaagtttctagccctaaatcacattaggcaggttttagatagaaattctcattagggcagagatctttgttacccagtgcctggaaaggtgcctaacaaaaactggccctcaatacatattcattgaatgaaaaaatgaatgaatggggaagacccttgtcccctgccttttttttcctgatatattcagaaccacatctgagaaggacaggtcttctgcttcaaggtgggtttttttttcttagtttgccaactgagggtgtcaccctttgggagcctggaagtctcaactttaagtaagggtcctcatttaatctcttgtcctgcttgggcccgggctctgtctgctatcctcccaactctcttgccatgtgcccatttagaacccaggctctagttcattaaggattggcaactgctctcaggaaagaatcctcccaagtttttttccttctgagaaatgttatttttttcagttgtttctggcttacatttatttctgttactctctggctgaaccatgcttaaaaagacatattttatattttaggtgtgatgtactagtcttctgtcatattgctaggagtgtgattctctgtaacaatttctttagagaaggtataatgtaaagtaaaaattaatatggaggaatgggttatagggaagttagtgtccctgagatcatgaaattatctctttacgcactggaagttatttttttctctcgtgtttcaagttagaactttttattatgtcatagattaatcacactgctgtcacttattgagtgactcttgtgcatcaggcattttacatatattatttctaatcatcataaaagctttgcaaccagacttagcagctttattgcaaaagtgaagaacctgaaagccagagcatttatgaaacttttccaattattccaggcagtgagaaattgtagtagacatgttttatggcacctgcttgccatgcttctaagaggcgttattcctccttgttgaggagtaacagccctggtttgtaccatatgaccccatccccatcttctagtcaagtgatctaaggatccacaatccttagcttggtaagtgccctcttgctaacctaaaaacgaaaaagtcaacagcttgctttatagggaattccagaagcatttccataaacttattaagccaatgatcacccttattcctactatcatttagtattgttatagtagcactagacaaaggagtcttacaagaaaaagaaattagaaataaaaaaaactagaaaggaggcatattaactataccttctaagtaatatgattgtatatttggaaaaaccaagtgattcaactaaaaaatttacaaaaataaaagaattcataatgacagattctgagaaagaagaacattgcggtgggactagaccaatttttgtaaaatgtattaagctacaataacttaaagactgtggtgctggtatagatagttaaatggaaaaaaatgggacatccaaaaataaatgtggaaggagtataagatatatatacatatcttatatatatatatttcacataagataatgttggcattgcatatcacaataaacactggagcattcaataaatcttaccattaggcaaagaaatggagttgaatttatatcttaagccttatccaaaaataaatccttgggggcaacaatgatttaaatgtgaaaaataaaatcaaaaaagtattggaagaatatctaaggttatttaagataatttctacattagaaagtcttttcaagtataatataaagcacagaagccataagataactaactttaaatactaaaaaacaaagtttatgcataacaagaaaatccattgtaagcaaagtcaaatgacaaatgaaaatctggagaagatatttcacatgtatcacaaaccaagactattttccctattgaatagagagcatctacaaataaacaagaaagcaatgaccagcgatgggtaaaggataaggacagatcacagaaaagtaagcacaagtgcttttaaaatttaagaaaaagatatcagacttccctcctgatgaaaattaaatggaaaacatgatatatcatattattgaagataaagaagcttgatcaaaactggctataaagggtttgagaaagcagttggttttatactttttggtggaatgataaattgttagatacaacttctgtgaaggccaatctataaaaaaaacttaaatgcatgtatcctttgactaagcaattccacttaaggaattttcctacatttgtgtttttcatttgagcaaaatgactgacataagtatagttattgcatcaatacttataatagcagaggactggaaacaacttaattgtcatcaataggagactgaatcagtatattatggtactccatggaatatactgtgcaacttgttaaaagaatgaagaagttctgcagtggtaatggaacaaaatccaagatgcattattaaataaagcaaaatgagaacagtatgtctaacatgctctcctttgtataaaacaaacacacacacacacacacacagacacacacacacaaatgcatagcttatctttgttgtaaggttgtttccaggggggggttttgctgtgtgagaaacaggaaaaagagactttcttttcagtgcaaatccttttatgttttatcattttcaggctttgcctgttccataaaaataaaattaaccatataaatgtcaggaatgatcttttcttttctttttttctttctttctttttttttttttttttttgagacagagctgtctcctccagactggagtgcagtggcatgatcatggcttactccagcctcaacctctcaggctcacatgatcctcccacctcagcctcctgagtagctgggatcataggcgtgtaccaccatatctgactaattttcttcttgatttttagtacagtcagtatcttattatgttgcccaggctggtcttgaattcctgggctcaagcagtcttcccaccttggcctcccaaagtgttgagatcgcaggcatgagctaccatacctggacaggaacttagtcttttaaaaagttagatgatatcagctgggcacggtggctcacacctgtaatcccagcactttgggaggccgagatgggtggatcacttgaggtcaggagatcaagagcagtctggccaacgtggtgaaaccccatctctactaaaaatacaaaaattagctcggcatggtggcgcacacctgtagtcccagctactcgggaggctgaggtgggagaattgcttcaacccgggaggtggaggttgcagtgagccgagattgcgccactgcactccagtctgggcaacagagtgagactccgtctcaaaaaaacaaaaccaaccaaccaaacaaacaaaaaactgttggttgcatttcaaaaatctaactgaaaagactttgtgcacaagcaactgcatggaatttcatttatccatcttggataaaaagcctagttggtcctgctatgatttgactctgtgtttcttcaggctctaagtattccaaaatgatgcattagctccctggactctctgtgcatcagagacctaggatgtgctatttaaatcatctggcaaattgatgtgtgggggaatggaactctttcccccattttttaaaaaaaattaaattttgtaatggtggcacattgtataataagcacatatgaagattggagctatcattttggaaatgaccttaaatagaaggaggaaatgatagactcatagtaccatccaacagtgtgggttcagcctattttccattcctaccacagagctgctgggtgactctgagtaagcagtttcatccaattttactgtaagcctttgcattcctaatagaggcacaatagtattggtacctgtcttattcagagagtggcagattaagaagactttgggtgatttctaacttctagcagccgtacacacgaaaaagtctgtacaatatagtgtgtttttgtactcagatatttcatgtgatggctctattttttgaagccatagaataattcttccttaagtaaaacagcaaactagctccttgatgtcactgagtttgtgaattattttcgttcattttgattagtacataggcctcacaagctattaaggagaaaaaagaagacaggttttcttattcttattttaatgatgagatatatacagttgaaaggaattatgtaaggccgggtgtggtggctcacacctgtaatctcagcactttgggaggccaaggggggcggatcatgaggtcaggagtttgagaccagcctggccaacatggtgaaaccccatctctactaaaaatacaaagattagctgggcatggcgggcacctgtaattccagctacttgggaggctgaggcaggagaatcacttgaacccgggaggtggaggttatagtgagccgagattgtgccattgcactccagcctgggtgacagagcaagactctgactcaaaaaaaaaaaaaaattatatagctttctcaagctctcatgagaaacaggtgacgaagtgaaattttcctgcataatgtcacattggatgagaaatgtatccttatttaaaatgttacatcagggagtcatatgctttatggtgcactcatgccagcagtaacattgttgagctccatatgagacacacagcaaagtggtttaaaaattgcatagggctgtagcattcatttacacaacattcaaaacaaaacaattactgaatcaagcaagtggaaatgcagaatctaagggggtgaaaaaagattgtcttgtgtttacttcttttttaattctctcattgtcttcagttgatattcctctcagatgccagatacctgtcattgttgccagatgactggactctgctggctcatcaaggggctgtggcagtgcttgtttccatgagagctggaagaaaaactgcaatggaaaagcacacgcagtcgttcataagtagctggctgtgtaattctcagtgccctgtgttcatctgaatgtgaacttaatctgatattgcttagaactggggcttcatcaatgcaaatgactgtgcttgcaagctgaacttcaatatttgtgagcagtggcagagcactttggttaatgtgtacatattcaggtttgtagaaaaaaaatctgtgcaatttgactgtggtcagtttagttgccaggagaattggatattcctgggaaaagaaaaaaagtgtctcacttctggagccattgtaaccatgtaggtatttaagaggtttttgttttgttttgttttgttttttcaaagataaatccctttttggatgattagtcagttgatcttaaatatcatgtaattggccatgaaaattgatggaaggctctgttcttagaactgtagctccattgaaactcattctcatggtgtcatttagaaagcaccaacgtcccataggatcacatgaaaacagagtctaaaggagttatcaaaatgatacttaagaagttgaagtaagtcatcccatatctgatcttcatgatgactatcaacacttatgttagatgggcactctcattaatcctggtgttttcccatgatttctctggtgctagatctgatatgaataacttggttgcaataattataatagaagggagattgaattatatacatctttgttttatagctatacctttttttgtgctaataattttttactgtagtaacaacaaaaatcattcttttatcagcttttaaatattcgtattcataatagcacttcccttagtttatgtagccttgtttcctgagcatgtttgctgccttgattctattgttgtgcatgctcttgttctgggggagccatttaggttttgtgtatgccaaaaaaaagtctcatactcagcagttacaaaattactttccttctttatggattactttatattcaagtcctccagtcctaagtcgttgtcagcaaagattggaagcagcagtcagaagtgttctactcctttgaataactgcataaaactatagcccctcaccaaagaaaatgggttttcatgtatgacacgttgatcagcatgagattgctgctgagctggagaagagactgtgcagtgacttacttgacagcagaggtgctttttacttccttagtactcaaactgcagcatctgttccataccagaagtgagcagcttgttttccaatcaaaatggattcttctgcaattgtaccttttttggaaattaggtacactttctaacatatatgttttgaggcccttgagtatttgaaacatttcctagtctactttcccagacttaaaagatatcatgtgtgaaatatgtggaatgagaatctcaaggtgtttgggtggattcgttctacggagaatatatttgcttattgcagtttctcaataaagactttaaagtagctgagggaaaatctaaaagcacctcttcagaactgaaataatttatgtctgctggtatacatagaaccttccagagtataagctaatgagccacctcagataccacctcctttgtgaaaccttctccagcacccttaaaagaaagtagttatcctctgctctgcttttccaaagccctttgaccctctgtaaaagggcttatctcatatatgtgcctcaaattatattttttcatctctctccctatttatcatggaaatcagaaaggagattttgtcttatttatttttgtatttcccaaactactccacccagaccattgaatgtagctatagatcaggcaacaaccccaacccacctggtttcctcctgagtggtctgttcactccctgtgctctgctaggattatatgctcttaaaagcactattcacatactgtttcaacgatttgtttatatagctgtctcttctattagactgcaaattccatggggataggactaagtcctccatctgtattaacccagggcctagcataatgctgcaacacagagtactcattaatttgtattgaatgaatgttggatttattcagtgaatggtggccttgagtatatgaatgggaaatataggggctcatattccagttagcggtactgtatagtgataattcataaataacaattgtacattgtaacacacacacacacacacacacacacacacacacacacacacacacacacatacacacagtaatgctttttgtccctggaaaaccacaagtaacaatgaagtattctgctttattatgttgatatcatcatgataggaaggatatgttgcttattcactcttactttaaaacccagagatggtattctgtcatttcttagaaggttaagtagaattgatctgttatcagatagaattaaattttagagttttcattgtatctcatgatggaattgcctgttagtttgtgtcccctaggaatgtaagttccctgtgagtaggtgctataccttctatgctgaggttcctagcatagggcttggagagcatggtagatgatcaacaaatatctattgaatggaacataaaaatgaatgtatgatacaattagaaaaacccataaaaattcgttagctttaaagtgaaaattctttttaccgcttgggaagtatcactgggaccaaatggcttttaagagaaatgtagaaaccttctgaacatggcagtatttagaagctggaatatgagtttggttttgattgttccaagttcttcctttggaagatcaaacttcattcctttagaagcttaatcctttttgtgtctctatctttagcttagattctcacccagagaaatagaccttcaataaagttaatgtgaagagaagtcaattagatcgcaagaggagtttctttgcaatcaaattacctggaattttcaggtcaaacctgacagagtgtaggtttcattaaaaaggggcttataggccaggcaccagtggctcactcgtataatcccagcacttaggccaaggtggatggatcacttgaggtcaggagttcgagactagcctggccaacatggtgaaaccccatctctaccagaaaatacaaaaaatagctgggtgtggtgttacacgcctgtagccccagctacacgggaggctgaggtgggagaaccacttgaacccgggaggcagaggttgcagtgagcccaaatcatgctgctgcacttcagcctaggtgacagagtgagaccctgtctcaaaaaaaacgtgagtgggggggcttgtagatactgctctgtatctctgctctcaaatgatatgaacttggtaacagatacacagctcttactaagttagcattcataattttaatttaaactctcaagctagttttggtagctctctattttaaaagagttaacatgtagtttttcattgaaattaatttttctttactctgaaaggtaatttcctagagatgagaaggtatctagcctttttctcttcttaggagacacaaactaagccagttgcagtatcatttactactttgtatcttgctcttttttgtcatcaagggcactggtcttgcttctggaagaattcactgtgaatgagaaagccacagaaggatttagctgtaggagatcctttgcttagaggcttttattttatagatgaggagatcggctctgagatgttaacttatttgtttaaggttacacagcaagtccatagtagagcctaaactagaacctaggtctcttggctgcttgttcaagcctctttctactataccttacgagttttctttgtatactgaggtaggatgctcacttccaggcaaacactgattgctgaaactgagaaactgagaactctatgagtttagagtttggggtgacaacacagctaaaacttaaagacttacacatgtcacattattctttaactagagaataatttagtttaacatcaatttggtagtttaactacaactgctacattgtacctagtgtctggttcagtgtagataccacagggcaacagcagtgaggtgcctgtcacttaaaaggggaaattagattttcccctaaactagaaatcgataagcacagggtcacagtggaaatttacacaattttcttaaatactatgatcttgaaagaataaaagacttgactgcaaaactaaatagcagatattagtcagaaaagatgttggtcatctatagaagcatggacaagatcaaatcgcaaggtaaaggttgcctgtgcctacaagcagagtgtactccagtggttctcaaactttagtatatactttagaattaactggaggccttgttaaagtaccaattcctaggccctatccccagatgcttatggcccaagaatttgcatttctaacaggttcctagatgatagtgatgctggttggggaacaacattttgaggatcattggtctataggtgtgttagttttctactgcggtgtaaccacaaacttaacagcttaaaacaacagccatttattagctcacatttctgtagatagaaatccaggacagtatggctgagttttctattcaggctgaaatgaaatcaaggtattggttggcagtgttcttacctggagctcatagtcctcttccaagatcattccttttattggcagatttcattcctctgcagctttagaactgaagtcttgttttcttggtatcagccagggactgctctcaactcctagaggttgttctctggtccatagagggtgccttcagaggagaaaatacagtagtgtggctgactcaagtgttcctggtctatgtagcaattgattttctctgaggagattaataaatcaacattcttattatatacatcagcctctgtgaatctgcttaatgtgggtctcctcttgctgtgtttaaagattgggttttgaaactgattagctgagatttagatcctggaatgaagataaattcaccaagatgaaaaccaatgttggggaacaaactgggcagccagccctcccttttaggaatcatctctctattgctttacaactgtatttgttcttcaaaattctcattgtatagcatatcttggattaaagccatggttaaaattaaagatctcagaaattcaaacaaaatgtctaataatttttctttagccaatctcctctctttttttgtagaaattgattcttttactgaagccttgagatctctgagcattataaactttctgaactaaagtaagaatcctgaaaataaaatttcaaaggtgaaatggtggcaacttcacttcctatgggaattcctgtaaatatcagagaaaagtgcttggcagtcacagattgttgagagttatcaagtaagcctccataatctactggttcttaatgcctgatctatatggctgactttgtgtgtgtgggtgtgtgtttgtgtgtgtgtgtgtgtcttttatttaccaaattttgttttttcatcccttaggaaaagtcaggctctatttgtttgagtatcagtggctcagaggttcttttatacaaatgtatttagctaattatgtgactcaaatatccaaatttagaattattaaattcctttagagcagattgataaacaggattattgttattttattcccttgtcacattgttagagaataaaactcaatctgtatttctaaagtcagtgacaaccatatcattacattggcaaattttgtagacttaactgaaaccacatcaagcctaaaaggctgcaatgtcacttagaattttaaaagtaaactgtatactatacagctgaaaatatttaattttatagaagttaatataaaatgacttaagattttagttgtctataaaatcaaaatctgcctcagtgtcatgtgcttgtgatgtgggctttggagctgcattaacaaaagtacatgtcaagatcaaagatggacatattcgctgggtgcggtggctcacgcccgtaatccctgcactttgggaggccaaggcaggctgatcacctgaggtcaggagttcgagaccagcctgaccaacatggtgaaaccctgcctccactaaaaatacaaaaattagccaggcgtggtgtcatgcgtctataatcccagccacttgggaggctgaggcaggaaaatcgcttgaacccagtgggcggaggttgcagtgagccgagatcatgccacttcactccagcctaggtgacaaagcgaaactctatctcaaaaaaataaaaaaataaaaagatcgacatattcttcctatcgctctctgttctggtcagaccaccttttgtttgactgccatgtgttcacaaagatttttgataaatgttcatttaggagggaaccaatcagattatagattggaaatcaagtcacctgaagtacagttcaacaagctgagattacttagcctaaaaaagagaaaactttggggatatgtttaagatagacttgtttaattatataaactaaccagttaatagcatttcttattggaaggatattaaagagtttacagagtcaaagagaagaaggaagaatcaggctcagaaaggacagggaaagaacagcttaagagggctcagtaaacctggcagtcacattcttctgggcttcactgccaaagttatcacactccagcaactttcagtgtttttgttaagattcaaaactaggggatctggcttgggtcatatgttcactttttggctaaagaatggcagggaatcttgactcataatcccattaggctgcattcagtggggtagaggtaattttcctcaaagatttggggtgctattatcaaaatagtaaggaaatatatgctgtacagacaaaaagtaatgaatatccacaaaggttatgtgatcataatctttgaatattggaaagaggaagatgagccttggtaaggatgtaaggcaatagttggaatatccatggaggcatatgtgtttcaacatcaggaagaacattctaacaattagagctcttaacaggctgtattgtgagttatggacttcttattcatagtaggatattcttttcattgcatgtggtggaaacgtgacttgaactagcttggtaaaaagaggaaattagtggaaagatattaggaatgtctcatgtgaacaaagaaaggattgaacagccaaactgtggagagggcaggcatcccactgggccccagaaactgctagaaccagagactcaaatgcagctttccttatttctctttctttcatctctgcttctctcagagtattagctcattttccctctgcagacttactctctcatgcacattatgtgaaacatgattgctaagcatgcctgggttatacatctcccaacaatcaagagaaactctctctagcacatttagtgagaaaaaccttggaaaaattctctggtccaggttgggccaagtgcccaattctgaacaaatcaaccaaggccaaggggcaggacccctagtttggttccagtgccttctctggactgatctcgggatggaaaaaattggctcttaggagaactataattgagaaaagcagttcacagaaaaaagagggatgctttttccagaaaagaatgtggggggcaggcaatatagtaattgcatgtattcaaaggttagctcaatcagaaatattagagaaatgaatcttatgttggtgggaatttgaactggaagaacttgaagttctttccaactcagagatgatgtgattctagctgtttttcaggtaaggcaggcacatattggtttatactaggaattttctttttccacgtatttctactcaaggattactctgtttggaaactgaggaatatttattcagctgtttttgaatttgaggatagaggaaaatgttttattttctaaaaatgaatgtctggtagaagagaagtcatgtatgctttttaaaaaatggaacctgtggctttaaagtcacattaccttcaaagacagtactcttaaatctgaatgatttttttttctttttgagacgaagtctcactgtgttgcccaggctggagtgcagtggcgtgatcttggcttactgcaacctccacttcccgggttcaagcgattctcctgcctcggcctcctgagtagctgggactacaggcgcacaccaccacgcctggctaatttttgtatttttttagtagagacggagtttcaccatattggccaggctggtctcgaactcctgacctcgtgatcctcccgccttagcctcccaaagtgctgggattacaggcatgagccaccatgcctggccaaatctgaatgatttttttaagattattttggcttgttaagaaaacttttttttttaaataattatatattcatagcaaggtacaaagaaatgtacagcgaggtcatatatatccttcacccagccttccccagtgttgacatattccatggctcaagtacagtatcaaaacctggaaaccaatatgggtacaacccataaaacttatttcaccagtaatgcatgcattcatttttgtgtgtcatcatgcgtagctttgaataaccactagcatccatcaaaatgcctcactgtattatcagaagcctctcgtgccacatcctgctagccacacccaccccatctcatattccctaacctctggtaaccgtgaatctgttctccatctctgtaatcatgttatttcacaaatattacataaatgaaattatacagtatgtagccttttgtaattggctttttccacttttcttatggttcatccaagtggttatgtgtatatagaattcatttatttttattgctgagtagtattttgttgtatggatgtaccatagtttgtttaactattcacccttttaaggatatttggatagttttcagtttgggactattatgaataaagctgctctgaaccttcatgtacaaatttctatgagaaaagttttcatttctctgggatatgtatcaaagagtacaatcctgggttgtatagtaaatctatttttagttttaaaaggaactatcagactgttttccagaatggcgattccattttacatttccaccagcagtgtatgagtgatccaaaatcatttagcgttatcattaatttttaaatgccatttttgataggtgatagtaatattgtgattttaatttacatttttctaatgactaattgatgttaaacatattttcatgtgtttacttgccatctatatatcccgcttgagtgaaaggatgtctgtgtatattttttgctaattttctaattgggttatttgatttttttaatgttgaattttgggaatcctcttcgcattctagatacaagttctttgtctgatatatggtttacaaatattttctcccattctgtaaactaccttttcatcctgttaacagggtttttgcagagcaaaggttttacattttgatgaagatgattttatgttatttttatgattaatattttaaggaatgaagtatacattttgcatactttttattgatcttaagaattttaaattgccaaattacctgctctaccttctttttcagctcagacgtgttaccaatgcagatgcagttaaattttaagatgagtaaaaccattgagtacatagtgtttaagtgtagtggaatgtctgtgtgttctactctattctaatacctgcttttctctagtgttttaattaatgtagcaaaggaagatctcactttctgaggtagtttcattttgagtttcagcaagatttaataacaccggaaagaggacatgtgattctacttgtacaatggattattgtaaataaacacctcatattactaatatttttctttctacacaatcccaaccatattagacagtgcagcaacgtcccatgttgctttgtttatataaatttagcctttagcttttccttttggcagcccatttgttcattccagaaatactgcacacctaccagctttgtcaagattgtgctgggttcagggttataatggggaatagtatacacatagacataggttctgccctcatggagcttacaatttggttctcatttcttattatggtaagcttgtattgcctgtcagtatttcactgatttgattgaatatccttacttcccatcttctgtcacagaatcttcctcattcatccaaaacgcaacatgtccaaatcttagtgaatgctttcagtgctttgggagtggttacattccattaagattaaatccaagccaagcaagtaatacttacaagcatgcacaggagaatatgagatgaggagagaaatcctcatacttagttaatttcttgccaagtagagaaattttcagtagagccttaagttacctcagggatggctgaagattctaaatatgagattccaaagtccaccgttcaccatattctataaaaagagactcagccatttgaacaagctagctaatcagatgccctctgcatagttcatatttttaaaaatcttggtccttatattatttataaaaaaagtgactctatattagttttaaggtataaatgagacacttttcctatctgtaaactagctgatctatttgtagtctggcttaaaatgtgacttgcccaaacataggaaaatcttccaaaacaggatctagactgtgtaattaaaaatcaaaattagttaagaatcaaacgtctgaattgaaaatttaatttttagttaaattatttgctatccagtcatctttaatattttgttttgctgtgagcagggtcacatatgacaaattaaaggtggatcaggccgggcacagtggctcacacctgtaatcccagcactttgggaggccaaggcgggcgggtggatcacgaggtcaagagatcgagaccatcctgtccaacatggtgaaaccccatctctactaaaaatacaaaaattagctgagcatggtggcacatgcctggagtcccagctacttgggaggctgaggcaggagaatcgcttgaacccgggaggcagaggttgcagtgagctgagatcacaccactgcactgtagtgtggtgacaaatgagactccatctcaaaaaaaaaaaaaaaaaaaaaaaaaagaagtagaccagccatacttttaaaagcttattgtaacaaacacatactgcttattccatgctggtgtgttttgtgttctttgcaaatgttaactaattaaatcctgacaataaacctattaagatagatattattaacctcattttacagatgatgaaactgagacagagggagactagataacatgcccaaggtcatacagttaataagtggcagaaccagggttcaaaaccagtccagaggctatgctcttaaccactatacaatggtcccatattgtagttaatcaggtatttttccatataacacaataaaagcattgaactgggattttcctatatttgagaaaacagtatggaaataacagatggaggtatagaagtttttgataagctaggcatgttggctcatgcctgtaatcccagcactttgggaggccgaggagggtagatcacttaaggtcaggagttcgagagcagcctagccaacatggtaaaactctgcctctactaaaaatacaaaaattggcctggcgtgatggcacacgcttataatcccagctagtcgggaggctgaggcaggagaatcacatgaacccgggaggcggaggttgcagtgagccgagaccacgccactgcactcctgatagaaggaaaactggacctaaggatttgagttttgacattactagtacaagctgtgtgtaactttggggaaggctgctacattagtttcagtttcctattgctatggtaagaaattactacagatttaagttacataaaacaacccaaatttattattttatagttcttgagaattttaaaatcaaagtgttctttaatgactacaaaagctaatacactgttaacctctttccaattctattaataccatcattatctttaatagttgcatggaatccacatggaatgcaccataaatgaatcgaaatcttatgttgaacatttgtttactgtcttttgccattataaacaatattatgatgaacatccctaaatatatgcctttgaatacttgttcaattttattcattggggcaaaaaggtatgcacattttaaagaactacagtccacaggtgttcatgcaattgctgagggttttctgagaaggtgaacaagagcagtctatttcaaaactactgaagccctttttgcatgactgactggcattccctaactgggccttcttcgttgccctgacactgcctgttgctgctcctctgagaaggaatgtgtattcacagatgaggcgctccattagtcatggtgcatttcctgggccctggagacatgggcatgacatcaccaagggccaatgagaaaggattctctgtagcaagctctcaaaactctttagaggattgtagactgtgtgttctgttcctagccctcagggtgtgatttgagcttgccttgctcatccagccatagtctgggcacaaaagtctagcttacagacccaagaagccaggacaagcttgaaaatctgcagagctgcaggcagattcccatttagtattttttttttccagggctcaggttgttattcccagagttttccactcctaatgatgttgttacttcatgtggtaatgggtgggtggtgaaagatgaagtctgcattaaataaaagacatttggcagttaaaatttctgggtaagtataggttggtagcataacaaaatcagaagtacattttaccgttttgttacattgcttttgtgtgtagtttcacataataaaacaacatcttttaacagcaaaggctcctagcaaaatgagtgtggcttaaaatagggcaattaccaaagaactttactgaggggattagtaactcattaaatcttttctcttcaaggagaaaagaaacttaaaaaaaaattctcttttcttgggttttaagcattttggataaaaacttttctgtctttctctgtatctgtctctctctctgctccctaatttatgtatttatttatgaaaatgatttgtggaatttagtcagggataactttgttaattctgcacaccaggaagtctattgaaagacttatttcctaattggcccaatcttttgctaacaaggtataattgtaaaattatctttttaaaaaatagtcaaggaaattaaggctcaaaactcaatgtgagcttacactgaacagacttttatagcttaactcagtagttgaacctaagagctgtgcttttctatcttcattcaatctatgattgaatgagaatggttcttttagtattttttcatgtttaattcctttttgatgaagtcaaagagaaattgggaaaagtagccatctttattagtgtgttatctgtggatgccatatactatggaagaacctgcctctaccacttttaaaaaaatgtttctgcaagataaagatgatttttttttgtaattatagcagcttttatttttaaaaatcacttgaaaccgcatgaatttatccttatttcctaacatatataccagtaattaaaggactttcctctagaactataacatactataagacagggcacttttcaacacttcagagatcctccttcaaagatctctgtgcaattcaaaacatttattactaaaatttcaaaacatctctggagatattctaaatggttttttttttttggcttgtatagatgagaaagttgaggtacagaaagattgaaccttgtactttgtgtcagtcatagaagcagatactgcatacataaatcattcttttatcaaaactcttaagaggacagttctttgtgtctttgtataaaattgttcttgttttcctttgacagcttcaggctttgccttattaacagcagtgcttatttttcaaaaccctttgattgagacaaaaaaaaaagcaggttcatctagcctaggcagaactggaagaagccctgaaagggataaattacctaaggggtggcagtgtggggcatgggagcactcccactgcctcactcttagcagagtacttgattcttctcaatcccatcccacaatttctcccacctgaaccaatatttgccagttttctactcgagggttgccatgactcctgatgagttaatattggtaaaacactttaagcctttggaaaaaggtctcataaaagtgtacaattggcactggccctgatagtagtcacaggctttttgagtgggcactaggcaccctcagataaggttaaccagatccctgtttttggcgaggacaggctctagaatgaggtctgctgctgccatcttgagagaacacatctggtttgaaacgttgaaagccaggtgacccttgaagcagccacacagtaatgtctcctcactgcttctgcttcctgctaatttggggagcagcaggtgcctccctgagaaaccctgccagagggttggcatgccatgctgatcgtctcattaagccctaaactttttctacagaagaaaactctcaaaaggcgattccagaatatgacagagagaggtcatgacagataatcagatcagtttataaaaagttaaggatgagtcatgtcactcctaaaggagttggcatcaatttattacacaagaccaaacactgaaggaagaaaagcctttagtctcattaaggagcccagacaaaaatcccacttaatccatcttgcttttccttttcctgcaactcagctggtgtgcaggtgtagggcagcttggcagaagatttgaacgtttggaaaagggagtcattactgaaagtcactgacacacacttcccttggaatgctgctgatgtcatggaaaaccaggaccttagcaataacccctaacaaccacagctacagtaaacagtaaatgttacctccaccaaggcattggtttttaaagagttttaacaggccagggcttgccagccacaactcataaaaatgttcttataattttaccctactctctaaaagtgctggataactgctgaggtttctctgccacttgggatgcaaagccaaattcacgtcactttcaaggttcactaatcagaatttacagcatttcttttgcagtcctcttcataccccctgccatgctcacagagttaggtctggtagatttcatactttttcaaagaagtctcttgtcttactgagttgtctcaatttctggtgatggtgtgaattaatgtgccaggttttgactagtgttttattagtctagaggttaggcaaatctggttaattgatagcactcaatctataggttatattccaatcaatttgaaacaaccgggcaaagtggcattctatagttcaaactctgaactgggtattgtcaaggtgaccatataatttatcatcaaaactaggatatttttgaaagtaaaggggctctattaataattactctgagataacagcaataaaccgggactgtcgaagcaagttgagcatagggtcacccttgttactgtgccaagagtcaccatctagctgtcatttattaagtcagacattgaagaaacttgcaggaatgcagaacagtgccactcttctcatgaacattttttgttttagaaaatctagtcattctcataaaaatgttatttatgataagatgttatgagtttattagtgttagttttaaatgaattaaataaatgctttaaaattcatctattttaatttctaatatggtaaatataatcctcccaagtaaaagctctataggtcttcaataatttttatattcttaaagggaacccaagactaaaagttttgagaattgctgctttttctctgcatgggaaagaatatactactaaagcaaaatgataaattccctggcaagagagaccagcttaatcatgattgcatctgctacagcactagcaaaatgtcctgcatatagttagtattctgtaatacataaatatgagtagacaaatctcgtgtgacaacgctgaaaagttgctgtgttttctgacgtttgggtattacattaacattattatttggtttaagtctttgttttttgatattcagtatgtttggtactctttgttaatcttatttcgacacaacaatgatgatgtcatttttccttcgaaagttttatgggatagatcaaatttcctatgaaatgagtatgttagataagaaaacataaagcataataaaagtaggactcctttcttttaacctgcctaactcatgtttatcctttatctcaggtgtcatcttcttcatttggccttcctagaccttcccaggctggtctgcagcccctcccatgtgctttcaaagtaccttttatcacaagacttatgactcagggtcattccattcatatgttggtttccccagttaattttgagtgcttttatgtcagaagcatcctttaatttccttattcccagaattaaatgatgcttggtaaagctattaaagactatctgttacactgaaatgaatataaagaaggaaaaactagttaatttaacttttactagttaatgaagtgttttttttttaaatgtcatatgacatgatttctatagtactggaagaaaaaattttttagagtaaaggaaaccacagtttgaggaaagaagatagattgctttgttatgaccttacatgcagattgatttacatctacctacccctccactctcaaactccttttcagagttagactcttttaagccctttaagggttacgtatttctgagtatgtgatttctgtcaatatcagaaattatttccattggcaaaaaaagttatgaaatgatttctataatataggtttacttttgttgcaagtaacttttcattctttatgtttttctttctttcaaatgaaaatattatcttctatatttaaatttgttccttgagttagaaatataatattttaaatccatgcttaatttaatttagaagacatctccaaggcctaaaattgacttgctgttttgtaaatcaacatgacaggataaacagaggccatagtttatttgggaagcagcatgatcgtcatgatttaataatagtgataattatatgtaataagtaaaagtaggaatctaagttttatgaagatggtttttaatgccatgtgttttgcttggttttagtttgggtcttttctctgagtgctgttctgtgcctccacatttgtttctctttttggagaccacacattttggataattacttaccaaacttatatgcaaattattgatgagagtcagaacacatcacagtttttatcaagtctccactaaaaaaggggttgggggcttgcagtgagctgagatggcaccactgcactccagcctgggcgacagagcaagactctgtctcaaggaaaaaaaaaaggcgcggagggcgagggggtggggggggagttattatgctgtctgagatggagtcctaaaggaacactgtgatttctgtggacaggtgactggctggatggggatgagagagctgggtacttgtcccaactttgccactttctaagttttggtgtgtttttagcatgtcaccttacttctcttagctgctattagtgtccccatctgtaaaatcagtctgatcaggctgggttagatgatctccaaggtcttttacaaatcatctaattctatagcttgtgtagtcttctgtcaggatttcttgttcttgaagtccctagttgacagataatggtgtggaaggaaatgatacatggcagagtcctgaatgaccaaaatggactttgtccacacttatgtgctaatctccaaagaagaagaaaatacaaatgggccagcggccaaacatgaaaatggtgacagtgagcaaaacattgaagcagacagctgaaagcttcatttcctggcccggctgccatgagaaatgctgtgcttgccaaacccttcaggctgtcaaggccagaactttggctagctcttattttgagctccccccataccacacacacaaaccacacaggaaaattgtctctctccctttatatttgtgccttttggctacacttctatttatgccaagtccttgcctaatctccttccttccagctgtcactatactctgcctgttgctttctgggggctttgaaaagcagctgcaaccttcagaggaagcgcagggtggttggcattggtggaagggtattgtaagtgtgtgtggactctatcagaaccaaccgtcacttttacctggtttatggacagtccaaacagtgttctcactctctttccttggcaaatgttagaactgatggctttatttttttctccctcccttcatcttcagggattttttttttctcttctacattactcagcctttttgtctgtgaacatcctgtggaagatttcatttatcttaggttctttggccaggctgctcatcatcttttttttccacataaaacatatttacctaatgagagaacttaagatggataaccagagcctctgtactctctcacaagcctagaaatttgacactttctcaattctgacagttcatcccaaaccattggcctcctaaggcccagagagctcttggtcatttgctgtctgtctagccccagctgttggagaactagcttaggtgtactttcacccctggcctgtgttgtttccccacagagcttgtctgcatatgtctcatattggctcttagtgagggcggctgagcaaagaggcacttggttgtcatcattttagaaaatcaaggaagaatctcaggaagcctgattgaagaatcttggctcaatataggggaacaccatgtactatgaaggttttaagttattgcgcttgcacagactgactttgtggccttaatatggaaagcaaaacaagattaaaatctcacacagtcattgtcttttgtagtagagcattgtcttttgttgatgagtagagctttttgagatacaatgagttgttctctgctgctctttctggaaacttcgttaactatcttgccctatacctggcagtgccaacccacatttctgtttatataaaaggaactccatatcctcttcagaagctagtaaacaaaaaaacctcaaagcatatctgtattggggtttgtctatgttttctcatgtctgtattttgtgttttatttaaaataattaaaatgttaattgattttaacttcaaacagatgaatttgtttgctaaaattctttttttgatgggatcttgtttacctttttgtatactatataaagtcttttttattcatattgggaagataacactacaaagccatttttttccatttctgcctgtataatttcctcaatctttgacttgcttggctatattgtttcaaatacccagttaacctttttattactcatttccttattacatgcttttgcattgtctacaattcatagaatcagtatggtaaaacattagagctggaaaagccattaaatattaactatccaaactccctattttatattaatagatgagaaaaagcctgcagaaggaacatgattagaccaaggtcacacacatgccacagccaggctgacaagtcttctgacccattgtctagtggttttccattataacacctgtgctccatgtgtcaggaattttccaaagcactagtgagaactccatcagagactgcatcctactggaaagggcacaggctttggagctggatagatctgggtttgaatatcttgttctgccacctacgggcggggtacattaggcaaggaaccaaagcttttggggacttgttttttcctctgttatatggcaaaagtaacaagaatactttatggttattgtgggtattaaattatataacctacattaaagtacctgttacacatattatgtttaataagttattataaaaatctgctgttcacagaaaaatgtgatatgtgtaaataataacttaaaataggtatttcattattgggtattctgagcctctcttgttcagtagtattttcttgaagtcagtattaatatgtgaattgagtgaattgtctggaaatgaattactgaaagttatttatatcttgattgtgattcatacatttcccttttctttatggctttcctctgtacttagctgcagtgcatctgcatcctatccaagaacttttgtacaagttgaactcacccaaagaagacatttggagagtacttgggtttggcccctgcttttcatctggctaaacactattagataaatctagaatatatagtctatgtagaatattatgtttacatttttagaaactttggatttttagtgtttttctgaaacttactgaactatgtgatgaacagcttcagtgtgaaattatacgtacttggtctgagtataggtagaagttatgttcaatataaaggggcccaggactgttgttaaaaggaataaggactacattatttaactagtagtgtggggaggtggaatgagttaggaaacaaaagctaagatggatttagcaaaggccagagcaagaaaagaaagtttaggctgggcgtggtggcacatgcctataatcctagcgctttgggaggccttggtgggcggaatgcctgagctcaggagtttgagaccagcttgggcaacgtggtgaaaccccatctctactaaaaatacaaaaaattagtggatatgatgacgtgcacctgtagtcccagctactcaggaggctgaggcaggagaattgctcgaaccaagatggcgccactgcactccagcctgggcaacagactgagactctgtttcccccccacggccccctcccccacaaaaaagtttagaatcgtcgcaggaggtgactcaggggaatttcatttaagggcctctcaaattgcttgggtgttgttggcttactggaatgccttgagtttgaattagagggaaggaccttaaggaactagacagaattttgcttctctattagaggaccctggcttaggttttaaacggaagttaagtgcaattagaaagaggcactatgtacctaacacgtagtggatccttcatatgaaaccattaattgtcaggggactttgaggctcatataatttggcccataattatggctacataagtaaaagctgtgaacactcttagggttttttttaaattgttttttcagtaaaggtgaaagtatagcagtgttgggagggggtgttccttgtgcctatttgtacacaatgtcttagattagattaagagccttaggccaatgattgcttaaagataaaaagcaggcatgattctggagggatattggataatcaaatatgaccaggaaatagaaggtcctattttgctgtattttgggttcatccagatgggatcagaccagaggaatttggcaagcattgagactcgccacttagaaccacactgaaatagttgtggtggcaaaagaatttctccgggagtcttattccacttgaggcataacagccagagattcctggcctttgaggggagagtgccaaagttgatgtattttaaaaacatcaactgagatctataaacctacgagaaatagttgaattggatgacactgggactatgtgtttctgtacttttcttacagaagacatactatgaatacatgtgtcctggaatctacttttaaaaattagttctatgctcatatcctcacattgagatttaatgtatttcagtttaataaatgagaacatataaaataatttacctgtaaggacctgtctatgggaacttctatattctgcttgaaattctgacacattaacctggccatttccaaaaactttctggcaagagctcttcatggacctaataattgctttactgtttaatcattccctgagcctttttatactctagtaaactgcatctgtcactagatttcatcaccatctgtattatttatcccttgtaatctgatatctatctctataatgcccaattgtatccccttcaagtgcccacttcattggcttatatacattaggttttcaataaatatttttatataatggtaaatgaagaagttgttctttatattttaaacaactcttacggaaggagattacaacacagctggaaggaattattgtgagagtgaaacatggaaccaaaaaagataaagcaagggaaattaaaaaaaaaaaaagagctttattgagttataactgacatccaataaacagcacatatttagtccaatttgatgttttaacatatttacatacccattagatcatcaccacactcaagataattaacatgtcttttatccttaaatgtttctacatgacctttgcaatccatgtctcttacccttccttaccttaccctcataagcaaaacactgatctgtttttgtcacaatagattatattacattttctagagttccttattaatggatcatacagtataaactcattttggtcttgcttttttactccaatttattttgagattcatccatgttgttgcatgtatcagtacttcattactttttcctgcaaagtagttttccactgtatgtatatactacatttgcttatccattcatctgttgatggatattttgggttctttctagtttatggctattacaaataaatctactatgaacatttgactacaaatttttgaaaagaggtatgctttcttttttattgggcaaatacctaggagtggaatcactagattataggattgctgtatgttcagctttgtaagaaactgccaaactgtctgtaccattttgctttctcaccagcaatgaatgagagttcctgttgcttcacatccttgccagcatttggcgatgtcattgctttggattttagtcattctgatacagatgttccccaacttacaatggtttgacttacacttttttgatttttcaatggtgtgaaagcaatatgcatgcagtagaaactatactttaaattttgaatgttgatcttttcctgggctagtgatatgtgttacgatactctctcgtgatactgtgcagtaacagtaagccccaagtcccagtcagccatgtggtcaaagggtaaacaatcagtactgtgcagtgtactcttcaataaattgtatgagttatttggcactttattataacataggctttgcattagatgattttgtccaactgtaggctaatggaagtgttctgagcatgtttaagataggctaagccaagtaagatatgatgttctgtaggttaggtatattacatttatttttgacttatgagttttcaatttacaaagaacttattgagtcataaccccactgtaagttgaggaggatctgcaggtgtgtagtggtatctgtgttacttctttgaagaagtgtctgttcagatcttttactcatttttaaaatcagattgtttgttttcttattgctgttttaagagtcctgtggatgcaagtcctttatcagataggtgttttgtaaaaattttctcccaatatttggtttgtctattcattatcttaacagtgtctttgtcagagcagaagcttttaattttaatgaagcctaacatcaatttttttttcatggattgtgctttaagtgttatattcaaactcattgccaagcccaagatcacctagatttttttctatgttatcgtctggaatttttatagtttgcattgtatatttacttctatgatccactttgagttaatctttctgaaaggtgtaaggtcagtgtttagactgatgtgaatgactatttggtccagcatcgtttgttgaaaagactatccttctgcattgaattgactttgcttctttgtcaaggttcatttaactatatttatgtgagtctgtttctgggctctattttgttctatttatctagttatctatattttcaccaatatcacattgtcttgattactgtagctttgtgaatgtatgcatgtattcatttaagagatgaggtcccactatgtggctcaggatggagtgcagtggctattcatgggcttgatcccacttctgatcagcatgggagttttggagtgctccagttccaatctaggccagtttattcctctttaggcaacctggttggttccctgctttcagcatattgatgctgaactaaatgtggacatccaattggcatagcacacaacagcccagaactcctgtactcaagcagtctttctgctttagcctcccaatagctgggactacaagtgcatgccaccatgcctgtcagattactgtagctttatagtaagtcttgaagttgaagactttttttttttttgagacagagtttcactcttgttatccatgctggagtgcaatggtgcaatctcagctcactgcaacctccacctcccaggttcaagcaattctcctgcctcagcctcccaagtagttgggattacaggtatgcgccaccacgcccagctaattttgtatttttaacaagagacagggtttcaccatgttggtcaggctagtctcaaactcctgactcaggtgatccacccaccttggcctcacaaagtgttgggattactggcatcagccaccgtgcccagcctgaagacttttatttctccaactttgtttttctttgtcagtattatgttggctattagtttgtttcctttctagataaactttagaatttgtccatatccataaagtaacttgtttggattttgattgagattgcaccaaatttatggattaagttgggaagaactgacttcttaacaatattgagtcttcttatccatgaacatagaatatttctccacttatttagatcttctttgatttctttcatgaaagttttataattttcttacataggtcttgtacatattttgtttggtttatacctaagtatttcccttttgttgatgctagtctaaatggtattgtgtttttaatttcaaattccaattgctcattgctagtatataactaagcaattgacttatgtacattaaccttatatcttatttgtttttggatttgtgtttttatgattccatttacctctactattgttctattagctgtaactccttgtgtagttattttagtgatggccataggatttgacagtatatatctttaacttatcacagtctatcttgaagtgatattataccactttacatacagtataagaaccttacgatagtcttaaagtagttgtcatacattttacttacacataaatatactttagttataaatcccacactgagttttattttagtcaattatctgtaaaatatattttgataataagaaaataaatttaataaatatatattacccagtggttaccatttcctgtgatctttcctttgtatagactgatttactgaatgagatttacctgaagaattttctctatcaggtcttgtggtgtaggtctccttgtgatgaattattttagcttttgtttatctgagaggtctttattttacctttgtttttgaaagatatctttgttgggtatagaattctagattgatagatttttttcttttagctttttgtagttattgctttattgtattttgacttttattgtttctgactagaaactgtgcttatccttatctttgttcctctgcatatatatataatttttttaatcttgttgtttttgagattttcttttctcttcgattttgagaaattgattgtgatgtgcctttgtgtccttttctttgctttttatgcttggggttttcttgagctttttttgatatgtttgtttagcattttcatcaaatttggaaaaatcttggccactatgttttcaaatatttttcttctctctctaccttctcatctttggggtctcttactacacatatataaagctaactgaaattgtcccacagctcactaatgtcccacagctccattcatttttcttggttttttgtgtgtgtgtgtgtgtgtttcagtttgcatagtttctattgttatgccttcaagttctctaatcatctcttttgcaatgtttaatctaccattaattctatccagtgtatttgtcacctcagacattgtagtgtttaccactagaaatttgatttgggtatttttagtatttctattgacttttcaaacatggactatagttataaagactttttttttttttttttttttttttttttttttttttgagatggagtttcactcttgttgcccaggctggagtgcaatggcatgatcttggctcaccacaacctccgcctcctgggttcaagtgattctcctgccccagcctcctgagtagctgggattacaggcatgcgccaccatgcctggctaattttttgtatttttactagagacggggtttctccatttggtcaggctggtttcgaactccagacctcaggtgatctgcccaccttggcctcccaaagtgctgggattgcaggcgtgaaccaccatgcccagccataaagactattttaatgttctcgtgttatgtagctttgaaatgattccagacacataatttgctgcatgaatgataaaagttttgctgtggtaagaacacagagtgtaatcttcctccccatggaaatgttatatcacaccttatcagaccacatatatgaactcatatatgtcctcaactactggactctaaaacacatataaacccaagattttgacagatacgttgagaatgtaggctgtggcagggctactctctgttagcctttgagttattcttttgagcctggccagccaacatcagcaccacttgctagtgttgagggacttttcatgttgttgtggatccccattgtgttggtcaaatcatcactccctagaatctcttgtaaaaagatacgcctcagatgttgttttttgtttgtttttgcttttttaacttaacaaattggtaattgttttaacttttttattaggttcaggggtacatgtgcagttttgttatatagggaaattcgtatcacagggttggttgtacagattatttcattacctaggtactaagcttagtacccaatcttttttttttttttagctcctccctcctcccactctcttccttcaagtaggctccagtgtctgttgttctcctctttgtgtccatcagttttcatcatttagctcctactgataagtgagaacatgtgatttgattttctttttctgtgttagttcactaaggataatggcctccagctccatccatggtcccacaaaagacatgatttcattcctttttatggctgtgtagtattccatagtgtatatatatcacattttctttttccagtctgccatttatgggcatttaggttgattccatgtccttgctattatgaatagtgctgcaatgaacatacatgtgctatgtctttatggtagaatgatttatattcctttgggtatatacccagtagtagtattgctgggtcaatatctttaagtgttactgtgccactttacgtatagtataagaaccttaacaatagtcttacagtacttgtcatacatttaaatatacattagttataaatcccacactcgattttgttttagtcaattatctgtaaaatatattttgataataagaaataaatataataaataaatttgaattatccagtggttatcctttccagtgatctttcctttgtacacattgatttactgaatggtagtgctatttttagctctttgaggaattttcacactgctttccacaatggttgaactaatttgcattcccaccagcagtgtataagtgtttcctgttctcctcaacctctctagcatctgttagtttttgactttataataatagccattctgacttgtgtgagatattatctcattgtggttttgatttgcatttctctaatgatcagtgatattgagcttttttcatatgctcgttggccatatatatgtctttttttgaaaagtgtctattcatgtcctttttaatggggttgtttttttcttgtaaattcatttacatttcttatatatgccggatattagacatttgtcagatgcatagttttatgcctcaaactttgactagactttgtattcatggcggcctacttccaccctaattgggcaaatagactttaataattagactctaaatgaaatggaaactcacacactatgaggttagtgtatctcatttattgagtgtattccctaagagatttgttctcattattctccacctgtttaagcattgtgggggagaaaagaatctctttgtcaataagccatgtgattcatgagtcgtattttaatcgtcttcttattttaactatacaaagcaccttgtctgctaactctagtatctgtgtcagttctgagttaatttcaattggttgatttttctcctcactgtgagttgtattttcttgcttgttttgcatgcctggttatctttgattagataccagacattgtgaatttcacctttttgggtgcaagatatttgtattcctataaattttaaactttgttttgggatgcagttaagttacttggaaacacatccttttggatcttgctttcaggatttgttttggcagaactatttaatttaaagctaatcattccccaccatcaaggcaagacccgtctgagtattctatccaatgcttcatgcattatgaagttttccattcttattcgtaaaaataggcattattcttggtcctgtatgagtgccaggcactctaccctctactcctctcagagcattctttctctagcctcaggcagtttccttacatgcatgcactaatcagtactctgatgaatatttgagggagactctctaagatctcttctgtgaactttagctgtcttcttttctctgaattttcagctccttctcctcacttcagggagcctgttggattccacctgtgttccctcttcatgcaacacaacctagaaattctcttaaggtaatggcctgaggaaattgtagaactttccttttttttttttttccctcatctcttaccagatgtccagtgtcttgaaaagacattgttctgtttgttttgtttcttgaaaagtattgttggttgttttaggtggtagggtaaatctggtccctgttacttaatctttgtcaaaagcaaaagtgctcagagatcttcctttaagttttcattggtagttctagaaatgaccaatcacaaaacagggaatctctaactgaaagatccatgacatttcattatagagagttaggaaagagaattaatctgagaattaccattatctagtcttcctcccactcatattcttcataaacatttgcataacacaattttttgtaccattgttgaccatatcaatgggtagattactgaattttggggggaaagacatgtacaagctactagaatggtaagttttgttgaacatgttatataaaaggaaattacgcaaggggagctgggttggtatcatagtatagtattatatttcttttttttttttttgaggtggagtctcgctctattgcccaggctggagtgcagtggcgtgatctcagctcactgcaagctccgcctcccgggttcacgccattctcctgcctcagcctcccaagtagctgggactacaggtgcccgccaccatgcccagctaattttttgtattttttagtagagacggggtttcaccatgttggccaggatggtctcgatctcttgatctcatgatccacccgcctcggcctcccaaagtgctgagattacaggcatgagccaccgcgcccggcctatatttctttatagaggtaaaataggtgtgagatttttgtttttacttattttgctttgttatttgggcttcactggggaaccaagtgatttttggcaagagaagaagcacaaaaaatacagaaaagcctcttcttatggttcctataatggcaaccaagtcaataaatggttgcaaaattcaactagattgcgatagggtagttactgctactgctttatccttttataaatagtcagtttgaaaagtagaaaagttcatgggtaaagagcagtagctagaatgcaaatgtgaatccaggatgcaatatacaaaggtttttgcagttttcagcaagtgtgaagaatttctgattgatgaggccctcagagcagaaagagaccctcctctgtctatgtgtaagattagtaacacatagagacgtggtgttcatctgcccagtttatgtggctaattagcatttagagtttcttcaatagaagctagtgaagtaagaactagataatatcttggaagatctttttgtttcttctgtcttgcactttgaagaggggctcagactgttgaattggaatagaacaattaaacagactgtaaaatgaagtcctgacatgctggttgctttgcctgctctgtcagagcagcactggttccagggagagagaatactagttttgtttatttgtttgtttccagacaatttgctatgtcatcactttttttgtgtgtgcatgcgccaagtgtttgaggttgataatgttgacagagtccttgcagaatggaagttcatctccacagggaaaggctttgtatttcaagttttaaaattccaaaatattttgctataacattgttattcctagttttttatgcctttttgtgtggaaggttggtttctcctttatctacttaccagcttttaggggaatccctttttaagtcaagaaagcaccttagaaaatttctctctctctctctctctctctctctctctctctctctctgcctttatgaaactgacagtagcatatcttgctattcttgggtcttagtttggaattaagctgtgcatgcagtatgcccagaaggctcagtttttaaaaaatttctatgtttattcgtatttaacttcattctaatggggtcatgtacactgtgatatttattcatgaaatatttaggaaaagataaaatgtttgaactataatgaattatgattttattatccttttattaatgataatacacccaatgctattcttgaaagtttgaaaatggaaaccttggtaaattttttttcttttggcagaattttgaacttttttacataaaagtgtaaacctttgtttggtattatgggtcacctggttccatagcatctctttgatttaaagaggatatcatccatttaaaaaggactcacagccaggcatggtgcctcatgcctataatcctagcattttgggaggctgaagtaggcagatgcttgagctcaggagttcgagaccagcctgggcaacatggtgaaacgctgtctctacaaaaaatacaaaaattagccaggtgtggtggcatgcacctgtggtccaagctacctgggagactgaggtgggaagactgcttgagcctgggtggttgagtcagcagtgaaccatgattacaccactgcactccagcctagttgacagagcaagagcctatctcaaaaacaaaataagcaaaagggacttactttggggatttggagaactagaaaatattattattcatattaacttacacccataaaagagtgctattaaaagttcacttaatacaagggcttctttttctttgctttggatttaaacaggttttctataagctaatcaacagagatttgattaacatacttaagcatgttatatgaaagggatggcattgtgaaagatggggatactatatagaagtaataaaataaaaggtatggaattaggtagtgtaagaatttcagaactaaaatagtctgagaagtcatttggaacatggatttcttttgacagaaaacttctgtcctgcagtatatcagccttgtccagcagagctggttagtgcagatagaagaacctaggttgcttaactaccagttcactgtcctttctattatattgtaattctgttttctgtcttatttcagaagcagcaatccagatgagctctacatcctgaataaaaacaataataatggcaataacaaactattatttttttaagaaatatgacttaaacctatttgtttttatttatttggtttgtttgtttatttatatgtagtttgtcagaaaaccataggagtcaggcattgggtagctcgtggccattagtattattttcaaagtcagaaatcattggagaagaatccccttctaatataaatttttaaactattcatctgagtgtttaggaagctgtgatctctgctgtgataatcctagaagacattgctcaagccacagctggctattattgagactatggaaagagaaagagcttttgccctgatttatcccataaaatgaataataggccacattcagggagacctagcttgtggcagactattctcaccacacccttcacacagcctttttttttcttctcccatcccaagccaccatcccaacctgccttgactaaactcaatgaacaggaaccattgtatgaatcggaaggaaaatgtcttaaatatatgaagttataatgagttggtaagtgctgtaaaaatactctgtaacttagttggaagttgcatcatccatgcctgtggcactatggactggacccaaatggtataattcttcagtgtaacactgaagtaatttttgcatctgccaagtaaatggtttagatttcaaacctatgaaatgccgaactgtaattgttcaattctagtgaaccacagatgtgtttaatttccttcctttactttttgctgtcttctttaggtaagctgaaccaactaaagagtggccttatgtgaatctacaaagtgaactttaacgtcagtcagttaatatactttaacacctaaatgttgtataacactgctctatatagcacttttaaatgtataaaatttttgatagaggataagtccatttcatttagggaaaacagttgtttcaaccacatgtattataataggagtaaaagtggcatatcgtaatgaaagaacacgggaagtcagaaaacctggatttatttttgcctctcctgtcgattcttcatttgatccggcctgaataatttccttttcctttaatttctatatctgctgaaggtgaataataatactttcattggccacatagaggtgctgggagaatgaaagataaattctcccaaagcactttgaactgcctagaagaaagacttatttaaacaaaagttgattctgttttctatctttttatttcttacaagcagacaccaaagtaagtgttagaagagcctcaaagatttggttattttttttttgcaacttttattgtaggtgagaaggttaatataattgccttcattgtataaacagggaaactaatgctcccaaaaggtttgttttggggcttaaaatgagtagccctttatgagaataggggaaattgatgggggtgtagatgtaataacatcagccatgagttgacaattattaaagctggtaatgggtgtgtctgtttaggggggttatcatgaatactatcatgtctaccttgtctttgaaattttgtattaaaaagttaaaatttaaaaaattgattaaaaaaatagctcattttcatttgcaaggttcttttaaaaatgctattgaggctggtcacggtggctcacgcctgtaatcccagcactttgggaggctgcggtgggcggatcatgaggtcaggagttcgagacaagcctgaccaacatggtgaaaccctgtctctactaaaaatacaaaaattagccagccacgatggcgtgtgcctgtaatcccagctactcgggaggctgaggcagaagaatcacttgaacctgggaggtggaggttgcagtgagctgagatcgcaccactgtgctccagcctgggtgacagagcaaaactccatctcaaaaaaaaaaaaaaaagacaaagtatatgcttggaccctgaacacagacattttagtttttcatactcagtttttacattctatttccaatgctttctaaccatttactacttttaacatattatgccatttctttagcgttaatatattacacttttttcttactcccgttccagatgtttgtcatgtgctttgttgtcaattttagattttcattttcctatttttgggaattataagcagtcacttattaacccaattactttatgcttcaatgggcttgtcattgggtagccatgtgaattatttcaatttttagagacacagatcaacctgctaccctatacccacaacagaaaactgccgacttccccattgtaggaacttacaatcaaacggcatttgaaacatgtgagaacactcctattattaaaaaaaaaaatcaccctcaacctgggttattttcactgacagacttcatggttaaagcttgctatttcatgagctcccagatgacgcaaatgctgggaaatgtaacatactcactgtgatttgtttttagacatcaaaagaaatccattttacaaaggaatcatataactttagagctaagaaagatcttaataatcatctggtatagatctttccatttatttatgccagaacctaaaattagaaaggccaggtaatttgctcagtgttacataccttagtatggcagagctggaacttgaacctgagttccctagctttcaattcagagttcttaataggttgccactcaagtgcagtcaggtctttgatgctatttgtgaacaccaaatatgtctctgcttcttacaacttagaaatcttactctgttttgcaatgccctgccaagtcatattggagcctgaggcaaaatgaaagaccaatgacactgatcctgtctttatttaaaattctgatattttcttcactatggatttgtgggattaattttgattttttaaaatattgcattaaatattatatcttgactactgagttttttagtagctcctaaaattttgcatttgaagtgggtgccttgcttgattcaccctagtcccaatcctattatttttgctttaatctactaaatccctttttcagccttctggcaataaaataaaatcaacctatggaacctttataagcaaacccatactattggccacttacaaacaatggtggcaaacaaaccagaatctgcaagtgcttttcattggcttgattgttggtaacattgcatggtaattacatagtcatttttggctccatgaattgaaactctcttggaatgtctagcagtttattgaaaagagctcaaagccaagacgtgagttcttttgtttgatccttcacagtattgtgttttaggctcttatatcgttgtgtttgttttgatttctataaattgggactcaagggaaggaagctctttataggcctattattttcattttacttggtcctctcaacacctgtttgagataggcactttataggctaaaaccaactcacactgacttaagttaaaagagaattcactagctaacacaattgaaaaatctaaggagtagatctgacttcaggtattacacatcattttgtcagggctttctctctcgtgttttctactgggttggctttattattattcaggtttttcctgtgtagtagcaccaggtgtatactctactagcttagcaaccttagtagaaagggaatgaatctttcctgattgcttgagccagagtctcagaattgagtataattggcccagcataggtcacatgcacatccctgcactaggcattaaggcctggcgaatgcaattaaatcactggctgaacctggttcatgtgttcaaccctgggtcagggactggattgagagtagaagagatctgtttcctctaaaggaagagacgactttttaagtcttttccccccaaaagggattctggacagggaaagacaaatgtcaactaaaatgttactattctcacttcatttatgaggaagttgaggattaattaagtgaattttcacgaggctgcatagctaatgagtgataggatcttaactttgacccaaatctgcctaaatctaaagcccatctcttttctccacaccttgtatccctagaacatcatgcttcttcctccttctccttaatgtgaaaccatgatggttgccatcactttacagcagtattcttcaaaaaggagggattttgcccccagaggaaatttggtaatttctggagacatttttttattgtcacaactgtgcacagaggtgagtgtggtgctactgtatagaggctaggatgcctatacctcctgtagtgcacagaacaattcctcacaacaaagaattacccagcctaaaatgtcagtagtggtaaggttaagaaaccctgctttttaggttcaatttctcggctgttactattaacatcagttttgagagaaataagtaatagagagcaggattgaaataattcatacatgtaggtataattaagttgtctcttaattcagggaaacttcctttaatttccatagaagctaactttagaatattgaattatcttggttagtgagtaaattgcaatagaacgtaaattcctttttaaaatatttgttttatgcaagtttaagctaacttcccagacataatttttcattctaaaataagtcctataatttttttcttaaaatagaaatctagggatattttaaattgaatactgaatgcttttaaaggaaatatataagtttatctcaaaagccttttaatatttcatatagaagtttctataccaggggaaataattattttttaaaatccgagctgccgggcgtagtggctcacgccagtaatactagcactttgggaggcggaggcaggcgaatcatgaggtcaggagatcgagaccatcctagctaacacggtgaaaccccgtcttgactaaaaatacaaaaaattagccgggtgtggtggcgggcgcctgtagtcccagctactcgggaggctgaggcaggagaatggtgtgaacccaggaggcagaggttgcagtgagccaagattgtgccactgcactccagcctggatgacagagcgagaatccgtctcaaaaaacaaaacaaaacaaaacaaacaaacaaacaaaactgagccaaagcatttctaaaactttggatgataataagggatttaatgtactaaaaagcatacagaaattttcttcctgtaagcatgtgctttgtgaaagaataatgaaagcagaagaatgcgttaaatgtattatagctgcagttattgggtttgacacttcagagaaatcaaccttcttgttaaatgacatgaaaatagtttatactgtctgactccttgagacttgcaagtcgtttctgaattgtgcatatctgaatgaatccagggaaagctgtgcttctgtagtcaaaccacagataatattctagtagaagagctgaatgagtagagtgatactacagatggatttcatataagaaatcttttacaatccagcaagtcaaatttattgttggagtcggaagatttgaggcttagcattttctcgttttgccagttttatacaaataattcttcttgttttccaaattctcatgactgtatgcagcatggaattacaagtccattcctttctctggttctttttaaccttatcagacccaacccagatcaatgaacattcctctgatttcaactgaataattctgacttgctttgatatctcacatggatgactttcttcccatctctcctatcccccgatggtccttcagctcatgcctgtcgtgcccatttttttggcctcacttctttacctaatctcaggaatactcattgctttttctatttcttctatttttctttggcctctctttccgctcccatattaaatttcctccttggctataacgcctgccttcttctgtttcccaagtcctatttactggctctgtatccttagactcacttgtttcttaattcatatcctcatctactaaggtgcctaatggccacccacctagcatattttagtaaggcatgtgtgtacagacaggtcacctattcattgttaatagaattcaatttgcagtttccctggaaataaggcagtttctgatcttcaaatcacccaagttcttactcgttagaatgcaagttcctttgtcacattaggaaggacagtaatatttatttatgaaaaagttgaaaaaatactgtaataaatggtgctgggttaattaatatattattaatatggtcctatttttcttgagaagaaatgttcttgaagatttgaaatttcttatctgtttacaaacattttcctggtgccatcagcagtttattcctctttactgctttgtgatagggcttggtattcccaattttacagagcagagatgacaggtcacttgactaaacaagtgacttatttagaatttcacaggaaagtaattacagagcccttaaatttcctgtctcttacttctatgatataaaacaatttactttgcattccttatttatataaatgccttagagcatttcctttcctttaataaaatcatgaagactatcacctggtaatgaaattgttaggatggaagagaaatgaactaggcacagtgtacgtgaatttgattattgccttttcaactgtctaataatgggagctgtgggctcataggctctccttttgaattgtgaaaactatacttattttatactacattggtgaagttccctgaagtccttaaaaaacaaacaagatttaaagtgcaaaatgttattgttaagttaaaatgacccttgtgtgtttgcaaagctccgcgggctttctggggctagtgatccccttggtgagcattgtggagtgtggtgggaaccagccatgttttggtgatttcttttagatttctaaaactgtttttctgttgggttgaagtgggaaaacagctttggaactgcttttggtgttgctctgagtgtgtttgggagtgcattccaatagtttgtgaggggatgttagctgttcaggaaaaataacccttaccaaaggtaatggttcccactagcattttcagtaacatgtaccagatgtgggtagttaattattctcagatctgataaatacctgccagccaagcctaattttattttcagtaaacagtggccaaaggtcctagctgttcatttgataggatgggcctgtttgcacttatctattaataaaagcacaacactcctttagttttcctttcccagggccagataaaacattttagacactcacgtatttgtcttagtaaatcagacaaagtaaacaaatctggtagattaacttggtaaatagagtgtggttaagtgttacctttggagttgaactcagtgccatataaatagcattaatcgcatggtattttcaataatctttatggagtaaaacggagggttgtttttttctttcaaccaacagggacttaagtatatttcttaagtactttcagatgttcttctgtatggagattttaaaatcactttaaaatgaaatttattcttttgtcccattagtaacttgttgggaactttgtactagttaacattatgtttaaaaacctggaaacctctatagttcatctcagaagaaaaataggactacatagtggcatgcaagctttgccagacagagataatggccatctagaggttactgatttgggtggaacagtgaaaatggggccgcttttatggggaagacagtggctggtaggcagaaattcactttattcatatgcattttttttcctcttgggtaaagagttttattagggtcagaagtactatttatttttgtgaggtaaattcttgtcttgtgagaactggcatgaaacagactcattatttcacactagccaacaaaacagtattttatcaaagtaacttctagtcagtccaagactggactggatttgtactggtaacctggtggtgcagggctctaagtctcatgccagctcttgtctccctcattaaacttccttttttagtaatgattaaaaacaactctctttactacaatatattttctcattggctttatactcgaagttgcaagtactttataaaattatttttagttttgcatgctgtataataatccatctaatttggtaagcatagtacataaaagaaatagctgaaaggctttagagaaagttccctactcatacctccccctttacaatgatctcggcattaatatcttatgctgtaagagggtggcctggcacagtaccatgaatattgtgcccgatacccagtggtaacctaccaatgattgttatgaaaatgatggtgatgatagtataggggagagagtgtaaaccaaaagttgagatctgtattctgttttcagcttcattttaatggcctactggaagaccaggtacattatttctgctcttttttttttttttttttagtttctccagctatacatgaagaaaaaagtcctagtccactagccaacctgacaggcatgttgtgaaaactaatgaaagtataaagttctcatagtccgaagcataaaaggtgctgtaaccaataggtacaaaatactaattattatttttacagttcagcatagtaaatctttggagtaaatttttttcattatatttactagtctttcctttaagaattatttgccaaatttaactctttttctcttttaattagacccagagtatagtaaaaaaattgatggtttggctttcagaaagagttattttgttatctgtaccaaattttcaattaaatatttttagctgtgaatcaagtttcatcttcaaaagtgtcttcaattttaaataatttgagaatacttacctggttagtaggctaaactaacgtagtagggaagagagtgtaagaaaagtgctgttgaattcatcattcccattagcaccagtctgcggattcccaaacatgtatttctaggctcagatatttttcctgatccccagacttattaatccaggaactagtcaacttctttacctggatgccctgtaatgatttgtagcacaacatacataaaacttaatattctgttcctgaatttgctctctctgtgaatggaatatctatccaccccatctctcaagctgaaaaaccctcaccccatttcctcaacatctgtagatttaactgtcttaatactttatgccccttatctccatcccacaattactaccttaattcggcttttgctcttctgtcaccgggcagctgcaattgtcttcctgccaccagtctggtctcattacagtctactctcgataccatttccagattaacctttacaaaatgcaaatcatagaatattactgtctcattttaaaaatatttagtggtttcttgtgtgctataagacaaagtttacactctttatattggttattgaaatcttaataatctttaccttgtttctagtcttgaatcctcttatgacctctgttctagtcacactgaaagtttgtgggttccaaaacatgccatgttgttggacattctacattctctccacccacttctttaattgccaacactgttttatattttaaaacctaattccagtgtgaagtcttttgtaactccctccttgtatcccatcataccctgtatatacttcttacatagttcctataaaacctatagcacgtattttgtgtatatccttcccttcctgctttattgtatgagagattatgtcttgtttatttttgcctttcaacgtccagctcagtggttggtacagaggtagcacttggtagattgattagatagtgggtggagtaaaattctatgaccatattttcctcctcaagttctactcccttttcagtgttgcatggaaatggctttttaaagtactcagattaagatttgatgggtagacgaggtctttacttaattggtatgattgatgggacaacaggaatactcctgtaaccactatacctacccaaagatttcatagacagtctgacatttccccatgaaaagtcatttattagagttctgatattctacttattatactccctgccctctttagcactttataggtacaaagtcctcccataaacattatcttatttaatttttaaaacaagcttatgagatggattttattgtatatactttaactttatctctaaagcatatacaatataatttgcacccttaggcagatctgtgaattgctttgaagaataactcgctattctttttcgtgatttggactactctgatagtgacactgttttgctaagctgtgagagtttggaagtgtctcccataattttgacactagattttattgggtacagcacaaatatcactccttggggtgggccacatagtcacggacccacagatactcagataggaagaggctctaaaggacattttctctttatatatggaattgtatgaaatttaatagaaatggatctctagaattttactccttttaatcaggacagtagtacaaagcaaaacttttgtacactgcctagcatggtgctcagttctgcaaacgtcttttatgtctttgatagtgatggtggtgatgatttagaagcagtttttgcccatatacatataccatggtaaagcagttttctcgtttaccaacgatctatgaggagcattatttttatagatcttagatataaattctctccttcagactgtttgcctgaaccttaaaatgtagcatgattacacaagcactctggaatttagattaaacagcattcaatttgaaaatctaatcatatcatctaaatatcattaagtaataataggctgattgatagggaccaaagctgttttggcctggtgttgcatgcctttcactcagccagccttttcaaaccaagatgttgataaagaggtctataaatcttaatagttggagacagtttaaaagcatagttcactggataaggtcacacccacttaagtgacctattttgtatacttttcaaaaataggttaattaacttaatagaaataagactctcatattgatgtgcaattactactaaaacagctttgtttttttttctttccaagtgaacatgatgttcatgaaattgagggcataatagccatgacaagaaccaggcttagcaaggcaggtcatgttcagcgagtacatttcagacttcccctttaaaatcctcttttattccaggtcctaggacataagcatacacctccatcagagcagtttattcctggctctctcctatttcagtttttaggagggattattctagctgttgttgttttcctaatcactataacagcactttatatagtttctgatccctgaagactccagcttgcatagtaagctcaatgaattttggtctctttttcttttaatctgaggctttcttcatttttctaacagatggatgattcatttgctaccctgggagaagcatggtttcagaggaggatacagtataaaagggcaagggagtacccagaccagagtcatattctggttatattctcctcatacagcctgctttcatttgttgttgtcgtttagtgcccatttcaaattttctgctcctaaagccttttatctactcttagtcttcttattgatgattataaccttcttagtctattattggtcactaattttgcataatttgattttcccattcatctgttccttaacatataaccccttaatgttttatatcgtaagttgagtacatgggcatttattattctttgaacttttaaatatattttaaataacatatacatttagaaaagttaacctcctcccccagtctgatatcttgtatcacacataactctctgtgtagatgttgctgagtcctgctggctcgaattttcctgtggccagatggtctgagaggcagttagtgatgcacattcatggaagggtgggttcttgcaaggtagccatgatgggtatatttgaattgatggatatatgttgatctgatgggcgtattttgaattagaggttctaatatatatagcagaggttctagatgacctctttgttcaccttacagtagtgtcatttctctgcttgtttgcactgcacttacagcaaagacttttctaaattaaacaagtcttgtttatatgttttgtgtatgtgatcacaaaaaatagcaaagaatactgttctatggactcttagctgtggtggaaagaaccattgaaactctctcagcctttagttcttcattaggaagatgcctttcttactgagggttgtaatgattgtgaagtccagttttctgacttctccattagggaataagagaactctttggttttaaattgaaagatggagtgattcactctccagtgtaggagggaacctactctacttgaatttgctatatttctttatttcctaggaaaatgttggtggttttccctcccaagcattctctctagagtttagcagcatcctttccttgaaagcaaaggcctcatttcctatttctttcatatcctttaatttgcctagtacagggtccatttcatagtaagcactcattaaaaacattttagttaattaactacaaaatgtctggctcaggtttaggagagaatgaaagattgggcaggggaagtactggcacacaggagaattaaaatcagaggatatcctttttattactaattctttttccaataataaaagtactctattttccttatttaagaaagctatcatttaaaaaattagtgttctaaaaccacaccctgaaatgactactgttaacattttgtcatatttcttactagtcttattttatacacatttaaaatttttacatagtttagcttatattttatggtttttatatagtattttttacttattttatcatctcatcctattaaaaacttttttgtcaaaggaattttaatggcagcagaattgtttatttcacaactgtaatatgaattctataaccattctagatgttggacatttaggctgaatctattttttcatgattataattagcaagttgccttttggaaaggctatacaactttttattctcatttctgaacataaaatgttgatgaaaaaaatgtattgggaatgataacttcactgagttttagaccagggtttccagaagtaaaatgttcctgtcttggttttggcctttgggtagaaaaaagtaagtttttaccaggagtccctgaaagggaaggccctgctggccaggggtttcaggctcctcctccataacccatcaagtggccaaagtcttgattttctgtgtaaacgggtagacaggttctcagcctgatcgagtcatgtatttatagaagaggttctctttttcttgaagaatttctgacttacttgatctgtcatcattgtctcatatttgtaactttagagcctgacagaacaaaaaagaaataagccatttctgtagcagaatcttatttggagaaaaggattcaagactacagcgtcctatttttttttgtttgtttgtttttgttttgagatggagtttcactcctgttgcccagtctggagtgcaatggcagcaatctcagctcactgcaacctctgcctcccgggttcaagtgattctcctgcctcagcctcccaagtagctgggattacaggcgcccaccaccacacccagctaattttttgtatttttagtagagacagtgtttcaccatgttggcccggctcgtctcaaactcctgacctcaggtgatccacccacctcggcctcccaaagtgctgggattacaggcataagaaccgcacccagcctacagtgtcttttactaggaattgtaattttattagtttctaaagaaaatattaaatgcagtgttttgtaggcagtgattacctttcatcttgtttgtcatatttctcattctttttttgtgtgtgtgacggagtctcgctctgtcgcccaggctggagtgcaatggggcgatctcggttcactttaacctctgcctccggggttcaagagattctcctgcctcagcctcccaagtaactgggattgcagatgcccaccaccaagccctgctaatttttgtatttttagtagatacaaggtttcaccatgttggccagcctggtttcgaactcctgacctcaagtgatccacccacctcagcctcccaaagtgctgggattacaggtgtgagccaccacacccagccatatttctcattcttattttaggctgatgaaaatactaaatatttcaacacctctgtatcatagccatgtttaaatgtgcatatccaccagtcaattttaatacattcctttctagtaaattctgttaggtcttcagttcaactgtacctccctcagtgtcactttttaccttccctcctcccttaaatcgcctagttctcattttgaaaaggtagagaaatcctttgtcagtagttaggaggttgtagatcctgtatgattttctgtcattacattcttaatctattacatgtgtatttgtcccgtccttactgacttaacctctgaccacattgcaaaatgtaaacagagccagataccgacaggtttgtcccttcattagccagggcccaattcataatttctattttctaatttggagaataagaaggttagctagattaagaggctttcctaagtcacataaccgtttgcaagtagctaagaacaggattgtgaactcttgccaaactcctccataaaattccataagcttgtgggagctcatttatacaatatttaagaggttatataggcaaggagaataattgaatttctatatatttagattgactgatatttcccaaacttcaagtggaaaaaaaaagcccttaaagaaagagcttaagagaattaaaatgatgtgacccgaaccatggttcctttctcattcaattattttcttttaaccactgatggctttttgtgcttggctgggtaactttctagctagtcaagcctatgttatgaaagagaaataagacacttaatcctgtgaatgattaactagtattggcctcccttcccagtagtttgcccttcctgtattgtagtctgtgtactcatttctgagccaaatctccaaggtctcttattattgagtgtagggacacctggattacagggagttaggcctttgttttagtctgaagatgatgtggctaattatacagctccaggcatttgcattttttcaaggcattttaaagtttattgcttgtgaaaacctagtttgtaaagtatcatttttaaattttacaggtgaagaagtagaactcagagaagttttacttgccaaaagttctgcagcaagtcagtggcaaattcaaataagtgtacactcatgtatacttagctcagtgtttaactcatggaggtattgttttgtttcttatttataatataaagccaagtagggctggctagagccatttgtagttaatacattttggtctttgatctttttccacataaggtcagacttcaagatagaaaaatattctttatattctttgcaaagagctgattgccatctttctatactgcctgtgggaacactctggccttagaatccaagattttattatccaagacagcagccagtaagtacagtgagacctaagtggggaattaacttttgggctgtagattttgaatgagaagtcctactcaggatctgagaggtgacaagaacgagtgactattcattgatttggattcctgggtcttggcaccttctgtgggataagaatcacatgcaatatgagtaattttgtggaaaggtcttggtcctggttcatagactgtctcagttcctcagtagagagaacttagaggagaaatgactcccttgttgtcatattgaagcagcagcagactattagggagtacccatgttcctggcttctttccttgggctggaaccattcaactgcacagataaatgtttactcaaggaagaatgcatagctttgaaacagtcttaagatgagtaaaagtcttaagatcagtaaaatatacaaactactcctatgtaggtcattatattaacatctgtggccacatattggtccatgaaagggatacttctagccactgaaatcttaaccactagaaacttactctgcagggcatctttgtaattatggcactgagtagcccaagtcttagattatttcattgtgatgtttccagtgtaccatcaactgtataggtgattagcatttgcctattaattccttcttcctctcttatcttcttaatgactcttatacattttgttatcttttcttactctccatgtagtagttcttactctgcatgttcagactctagtggaggtgctaggaagttccactttctggtagattatttagagtacaggatagtcaagggaataaggatggtgctaaggcaggctgtggtggtttaagcctatagtgccagctactcaggtgggaggatccctggagcccaggagttccagggtgtagtggagctatgattgtatcactgcactctagcttgggcaaaaaaagtgagaccctgtctccaaaaaaaaaagaaaaaaaaagtggttataagaaccataggaaagagaacaacatcattttgactaagacaaaggcataaccttgacagatctcagtgtctccaggctaagagaagagcaacttagatatagtaccttgagcctttcaatgattgctgtttaaaaagtatatgactgtaggataggatacattggaaatactgaacaatgctggaggaaagccaacagcatgtggataagaccatccaatggggccaagatgagggggcactggattggatcaacgttaatgactaaaattctctgcttctaatatacacatgactaactcccttactcacttcaagcctttgctgaaatgttatcttctcaacgggtctgcaaacctattctgacctacctatttaaacttggaattaattgaatgaattaatggaagcctcatgttgattaatcctcttttcaaggactgaactgcattacataagaaaatttaattctattaatggtgagctcagtggcacaatccacatctaagtttttagctttatcctccttgcaaataatgatattaagttagtgtaaatattaataatatttgcccatgagaaaggaacagaatgttctctacctttctccagccatactttgaatcctggggaatcagcatttcccagaaagatcaaactatcaatgacataaagcaacagattgattccattgatgatctttttataatactgacgtaccacattcttccccatggcttttgcatttctatctttccatctgagacttacaacttcaaactccattttccatgcttttgctggcatgaagaaggaaaaaagaaatcatggtgcatttactggccttaaagaaagttggtatgtttataaaagaaataaagcatactgaagaggaacagtatttgagtttcatcagttaagcagagcaatttaagtactgaatgcttcatactgaccatttccattttattcattgtaggcaggtttataaagatggctaggtgcacttgtccatggttctcccacccgtgtttgggatgtgctacctcacaagcatagctggctggggatagtctttaggtggaaaatagctacgaaatacctatttttggttgtattaaatgagctatggctgacatattctgtgattcatttctttctaaatgagtgctggggcatgatactaagtgtgcccatgtctcactggtcttgggttcttttatggttccccagccaaattcaagttgaattatggtgtccgtttaacttacaggtgtctgagataagttgtcagttaacatttatacatgagatcaccatctcctagtaagtacagagtactggtagaaaatgtgtggctcagtctgacttgggttcaaatcactctaccgccttttattacatgaattccatcaagtgaacctctctcagcctccatttcctcatcagtaaagtctgacagttccaagccaatggcttaatgatttctctactatatatgcacttcctagaatagttgcattcaaatttgcaatatctttcatcaagatgttgcctctctttccttctttttctcttccatcacagtaagtgatagaaacctgcttgctgcactcataaataaatggccagacatgtgctataataggcaggatcctcctgctgagcctggactccatttggatgctgtgttcgttagttggagtctcagagtatgtgccaactcaccaatctagctaatccttaaatatccctaggagatgatgaggaggcagattttatctcttaggcatgcatcttggaaaacataccaagtaacacgtatctatttttctggggctttgtatggatgggtggcaagtgaggcacagagaggttaagaaacttatccaagattcacaatagtaaatagtagaactgggattcaaacccaggtccaactaattccaaaacctgtactcttaatcagtatgctgttctcaaagacttagctcttaaatccttagtcatttctcaaaataagataatacattctagtgctgaaatagtggatcagaaaatttagagtttactctcagctttaccagcgacttcacctcaggcaactcaatcatcattagatgatttctctatgaggaaatgaggatcatgatgtctgtcactcagggatagaatgagcattaaaaactaaaacaatagcctctgtaaaagccctttggtctccagagttgatgaacattgcattaatctacagcattaatattttatattgaagacttctgagcaggtcattttgaacacaaaaaagggtaaactttggatcatgtattccctggttctagaaattaaaggtaaccaaccttgaaataaatagttatagcagtgccaaaagaggatacgattatggaacaatatcacccaggtatcttacacagaaggcttctggattgtttcagttagcagcaagagtatgtatttcatgggcctggggcatattaatcaactgcactatgccaagatggagttctgttttttactagagatctgctctaaatcactctgttcataatattgtcatcaaatttgccatccacaattgaggcatgtcacaaaatgagcaaaggagtccttttctctagagtgtaactgccagaatgggccaagaaaggtaatgttggactaagacttgtttctgagaaaagtttttcttccagattcaagactgacactgagtgtacaatgccacattgacttccaatggcaaacagcacataattctgtacacaaacacttagtgatgttttcctctaaaacttttaaaagcaccatctttttctgggtgccagaaaggcactcagcccaacagtataagcctatgactgctcaagcacatgtgtgtgcatgcacttgggtgtgcatgcatgtgtgtatgtttacacaggtaggcacctaggtgttttgttctccatttttagaatgatctttgttgctggccagtaccagagtgatctaattatacatgctttactgatttccatctaccaaaattcatgtttcaagtttaactagatatccttagtggatgtttccttaaaaacatgcgatcacatgtgcttatcttttctctcactaggctggagcttaagtccacttatgaggagaaaatatataaaagcaactctaaattggtgagggcgatggagggggccagtggggaatgagagaaagggaaaaatgaaaataagaagcaattaagttttttttttttaaattagcctaagctcctggaaacagatataaataaatttgagaaagccttccaaaagtcagaagaatttaactctccagccgagatgttcaagctttctggcatttgactaacgttttatgctctcttgtctattgatcattgagccactgttgagatgaccagatgaccaggtgctaagcatactttaaagaaagttaccttgcctgaagacattttcctactcagatatctttaacagctcaatgcacatgaccttggcattgcttcaaaggtggcagctcatccaagtaggcagaatacctggtctctcagcactgcttttataatgccctttttctaacgttgagctggtgaccatgctgccctcttcattttgcagtaatcagggttgtcttcttttttcatatccctttcctgcctgaggctgcttcaacaaacagcaagtataaactgaaaccctatctctttgcggatcaaacacacagcttgaatacattgataagtaactttaaaaaaaaattgtttagcctgtggacctatttatcagaatgctatataaaattattgttttccagtgacccaattagttgaaatattctttctgaagctataggaaaaagacttaatattgtttgatatgattttatcatttgtttagttatgtatcacttcccactttacagtgtgttatgcatactttctttttttctgtcatccttcccccatgtctctactcttcagtctcatgcataaagaaacagggttccctacttgacagtaaccacatgaggagttgacattggcaactggtttaagacttcgatcataagtcatctaagtaattgggctatgcgtatcctgttgaatcacattccttctcaaatccttctttgttaaaagtttgaagcccaggcctttcaattttctcttatccctttaagtccacaaaggaatttttaggctgtttctggagggttataacttctccccagtgctgtccaatagctggcatattggaaattggcagaatgtgggtgcaagagagaagggagttctcagtaaagcaccattagaattctcccacagtttgacacattcatttcattgcccctgttttgtgtggctagcaactgatgttgtttggctgtgacatgcgtaaacagatgttgtaaaaaacctgaaaaacaaaaaatcatctttccctactttttcaggcatactgaagacagaatccttttttggttatcttgaagagtctgaaataggaaacactttgaagtgtagataaaatttctgctctggtcacaatggatgccaagtgttataaaatgattgtgggagtgtgtttctatattggcattttgatatagaggcaggtaagagcaatgccaccttcctgcagagtactctaaaaccctttcttccttcattaatagttttcctttgaagataaaggaactgctttcattatgtgtgaagcattccttttacagttaaattactgtttattggtgagtggtttccttgctgcgctagtatgcggcagatgtttctcatgtatccctaggttttcaggctttttcttttcaggatgaggctctgttgtcttttctttttttctttcttggcaagaatctgattgggataaaacacattttatgcagcaaattaaaaatacgtatttaaatttaccttttattttttacctaaaaagttcgcaaactacttgtagctattattactctgaggtcattcctctgatacaaatgtatttgttgttttatttcggagctacagatagaaaatctaaatacagaatattaaaagtatgtagtgtaacatgacttgtacttagtaggtactccgtaaatgtttggaacttatgaattgaaggtttctttctgatcttagtctagaacagtgcttcacagcctttcttatgtcataatacacatagaaattgataatatttatatgtcatatggaatttttttcaaagaacatctctagtaataacataatacagagagggatacaagttgaaaaatgctcttctatgttgttattgtaacttttaggagtaagactaccatagaaagcatgcattagaatgctaggctatgacatgggtaaacagatgttacatctttcagggcatcacaccataggagtggtatgccttacatcacatgggagatgtgaatggcttataaggagtcccaaacactaggacaccagccagttgaggtctgacttcaagacagttgggtcttgcacagatggtagaaacagatggtagaatgtatatttgtgtatggggggagagggtgccctgtattccaccctttattccccccttgcattctgagactagagcttggcctatggcaccgacaattcctcagtcctgaataacatgtataggctacagcattgcctagttccataagtcaccctaatggttaaagttttgccacctgtcaccttaaaataccccaactttgaatggattctgaaccatagcctacgtgtttagaatgtctagtttgatggagcacagatggtttggggagcgctaacattcatctttactttgccttcatctattattttgcccaaacgtgtttatcctacagcctgcttactaatggctcagtttgttctagctagttgtggtttgggagtaggaggccactctgcccactgttagatgaggggattgtaaatgttagagagggccggggtagaggagtactctttttaagaaaagtagttgactttgataatgaaaaagtatcatcatgattatcgtcatgctgttgagtgctttactacatttcaggcacgataaggttatatatttaatacttacaactttatgagcagctgtcgtcattatcgccactttacaaatatggaaacccaggcaaaaagaggctaagtaactttgccaaggtctcacaggtagcaaattgcagagccagaatgcaaaactactgccttatgatctgcttctctaagtagctgggaatggagaaagacggcgagcagatgtatagaatgcactgattagggtgactgggtgagctctgtgctgagttatacttcaagatgtacaggacagagttagggaaatgtgagaccaagggcttttctgggcaggaacaaccatactggctgctgtggcaaggttagagcctgccaggtaactacagtgagacttccttttcatacagattgggggaactggcaagacaagttatcatcacctccacatagcaggtgagggaagggaagcaacagcagaggcattggtgttttgtatttagaagggcacatagcctaatgctaaaactcacccattagttacatcaatgtttggatgctctttgaaagacttctcaggagaggtgtgagaatgatttgatttgaaggtgggttttagtcttgaccgtgtgccacagcaaacaaaatgaaactccccttgagataaaggtaatcaagatgaaggtgtatttacaaagatgagcagtgggatttatccagtgactctggaaggtaatccccagatttagtgctccatgaataccttgccatgttcctaagctggtaaattactctgagttttatgagagcggattgtgggaagcatctagatgaaattcagcctgtttcacctcgagtccagggctcactaatgcaccccaggtgtgcagactgcccaggctttctgccttggaagcctcaaggaactttcatcccaaagggaagctttgaagaataccaaggacctttctatctgtccttgattttttgtcatttttctgcccacatttggtaattggagatatttgtggtgttaaagccggacttgttccttctcagcctgccccctccagtagtgaaattttaagcctgtggctttgattatgcaaagcagtgatttctctgcagtgtccctcagatgtaaaaggagaatgactgaaatactagaaaggaagttacgggaaatcaccaaacaaccattttccatgtctacagatcctttcatctgagggcaaaagaagctggagagggtgcctccaaaggtgggggtttggaggagcacaatttaaaattctctgggttgtaggctaaggatcaaagggttatgtcctcagaattacacggtgagtcactggaaaaactctgagtaaaagtcaggcatcctgttttccaatcttatatgcctaataatttcaactggctttaagacagtacatttatgtatatttttcatttagatccattgccacctaaagaatataatgatgtatgcattatatagattatggtttccatgccctagagcatcatgaggtgttttgccatgagaatacagtgggttaggtgaagaggtgcttgagaagccttggtgtctaatgtgtggtctcagtactctgtggaatctcctcctcccttacaaaccactgcctctattcaagccatcttgtgcttcaatttagaagttctcctttaagagagagttttccaaagctaaattaacagctatgcagtgtactgagtaactctgtgatttactttttccaattttgactgctgtaagcatttcagtttgtttcccactagtttggatcaacatgttggttttaactttatctccaaatgtaatgattttacatattatagacaaatgtgtttgcacagttaagggcagcaggatttgcttgaacagagaatatgtgagttctgtaacttttaatattcaattcaatttaaattctttttcatatgtcctttttatatattccagtttctgattatgggtaacctgacttgaaggtcagaccatctgaagtgaagatggttaaattgtatgtgtttgcacatgcatacacgtgtgtgtgtgtgtgcatgcatccacatacacatgggtgttcatgtggtaaaggagagccagagagatgtttaatttcctcaccacattgtagaaactgaaagagacatgtactgcagaaacaaattctgagatacgtttgctaaccacttttttaggtttcaccttccggggaaaatgttaaggcatttgcaaacatgcctagtttcttagcgatttaaggcgcatagactctctgtgactacacctagagaggtaagacatggaaaagaacataagctttgagccacctagattaggggcttaatctggccacaccactttttagatgtataacttcaggttgattactggacctgtattccttttctttccttggttgacacttgttccaacttatgatgttggtttatgattttgattttagtttggttaacttcttatttgggggattttgactgacttaatttgttctcatcttgtgttagggttctctagaggggtagaactaacaggatagatgaatatatgaagggaaatttattaagtagtattgactcacacgatcacaaggtgaggtcccacaataggctctctgcaagctgaggagcaaggaagccagtccaagtcccaagacctcaaaagtagggaaaccaacagtgcagctttcagtctgtgtccaaaggcccaagagcccctggcaaatcactggtgtaagtcaagagtctaaaagctaaggaatttggagtctgatgttcaagcgcaggaagcatccagcacaggagaaagatgaagactcagcaagtcaagtccaacttctgcctgcttctttctagccacactggcagctgattagatggtgcccaccaagattgagggtgggtctgcttctccaagtccactgactcaaatgtttaactttttggcaacaccctcacagacacacccaggaataatactttgcatccttcagtccaatcaggttgacactcagtattataaccgtcacacatctgttatcctattgatcctgattcttgacctctagccgcagttccattcagagaagattagaattgtttcagagttgggctaggcacgatggttcacacctgtaatcccagcacgttgaaagcccaaggtgggaggattgcttgagctcaggagtttgagaccagcctgcgcaatatagtgagaccccatcgctacaaaaaattttttaaattacctgggtaaggccgggcgtagtggctcacgcctgtaatcccagcactttgggaggccgaggcaagctgatcacgaggtcaggagattgagaccatcctggctaacatggtgaaaccccgtctctattaaaatacaaaaaattaggcgggcgtggtggcgggcacctgtagtcccagctactcggggggggtgaggcaggagaatggcatgaacctgggagacagagcttgcagtgagcggagatcacgccactgcactccagcctgggcgacagagggagactccatctcaaaaaaaaaaaaaaaaaaaattacccgggtatggtggcatgcacctgtacttggatgtcccagtggcatgctcccagctacttgggaggctgatgtgggaggatcacttgaacccaagagtgcaaggttatagtgagattttttaaaaaaagttattttttgagacaggatctcactgtctcatccaggctggagtgcagtggtgcaatcacagctcactacaacctctgcctcctgggctcaagcaatccttccatctcagcctcctgagtagctgggactacaggtgcataccaccatgcctggctaatattttgtattcttttttcttttgtagagacagggtttcgccatgttacccaggctggtcttaaactcctaaactcaaacaatccacctgcctcatcttcccaaagtgctgggattacaggcgtgagccactgtgccttactgcttagagtgagtttgctactgcaccactccagccagccagggtgatagagcaaggccctgtctaaaaaaaaaaaaaaaccaaaaaaaaaaacaggaagaagaagaaggagaacaattgtttcagagttaaaaagaatcttaaaaatcattgtgcttgacaacaatttttatgctgcaggtgcttctctccaaagaccattggtaagtttacctgtaaatggaaacaaaatatgaacaatccccaaatctgtgtttctgaagatttattctttctaatgcttgagcattttgaaagagagacagattaataagaaggaagaggcttcctagtatgagggaaagtgttcatgagttttagtcctagctttgactctcattacacatgtgaaaattttctcatctttaaacaggcttaaatacaaagaataactgaaaaatattggaaacctaagtggttataatgttgtatctagcagtgggactaggagtgattctttgtttggtttggttctgtttttatttccaaattttatgcactgggagtgtactccttttgtatttactacttcacccccaccagccaaaatgtcttaaaatgtaaaatcatgaaaaataaaaggatagggatgattttcagccccactacctcatagggtttctatgaaaatcagatgaaacaatgtaagactgcgcattgaaaaataaataataactacataataaagtattgccaacatgttagatttagccttaaagaaattcagtttctgtatagggcaagtggagtggcatgcaaattcttgaatctcttgaattcatcatttcagtttgctattcctgcaagaggaaggaattccatagatccaaaatgcatatctatttgtcgcaaagacaataactaaagattatttgctgctactacagactgatagcaaatttatcagcattaaaataattattttaaaggctacaggaaaaacatgatcatggcaaggaattatatcatgttcttgagtagattagggagaaagaatagaattcaggcagacgaggcttgcctatggtccccaacctttttttgacaccagggaccagttttgtggaagacaatttttccgtggatgggggcgggggtggtggtttcaggatgaaactgttccacttcagatcatcaggcattaaattctcataaagagcacacaacctagatccctcaaatgtgcagttcacaataggattcgtgttcctaagagaatctaactctgccactgatctgacaggaggtgaagttcacctcctgttgtgtggcccagttcctaacaggccacagaccagtgttggtccatggcctgggggtacccctgcacaaatctaaaaactctccctttgaggcatcacattacccaactggaaactatagtataaggctgcagtaagcaaaacagcatggtactggtacagaagcaaacacattaaccagtggaacagaatagagaaccctgaaataaagccacacacctacagatgtctaatcttcaacaaagctgacaaaaataagcaatggggaaaggactcactggtcaataaatactgctggggttgttggctagccatatgcagaagaatgaaaccagacccctacctttcaccatatgcaaaaattgactcaagatggattaaagatttaaatgtaagaccttgaaatataagaatcctagaagaaaacctaggaaataccattttgtacatgggctttggtaaagaatttatgactaagtcctcaaagcaattggaacaaaaacaaaaattgacagatgggacctaattaaactaaaaagcttctgcacagcaaaagaaactatcaacagagtaaacagacaacctacagatagggagaaaatattcacaaactatgcatctgacaaaggtgtaatatccaaattctgttaggaacttattgaacagttgaacagcaaaacccaaataacactattaaaagatgggcaaaagacatgagaagacacttctcaaaagaagacatacaagcaaccaacaaacatatgaaaaaatacttattatcactaatcatcagagaaatgcaaatcaaaaccacaatgagataccatcttacaccagtcagaatggctgctattaaaaagccaaaaaacaacatgttggcaagactgcagagaaaaggaatgcatgtacactgttggtgggaatgtaaattatttcagccactgtggaaagcagtttggagatttctcaaagaacctaaaacagaattatcatttgacccagcaattccattactgggtatatatccaatagaaaacaaatttttctacgaaaaagacacatacatatactcacatgttcatcgcagcactattcacgatagcaaagacatggaatcagcctaggtgcccatctgataaagaaaatatggtacatatagaccatggaatactatgcagccataaaaagaatgaagtcatgtcctttgcagcaacatggatgcagctggaggccattatcctaagtgaattaaggcaggaacacgaaaccaaataccgcacattctcacttataagtggaagctaaacattaagtactcaagaacataaagatggcaacagtcaacactgggaactactagagaagggagggaggaattggggagaagggttgaaaaactaactgttgagtgctgttctcagtacctaaataaggggatcattcataccgcaaacctcagcatcacactatatatccaggtaacaaacttgcacatgtatcccctgaatctaaaataaaagttgaaaaagaaaaaaaaaagaactatccctttgggatgttatgctgaccacatagaaatgtgggaaacctgcttgttagtggtgacacccacatggaagtgcttattttacttatccaacttcccacaacctttgtgattatgggccaccatcaagagatctcatttaaattacatttatccttcatatgcttttatgtttgtaaaagtaatacatacccttaaaattcagacctttcagagatacactatggaggaagggaaaaagttccccataatcttagacttaactgatattagcatgtttgtatacagtccttcaaattttttcaatgcgtatattaacatatttagtattcatttgcttcacaaagaatgtgtttatatattatatactgttttgcatctttttctcttaatacattttggacatatttttattttatttgtttatttttctttgttttttgaggtgaagtcttgctctgtcacccaggctggagtgcagtggcgcaatctcggctcactgcaacctccacctcctgggtcaaagctattctcctgcctcagcctcctgagtagttggtattacaggtgcacgccacgatggccagctaatttttgtatttttagtagagatggggtttcaccatgttaaccaagctggtcttgaactcctgacctcaagtcatccacccgcctcagcctcccaaagtgctgggattacaggcctgagccaccactcccggcctggacatattttataaaaccctttgtaataccagttgtcttaatttttcatattctttcagagtcatttagtccgtgatttcagtggtacatgtcttacaaagttaaaaaggagagctggatagtgatttctttttttttttctttgttgttcttcttttttctttttccttcttcccttcttcctttttttcttcctcctcctccctccattacctcctcccttctgtccctcctcccccctcctcctttctccccttctctccttgtttttccctcctcccccttccctttctcccatctttcttctttctcctcttctttcttcttcttttaggtaagaaagagttttttggaatgatctttcagaagcagttgctataggcaacaatattaggtttgtctatggctctacttttgtattagccaatccattacttgtgattgttgtgttgataatgggaatcgtgaattgattacttcatcaaagcaattttttccacactgacattctttctagcaatgaacttgtgaaatcaaatggaatttagaggtgatgctcctctgttttggaaaggtggaatgagttatccacctagaaacaaatctgatctagtcactctcctatttagagacttcttttgacttcttctctaaagaatagaatccaaatttattctcttagtttgtaagattttcttgggtcacctctctagccatgtatgtgcttcagacacactgatttcttgctgttcctcatccttgtgttttgcatcgacttttcttccactaggatgctttttgccagcttctctgcttggtgaaactcgtatgtttatagctctttgataaggctttgctcctccccctaggcacaactcctcctccttgttctctacttctattgtagtggttctgctgctatagtttaacttaccttaccagtcctaatctttcttttaattttttattgtgtaatttattgctgcatatgtattatattttacaataattaatattatatatttgttactatataatttacatatcgtaaagtacacaaatcataagtatacagttgatgtatttgccaggtctgaatttgtacctgggctgtgagccttcagagggtaggaacaatattttagtcattcttatatcaccagaggtactcaataagtacttgaatatgagcgaccactacataatttcctcagttcatctagtgtctatttctttatggaaaggggacattaacaagtatttttttgtagatgtttcaaaccaagtaatatttgtttactgtcttgctactaatctcaaaagttgagagattcaacctaaaatattgatttcctagtggcaattatagatcagtgactaaaaacaaatttcatccatttttctactcacttgataatgttttattagaaactataaatcttaagacttgaggtattaaacagcagagagatatggttaggatcaaacttccttttcctcactatttattccttatagaaaaaaagcaactaccccttcccttaaatttattattattattattatttgtgatggagtttcactctgtcacccaggctggaatgttgtggcatgatctcggctcactacaacctctgcctcagggttcaagcaattctcctgtctcagcctcctgagtaactgggattacaggcacccaccaccatgcccgactaatttttgtatttttagtagagattagatttcacgatgttgatcaggctggccttgaactcctggcctcagatgatccacctgccttagcctcccaaagtgctgggattacaggcatgagccactgcacctggcctcccttaaatttaaattcccttaaatattccttttgaaagatgctttttaccattgctaaagaagtggaatgatttcaaattaatttcaaaataatttcaaattaatttcaaaattctcccactaaaagttgctgacatattaaaggaaatgatatttatgcatgttttctaaaagctagatgtagaaaacttgctcggagtaatttgattcaacaaaagagtttagtagtttccttgaaagataatcctgaaatcaatacctttaatttacattaggcactcaaagaaaataaacacatttccctacttaaaaggctggtccaggtactttttttgtgctagaaaatcaaggctgaaatatctttactttgtattgattcagattttaaattgttctttgaaaagtatatatggaaacagatttttaaaaatgtataaatagataaacatgtataagcagagttttaaatgtatagaaaaacagatttaaaaaacatgtccaccaaatggacatcttttcctactatattcagtaacctaaatgaccctatcccttctcagcttatcttaattttagtatacagttgcccttcttccattaattaatcaataagctcattcattcacataatcagtcattgttgatgcctgttatatccaaggcactctatattctatatgctttatattctatgtactctatattctggagacatcaagatgaaaagttcagattaaaattttcctgactccatttttaaaaagttagtttttacttttatggttaattgtcttaatttaacaagtgtccatttaggatgtaatctgtgctcagtactgttgtacatcatgatctatattctctctagaagctagcattttatcccattgatttaaataatgtctaatgaattttaagttcttcatgtggttagtgttttacattttatgagtaataatgaaatggaagattcaagcaaactccattttcctgagaaatatgcatctctttatttcccaatgttaattatctaaatgctgttagttaatgctatattactacaagcttttttttaaaaaaagagacaatatcctttcttaaaagaatgttataaatataaaaaagtacttgtgttaaataaatgttattgttcatttttagagaaatcgagtgttttcttggcagagatgggagaagaaatgtaattgcttaaataattaagtattcatgcttggaaacccaacttctgttgcagggttaacatatgaactggtgattaactgacaaaaattaagcatatgtgtttggatcatggtttctgtggaggccatagatttgctttatggaaacttgagcttctgtataacagagtttgaaaccattacatgatcaggtcatttagtaggacaacccaataaaaggtaacttgaggccccatgataagaaagtgtctaagaactaagtgatatggttacttaccaattaaaatgagaaaagtcatactcttttagttttcatctgttatggtcatggggaaaatatttctttgaattcggtcctgaacccatctgagacttggggaacattagcagcttctcagtgcatactttctagggaaggagataatggaagaccctttcttcctgtcttctgtggtctctcttgggagcccaggtcttactcagaataggttctcatacttagaggaaactcagattgctttggtcttagcctgtaaatcaaagggtgaagactttttctgttttccttaagagagttctgccctcagtagagggcagagaaagaatatgtgtcattaatcacttgagaattgtttacaactataatctagagagcacttacttgcccatggcaggcagtaaagttaccttggttgtgtaagaataacctgagtggtttactcagactgttcacaaatgtttggacatcattcaagggctgtccaagtctgactagttagctttatgatatactcagatacactcagattcacctttataccatccaatcacatttaaaggagggtgtttcctgaaattgcaacattactgacttcccagccatgtgacatagcttttcagactctaagttaaattttaacccagacatctctcttcaattcaggtcacctacaggccagacaaagccaaggtcatgtattgagtgaatataaggagttttgttggttctaataactgtaatgttattcactggttgaaatactataccatggttaatcataagttgcagctgttgtgtccttttatttatgagcccttaatcaagaggacacagcaagagccactgtttgaaaggagcctttcatgaggtcttctctttgggtgctccttcttgtttcattgtgaaaagaagagaagtttatattgccttgcaaaagttattaaatagtatatgttggcttctctgaaaacagatttttctattccaaatttgaaagatcaaattataatctttatatttcagctgatgataatagaaacactaagcctgtgctctccaaacaatgtcttttaattggtgccaagtttgattgaatctcaatatcagccatcagaagttatatgttggctctctgaaaacagactttcctatccagaattcaggttttctatttgtgacaatatgtctctgctgatgttaaggtaaacagaccagagctctttgtgcagccctttttactggtcctgaacctgatgaatgagattttaaatgtaagtcaatctctctctccttttttaactttttggttttaaatcctcccttattttatgagaattcatcttatgagttacccttgttaaaatattggcatatccaggagtttgaatagggtcattttctgaatggattttggaataattacgtaaattgatttttctgatcaaggaatttagtgataggttatattttcaaatgtgttgattgtcagcttcatcctaaattgcaatgtaacacaaaagctggtacacagctcttttctttgagacactcaaaatgtttccaaactttaaattcatactttttactgataacatttttgtggatctcattcaggtaaacttttcttcttcacttgttgatcccgcgtgacccctccagccacacaggtttcatgtgcttccctgaatacagcatgcacttagcaccctttatagcctggatagtgttgttaccccagactagaattctttcctcatctccattacaatacttgacatccttcaagacaacactcaaatgctacttatatcattaaatttcctccctgatttctacttggacttaaatgttgctctttgtaccactttatttgacctgttgctgaagcacttagttcactgtaccttgtattttaattgattttgtacatgttttttccctcaacaagaagcaaacttattgaggtctgggaccatatcttcaagcagcctccagataattggcttggcacaaaattgcatgcatctcttgttttctcataactggatggaaacaatgatatttagatttatcagaactgctacagagggctaaagggatgcaaaaacacttggtaaaattcaaaattctctttaaagtagtcagtattgttctcaaaacaattacatcaaacttttagtgactgaagtgttgtaataatttgtgattttcaaagatactcaaaatttaaggtgaacagtgagccagaacacaagatgatatacctaatctcattcaccagtctgttttgaccaagtcaagttgaggcaagaatgctgggaacaagcttttctgattgaatgtgttaatttagcccgccttcaaacttcttaaccaatggcttccactctaccacctttcaacgcttttttttctgtaagatggcatgttatctgttagaaataatggggatcacattcattataccagcagtagtctctctgtgatcacactcattagactgtttactaccacgaattctgggagaaatggcctgggacattaaaagaaacaaacaagctaagagggctgtctaggaccaatgacagttattggatttgttttaagaattaagcttatgagttacacttttttcctttgcagcatagatgaaaatcatcacttgaggaacatttcaacatcatagttgcaagtataacttacacaatggaaaatgtttttcattttgagaagaggcaattgctattttgtaatggaacgcaaggactactggagataaaacttgcatgcaagaccagtacagcttgatgaagggagcagagtctagtttaacctctaaattaggagatgtttgttttaattttactgctattccaggcaagaaatattaagtgtctgctgtgttcaggactgctaaacattatggacaatacagtaatagtagaagacatggtgtctgcccttgagggagtgaaaattgaatagacaactcttaactatcaggatcaacaaaaaaatggtgttagttagggagtaataaaagtgccacacggctaactacaaaccagaaggccagggacggattactgtgaactcagctgctgtgtagctttgagtttcttgaatattgtccatgacccatttattttgttttaaatagagaattatatctgccctctaccaaatacacaggaataatctgagtaatgtttataactgtgatctgagaactttttgagtcttttgcaaatctgtaaacacagagtgagaatgagatatgacagtgtggtaaaagaggacttttgagatttattaatatttagaagtacaagggggaagaatacttttatagtatgattataatgttaaagatattcttcctttagttttataaaatgtggcttttgatcagtaagtggcaacttagaagaaaagtctatcctaagttgatttgctattccttgaccttaagaactatagaacactttattttctcctaagaccacttttttgtttttattttactccattcattaattcattcagcacataataacgaagtatgtacttggtggcaagcactgtggtaggacctggggatatgaagttgaagaagacctgggccatatctctaaaaaccttgtgaggggaaaccaagggggaaaaagtttctactattttaaataattagaatagattttattttatagttaaatttgaagaaaactacaattttagttagatttactatgccatctttactcatttgttcactcccattcgttcatttttcaagttaatgggtgctggaaacctgagtcatccttgacatgtccctttcatttgccctccaaatgcaaacaaccacctgttgtttcagtcctttcaaatgcctgcctccagaatgagcattaaatctgtcaacatatttaccatctcagcttctccagtcacctcctaactgctctcccagtttccactcttacttacctctaattaacagctttcagacttttttgaggatgacctacaattaaaaaatacatccatgatactcccagtacacatacttgtgttgctatgtatctataagtaaatccaaaatcaaagattaacagaataatacgtatcttttctcagtatcatgcattttgatatttttaaaaattatattcctggccgggcatggtagcttacacctgtaatcccagcactttgggaggctgaggcaggtggatcacctgaggtcaggagttcgagaccagcctgaccagcagggagaaaacctgtccctactaaaaatacaaaattagccaggcatggtggcacatgcctgtaaacccagctacttgggaggctgaggcaggagaatcccttgaacccaggaggcagaggttgtggtgagccgagatcacaccattgcactccagcctgggccacaagagcagagctctgtttcaaaaaaaaaaaaaaaaacaacaattaggggccaggtgcaatggctcatgcctgtaatcccagcactttgggtggatcacgaggtcaggagttcaagaccatcctggctgacaaggtgaaacactctctactaaaaatacaaaaagattagctgggcgtggtggcaggcgcctgtagtcccagctacttgggaggctgaggcaggagaatcgcttggagcttgcagtaagcagagattgcgccactgcactccagcctgggcgacagagtgagactccatctcaaaaaaaaaaaaaaaaattatattcctttgtcgctttcttgctgggcatgattaattaaattcactttatgatccattaatgatgtgaaatttactgttctaatacttttaaacacaggttgtttaaagccagggtgataggtttatattatttccctgcttaaaatgtttcattggcttctggttgtacttttagaattcaacgtagaaatcattgtatggcctacaaagtcctgcatggtcccactctgcctcctcctcactctttcctacttctccacatcttcacacaggttctttcctctccatggaataatagtcttccttccccaatcttcaccttgccaattgctattattctatgggtctctgtgtaaaaatcactcctttaagaaaattagatctccccttataattcctcttcctcctctttttattcactgtatttattataattgtataattatatatttatttgtatgacttttttatttaatattagtggcccacactagattacaggttccccaatatctaagaccagatctgttttgtttattgctatatctacaatacctggtatagtcctagcataatcagcaaatattcttggtatgaactttggatcaaatgctatgcttgccccacaaaggtgaataaaacatagactttattctcaaggagttctactcttttgacatggagtatactttgtttgaagacaggtatctaaaagacaaaacaggttaataaacatcttagaaagggtattagaatgctggaaatcctataaacaatggcttctttagtttaagactctaactggagggaagttttccttatttactcatgatactaactcaaggaaatgcaatgattttttttaaaggaagcagagatattattcttttattgaggtaaaatttctagagattgaaatgcacagatcttaagtggacaattcaatgagctttgaaaaaaatattttcttgtgttcccttccagtcaatctcaagcctccttaggcaatcactcttctgatttctatcactacagattagtttttcctgtgcttgaaactcacatacgtagaaatcaagcactgatatctggcttctttcagacggcctttctttttagatttatccatgttttgtgtgtattttttgttaattccttttttagtaatgagtagtatgccattgtaaaaatataagacaattactttttagccattcttttagggatagatatgtgggtaattttcactttagggttattatgaataatgccattatgaatatgcttatacaagttctgtttttgaaattggtgggtcagaggatagacgaatgtttaactctaaaataaagtgccaaactgtttccaaagtaggttatacaaattttccattaccaacagaaatataaaataattatgtttgttctacagtttcactaagagcttttttctttaattttagacattccagtaagcttgaaacagtcttgcactgtaattttaattttgatttcactgatgactaatgatattgaataccttttcatgtgcttattaagcactcacatattcttttgtgaagtgtttcttcaatcttttgatcagttttattggctgtttgtctttttattgttggttttggaagtttttaaaaatatattctgaatataagtcctttttcagatatatgtactataactatgtcctcgcagtccgtggcttgtcattttaccttcttactggtgtctttattgagcaagttttaattaaaatggttagttctttttatagccttttaaagaaatctttgtcaacctcatggttgcagcaatcttcttctacacctttttctagaagctttattgtttcatctcttatgtttatgatcaatcctgaattaatctctatgtgtgtcatgaggtagctatcaaggttcatttttttcccatatatttttccagcgttctctagctatcttttgaagggttttctctttttattaaattatcttggagcctttgtaaaaattatcaatttactgcatatgctttactctaactggactctccatttcgttccacagcaggatttgctatctttacaccactcctatgttgcttaggctctgaggctttatactaagtcttaatatcaggtagtgcgagttctctgactttgtgagttttttaaaaaatcaatttttttggtataaatattttgcacttcatataaattttagattcagcctgaaaattttgagaaaaaactattaagttttcactgggattgtaatgaatctgtgttgaactcagggtgaattgacatctttaataatatggaattttccatgaccatgatcatgttttctctcccaattgattaggtctcctttaatttcactcagaaatatcttatggttctcagtgcagaggattgtgatggtattttgaatgactatgaataaatttttggctgatatattaagtcaataatagatacctttgatttttattattatttctatattattatgcagttctcagccttgaagtttgaaagactttaataagacattgacaccagtctcccacttaatgctggaatgctcaattacaaatccctggcaaatgttcattagactttgaactcttccaatgctggagaaataactgttacacaaaacaccctattccatttggggacagtttgaattgttggaaacgttctttttatattgagctagttttctgcctgttgtctgccctttggagtcatggagatgagtttgccctctctcctacagagtaccctccagctattcgtagatagctaatctgcccaatgaattcttttttcttgttgaaacaattctagtttctctacttattcctcgcatgacatgatttttgtatcttttctctttctctgactcttttgacatgctccagttttctgtattttctttaacttttggcatccagaatagaagcaacactccaactgtgtccagaccagtgcagagcacagaaagactattttttttccttactctgaacactatacttctgctaatctggccttaaatatcatcagggttttcagcagccaagtcacactgttggctcatgtaatgttcactgtcagctaaaacccctagatctttttcacatgaactcttattcagactgctcattctttcatcctgaacttaggcctgtaatagttttctttcttgtgttcatgtaatagagtttacatttattcccattcagtctcagaacttcagaccaatcttctagtcagtcttttgtggagtctataggcttgacaaaagaaaaaactcagactccagtgaataccacaaacagttatttgctttaggttcaggaaatgaaaatgtgctggttttaagtttctgaagttgcctccctccttcatctcattccgtcctcccccttcagttctttggtccgagacccaatagaggatgtctacagccactctccctctagggagggcctgggtctcatcttccacccactgccattcaataatagcttgggtctgtcttggctaagccaagggaacatccagcttcactgagaaaacctttgctgcatggtgatacgccacctacttgcactgtagcgttgtctggcaggtttggcccattgtctcccagaggaaacagaaaacaactccccagcaacccgccaatctcttttgtccccacagtcgagctctggaaaatatctgaatgccacagaagtgggagtaccctttgatgtttatattggctggctccttttcctttttgctttttctttttttcatttaataatcagggtagtagaaaatgcggagaattaaccgcatgacagcagcagaggaattcattagagaaacagagatgaattctgctcagatttcaggctctcaggcagaagacacaaaggagtaatcgtcttctagttttttttaatcatttcttttgtggcaccttccttgtccatgaaggcaatctcagcgtctggcatgggggagcccaagaacataggcagtgcaaatggtggctttgatttggggattattacagcaatattaaccacttccttcttacctctctttgaaaagatggagcttgtcattcttggagaaggcagtgaacagtgctatgttattgcttttatttaaagtattacccactaaaacttcattttaaaattgggaaaaatgtgcataacattttactatggaaaattcttgaacagagcaaaaaatgctgaggaatataattttgcaaatgtgttctcttctaacttaatatcctcagagacccttccttttatgagcctcaaagacagctttagtgatggcttacacaaaactaagtaaatttacgcatacaattttacttgaaggaagttggtaaaataaatcaataatttttttttcttcttgagacagagtgtcactctgtcacccaggctggagtgcagtggtgtgatcacggctcactgtagcctcaaccttgcaggttcaagtgatcctcccacctcagcctcccaagtaactgggatcacaggcatgtgccactatgcctagctaatttttttttttatttttagtagagatgaggtctcgctatgttgcccaggccggtctcaaactcctggactcgagcaatcctcccgccttggtctcccaaagtgggattacaggtgtaagctaccatgcccatccacatggttttttctataattgtacaaaggcagcagctggatccccagaagctactggtaatactaagatttccctcccaaagtcgaaagtagtcctgattgctttgcttaagtagtagagtttcattactattttaattcctcatgaattttttaaaaaatacaaatcatattcggagtttcatattgaaattatttaagagaaaatttttttctcaagtactgttacacactttaaaagcgtgtatgtaatttattgattttataaatataaatgatttgcatcttatgagagcaagttctataaagctctttcttggttacaatttttagcatggttttatttttaagtaaacatatctacctgaaagcaatgaaaagaacagttttgaatcttagtgatatttctggaaagagaactcattaacctgaagtactcatgcatataattaatttaaaaaccatttggttttaaccttaagctaatccaatcaacttgtgctttcatcaaacatttaaggcctaacagggacaggtctggtatcacaaaaactttcccagggaatactcttcttatggctcatcttaggacataggctgtagaactatgtcctagaaccagaccattagcaagtaagtcaccttttcataccatgtttctcctacctgtcaagcgaagatgcaggcacttgccacctgtcaatgggagaaaatactgtatatcaatcttttttatatcagtgataaggaggaaggatagtgatgactgtggcctgtagagggtatagggaaggctctgtggaagaggagagatttaaataaggcttacaagaatatgtaggatgttagtcaatgaccgttttttgagaatattgataaaaaggcatttaagatatgttgcctgcttctgatttggattggcatagaaaaggcatgaagacaacatcagaaagggagtaaaagcacaggtgtgtcaaagcacatgcaggcatatcttggagatattgagggattggttccagaccaccacaataaagtgaatatggagaaaaactgaatattgtaataaaggtactcacacaatttttttggtttcctagtgcatatcaaagttatgttaatgctatactgtagactcttaagtgtacagtaccattatgtctaaaaaaccaatgtatatactttaattaaaaataatttattgctaaaaaatgctaataatcatctgagccttcagtgagttgtaatctttttgctggtggagtgttttgcctggatgttagtggctgctctctgatcacggtggtggttactgaaggttggggtggatgtgccactttctcaaaacaagtcaacagtgaagtttactgcattaatagactcttcctttcatgaaatattgctctatagcatgtcataatgtttgataacacttaacccatagtagaactttaaaaatttgagtcagtcctctcaaaccctgctgttgccttatcaactacgtttatataatattctgaatcctttgttgtcatttcaatgatgttcacagcaccttcaccaggagtagatcccatctcaagaaactactttctttgttcattcatatgaagcaacgtcttttttttttttttttttttttttttgagacggagttttgctcttgttgcccaggctggagtgcaatggtgtgatcttggttcaccgcagcctctgcttcccgggttaaagcgattctcctgcctcagcctcctcagtagctgggattacaggtgtgtgcctccacacctggctaattttgtatttttagtagagacggggtttctccatgttggtcaggctggtctcgaactcccaacctcaggtgatctgcccacctcagcctcacaaagtgctgggattacaagcatgagccactgcgcccaggcatgaatcaacttctcatcagattttatcatgagattgcagcaattcagtcacagcttcaggctctacttctaattctagttcttttactatttccttcacatctgcagtgacttcatccagtcttaaacccctcagagtcatccctgagggttggaatcagtttctttaaaactcctgtttatgctgatattttgacctcctcccatgaatcatgaatgttcttaatggcacctagaattgtgaatcttttccagaacgttcccaatttatatattttgtgaagatccatcaggggaatcactatctgtggcagctataaccttacaaaaatttatttcttaaatattaagacttgaatgttgaaattattcctcgacacatgggatacagaatcaggcatgaaaacaaccttaatcttatgtatctccatcagagctcttgggtgactaggaacattgtcaatgagcagtactattttgaaagaaatctttttctctgagcagtaggtctcaacagtgtgtttaaaatattcattaagacatactgtaaacagatgtgctgccatccagactttgtcgttccacttctagagcacaggcaaagtagcttttgcataaatcttagggactctgggttttcagaatggtaaatgatcattggcttcaagttagagtcatcagctgcattagcccctaccgagagagtcagcctgtcttttgaagctctgaagctaggcattgacttctgctcttgagctttgacagtctgagatggcaccttcttccaatatgaggctattttgtctacatgaaaaatctgttgtttagttgagtcgccttcatcaatgatcttagctagatcttctggataaatttctgcaacttctacatcagcacttgctgcttcactttgtatttgtatgttacagaggtggcctctttccttaaacaactcatgaagcaacccctgctaacttccaacttttcttctgcagctttctgatctctttcagcctttgtagaattgaagagttaagcccttgctctggattagactttggcttaagggaatgttgtggctggtttggtcttctagctaaactactaaaattctccctatgagcaataaggttgttttgccttcttatcattcatgtgttcattggagtagcacttctaatttccttcatgaacttttgctttgcattcataacttggccaactgtttggcacaagaggcctagcttcctgcctgattcagcttttgactttccctcactaagctaaattatctctaacttttgatttaaaatgagagaagtgtgattctttctttcacttgaacacttagaggctattgtaaggttattaattgaactaatttcaatattggtattgtctcagggaatagagaggcccaaggagtgggaaaaagatggggaaatagctggccaatggagcagtcagaatacacatatttatcaattaaatttgctgtcatatatgagtgtagttcatggcacccacaaacaatgacaagaataacatcaaagatcactgatcacaggtcaccataataacataatcataattgaaaaagttagaaatattgtgagaattaccaaatatcacacagagacatgcatgagcacatgctattggaaaaatggcactaatagacttgtttgatgcagagttgccacaaccttcaatttgtaaaagttgaagtatctgtgaagcacgataaagtggagtacaataaagtaaggtatgtctctagtgtgtttgtgtacattaagtggtggaagatgtgatttaattttttaaaaaatagccgtttaccctagataaatcagtaagagatgagtacaagtatgtatctacaaattatttttatttgtgctctttataagaattaaaaattgaaaaactcccaaataattaatgaagtaaattatctttcaagtatacactgtattgttctatagctattaaaaatcatattgtataaaaatatttattcaaatggggaaatactcatgatataggaagaagtgaaaagtaggttataaaacagaatgtatagtatggtccccattttgggaaatatatttacacttatgacaataaaaaaatcagacaggatacataatgagttgttagcagtggttatatatactctgagaccatgagttattttgatttttgagaggcgagtgtgcttgttggtgttttcaactctttcctaccataaaatgtattaattcactattcaatttttttaagttctaagaagttagacacttatttattttaggtgttatacagtccatagtggaaatttgagatgagtgacagaatgaaaataatatggttgcagacaaatgtgataaatatgtgtaagatgtttttgaatagacaaagcctattttaggagtgatgaattgtagcaataatttattgtaaaatgatagatgtttgaaatagggtgggagtggtaggaattcaaaggaagggatagatatgaaacatgaaggatgaatgggcagtatgtggtgaaatggctctgagaggtgagagagagaagactcttgaggacaagtgcaatgtttcaacctgcttaggataataaagccaataaaagatagagacagcttgtttgggggctgagataaaaggtttcaatccaggcttttttggttgttttttgtgttgttttcttttcttttcttttcttttttttttactttttatttggaagtaagaaagttgcaagaatgaaaacagtccacataacagtcaaatacctttacccatattcacctgttgctaatattttaccacatttgctttataatttactcgatctacatatgcatatatatgtataatatttttctgagccatttgaggctaaattacattcatcatgattctatacccccaaatacttcggtgtggtatttccaagaaaggggatattctgttatataaccttagtagagttatcaactttggtaaatttgattaaatacttctatctaatctaccatttatatgccagttttgtcagttggctcaaagatacaatagtgttgtttatagcactttttccctccagcataggatccagcataggattaggtattgcctttagttgtcatgttcctttagtctcctttaatctggaacatgtctacagcctttatcttttatgactttgtcagttttaaagaatttaagccccccctcttgctttttaaaaatttgtctgatgtttccttatgattagaatcaggttatgccttgtcatccaggtgatgttttgtccttgagttatcacatctgcaggcacataatgtccatctcccactcatggtgatgtaaattttgatctccaggtcaaggcattgtctaatttttcctttgtgtaggtactgtttttcctttaaaagcactgagtaatcagtgggaaacaaatagcttgctcttcatcactacccccaaatttattatctgttgatgattcttgtatagtccaaactttataagatgactgaaaaatcatgattttccatctttgacattccttccacattcgcctgtcaacagtagacattttctaataagcaggagctttttcttctctccatccaaacatgcatctcttaccagtttgtactggtcatggaatccactgttcttttcagtggttgatactgtaccagatcattttggtatataaactgtctcagatttagccagtatgttctggtatcatatctccaccgtctatttttttttttttaacacttccttgatttttggcataagttattctaggcacaccttgtacctactctgcctaagctctgaaatcacccattttcccaagaaaccccagttctttttttttttttttttttgagacggagtctcactctgtcacccaggcggttatgcagtggcgcgatctcggctcactgcaagccccgcctcccgggttcatgccattctcctgcctcagcctcccaagtagctgggactacaggcgcccgccaacgcgcccggctaatttttttatatttttagtagagacagggtttcaccctgttagccaggatagtctcgatctcctgacctcatgatccgcccgccttggcctcccaaagtgctgggattacaggcttgagccaccgcacccggccaccccagttcttttctggtggaaatagtgttaaagactaagttctgggcataggtgtgctcattactattgaggtatcttggctcttggctctttcagtgaagtgaacttggggaaaaatacacacacacacacacatacatatatatataaatacacacacatatacacctacatatgcatatatgcatattttagaaatcatgaattgattcattgatatctccaattttaattcattcccacaggtttcttacttgcccaattcagttttacatggcttctgaatttgaaataataaggcaaaatggtagagatgttcagcttgcagtgggggaagatagaaaatcgaaattcacatgacagggtgaagcatagtgattaagattaggaagtcatccacacagagttaggagaaaatacatctagagtttgccaaatccaaaggcaagactgtaagaaaaagatactaaaagagaaaagagcagaggatgtctctgcattttgtgatacattaaaaagttatggtaggagaaggagataaattaagaatagcctggggaaagagatgtagagagtgaagtcaaagaagcaggggagccagtactaggtagagtcatggtggtcaggattagaaagaattccagcagtccaatactgcagaatagtcaaggaaaattgaagaccgagactgggcctttggatttgatatttggttaccaaaggtttttaaatctggatttaggaactcatttgagattttttttttgagaatataacttttaaataacaagtcagctcacgttaattaatgtttaatgttttggggacatttacatttagcttttcttaaccttttaaatgtgttcactaaatattattttatttctaactgcaggctaagcaagttatactgtgtgtataaagtgcccaagtctaagaggcattgtagacaggctatttttagggaaactcatgtttttctttaaaagttcagctagcatttggaatcgatatacagtataatatttaaaaaaaaaaacaacatatttcctcatcccccaagaggtttcttaaaatagcatgtaatcttacctacagtgggaaaagcctcaaattttataaattgggttggatctaacccagattacctgaccaagagagtccccaagaaaaacaaggtgtggtaaaggttatagtaatggtaattaagaaagttgtgttgtgcctgctgggcctcactaaaagcaatgacccagcctgtggctactggcatcattttgactgctgagacatgctttcttttggagagaagtccaaaccaaatctttgcccactttgaaagccaagatattctcattcctttcagccacagaaagggctggtttttctaacaggatcatgtccgtgtgaccttctgatgtatcaacttgttttctatgcagtatataaacaataaagggtttaattttagttgcttttcttcacagagtcatggaatattacaaatgttagaagctagagaggatctttgaggttatctgctttaagccccttgctttccacaggaaaacaccaaggctcagagagataaaatgtgtccatgctggacacagctggaaaatgatagagcttgaactcaggttaactgaccctccatgcaggtctgtggctgcaccatacattacagcatctctattcaacagtaaaactcattggggttatatattataccctagtggatattacatctgtgggatgacaagctgcattatgatagagttgcactgtgctcagcagcagttgagtagccagcacccacaggcaacctctatgggcaatctgaaagtgaaatctttactgaattgaatggaatctgtggagatcttcgatagtcttcccttgaggtgaaatcttgttttgttgagtggtttaagatgttttctagggtgtagcactttgcagaagtgctttcctctttcatgataggtgacccagtttggagatcaggaagattttgtcatccttcacattgcaagacttgaagacttgcaactcaaaatggtatatttttttcttttcttccaatagagaacaattccactctagcactcaagtatctaatacttttgggacatgttgaaactgtttccatttcatctgatttcactcagcaattatttatagaactctctgtgaggtaggcaccatgctaagtatcctgaggctgacaaagacatcctttctaagttgaggcagtgacagagggcacagcagccattgctaattgtccttgctgcagccttgttgggtgacacctctggcttccagggcctcatattttcacagcttcactgataactctctgagaggaattgtccctcccactaagattcccttctagaagatgagtttttccatgagcattttaaaattttctttgttgccttgttcatttttttttccaacatttaaaagagcagaagtgagggcgaagagaaaggagaatatttagatctgaaaaatgcaccagtccacttttaatctacttttgggaagatgattgtaagatattctgtacccacttagggatctcctgcccttcggatacacatgccttaactaccatcttgctagaatagaaggtcctgtgtttaggcatcaaagaaaggaattgcactgagaaattttagtgataattcttttattgtaatcgtgattttcttcctcctgctaatctttttaagtggtattaaaggaagcttcttgccaggcagtaatattcctccatgagcacacgatctttttccttatttggcactggaatttcatcaggctgtattagtctgagcgaaacatactctaggaataccttttttttttttttttgagacagagtcttactctgtcacccaggctggagtgcagtggcgccatctcagctcactgcaacctccgccacccgggttcaagtgattttcctgcctcagcctcctgaggagctaggacaacaggcgtacgccaccatgcccagctaatttttgtatttttagtagagacaggatttcaccatgttggccaggctggtctctaactcctgacctgaggtaatcacctgcctcagcctcccaaagtgctaggattacaggtgtgagccaccgcacccagccaggaatatctttagaatagttctatagttaggaacgttgagaccaggtaacaagggatttattcaatgggatgacaatttttatacaccatgcctgaagcaaataaaggtgatcagtatttatattgcagtattcaaatactctggagccaaatagataggactaccttaaaaatgttcttgtacatgtgggtttgatcttaaagatattagggatggtaacataccattctatgtatatacatgaccaggccttaggttacttaagggtgatggaatgaccattgtgtgtgtcttgtgtcttggtggccttcagtgaattctgcatgagctctagtagtaactgccactgctgtagtatcatggaaaaaacactgaacttaaaatagttttcttacctgtaacaaaatggacaacaatctcacagagtttgtgtgagaattaaaggagaaaatacttgggaagaagtgctttgaaatctccattgcactctgcaaaagcaaggaaatgcgcttgtgatcagtatcatgttgacgtggagtgagttactccccagctgttcacgatatggtcgcccacaaagagcaagtaggtcacttcaccaaacagaattctgtatgtattacagaaactcccaggctgagtcaccaagtaaaatgaagggcagtgtgctctatttaaaatgttcatttcattttcgcattccattctttactaacagaatggtttcacttcatttccagtcactttcattttcaggttgtcaagcttcacttagtgtcagttgtgttcccacactcaaacatgtgccttgtcttccttgatcttctctctgaggatgtttctctgactaatgtgctgtggtcagaacaagagcattgccacatggtgcatttcctaggtaggcatgtctaaaatcattaagtggcctagctcagaacattctttgtgaccctttcccctccccacccagtgcctagtgactgatttatctgaatataaggctacttccacttttagttcaagggccttgctccctgcctgcaagaatctctctaatcacattgccctccctccacccgctttccccattgaaaccaatgtttggagaagatagaagaatgaaaagaacatctcaggtcctgtttttgtaccaccttcactattgtagcacctcttttgtgttgccaactgaatatggtatacatggctttaagggggaaaaaagaaaaataaaacataagaaagtaggagagctcctagctttcttaaatgaattaaaggccttaggccagagtgaattatattatagattgtagactagatatggtggggaaggttactcaacaacttggttgggaaataaattaatatataaaaccatcagatatcagagcatagttgtggaaagtcacctaaggaaagtcattgtctctaggccaaagactggcctagacgtaagtaatgcaccagtgtgtcagaaagggggttggtcgacatcagaagcacccagaggcaaacactggttgtgccctgtacccacagtaactgtccatagaaatgtgaatgttggtagtcttcaaagtttcagtgtcactggcaagtccttctttgttggaaattcaatttaacattcaagttctatagcaaatgcctcctattatgatgtcttgtgtttacagtttgcctctgtaagtagaaccctctaaagggaaaaatgctctggtcagattgttatggtctgtatgacagatacataactgttgtaaatcaacacattggcattctcgtttgctccaccagtttgttgtgaacttcgtcaggggaaggcatcatgcctaagtctattcaactctgggatactgacaaggtcaaatttctgtgcctgcaaggctgggactggacccaagctgtacagttcatacaatgaaatagtgccatttagtaaaaaagggagataatatggcacttggttggaagtttggctctagaatctgattgaactgggtttgaatactaggtcagccacttacatgctgtatgacctaagaccccgctctaaaaaggatattatctttacactgacctcagagggctgttttgagaattaaattagacaatccatgtaaaatacttgactcagagccttacatagagctgttagcagcagcaacaacagcagcaccagcagcaaggtaaataccaccatgtgtgtcctttgggtggtcagcagtttgctgaacaatttggactggtttagaaccctcctaactcactactggggactttccattggaaccacagcactgggtagtgacagaatttgccagtgtaatcacatcatttatgagaaatgatagcaatagggtttggtgtcatagtaatggaaaatggcactggacactatcctaattttgaagaaatggagtgaagaagaagacatgttccagaatgcacaggacattgatcttcagcaaatttttagagtggattactgaatgattacgtgtgagaaaaatgtgattattaggagtcaatatgagctcattgaaaacaaaacattcctatttctaacatccttaaagtctttcacagttcatcttattggttatggaaatgtcaagggatagatttttatttctgggaggagtttggctaagatttttatgatactcttgttgtcttgttgaggttaagtagattcatagctggttgaacaaatgtccactggcagttttgacctgatggatggactaatgtccatctggagaggggtcctcagggtaagcctcaggaacctgtctagtgatgctgttctatccaattttctcattaaaaatttctgacgaaagcacaaataatgtgcttttgcaacaagtgagataggattttttaaagatctgtgtaggttgatgggcggatttgctaataacaaccatatgtagcatttattgagtacttactgtgtgccaggcaaaatgctaaatgtgttgtatgacttctctcatttaatcctcacagtgaccctctgaggtgtatactagtaatattccattctatagatagatgtagaggcacagatatgctaagtcatttacccaagtcccacagccaataagaggcacagatggcagaggaccatttgtctatcaccaaagcccatgctcataactgtattatgctactagaaccagtgagtcagaattttacacagattaatgtaaagtcctaagctaaggttaacaaaatagtatgttaagtcttgaaggaggaagcttaggttgatagcaagtaataaggaaaagatttagggacattagttggtgggaaactcaatgtgattcaatactaacgtatacctacttttaaaaaagaacaactaataggagggtgcattattagaatatagcatcatggatcatggtggcagtagttcttctctaagagtccatgtccagagtactaggtcaggtctgtcattaagggggtccttgaccattataatcaggagaataagaggtctggatttacatcctaagaggaaaaacggtgaactaatgtcaggctggaaaagagaaaaaccaaagaggaatatgaagacaaccttcaaatattaacatagttacatgatgagaaagagtagatgccattggtgtctaagagagtaaaaaaatcacttctcattccctgttgagaaatggactctggcatcaggttgatggagaacaaaatgtcagctttattccagtaaaaccatattagagaatgtggcctgatctgtggctacaatcaggccttttatacccttccctagttaaacacactctcagagtcaggtaaggccctggacaactgttgtttgcaggaggagggcagttcctgtgtgaaggagaaggagaaagtgtgcatcctgaagccaggggtgcacctgacttctcgactgtgaatgagagaggaggaaacctagttcatatctgcacaaaaattctttttggtatccttgaagtgggctgaaacaaaaaagatcaaaatgttactctagcaggaggccactcatggaaaccttaggcaggggaattgtgttacccctggtacttaccaactttaacttcagtggggcaaccaagccaatggagcactcttatctctgaaatgtttggcctctgtacagaatgatgtgaaaaagaatcttctagcatggggaggtggaggggagggatgtctagattacttctacggcccccactccctaagattcttttgaaatcagttaagacacgcataaataaaaaaactccaagtaaagcatgtcagtattttaaaggcttatttgtttgagcaatgagagatgatcagtgttctaagtgctatggttcatcatgttctggaggtggctttgttccaactgtttgttcacgagtgttttgagttaaagggaattacagtctacaaatttatgcacatggcacttcacagaatagaagaggccaacttctggcctcttatacccacatgcaacaaatacagctcgtgtccttcccccaggactcaatttgtaagcctctttattgcattgtgctgtagtaaaaaattctcagttttgtgggcaacctgtgaaaccagccttcttttatttcaactttgttgttttgcctttatactgtgaattaaatgaatccttgggggttctaattatattatggaaaaaagaacttgatattctgagaagctgaagaacaatttgttttcctcagctaggtatttaggacttttaggatttagttaccattttcaaaaaacttgaagaagattaattatctccattgcctcaaatgacaaagatagtatgttcaattctctcctgagttatcatcataataaccctatattcttaatatggccttttatattttacaaagtttctcaatagggaatgagaagaaagtgattttttaatctcttagacaccaatggcgtctactctcccttatcatataactatcttaatatttgaaggttgttttcatcttcctcttcagtttttctcttttctcttttaccacaataatcatcacaaataatcctgtttggaaggtggagaagaggaagcaagacagatattattgtacccatttcagaaataaggagaatggaactcagagagtggtggtgggaacaattaacaaatgttttctgagcaccaatctgttccaactacctgcagtagtgcatttaatccttataatagttccgggagttaggtgctattatccccattttgagatgaggaaactgtggctcaaagtgttagttgcccaaggtcatgcagtattaagtagaagaaccaaaattagacccaggctttctggttctgaaatccatactcttaagcactaggttgttaccactggagaggttatgaacgtgcccaaaggcactggctgcctagtagctgaggcagggccagaacctgtctttagactgcttagcacatcttctagatcctgtagctgcttcactggttttcattaactttggggtttttcaatacaaaaagaggaaacaaatgaaagctgagccgaattttgcttttgtaacatagaggaacttactcagtaccaaggataatctgaggctcttatgggatttttttaagtgcccagtgttgtttcatattctgtttattcttcaccaccaccaccagtaaatgcaggtggttcttgtctcatagtgattcacatgtgggtttatgccaggtacacctattttactacttttggcatttataagggcaatatgtttctgaactaatttggggaaaataagttcttatattaattgtagcagaaaaacaaatgggaaagtcagtgaggttcaatgcaaagagctcagaccaacctttggcatcagcccaagcagagttggaaatcccagcttagtctcttcctaaaagagggactttaagtgagttactgaagctctctaaaaacctatttctttattttaaactggagataacacttgactcatgcgttgcgtttgttagagagaacaaatgaaaaaggtcgttaagggtttattggcagtgaactgtatggtaggtgctgtgcttgtgtttgcttcacttaatcctcatgacagccctaggagataggtattattatcacctcctgacagttaaggaaattgaatcttaaggacatgtgataactttcctaaagtgaactctaccttaatgtgttggaaaagagtgtagcaaatcaaatatatcattcagtttctccaaagccatgaaatgtctttaagtctccctgaaagatttcccaaataaggctgtcaaagtcttcttaaagaatcccatctaagttctattatcccagtggttcctttatctttttatttcttgccataaaattaaatctagaattacaaagaagtatttcaaagtatatataatattcctctgttttatggatttacatatcacctcctccatcagcagggattaggaggggtgtaaatacttggatagggctcttttccttggacttcctcacctccatcaacaggggtcaagaggagcctggacagtaatccctgtccgacccccctctcagcctaatcactactatttgcctcaaacaatcttatttcatgaggcctttgatcaatgttgagattagtcactgtaagaagcctgacttgtaggaaaccttttacctcccagactctaattcttctattccgtttctccccaagtcctgtgtcctctggaattcagaatctgtcattggcaagatctcctgtgttctcaaccccttctcagaacagtcctttcaccttcccactctaaactgaactgtggctgtcgcctaaggatgctgcctcccctgctgctctcctaagtggtggtagtgttatcttccccagtctcctatgacaaggcctggaggtgggctaggtgtcctctttcttgttccccactgctgctttcagaccattcttcatctcctcttttctaaatccagccctcctcccccttaaaatcttatgttatcagttatctatagacctctgtgagcttaatcctacgcaatgtaaaggcatatctttctggccaatcaatatggagtttatggcacttttataaagaaagtggataatggcctcctgatcaagaacataactgctattttcattagtcggtactctatgatgcgggtgcatggtccaggggaagtgggttcaggcccatcagactgactgagagttgagttctttacccactcagagtcaagaattgtggtatggggggaagcactgtgtgaagcatcctacaggggtctgttctgaacactgaaaatgtacagtccctgtcccagagtggcattctcaagatttttttcttgatgggacttgtgtggctatgggccaaattaaatttaatataagcctgactctcatagcctttgtagaggaatgaaaccagaagaatttggagcagagagtcgggcactcatagaatatttttctaaaacagaggaagtcatggaagactcagggtctagagtataaagtgtttgttacttaactttgaaaggacaactttgtataatttagcaaagccttcttgtttaagattagtctctaataagtaagagggccttgctggatttcttcataattctcagtagttaccagaagtcagaactattccttatctgtaagtaacaggtctttagattatagacctagtggggatataactttaatgttgtacagttaaatcaacttcacactatttacaagacatgtcatacaacactgaaaacaagaaattagagtatgtggaaactatgctactaaaattaagcagcataaggaaaattaatgtaagcctataagtcacagcttgacttctgtttcagcagctgacccagaggcaatgaagccaaaaacaattttaagacctgttctgttctgacttgtaaagattatttgatgttaaccccatacccttatcccctttccaagtgagtaccaggggttaggaaaaagatataatattgcctggctcatttctaatcaaactttaatgctggcttcagcaaggccagatgcctactttttgtaaatatcattggcagttggcagtacatttcattaacagtttttatggctatcagtagtatttttgatactctgaggatgagcactagagaaatatgtgcttgctgaaaagcctgctaatctctgtgtgataacttaattttgctattacctgaatgtaagtgctattgatgtggcattagcattgatttcatagctatttaataaagagacagaaacttcaaatgcataattatgacatcaatatatgaatctttctttagagatgaaaaacacatagttaaaaactgtgaaaaactgccctgcttatatcagaaaacttatacttctctgttgaaaaaataggcaactaaaatagtttacaatataatctaaaaggatgaattggtggaattttcagtataactggaaggtatgatgtgttagatagtggggagagtgtatatatattatcaagccacaatattacaacctgacactattagatataatagattatgcagccaaaaatgtggtcatggacagtgataggggagcagaatggttcggtaaagtaccaagtctggtgacaggacaatgggaaaatttctgcagcctgatggtctgggtagttggatataagtctgacagcagagatactttcatatttagggaaaacctgcaaaatactgaaaagattaataaagagaaagggaacttctaaatagctaaaactcccggcagagcagcatagctgacagagcaccataatcttgcgtatcagagcttctcaattcctttggaacaggagaatttgataatttttttctcccatgaggatgcactatgaaggaaaccgctaggaaattggaattattttaaagtgattattttaacattaacttggtagacttcatctattccatagcatttcttttcttttatcccattcaattgcatcctctctataggattaatgcactcttgaaagtgtcaccttctagccagtggccaactaacacaaaaccaattcactaaacaaaaacacaacaaaggaccctcagagagtccacttcactccctgctacctccactggagcaggtactggtatcctcggctgcaagacctgaagacagatcacatcacaggacgctttgcagacactcgccagtaccaacccagagcccaagagctccactagatggctaggcccagaagagccaaaacaatcactagagtttggctctcaggaagccgcattcctgagagcggagcaccacctaagggagcaccccgtgtcccaaagaatctgaacagcagcccttgaatcccagatcttacctctgacatcgtctacccaaatgagaaggaactagaaaaacaattctggtaatatgacaaaatgaggttctttaacacccccaaaagatcatactggctcaccagcaattgattcaaaccaaggtgaaatctctgaattgccagaataataactataataattcagaaagtgaattattaagctaatcaaggaggcaccagagaaaggtgaagtccaacttaaagaaatcaaaaacatgatacaggatatgaaaggaaaattcttcagtgaaataaatagcataaataaaaaactctcacaacatctggaaatcaaggacacacttagagaaatgaagtcccagcaatagaatcaaacaagcagaaaaaagaccttcagagctcaaagacaaggttttcaaattaacccaatccatcaaagtcaaagaaaaaagaatttttaaaactgaacaaagcctccaagaaatttggtactatgctaagcatccaaacctaagaataattggtgttcccaagaaagaagagaaatctgaaagtttagaaagcgtatttgaggggataattgaggattaagtgggtttcagatgcagagatggtttaacatatgtcagtcaataaatgtgatataccacataaacagaaataaaattaaaaatcacatgatcacctcaagagacacagaaaaagcatttgacaaaatccagcatccctttatgattaataccctcagcaaaatcggcatagaagggacacaccttaaggtaatataagccgtctatgacacacacacagccaacattatactgaacagggataagttgaaagcatccctcatgagaactggaataagacaaagatgcccactttcaccgcttctattcaacatagtactggaagtcctagccagagcagttagacaaataaatggcatccaagtcagtaaagaggaagttaaaccattgctatttgccaatgatatgatggtatacctagaaaacccaaaaagactcatccaaaaagctcttagaactgataaatgaattcagcaaagtttcaagacacaaaattaacatacacaaatcagtagctctgctatacaccaacagcagccaagctgagaatcaaatcaagaactcaaccccggccaggcatggtggctcacacctgtaatcccagcactttgggaggccgaggcaggcagatcacgaggtcaggagatcgagaccatcctggccaacgtggtgaaaccctgtctttactaaaaatacaaaaattagctgggcatggtggcgcacacctgtagtcccagttactcaggaggctgaggcaggagaatcacttgaacctgggaggcagaggtagtgagcagagatcacgccactgcactcaatatgtgaaaatgaccatactgccaaaagccctctgcaaattaaatgcaattcccattaaaataccaccaacattcttcacagaactagaaaaaacaatcctgaaattcacatggaaccaaaaaagagcctgtgagtcaaagcaatactaagcataaagaacaaatctggaggcatcacattacccaacttcaaactataagggcatagtcaccaagacagcatggtactggtataaaaatagacacatagaccaatgaaacagaatagagaacccagaaataaagacaaatacttacagccaaccgatctttgacaaagcaaacaaaaacataaagtgggaaaaggacaccctattcaacaaatggtgctgggataattggcaagccacatgtaggagaatgaaactggatcctcatctctaaccttatacaaaaatcaactgaagatggatcaaagacttaaagacctgaaaccataaagattctagaagataacatcagaaaaacccttctagacactggcttaggcaaagacttcatgaccaagaacccaaaagcaaatgcaacaaaaacaaagacaaatagatgggactcaattaaactaaaaagcttcttcacagcaaaagaaataatcaacagagttaacaaacaacccacagagtgggagaaaatctttacaaaatctatacatgtgacaaaggactaatatccagaatctaaaaagaactcaaacaaatcatcaagaaaaaacaaacaattccatcaaaaagtgggctaaggacatgaatagacaattctgaaaagaagatatacaaatggccaataagcatatggaaaaaatgctcaacaccactaattatcagggaaatgcaaatcaaaaccacgacgtgataccacctcactcctgcaagaatggccataatcaaaacataaaaaaataatagatgttggcatggatgcggtgaaaagggaacacttttacactgttggttggaatgtaaaatagtgcaaccactagggaaaacaatgtggagattccttaaagaactaaaagtagatctaccatttgatccagccatcccactactaggaaaagaagtcattatataaaaaagatacttgcacatgtgtgtttatggcagcacagtttgcaattgcaaaaatatggaaccagctaaaatgcccatcagtcaatgagtatacaaggaaatgtggtatatgtatataccatggagtactactcagccataaaaaggaatgaaataacggcattcacagcaacctcgatgaaattggagactattattctaagtgaagtaactcaggaatgtaaaaccaaatattgaatgttctcactcatatgtgggagctaagctaggaggacacaaaggcataagaatgatgcatgggactttggggacttgcgggaaaaggttggggtggcgagagataaaagagttcacattaggtacagtgtacactgcttgggtgatgggtgcaccaaaatttcagaaatcaccaccaaggaacttactcatgtaaccaaacacctctgttccccaaaaacctattgaaataaaaaaaataaattaataaattaatgtttgtgttattcaaatacccataggagaagtaatctccttgagactggagctccattttcttcacttttctatgcctggaaatacctcacaaaatgactacagagtagttacccaagaggtatttgttgactcgttatctcttacagaattttagataccatctatacttcttttcttactgtacattttccctgggtgagctctcatttattcctgcggatgcacacataccctgaccagtcacagatctctacctccagctcaggctcttctcctgagctccagccccacgtgtccaagtgtctgctgggaatctcctagatgttgtgggctaactccaactcagaatgcccatgtctgaactgttagtatttctttccagaatggccatttcttacacttcccctaccttggctaacaggaaaatcgttatctactcagttgcctaaatcacaattttgaggcgtagaaactttccctcgtcctttcctcccatttttaatcaaacatgtttacattcttctttttccttctggtttaggatctcctccaagacggtttctgtctcattacttattagccttgcctaggccaaggcttgatttaggatatgtatgtttttaatacatgtctaatgaatgggaattttttgtagcttttagattttctgttgagaaacacacataaacacatactcacaaacacgtgtgtgcctggaagcacatacatgtagtattcacccaagtcgtccaagttcactgagtcctgtccagacctttaattctctcagtttatttgtgagattgttgtgtggcacaagcttacaggcatgtgtaattgttaagggaatatggattgagaactctgccatgataactcatagctccttctgggtagttaagccttacatcccattctgccaaacccttctcagacattcaaccattttctttctcccttgttaacaaattttttaaaatattttttaaaaggaaagaaaagaaaatcctaccttatgaaatcatcttggccttgatgagaatcttggccttgatgagcttagattctcaattgactattttccattctgtcactaagatgtatttggaaaacaacaaataacccctgagccctgctattgtttctttatggtttatgtttcatgctgtgctgcttagccagcagggagggaggcttaactgacaaacccagtttttgtagctgtgctgatatcatccacaattcaaagccacagtgaaaaattacaaatcagcctcagccatgtttttttgttgttcttcttactgagaaacacacatgcacagacaaagaagttccatgtttgctgagtgggaccaagcaatcttggtgtagaatgaagaaaaaatggtgaaactatggagggtgaaattatttaaactgtaaaaagcaaatgactttgttttccggatcttttataccacctcctttgatgcagcctgcttcctgcatgaagcctgttttgtttgttacttgttttcttatcctgagattgcgctaaaattgcatgactctgttacaattcttggataacttttcaagaaccactttggaaaaattattgtacaatagtatctctctggaatccagttttattctctcccagtcacttactttgccaatggcccattagctgtgtaagtgatgtagctcttccttttttcactcatggattacttctgcttggcatatcttctttcaccttgagcagcagtcaaaattttacttatttcttaatattcaacttaaatatcacctttgtgaaaagcctttcgggttcatattattatgatctattcatatttattcagttctctagtaagtactgtatgcataagtaggcatctgataaatatttattaagttgatattaacatatggcttaagaaattgctaattttataatacagtagttttattttttatgcaaacaacaaaagacatcttaaaaagctattcttttttttttgagaaggagagtctcactgtgttgcccaggctggagtacagtggcgcagtcttggctcactgcaacctctacctcccaggctcaagcaattctctgcctcagcctcccgagtagctgggattacaggtgtccgctgccacgcccagctaatttcatatttttagtagagacggggtttcaccatcttgaccaggctggtcttgaactcctgatctcgtgatccacccacctcggcctcccaaagtgctgggattacagatgtgagccactgcgcccggcccaaaaagctattttctttttaagcctcaacaatacatattaaaaaatacaagagaaagaatgtttgttaagaaaaaaatttagacatacaagtgtgcaatttagagaaactttttttctaaaatattataaatttagaaaaattttgcaaacagaaaacactgtagggacaatatatgataagtaaattgtacttcagcaactcattgctttttagataccactgaattatttgcactaatggaggaacattgttataccaacctatttatatttgatccacattttaagattcctgttcagcttatttactttcttacttatgtcttatctggattcttattaacgttagttctcccttacttgcttggaggagaaatcattagaaacatgctgagaactgggagatggccacttcaagtttaaatttgctatgaagaagctaccaataaccttctttcagtctaaattaaggtggcctgtagttttacaacccaaagcatgattgtgggatgctaatttagggaactattctgcagaaaccatgacacaatcagcttgctggtccgtatttagaaccatacttggaaattgtgctcaggtctgcaatttgtaattcatgggtaggggttgaatctagaggtggctgagagttcagccacaaaggtgataaaaggattgggaaagaactatgaaggaatttaaagaaactgggattagcttggaaagagaggaagataaagagcaatttaatcgcaatctttatgtacatagagaagcttagcggaacacagtgaccagtgttttctgcctcacctgaggacaacacaagaggcttaaactgcaatatgagggatttgggataggcataaggaagtatctactaacaagcaaaattggagtagactactgagaaatatggtagaatttccatctctgaggactgaaaatgtatatattctattcctttcgagtgttttaaggtaaatcttgctcaaagatgttgacctgaacttgatggcttcctggaaatccattcattgtgtgacattactgtttttagaagcttcttcatagatggcagggaggagcaagtacaccaatcaagtcacgggcagtgtgatatggagaaaagggctccaggctgagaggcaagggaacttgattgctgtctctgatgtactgcaattagttgagtgttcttatacttgtcacttaactcctctgtgcttcggttttctaatctataaaatgagggagccaacctaaatggctcaaaaaggagtttaaaagtaagaaagcataatattcagtaaacataagctaaaaccctctcccgggccagccacggagcaagacttcttcacgtattatcttctagagcatctcatctgatatagtttgattgtgtccccacccaaatctcaccttgaattgtagctcccataattcccacgtgttgtgagagggacccggtgggaggtaattgaatcatggtggtgggtctttcctgtgctgttttcatgatagtaaataagtctcacaagatctgatggttttataaaggggagttcccctacataagctctcttgcctggtgccgtgtaagacgtaactttgctcctccttgccttctgccatgattgtgcagcttccccagccatgtggaactgcaggtccattaaaccctcgggtatgtctttattagcgcatgagaacatactaatacatcctccaacccattttacaggtgagcaaactgagggccagagagactaagtgacttgccagttttacatagctagtttcagttctgggtagaacccaaatctcctgactcctaggccaggactcatttattttactgagctaggtctttgataatcatgctttgatacagtctttgagaatccattctagtttttctttacttcgtttctttttttcttccagaaatgtttattatgccctactaaatgataggcactatgttaggtacagaatggaactctgatggactcttccaggattttaaattcaaaactcaagtgtttcagttagtgaaggaggcttctggatctttccaggcatgtagatgtctttaaagatgcaatcaggcctcctcgtcacaagtgtgtggccagagatggagaaacaaaagattgacataagtatcctccaaggtttggagtcacttctggctttgcctaagaaggcagtagggcactcttgcctttcttcaaatagtctcttccctttctctccctccaggccccagatatggatgcttagcatgacttaggcgaaacttttccaactcccacaactgcacccctgttctctccttggggtccaaggccagttattcagtttgaagactgcctgggtttaaatcctactttcccacataccaactgttgaccttagattagttacttaatgcattctgtgaaatggcagtaatactgatatccacctcagagggttgttataagaattaaataaaacaattccagtagagctgtgattcttactaaaaaagtaataagtgttagcactcaataagttttagcaatttatattaatatttccaatgtagcgataatactgtcctcctcagcaatggtcccttcagcccagttttgagaccaaacccctcccaggtctttttaaattgtgcttttttcttcagggtccgtcaactggggtatatttctgtttggagacagtgtacagacacttacatattcagattctatagtctgaccatcctaagttcaaatccctgctctaatgtataattggaggaaaccttcctgtaagtatgatgggcatgcctacataacggctttgaaatacatgtgctggccattcatgaatttaattttgttcctttagaaccatttaacagagcatattattatgccattaattattattagtagtaataataatgatagtcattatgtattaagggcctactctgtgttagcactgtgctaaatgttttgcatacattatatctaacttttacaataaccctctaaagtaagttgtttcatcccccttttatacctgaaaaaattgagactaaggaaggtaaataaattgtccaagattacaagctagtaagagacagagccagaatttagtctgaaaatcaggtttctgtagctccaaagcccaaagcccatgatcactataactccttccttaccatctgagatggtaaggacaaggcatcttacctctaggttgggagctaaagatcataatggtttcggccttactagtatgattagcttagtgaaaatatgattcacttagtgaaaatatttatcagcttaatgaaattttattagcttaatgaaactttcattagcttaatgaaaagattttctcttgctggcaaaataattcatgtactgcttaatcaatgttgaatcattattcttactagatttatacaacctatttcattgtctcgcctttaacacagtgtgaaaatttgctgaaaaactgagagatgtcatttttagaaaccaacatctttgatttttttttaaaagaacttagttctattcatcattttgggtccatacctaaaacagctcttgatgtgtaagacatgctttataaatttgtgttgaatgacatgaatgaatgagaattcagtctggttaaaaacagctttattttaaagcacttgatacagtgaaatgagctgtggacacacgtcaaataatctattctctagatttagcctggcattgacccgctgtgtgacttacgtcaagccactatttcttgactggccctcacatgcaatttatcctttgcaaaatgatgggatttaatctaaatgattgctaaggttccttccaggtctcagcttttgcagcttcctatagactgtgaacatgggaatacagtctgattttctcagtgactcatctgggaccctagaaactggcagattgggaaagaaaactaatattctctaaaactgaatttcttaacttacagattataaaactctactttttaccatgtctaaaaattcagtattcgtggaacagctgatattatcttttgctgatgggcaaaattaacaggcacctttgagacctagcttcatatctatgaaaattcattaagttgaaagttcatttgtaaacaagcttctctagacagctgagaagtgattgttctatcttgcattgtatatattttaatcttttgtattgacctgtagtcatctcactggtcaagctaacatgtttttgatagccaagagttggaaaacctggtcactattggcctaattgtactcttggaccacccatggaactcttggcaattagattttcttataaaactctttcctagagggccctttgtggataagatgagcctcacattgcattttagaatagtacgtgctaagaagcagtgcaagtaaaagtgtgacattatagaagatgcctctggcttactcatcttcattatgacaggaatttgccattgtcaatgtcttatatgttgtagaatgagaaagaaatgactctttggagtagatatctgcaataaaatctggattgatctacttacagtcagtttcagagtaggcagtctccagggcactgggagtaactagactctggtctccaggcctaggttcagctacattccctacaaggcctttggcgtgtacctgttcagttggtcagtcaccctgtttccaaacaaaggacatggccctgaaaactatacacaacagggcaagatcctggctctagtttgggattcgtcatgtctttttagttaggcaagccttcaatttaggggacaggatcagagctgtgtcatagatctcttatatctttgtgccctatcttgccctcaagactgcctcatctctttgattagttcctgatgctgtcatgggctaggccaccttcctcatttcctactaaaattttcactttaactaggttgaagcaactcatatcatttctagcatgtcactgaattctatccctgctcttcagaatcagttacactttttcaactaggtatccagcactgagaaggcacagaggagaccaggcctgtagccagttgagaggttacaaaaagcatcaaattgtaggacagtcttatacaggtgactttctcattcagtgtaatgtggattatataagttgaggctttttgattgcaagcaatataaattactttggctaactgaaaggaaaaaagagtaatttttgaaggtatagagagtgtgtcatagaattgaaggaaaagtagaacagattttcagagtaggacatctgtgggagtagaggaaacagaaactaatggtcacgtcaaggcaccaccactggaatgagttcactccagacattttctgttaaacatctttattgtttgactagtcattcagattcccagcagagaatctgactggctttgattataagcctacctcttagccagggaaggccctgtaccttagatgacagtcctaccagcactgcccataataaaggtcaggggtggttacccaaagccaagcacttttggtgttcctaccaaaaaaaggacattcaaaggcaacagatgtctactacaaaatctgttctatgggatctacagtgagggaatagattcagccttacagctaaagaaacggattgctatgcagagatttctgcttcttaggagttgccaaaaagacccttatccggcttaggagttcttggctgtgattttagtgttcttttgtttcccaagtatttttaaaatgtaaatcagtaactagcaagaggcatctttggtcattgtagttgcttggagtagaataaatttaaaaaattctttgatgtgagaaaaattactatcatcattatcacacatggaaggtcaacattagggccagtcattggagttaaactgtcagaagaacatcccagttactttctcacttttgagttgtgtagactgacaggatttgagtctttgagggctttgactagggtaactgacctcaaaacaaatagctagagggatatttctacttctatccgctgagggatttgtagcaagaagccatattgtggatggtatattttaataacaaaggggattttaaaaggaggatgacacattgatttggaatgttttctcaactgtatttacttattcttaaatattttccttcatgctttctttctcaagtggatgaccagctggttgccacctttttcttctctctttgcctctgttcctaatttctttcttatccttaaccactccactttccttcctccaatcttgttttctctctaaatctttcctccaaccttattgaatctctccccttctttttgttatctggtcatttgatctataatttcgattccttttcctgaaattccctcctttttccttttcccctaaaccatcattctagtcctccccacacccaagcttcttatctctttgctgttaatctccaatgtgtttattgacttgtgtgccaaaaggcaaaatccccagccccctcccaaccatgccagtgcattgaaaagcagcagctgtcattgctcaacaagttccttgtgatctacaaatcaatggataagaattctcacagtgaaggtttacatgtatatatttgtatgtatatatgagacatgtgaccatgtttaatgaatggagaaggacttggatcttttctagtagagaagagaagcagaaagctttgcctaaccctatttctttactaaggtaatgaaaaaattatacagggaaaataaatgatgttaatgagagaaacagggacaggagaccaataaacaatcatcaggcatgagaatatcttgctgaacttattattgatagtagacacaggaatgtaatataaatgcagtgatggaacagaaagcagactcaggaaagaaagagatgataataaatagtaataaaatccaagtgattcatatgctcaagtgaaagaaagaagaaagagggcagtgtacacaaagtaaaagggcaagaaaatggaagtagagtcatcactcgtagagataaatagttgggaaatatgagaagccttcctgacatcagtaaaatattacatgttaaacagcaaacaaaagacaacaacagtgtctgtagtacttttggaatataaaagttagataatactagagtagtatcttcaaaataagcaacttcagaaatcaagtccccagtaaagggaattggaagaatttgaatagatgaaataaggagcagtggcaagtgatacaaaccttaagcaggaaaagtgattttaaatggtactggcaggttaacaactggcaaaaagaaaaaaaaagaaaagaaaagcaagatggtgctatatcccccaggtgctgggaaaccaacctggcctaaaaaaggagcagacccacctaactttttgccaagcactgtgctaggtgcattgcatacacttttaatttaagcctcgctgtacataaaagtgaagccaaggtctgagaatgatatccattgggaggaaaaaacaggaaaattttctgagccagttccaaagtcataaggctcagggggaataactttgactttgtcaagtcagagtgaacagccagagtcagcagacataggatattgtcagaggtaaatcaccagcttggtctggtctgtcttattgcaaggtcagaggaccatagcaagccagccaaatgttttcaaccatggaaatcccctaactttccaactgctgcagtcccacagctctgagcttttactcacaggatggctcccttccagctttcaaatctctccaagttgattaatcattttcttgttctgactcattcaggcctctagaaaaatagctgtaggtactggaagggctatgtagatcaaggaggtcagataaattggcttgatgttggtctatagaaaaatctagaagatattgccaaaagcttttaagcataccgtcttcagatgctgggatgtgggctatatccacaggccattggctcattcatgtgtttgaagcagaatatttttgtgtgcattaggagacttgggtatgttcatttcttaatgtaatgttagatattgtaagctggttgtttagacagtagaatttcattgtgaccacttatttttatatctatttagatggagtacaggccagattataaccccctaacaagaacagcaacagtaaacacacagatagtgcttattattagttaagcatggtactaatattttccctaagaggccacattcacaggactgaaatgtcagttctggttgtctgagccaagggcatatatgctgattacattattttgtctggctaatacactttatcatgaagcttattttagaagaaatgttcatttttagatttctgtttgtatatttaggtcatactataaggtccattctcttgcttttataataatttagtcttctgctttattcattcaattcatgaacattcattaagtacctgagtatgctagtcattggagatgcagttgtaactaaggcatcaccccagacctgaagttttatgttgtgttttgtgcttagtgattggcataagtaaaatacttgaggaaacacagaagcagcagcaaatatttctgcaaaggagaagagaaaatatttgagttgaagcttcaagaatatatcaacattttccagtttgacaagggtgggaggagccccatcaatacagggaacagcatgtggaaatgcaaagaggtgtgaaagagcatagtatattcagggtgaaaaaatacattttttatgaattgtagtagaaaatgagccgaaataggttaagttgaggtaagattgtgatgggtcttacagcatactaaggcattatcctgtaagtaatagaagggcttatggaggttttaaagaaagagagtaacttcatttgatttcttttttcaggaagagaattctgatgatagtgtagggtggaaaaaaggggtaacaaaggaaccagtgggaaagctgctgtatagtctggaagtggtagcagtaagaggagaggtgaagggacagatttgagatgcatatcagaagtcaaatgagcagactactgtgactggttggatacaggggtgggtgtttgagtgggacctccagttaggaactcagatgtctggatgggtcatgctgccttcaacaagaaattcagaggaaaagcagccttggggaatgatgaggtcattttgtaacatgttgagtttaaattaaggcactaatgagaagagacattcaggtggagaagtccaatggacgacaatagtatgggtcaagaaagaaagctgagaagtatctgaattacaattatgcatcacttaatgataggaatgtgttctgagaaatgagttattaggtgatttcaacattatgcaaacatcatcgagtgcacttacaaaaacctagatggtatagcctgctatacaccttggctggatggtacagcctgttattcctgggcagcaaacctgtagagcatgttattgtactgaatactataggcaattggaacacaatggcaagtgtttgtgtatctaaacatagaaattaaacagtaaatatatggtataagagatcaaaaatggtatatctatgagggtacttaccatgaatggagcttgcaggactgaaagctgttctgggtgagtcagtgagtgcacggtaagtaaatgtaaaggcttaggatattactgtacactactgtagattttataaacactacacttaggctacactaaatttattttacaaattttcaacaataaattaagtgtaattactgtaactgtttgactttataaacttttaattatttttaactttttgactcttttgtagtaaaacttaaatcaagcacaagagaaaatgatatacaatcaagaggtaaacaggagatatatgaggctgctgctgctgttacatataatattgttttacagtaaaatatttttaatatgtagaaagagtacactgtaaaataatgataaaagtatagcagagtaaaaacaaaccactaacatagtcatttattatcattatcaagtattatgtgccgtacattattgtatgtgctgtgcttttatatgactaacaatacagtaggtttgtttacaccagcatcaccacaaccacgtgagtaatatcttgcactatatcattaggacagctacagtgtcactacatgataggaatttttcagctccattatattgttgaccacgtagcacataactgtacttgaagccaagacagccaattagatcaagcagaagaggagggggccaaggacagtagtgtattctgttttgctttttttcctcttaagagctgagatcttcggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaagagctgagatcttacctgcgtgcatgtgttcattgtagcactattcacaatagcaaagataaggaatcaacctaaatgctcatcagtggtagactgggtaaagaaaatgtggtatatatacactgtagaatactacacaaccataaaaaaagaatgagatcatgtcctttgcagcaacatggatggagctggaagccattatcctaagtgaactaacacatgaacagaaaaccaagccatgtgttcttacttataagtgagagctaaacattgagctaaacatatagacacaaagaagggaataacagacaccagggcctacttgagggtggagggaggcaggagggtgatgatagaaaaacttcctatcagatactatgcttattacctgggtggcaaaataatctgtgcactaaactcccatgacaggccatttacctatataacaaactggtatatgtgcccctgaacctaaaataaaagtttaaaaattaattaattaaacaaataagagaagaggtcttgccatgttgcccaggctggagtgtagtggccatttgcaggtgcatttccgctactgatcagcataggagtttgatgtgctctgtttccaaactgggcaagttcaaccctccttaggcaacctggttgtcccctgctactgtaacgtcaccatattgatgtcaaatttagtgaggatacctgatcagcattgtgtcctatagcccagaactcctgggctcaagcaatcctcctgcctcagcctctctgggagctgggactataggtgccaccaccatgcctggtgagattgtgtatcaaggaatttattcatgctatatagagagttttaggagttcaccaacagggttttacaaccatgtttgttgtttttatggcagaacacactttggattctgttcttcttctacatatgactaacagactttttaatgaggtctgatgcctcaatcaaaggctagtaaaacactgaccccttctaggccattatctttgtgtctatttggggaggagttggggagttgttctctgaaacgcaaacatgtactcctgctcagctttccctggctgacctggattccaaatgactgttggctcctctatatagatttgcagacatccacacaaaggagtgtcatttgtatgcagccccttaactaattgtaacagtctgttccttaagtctctgagaaagcacacaaattgattccccagcacttgcctatttttgaggacacctgtatgacccttcatcaaaccagctgacacattctgcctgcctttattcacctgctatttcaattatgtgagcagtgatgtatctgtctcaaaaatctctgtcctgggaaatttcttcagaagagaattattggaaaaaaatttttttgctgtggagccaactcagggctttaaatcttttccagcctacagagcacctggattcaagtgtctattccctcctgactctggaagaatgagttacatcttgaattgaggatcataagcacattgagaaactatgagtttatttcttcctgctgttaactgaagcaatgaaaaataaacaaatctagatagcccagagccagttttaagtatcacaagatggggcctagcaatgtactagaacttaggagccttagtttcaaaatatttttaaaaactttattgaaacatagttcacataccatcaaatttacctatttaaaatgtccaattgagtaatttttgtgtattccctgagttgtgtaactattgtcattatcaagtttgagaacatttttactcccaaaagaaatcttgtacccattagcagtcactctgcatttcttctccttactccccatcccagccctaggcaaacactgctttctgtctctatggatttgagatttttttctgctttttagctattataaataatgctgctgtgaacatttacatgcagtgttttacatggacatgtgttttcatttctcttttttttttttttttttttttgagacggagtcttgctctgtcaccaggctggagtgcagtggtgcaatctcagctcactgcaacctctgcctcccggttcaagtgattcccctgcctcagcctcccaagtagctgggattacaggcatgcaccaccacgcccagctgatcttttgtattttagtagagatggtgtttcaccgtgttggccaagatggtctcgatctcctgactttgtgagccacccacctcggcctcccaaagtgcctcagcctccgaagcatttatcatatgaatatatctccgagtagaattgctgggttatatgttaactctgttttcttttaacattttgaggagctgccaaatcattttccaaagtgaccacaccattttacattcccaccatcaatatattgagggttctagtttctccacatccttgccaacactttttattgtcagtcttatagccatcctagtagttgtgaagtggtatttcatggtgattttgatcagaaacatttttcacaaaatagaattccttagtttagtttagttttgttttgttgtttttttgttttttaagatgaggtcttgctctgtcgccccagctggagtacagtggcacaatcatagctcactgcagccttgaacttctgggctcaagcagttctctcacctcagcctcccaagtagctagtactacaggtatgtaccactgtgcccagctaaattttaaaaaattttttgtagagacaaagatctcactgtgttgcccaggctgatctcaaattcctgccctcaagcaatcccccttccttggcctcccaaaatgctaggattacaggcatgagccactgtgcccaaccatatttattgctttttacaagaaaaagttattgataggttatgctaacccttactcatcactgtaacactcagcttggtctcaactcttaaaaccagaccatataatgtaatacaatgtatccctgcgttgtggtctgtggaacacctgcaattaattctatcagtttggggttgatgtgatactggttaacaattcagattcctgcattccaccagggatcagaatatctgaggttggagtgtgaccttgggcaagatgtgttgctcttcttagcctgtttctggatctatatcagagaactggtcatgatgatatctctgtccttttcagctgtgatgttctgtagcattctgtgaaccactatcaggagacactagttctacagaaatcttgggaccttaacaacaacaacaaaatgacaaatatttatcaaatagtcacagcatataatgcgctatactggttaccaagttcacatagataactaagctgtggcccttgtccttgtagaaatacagcctcctggggcccagataagacaactgttatctgaggaaaacgcctccactccctcctcacttccctcctgggcacctggggggatgtggttagacacctgtccttcctatggcatttctcctgcttattcgccccttctctgactccctttctcaaggtgtcaccaataccagcacagccactcttgatggtattgagtttaccaaacactgagaaatcctaagtgtgtcaagtcagcccaagaacacttacaaccctgctttctgcctgacatggaggtcacaactgctttctcatcacacgctgatcctccagagacggaagcagtcatcctgctccagcctcagcctctacttcccaaaaagctgtccttctccacagtcttttttttttttcttttttaaactgggcaccaggactccattctagtgcctgactttgatatgttttcttcaactcactgctctcttcttttgttcactgttctctgtcttcttccactcacctatctcatcagcccagccctgtggtactgccccagttctgagaccctggagttccctttataatctccaccagccaaaagaaccatatgaggcctctttacctagcagactcttgatataactatcagatattccaacaatctcatttcagatactttccattgtccctttaagtatacattgctgacaagagccctggtttttagttgagaaaatcaggccagtataactgtaatttaatatctaaattaaaaagtgaaaggtcttaggttggatgtgaaaaagctacattagtcacattgttttgggccacaactgttccttatttttacacagtctgtccatccagaaggccactgtctgtccatgagaacatccacgaaggcatcagagctgagagaccttctcactaaatgtgacactgacactgtccaggagccgcagcctcactctatcagcagctgaggtttttatagggtgcccctattaccctgggtgttgtatctaccattataaagactgccttggatctctagttttttttcatctcagaacagacctcattgtgtctatttggagccccagcccatgcctgttgtgtgtgtaataagtgcgatgacttagaacagcgcctttcactccaggagctggaaacctttaacaacctcaactccacttccttatacagccacttagggaaggacagacaataaacaggaacttctggggattgtctgttcaggaaaagcggagagaaaaagaagacatattttttacttacctaagatttcattagaggtgccttactaatcaattgccaggcagttaaaagtgataaaggatgattctttatctaacgaaagaaaagccaactgaagtttcagctggctcaggaacttgcttttcatggtgaattgctagtagagtaagataaagcgtccagagtacaaaatgcctcttgttttcatgtggcctgacatttgttcatatccctgcccttgtttacttctcaaagaaacaggttctattcccgtagtcgtcccaactcactcataggtaatgccagactcaaggacattagcccaaggaaatttgccttgatgtttttcttcctgaagaaatattggactgttttctatttcttcaagttatgctatcaaagaaagaaaaattatcttacgcttttgttgggtaagtagggaagaagctgagaaggaaaaggaaaggaactagcatatgctttgcctcatgtactaggctaggcactttacctacattatcttattaagctaaaataaaaccaaattcatgtgacaagtctgcaaagcaaagcaattctagtgagcttaccatctgtgcttgtttatcgtttgttagccagtagctgtttggatgttatcatagctttcaccccagatatctacctgggcctagtctatgactttttcttgtctttccctttaaaatgtggctctgggaggcggagaaacccaacgtgtgtattctttcctattggaagctgctatacgtggttggaacctagaatctaaaaacttcttctctttccttttttctcttctttcttcctttgttatgagaaaaacctgttctctttttaaattgtcaatcaggcgggcgtggtggctcacgcctgtaatcccagcacttcgggaggcctaagcaggtggatcacgaggtcaggagattgagaccatcctggctaacatggtggaacaccatctctactaaaaatacaaaaaattagctgggtatggtggcgggcgcctgtggtcccagctactcgggaggctgaggcaggagagtggcatgaacccaggaggccgagcttgcagtgagctgagatcgcgccactgcactccagctgggcgacagagtgagactccgtctcaaaatataaaaaaataaaaaaaaattgtcaatcatggtgtcatgataaaatatttcgcttcatcattttggctaagtctaattaacataggttccatttaaatttaaaattttttagttctcaggttttattttttttttaaatagttaaaaagtagtttctgcccatctccctgccctctccctgcaagcagtccagctcatgtatgttttgtctaccattcccaagaccatcaaatgattcccctgcccagtcatgtctcccttcatgaattctggtgccacactgagtttctgtcctactcctatctcttttgagctgtgcaaccttgggcctacactcagtttccccatctgaggatacttattgggttgttatgaggattaaatgattctggcagtgtctgccgggtctccagacttcccctgcttatgttgaccctgtatacagctgccagatcagtttgtctcagcctggctatacctcagctctgaagcttctctggtttctgccacctgtgccttgctatctgagccccttccaggctactccacactaccctttccagatctgtctctcactaatcttcggcataaacccttgtcctccagccagcctggactagtaggatttctgtaaagatgcatttgttttcttcactttagacttggctcagtccatcctgtttgcccagaatgaattcttttctcatcacacttcaaggtacgctccgtagctgtcctacccagggagtggttggaggtgactgccaacctctgaacccctagatagtctatacgtggaccgcacttatcacagattgcctggaaatagaagctactaacacatcttgtttccctgtgcaggttgtagaccccctgaaggtagaaagtctagtttttcttacatatcagtgcataataaaaatttgttgaaaaaataaagctccttttttcaccttttcatctcctcattttgaattcagtagtttcctctaacgttcaaacagaggaaggtagggtacatagcaatcaggactttgccttacttcatcatcatatacttttcaagtacctgctaagtgtttaaaactgtgctaattgctggggttaagaataatattatagccacaatttactgagcccttcctaggtgctaaacgccatgctaaataagtacttttcacacattatctcttttaatatttgtgacaaccacatgaggaagatattattattatcagtatattattatgtaagctctaggtcagagaagttagtagcttactcaagatcacccacctagttagtggtagagcctcttaattatgggatatgatctactcctggacatgatcttgggcatggaggccctagaaagcttaagctcaccctaaaggagctgatgctagaggctgtctgctgatcatactccccataggaggacagcaagtgcttccttgaaggaggctcttggcaccacattttaatgtatactatactactaataataccataagtagtgtgtgcatcatatattatttattactgttattaagatgtgctctccggaattaatttacatctaaaacctgggactatttaaaacagaaattttaaaggaaatcgatacccgttgccttcagattgctcattgctttgattcacatatgataattaatgatatttctctttttttctagctagggaaatattttcaagattattaaattttttaaacttgcgaaggttaaaaaataaagcattattcatatttttccctattgtaaacttttttatattatgcacacttttaggcagaaacaactttctgcatgttaatatttctaatagtttatctttttggttaagtcatccagcttctaagaattattgagtaacatcgctattaaattgtcatggttgatgttattttatattttccgagacctagaccttgctgatttttttgatccaggcttttccttccttagggaatttagtttccctttgttcacttatttatagctctgctgtgggtatggtttggagccttggtttttattgctttaattgcttggtagtaattgacacactgtacacattccaggccccatgttccctttacatatgaattcacactacttgatgactcaaataggctataatgaatcccctttatcctgggatatctttgagattctgggttaccgtgttgatctgtttcctttaaacatggttctggcagtgttgccctactggaaacaactgacctttcatttctgctggtatttcatcattatgggtgcatcccaatctaattatatgttgatttgtaatgaacagaggcttcctctcatttaattttctgttgactttatattccctctgtttggaaacctccaagattatggtatcagtttcaattttgttaaactgatgtcttttcgtgatgacctgcttccagtgtattacttttttattcagtgattctatcaaccagtgttatctgttaaaaaaacaaacaaaaacaaccactgatatgctggtgggctctatgctgtcatctaaaatgttatagaaagatctgtttgtattgttattgttgctgtgaattagtccaatggcctacctactatataagatatatttgaccttaggagtgaaaaaaaaaatcttaacgggaatcctcactgaagtctgatttgggtacaataagaattcatcaaaaacatagaagctgcatttcctaggaaatcgaggctttttcctgtatttgggagtggtaaagaatacgcccaagaacttggaacagataaagcattggcagacaaacaaaagatctgtagggcaggacttcctttttattctcctgagctctctttcccattgtttcagagaagatggagcaaacacccagacagaagctgcttcagtattgtcttctattgataggctgcttgtgttcagtgattcctctggcccatagtgtctgctggacagttggaggctttttgaagccattgtattgttagagaataattagagtgaatgaaacagtgggtaggggttaacaacaattctttgttgcaagcaattggtagtcttggcatcagtattggtaacaaggccaatctactggaaggaatcgaaacaaaagatggaaaagttgtggttggtttgtctgatccatccagcaaatccacccatgcatggccattgtgtcctgtgagctctctggaaatgcctttggtcacactgcattccaagccacggggtgggtaatctctgggtagtcttgtacatggatttcctagactttcccataacaaaaatggcaaggcacaggtgttgtcttggcaattaatcatacactttataaagaaaacaatgtcctaacatttgggtagatgaatggcatggtagaaaagccccatgatgtttcttttggaaggagggttaaagaatgccgtaacactaactagctcagatgtgtctattgataccaaggtgaaaacatctaggcaaaaccataatctatgtcctcattgtctcctccatctcctccagacctaccctgtcctcgtcctaggagtttatattgtgatctagaggaggcccagccagggtggggtctaacaaattggggtgggtataaatttagtacttcaaagatagtggctcttattggaaaactttataagctgaatgcctatttccccctcactaatttggggaactgcagctgctgctaaattctgagtcaaatagacttgcaactatggttgatcagatttgtgatgtattagtaacacatggaagtggtgccttatgtcggggccctgggttcctactggaaacccatcacttagatttgtatgatattggtatgatctgctagtgtgtgatgctttgttacatcctcttttcaagtcagctttccaccagagcttcccaagaacagagaggcctgcctcaaatatttggttcaaattatgcaacataagttaccttatatctcttttcctgttgcttatctaaaaggacagagactcagaggcagtttaaaagtggaggtgggcatatctccaaggcgatttatgactttagacgcatatccctaaaaggcgaattcctgctctcacaagttgaatagggctctaatcccacaatctgatttaggccaagaatgacttacatttgaaatcccaaaccaagactgttcaagattggtattaaagtcggagcaatgaggtggaggtagggttcacctccacattattctgagaatgggcctgaccctcatggatctgtgggtgtgaggagtggtggttgtcaggagccggggaaggtagtgcggggagtgaaggaggggagacagcagtgtgcttattttcagtttgtcagctgctctggaaaatggccaaaatgaatgagatacaacaagccttcagggctgctgtaagccaaggagagacaaggcccctccttttaaaaagctctgtggaatttagacttaaagttttatatgttattttgtttagggtaaatgtgaaatccctaaacactccccaggaaatgttagctcccaggaacacacagtgggccctaactccctggacagaagtacgtcttgagggagaaaaaagaattcagcaccattccatgaagcctcctggctctgtttggccatgggagaaagattgatgagaaccatgattagatctgtctctgtggcctccagcagattattggaaagccttgaaaaaaaaaaatctttttgacaaaaaaggatagaagttccagtagacaggggaaagaaaagggctaaatcttccaggccaaaatatgccagggtttgtacaaaccagggagatggagcaaagctgagcacttttatgagaagaggcactggcatcaatctaaaggagagagaatctgggacatttaagaaaagggggcttccatgtgggaagaagggcttgtgaacccagtgtggttgtgaattctgtaacggaagtcaccagctgggctttttctaggcaggagttatcttctttactggcaatcatgttccaagtttaatctctcctcagtgtgactttggtctcacgttcacatcatgaaaactccaggctgttttttgctatactcctgagtaatgttgacatttctaaggagagaggaaatctggataaatagagttcttttcttggcattgttaaaaatattactaaaaagagcaaagggtgttttcagagctaagtggaagtaaagtctttctttgcaattttgaaaggccaggtaggtggctgggtacgcactttcttgtagcctgtttgttttagcccgcagtggtttctgagcagctctaagttctgataaaggacacaaacacacccatgctacagtggccatctcacttaatgctgtcttttctatcctgtgactgaagagcaggggctcttgttcatgcccagtaagaagtaaaccctgaactaaacatcacacactgagaatctcttcataatctaggcacagataatctttaacactaaactactgtgaaattctaccagcattaagtactgtatattgccctgtgcttggataggctggctaactcgtaggaagagagcactgtatggtatccttttgctttattcaccagcattttgggggaacatttcttttacattttaaataaaacttcagcttgaaaaaaaaaatgtatgtaacttgtaggacatttctgaaaattacattatagctagtctatcacggattttgaattgtctttaaattttgctatcaaaagcagaacaacaacttgtcatcatagaactggaaggcatggttattttgtttacctcttactttttgcccatttggaaactgaaattgcttaaagttacatagctagttagtgcaggaacggaaatgaaaaactatttcctgatgcctggtttatcacaatggaaggctctgcccacaagaaggaaagttcagttcagattccctgtaattttaagaactttcatgaatatactaattttagtagaaacaactaaccaagatggcttatcattctcaacggaacataattttaaggagaaacacttggaataatctaattttaaactgtaatgctaattctttattagtctatttgggggattttttatatgttgcatgacatacttgcacattttcctatttaatacttcttttaatcctgaaagcacttatttaagaatgatcactagcactccaggacaagttaaatacagaaagccatatacatataaatggcagacataactgcaaaaagagaacaatatagtgagggaaatggtcttcagggtgctgcaaagcgctttatagttacaaaatgccttcatgtacatttctaattgatcctcaggacagtgttgtaaaaggaggaagaatgtgtgtgtaagtgtacagctgttttccagaacaccaaatcgaagctcagagatattgcacaactcaccagcacagcgaggaagctactgaattgggactcacactcagaccttcaccccaagcccatagctcattttattacttcataatgcgttagttgcagaagtaataatactttaaaaagcaatccacattttttctgtttactctttcctctcttcttcaggacagaaactgtactttccttgtccagttccagtttgtattattgtattcatggtatttaccttacctggagggaataggccttttaaatatcattaaaattgggtttttgaggttatgttcttttctccttcacatcctaaacttcagacctcatgctctttggccttccattcaattcaaatgagaagggctgttgtaattgttggcaatgcctccccaggctgccactgtatgtgaaggatcttcatgtttggaaagaaaaaaaaaatgcagtttagtgaagttcatgattctacttttactcttctaacatagccttttttttttaatttatttgtttgtttttacatgtaacactaggtggcagaataactacaccacaaagcaccacatcctttgtttctcactactctggggagtgggtatctgaatagtgaggcataaaaccatctgtggctacatgagattggaccaaccaacaaggccaatattttcttgacagggaactggctgcagtgattctaaaacgtatgcttccaagatactgtctttaagatttccatctttcttttttccccagctcccctggattttaatttctctgccccattgcactctgctagcagagggcggacacagcctgcaggcagctgctttgaaatggcagattgggatggatgtgcccattggtgctggcaccctcgcctttgtgtggcagtgggtcatgaagggtctgggggtaaggcacctgagtccttgcccgaatggcaccaggccctctggcagaggggcagcagtggctgggctgagtcagttggaagatgctgccctcactaactcaggtttacagaacaggtgtttttaaagagcagtctgatcctggttcagctctgtcaccggtttggaaatactgccgtgcagtcggtgggtcattgcctctcagtttcttcctagcaatttgctggtgtctgctaccctggatgcctcacatgccacaggacacactaagctaaataaagcagagcaagttctgtctttcatgttgtgaagagtatgaacttgggctgcggaaatacttctttggatttttgctgaaaaagaaaagaatagcattaaaacaaaacaatacttaccaactagtaataatactctaagtataccctacattaagaaactcctgtaaaaccaagtctgaatgtataaaatcgatcaaacaaaaaggttgtattttaattacaaaagcgttctttgtaactggaaccacaatcggatttcattaaatagtgagcttctgatgtgaattgtaaatgttttaatctacaaaaaaaagtacttaaatcttgacttttcaggaacccacttgttatataaaacaaaaaccaactggactatagttttacacacatacttacatcacaccctcaccactttccgactgggaatcctagagtattttttagtgtttagctggaggtccaggtagtgtcctaattttgcacacacagccctggtgacatgaaagggcattgttgaaatgaccaagtgagtcatggtaatcagggcaatcctgtaggttagagatatgggggtcttgtttatttgtttgcctgctagagctgcaattctttcataaactacatgacttttgaaaatacctcaaacaacatatataaatcagaccaaggatattaatctcaggccaccgccatagtgaggctttgaagccaggggaaggtggtgagaccttcttgtttgttaaggaagaaatgtcataaaaattccaaagcaggactcaaatttccaggggagagggcctctttattgtttcctctaatagctgctttggcgctttagtgaataaatgtgttgcacaaagtaaccctagatgcatctgaactttagtctggcttggctcccacttttgtatttagcatccattctgaattatttatttaagatatttttgctgttgtttgtcactccttcttcctgtctccctaccagtccccctcattcgtcctgtctttatttttacacttctctaattaattgatatcttctgctcttagcactgcagcaaatgtgcctgcatttttatgtggatcttcactatgcaggctatgcttttaagtttctggaatagaatgatggtaaaaatgagtcatggcttgtttctatatttgtttctgagtcaagaagcttaattttcttactataatgcctgagatatcaagctatacagtttacttttaagggaaacaatcacaatttcatcaattcctttaagtagatgttttcaaatattatagaattctttggatttgtgtttccaaaatgaacaacacaatggtagtgctattattgttttaaggagaaaaagaagcatatccaaaataggtaaaatcttcccctaaatcccctgggaacaggcctatgggtgttgccctggcctgctcacagccccaggacaaccggcattaattcactgagggcctcatacctacatctcaatgactgcttaaaccagatacctgagggtctggggtctaacagaagaaaaaaggagagtagagctgagggttatggaacattcccaggaagggagagaatatcagaaaatgcaagactgccccagtgcagcagcagtgatgcagccagaggttaccagaagttctggcacctccaccttcatggacacaagctgtatatatcagtttaccatggttttcagtgtaaaaaagcaacttatgtccttcagtgtcagtttattgagctcttcagtgcagcctcataacttatattaattgggaggaaaatgcttccagagaaaggagagatgctggacaaaacaactttgtctttgactagttgtcaaggccctgctgtttggagtcattgacaagtccttgattcttgtatgacagatccaggggaaaaaaagaagtgattcatcttcttctgttgcacctttcaaggaggaattaaaaaaaaaaaagattttgcttatggacttaacatcactggcagcagtaagtgggctctgactctttgcaaggtataatttaccattgtgctcctccctcctgagtttatgcacctcgatgagccccggcccattaaaattccttcttaaaagcaggaggtgaaaagagccaagcgtgtgttttttttagaggagagtgtagctatacaaggaaagaggtcccagtcctttttctattttaaatgctggtaaacaacttgaaacctgttaaagcttttgaaggaatgtggaggagttgtccttttgactctaatgttggggaaaacaaaataaaggaaataattttaagaaaagagactttcccatgatgagctttagtctgaagcatcctgcaggtgtcacatctgttcctctaggtgtgcagattaatttcagttgcctccatgtctgctgggtccattatctttgctcggctgggtccaacatctttgctcatttctctactgaactttttccaactttcagtgctgtgcttttccatctcagcccttgtcaaagtatgaaataccatttgtttgatggtgagacagaatagtgttgtttaaagatgacatgctaatacagttatgtaaaaattctccattttgtaatgttacaggaaaaaaacaccagtgtccgttatgactgaacaaagttatcactcagccatgttatctcagtcatgcacatcaagattgacctgtctgccatttggggaagccttcataatttgtaaggtgcaggaaggaactagttttaattgagatttaagaggaatgtctttcacagccaatagcctttctttttgagtcccttatttctaaagggtcttttgcaacttgtacaaaagagcaagatccttcattcctcttttaatcctacagcctgcaggagttgagtatacctataaccaggcagctaaattttgaaacaaggtggtgaagtttaaaattacattttagctgtggaaatttgagctttagagaatgattacgttctgattgtcttggaaatattctctgtatagagactcaaatgtgggtcttccctattatttatcccaacctcttcagaaattatatgaatggaagagggagaaataagagccatctaaaattatgtaaatctagctgggatgtgtatttttgaattgacatttaaatatggtcctagcttatattctggagattcaatacactcctccaagccttactttattccctacttcttcaccacccttccgtccatcactcatacacacatgtatgtgcacacacatgtcttttgccaaacaatggagaaacatacatggtattttaatagggtcacacttatataaactgttttgcaacttgtttctttttgtataacaacattgcaggaaaaaatacactttattcttttttaacagctgcctattaagtcatactgaatatatacatacaaacccatttgttattgatggatatttaggtggcgtctaatttttcactatttcaagcaatgtttcactatttcaagcaatgttatatgttctttttttcttaaaaaaggaatgtagccaggtgtggtgactcactcctgtaatcctagcgctttgggaggccaaggcaggcagatcacctgaggtcaggagttcgagaccagcctagccaacatggcgaaaccccgactctactaaaagtacaaaaaaattagccaggcatggtggtgtgtgcctgtaatctcagctgctcaggaggctaaggcaggagaatcacttgaacctgggcggcggaggttgcagtgagccaagatcatgccattgcactctagcctgggcaacagagcaggactccgtcaaaaaaaaaaaaaaagaatgttcctcattgtaaatttggtcaaattctccattccaaaaggcagaaaaatataaagaagaaataaaaatcacttagtcataattgtctatccagagatacctttaatactgtagtatatttatttccagattttttcagtgtatttgtttattaacaaaattggtatcatgccatctgtagctttttttttcatgtaacattatacttaagatatttcctcacatccttcaacctttcttttggaaaaatttttctgtatgttgtgttttgtcttttgtgaatgtttgtttagttttctgttcttcgcgtttctattggaatgttaatgtgtgtttttgtattggcttatacagtaaggctattaaccttttgtctcatatttgtttcagttatttttcccagtttctcatttgccttttaattttgtttgtggaatcatttatatgcaaaagtcttacattttttgtataatcaaatatgtcagcatttttctttataatttcttttaagcaaaacacatttctttaaaacacataaaatggtagctaataagtgattttgaaaagtttccattattattactacagcttttaaatctgtatttatttatgctttacagtaacccccctgtggggtaggtaatgttatctccgtttcactgataggaagttgaggcacagagagtaatacagatagaagtgacataaatgagattcaaactcagggttgtggacagtactcttactcactaaatatattgctatatattttactgttataattggcctcaaatattatcctgctctgtcttaacaattactaaaaacgagaaaaatatgcatcatttattctagtttttcaaatagttttataattaactctattttgtctggatcttatcttgatgtgcagtgttaggtgaagctcatatttaatttttctatttgtcagtgtccccagtatattagtgcctctttaggaacttggaaaggacttgccttctctaagaagcctttgtgattagtgccacttcatgttacttgtttctgcaattgtttatttcttcagaattgttggtttctcagcagctttgatctgaatgattttgtggaatctcatgttgctcctagattaaaagatttattttaaaaaaagaggtgctgtctcttcaagtcgtttcattctttacataagaacagggtgggaggttcttgtcctagttagcatcagcccctctcccccaaccctccacagtcagcagatccatgaatttagatgagaggaaagccacatctccattttcactaacctttaactgaaattgattatttccttcaattttgattgtgggcaaaaaaccacagtagtattagctgttcctgggactttaaaccacagatcagatagttaatcttgcatttcagttgttccaggtacctttaaatattctttatacgcatcactactttgacaatattgtagttgatccaccactagattttgccattaatgcattaagaagcacattcattaatatttcaaatattcaaagctattttggaaactatatttctataaaattagttttctttgtaatcctatatgttttatttacttaaaagtgtatatattttatgcacttagaaacatttttctgagaagggcttataggtttcaccaaatcaccaaagggatccatgataaacactgtgaagagttcttgtctgtttgaatacaaggcataccattgggccttgtaaattacccactgggtactgagtaatcaagaggcaatttaggaggagctggaaaatagtccaatatattcctctctagtgctttgattctttcacttctggaataattctctttatagtcctaaagagaactgtgtattctctttttctccatctcctttgcctttcatcctccccttttcctctttttcacttagtattttctttctttcacatgctcccttttttttctttctttctcattctcttcttccttgactttgctctttttcccttttcttcctcttccttttcctctctccccactaaaaacattaatatcttacggagtttgtgtttcaactattttcagaaaactttttctctttgtggtctaagaaagagttcaaagacagagataaacaaaaagagttgacagaaagagttaataatatcaacaagaagttgaaagcaagatttgtcaaagataaacataaggtaattatctggaaatagttgaccttagaggtcacctgcctggtttgctggtctggcccctgggaaagcccttgtaccctggttctggttccatcattccaagtcctactttcataccttagttacctaattccttttataagacaatcattcacactaattttcaaagtcccacaaggagggacttgttttgagacaatgaggcaattagactgtattgttgagttacagtcatttctttgagattagttcgaaagtatatatattcatggacaaaagttatcacataattttctcacctaaagtggaacttttgatacctgtaataagttagtagtttctcaactgcccataccatgatctcacctatctgctgcaatgtaatagtcattgttcatggatgcctatttatacaatgtgtattgctacagagcttttccttcttaaagtaatttctatgtctgggatgatgccatttttctacactaaaaacattagctcgtcttacagctaatataagctgaaaattagaggtgcctgggggagggaaatgaggcagatggattgtttacatgagtgctatagtttcactttttatgcaccagtcaccttggaaaaattaatgccctgtaagtttgccaatcagattgctccagtcatctctaaacattccatttggtttattagaataataaatactgtgcaaaaaaagttcatctggatccaggatattatactgtggtcagtggaagaaatatgtgctgcaccttacctctgactagatttggtcaggtgacacagtgagcttgacaaagggatacagatttaccctatttgggtgttgaatctgaggactagtcactggagttacagcctttagaaatctttgtcacctgtccagggctggtgctggtggcctcttcactggccatttctgtcatgcacctgaccatttgatgtctgctgagtggtctattaagaaaggattaaaggatctctcttcatccttccaggtggattcgggtgtctgtagtcacccagaaaagacttactggaaagtccattaaaggtgtcatctaatttgatgacgatgactctgaattaatttcagttggggaagcttccatttttatgtctggcttttaggtccttccatgatatgtcccttcttgtctcatcagactcattccagtggatccccaggaacagctctactgctctcagcgaaagaggcctgaagtcacactgcttggttgatctgtcgtgacatcctaatattttctctcaaactgttttctttcgtcctgtgtaaactttgctttttctctgaggcctatcctagtgtatttccaaggccccaggttaaatcccacctccttcccgagcctttcctattgtcttactcacttcaccaatctctcttgcccctaaccttctacagttctgaaacccgatacaaaaagaaaaacttttggcacaggaagcgattgaatagaatcagataaatactaaagtcataaacataaaatctggatttattcatataagggatattaaagttaaagttaatatacataagtatatttcaagagcaaagctcatattttaacactttatttctggagtataggttccaggaaaaaggaataaaatctgtaatttttaaaaaggcaattacagaatgtcccctgcactaatcaaattaattgcagcattaaaacatggatggactttgaaaacatgctgagtgaaataaatcagacattgaaggataaatgttgtatgattccacttatatgggtatctggaataggcaaattcatagatacagaaagtagaatagaggtttccaggagcttggggaaggatgaatggggagctgttttttagtgagtacagaatttattgggaataagaaaacattttgagtagataatggtaatagttatgtaatgttatgaattaatttaatgtcactgaattatatactcataaatggttaaaattataagcattacgctacatattttaccacaattaaaaaagcaatggaacaaaaaattaaaaattaaaataaaattaattgcaccattatttgtaaagggaaaaaactccttcagtgtctaaaaatggaagaattaaactgtgacatgtgtagtatactatttatgctcaattgataatttaaaattaaatgattttgtatattaataagaatttttacataatgttaagcaattaaaaacaaaatataaaattattaaaatgtgtatatatggagcaagatgagaagggaacatgaaggagtgaaaagagtttttgctaagattgcgggattgagaaattctttaattgaaagatttctctcttaacagtattataaaactccaaagtttattatataaatatgttaggtttcatagtgttgttctctgtgattgtttttgacatcttaactcaattgtaaacttcatagaagtggagtccatgtcatttatttcttccataacccatgcttttaaaatggtagagaaccacaatagattattaatgtttttaattaatggatagatttattagttatggagaaagtaagtcaaactagagcataggaactgacattttttgaacgcttactaagtgccacacattatgctggatgtttagtatagtttttttaatttgaatattcataaaaccctgagagaaatgtattactaatcaccttctaatgatgaggtatctgagattcagaaacataagtgagctgtgtgagtgatatgattagtcaaatttgagaccaggtgagtaatcccagcactttgggaggccaaggtgggaggatgacttgaggccaggagtttgagaccagcctgggcaatatagtgagaccctgtcaccacgaacagtaaaacattagccaggcgtggtggtgttcacttatagtcccagctactcaagaggctgaggcgggaggatcgcttgagcctgcaaggttgaggttgtagtgagccatgattgcacatgccagtgcactccagcctgggagaccctgtctctatacacacacaccacacacacacacacacacacacactctctctctctcacacacacacacacaatttgaaaccaagtttttattgtttttggttgatttttcttattccagaaacatatctctttaactagtaatatgttagtgtaaccgtggaacattgcgatggtttttgtgtcttaaaaaaacttaaagatgctgggttcatgactaataaaatggggtgtgtgtgtgtgcgtatgtaaggtatcaaacaatgaacactaatgaacactgcaccttttccaacattgccactcaaggacttcccacagactgcctgttatttgggggcaggtcatgaccatccccatgagatagtttactagagagcattattcttcctctctcacacattggtattaacttagacttttgtggtcttaaggaataaacacccactcaagccagctcagatgacaagaaagttactgcaaagaaagaagaatcttctagaatatcaagagcaggagccttcctgtgtaaaaattctggagcctctactgccggtggcctaagtagtcatttttcagaccagagtgacctgtccctagtcaaggttaactagactagaattaagcaactgagtcaagggcagaaactaaggggagaatttgccagtggcaggtgggcttgaaagaagctgctcagacatatttgtgagacatgtcagtgattgaggctctgcaaattcctgctgctgaagtccagcctccagtgccagcttccacaaagctctgccctgtcatggcccctgttcttgaacgaaatgcaaagcaagggaggatgatttaaaagctctcattgttcaattcccacctgtgagtgaggacacaggaaggggaacatcacacaccggggactgttgtggggtagggggaggggggagggatagcattaggagatatacctaatgctaaatgaggagttaatgggtgcagcataccaacatggcacatgtatacatatgtaacaaacctgcacgttgtgcacatgtaccctaaaacttaaagtataataataataaaataaaaataaataaacataaaaaaataaaagctcagagcacaaatagagtactcagaagtttttgctaggttatcatgtgtaatttaacaagatggcatttatcttttttttaagagactgaagaagaattagacaaggttagctgtgtaaagccagtggtaatctgccacatgtggttataaatggccataattttgtatgatcccaaagcaagatagatagcagattaagggtcagcacagatctgcaagttgagctcatggcactttatttccctccctagccccttttctagtgcttaggtagcaggcaccagttaagcatggtgtcttgaccatgatactgtggaccaagcagcgatatggctatggctatatcactgttttgcctgagagtcatttattccttcattatatatttattgggcatctactccgggccaggcatgtgttgggcattgagaaagtggtgaaaaagacagaggtcctgtcctcaaggagctttcattccagtggaagaattcagataatacacaaaataacaaatatataagatattttcgagtggtgatatatttgaccagggaaataaaactaaggaaagtgataatgggggggtgtggagactggctgctataaaatgggtgagcagaggaggcctctatgaggaggacttgcattagctgagacctaagtcatgagaagcatccccatgggtcttgggaaaagtgaggaaaacatattcaaatagaaagaaatatctggtgcaaaggctctgggataggagtaagcttagagtatcccagaacaaaaagagggccagtgtggctgagagaccgtgtgtgtgtgtgtgtgtgtggagaggggaagacagcgggggtagagatagtaggggagtaattacctcacaagtttcatggctgacacctctataacaaaggagattaacaagagaaaagcatagcacatttatttaaccaaagttttacatgatgcaggagccttcagaaattaagatccagacccaaggaaagctgtattattatggttaggtttgatgaagcatggacagtcatgtagaagtatagttggacaaaaagcagatatgacctaatgatgataaactagggggatcttagcaaagcctgtttgtttagtttcttcttggcctctgtgtttaacattccatccctccgggtatagtcaagacacctgtctcatgagggtcttcaagagagaaggtcagagagacctttttgcttctgcagttttcttaacttccttcagcttaatactcagtgcgccaagcttccatatttgggggtagcattttctgcactctatcatgctataagctgattttctcacatttagaggaacattcaacagctaacataaacaattacctgatgtcatatttgaagatatacttagataataaggtcttaaaaaacagtaagtacattaagtacattcacaacaattgttaatcttccattagttctgaaatgcctaatctaacctttgttttatctcagacttgggctagaatgctccttttaattcattctgcatgatttcatagaatcaattttttcttaaggtctcatatccttcaaagactttagggcaattggtcacgaagacccttgcacctcctcaaggctgtgtgctgtggatgttgcagcttaaggaagcattttgaaattgggcatctttcacagcctagtgtagaagttattggcccgcagtttttaccggctttctctttcagaaatcttcttttgttcctgccacaaggcaaaaacaggaaaagagatctgtgtgaaagaatgctctcccttttccttttgtggtgattgtgtatcttaagagaaggcctcaaaggttcccggagctgtctgtcttttcatgtaaatggagcccttaagcctatttagaagtgtgcgaaaagactgtgggagttgaggtgaaagatacagaagagtagcatcagcaccccgtttaatgtattcaagttcaactgtgcactctctctttcttgtatataattaaaaatactgcagaattgtattttgcacttgtacttttaattatatgctattcatattactatatacccatatagtgtgcagcgttgcaactacaaaaccatatattttgtattgggaggtttaagggattttccagggtaattttgaccgcgtaaaatttgccttacatgccaactctagaatacaatccccacgtaagatgtaaccctctatattaggtatttttaaatccctgcttatcccaaagtgagcagaactgggactcacattcaccccttgcccccaaaccagtaacaggtatagggttgtcactgaattttgtgagaagaaaagaggtgagacagaaggaacttgtgaggtttgacagaggagcaaggaaatctgtggcaggacacagtaggccggggacgctgggtcaggcagggaagggggctgagagagagttcctgggtgagactgtttgtactagtaaatgcagggctcaaagccatactagccatggggttggtagagtttgtaaataggagtaactcctactggatggataatagccatttttccctagagtaccttcaccttacaggaaagtttactgtgcattgttccatgtgaatgttgcagcatgtgtgtgtgtgcacacacgtgtatttgtgatgttgtagacagagtaggaggaaagagtagcagtgtggaaagaggagaaggcatgaggatttagcatccaaggtttaagaacaaggtctgccttttgttgttttgtggctggggcagtatcattaaatggctgaggggacctgagatattggcatgagagagggaaggtcacccttgtagcccctgtcacctgctaccttgggaggcattcccttcccctcttctcacccaccctaccactccaaggcagagtttgtttaatcagatgcagaaaatgttctgatttggtagtaaagaaaggtaaacaacacatccccatgccccacttaaggtttttaacaggtgcagttgaaatttatattcatggatgtgggattttcacctgccccctgacccagtttgtttaggaggttaatagaattccaagtcgcatctccctgggttggaattttctctacaactcttggtagtgatggggttcaggacacactaccccacaatatgaagcctggcatttgtgaaaattgcagaagcaggaaggtcattctcttactttccccctgcccttctctcctgaagctaaggagtgtccttatctctgaagacacacggactcagagaggagtttgaacaaacaggccttgctaaattccctcttgtttattgccattaaattatatcccctttttccaatcatacttctctacgactatccatctcttcatcaaacctaagtaaaaatacttaagtttacttgtttctttggatcttgatttctgaagcctcctgtgtcatataaaatttataaataaatttgtcatgcttttctcttggtaatgtggcttttattatagaggctcagccatgaaaaaataaatcgtttcctctcccacagtagctgttcgtcttttgagcaagtcttttagcctcagtttcctcctttgcatcagagatgatactgaccaccctgatgctctgtgagggctgaaaggaacaggatacctgcaagcattttcccacaacttatgcagatgacctgtgaacaaactgctaaccagcaagagtgtttgaatacaaaaaattctaatgcttaatacaacattttactcaagactctgttacatatgacaaaaactcagttctaagaagcttatgtaaaaagcagaatttcttgttttatagaagccagggaagacctgaggagtgaaaagggaaatcaccacatataagggatgaggcaggtgagtgctcccaggacagacagtcccaatgatgttagcaacatattggaacaaaaaattaaacaaggtcttagaacttaaatctgattttataataatattcattatcaatacttaattctaattttacatttttagatttatgtaattaacattagttacctatacagtaaagataaatatgtttcataatgctttttttctgacattagttcttgtttgaacacacaaagctacacttttctataagtaaaaatgaatatgtcagactttcaattcggaaacttgagtcaaatcagcagtctctgggaagaggaaagttgtaaggcctatgttctttcataatggcctagcccttccccctcatctgacattttcttgtggaaaacatctggtttaaataagcactaatggcaaacttgatcatcagaaactagaatgcagaaatcacaaacaatgtatagtaggttaaagggatgccaaaaagcagtatgcaaagagaagtcaacagcaaatttattttatatataaatttcaccattttggtgcttgtcttctaactgccttacacttttctcttctgggaacggccaaggcccccaaaacacaaaagtgaactatgatcccactttgctagactcttgagatggctctgtaaacataccctctaatctatggtccttccttcctacttcctcagaattcactgaaaacaatagagctctaggaactcctattgcttaaaacaggggtgaggatcgtgtttattcaggactatggctgttaaattagcaggactgttttgactagctggtactcaggggtagggttgtcatgttggtcaacatgcctatcccatttgggactactctaaaggaaataggaatgcctaaaaagtttctagacttctaagaattctatgactggggttagggatgacttataggcaggaacggagccagactcctgacggtatccaaggtttataggcttggtgatagaatttaccagagtagaagagaaagttttctgagtagctagtgttttgaatggcatggggtttgtgacaagatttggggtaagccagtgagagatgctttggagttatctgggacctcatttattctggtggaatgccagaagtacaggaggcatctcctagggtatttagttttttagaggctaggaaaggtagtaaaggtaaagtagatacaaatttgttactatgacttttatggagccttgagatagttatacgaagtaggaggttgagcagggattattttaatcggagaagagattagtagaaactcatttaggaggattagagcatgctgaatgagatgtcagaagcttttaggatccaagaaaagtggatggcagagagagagaggggtcagcactgtgtttaatttccttctttaccgtttctcgtctgcctttcctggatattacctatttcaaactaaagggaaatgtgtggaggctgcatcgggtagcagaaaaacatggaatagggaactctgcctctgaaatagcatataatacttcccacagggtttaatgtgaaataagtggtataatctaggtcaagtggcttaggtagaatactgatcaagtgaccagatgtcttggaatgagtaggataatcttagattttggcttcctatcctgtatccaattcactttaccattagggcttactattaccttgatgtctggagtgaatagacccttatcaacttacgataaacatttatcagtagtttagacagaattcttaaactggattcagaactagaattataatagcagagttactgtatgtttcaaacagtgatttggccttagtaaagtttggtctcttaagatttattactcatttatggctaagtatatcacaaataaatgttaggtcccctagtgagtattcagcaatcatttccttgggatctaaggcataccaggtgctatgttcaaaatgaatgggacatggttcttgtttttaagatgctcccagaccagtggggcagactggtataaaaataactaactgtcggccaggcgcggtggctcacacctgtaatcctagcactttgggaggctgaggcaggtggaacacctgaggtcaggagttcaagaccagcctggccaatatggtaaaaccccatttctactaataaaatacaaaaattagctgggcgtggtggcatgtgcctgtaatcccagctgctcgggaggctgaggcaggagaatcacttgaacccaggaggcggaggttgcaatgagctgagatcacataccactgcactcctgcctgggcaacagagtgagactctgtcttaaaaaataaaaaataaaaataacataactaactgtataatataataatatgataaatgctattctgttggtatgaatcaagtagcacagaggaagaaaacaattcactctagtagatggttggcattttgagagagatataaatataattgtgctcatttataacatgaattataaatgtagcagcattggaaatggacatttaataaggtgtagcactactaaattggattaagtgcatgcactgggtttatagatggatgttcccatcaaatttgttctttatttgtatccctacccctgagcagtccttgcctggcaagtgattggtgtttgcactgttgggggtaggctttaggttcctgtttgggcaccaggagctgtagggttagaagaagtaatgtctttttctcacctattgcaaggttcattactgaaccctatagcaaaggcagagtaacaagcaaaaagcataacaaatttatttaacagagttttatgtgacactgaagcccttagaaatgacccaaagacccagggaaaactgtgtatttatatggatagtcatacagaagtatgattggagcaccacagagtatcatctaatggtaatcaactagggagaactttgcaagccctgtttgttcgaatggcttccaagtatagggtaggacccctctggaatgaagatcttaaggcctacttttagggaagataggtcagaaaattattttatggcctgcttcagagggaaaggcaagagaaggtcagagagtgaccttcctgtttctgtggttttccaatgtcctttagcttaaaatgcttggtatgccagggtgccatatttgggggtatcctgttctaagccccaacatttccctggaagggcgatggctttttgatctaagcaaagttatcagagggaatgaggtacaaatcaatagaggacagactatgagatcaaattctgactctactacttaagagctgagtgtcttttgacaaattacatgtattcctggtgactctgatatctctataaaatagggatgatagtagtaccaaccttacaaggctgtgcctcaaatgtgtaataaatatgaaaacactttgtaaagtgctgtaaaaatatataaacattattgttttatcacaaatatcagcacaccaattatttatgtagttctatacattacgcaaaaagttacagagatgtggggctcatcttctaggaaaacagaatcagaattctgaatcagctctaaagtcggagaccaaacctcgagctctctctaggtgctgtttctcctgaaaagttgacttgtaagtctaacccagtgcattgcctctgatggcctggtgttcttcagataggtaaaaagcaactcgaaaaggggaagagtattgtgctttccgcaaagacgatacttttttgctctttggaaattcttgctcttttggttttgagctctgaaggtgaacaatccagctgattcaaatccccagagtagccctaataataggaaaaccgtgacaaccgcagatattaaaaacatacctcaatttgcacaactggggtaagacaaatacatatggtattatatgaaaaaaattcctttatgcaaatctagaaacttactttaatgtcatttcatttaacatcaaagagatgatgtcaaagagaacatgtttaccactgggagagtcaaatgaaagaattagtcttctagaattctttcaaatgaaagaatttgtgtgtaaggtttgattggttatttggcaaacactaatattaataaaaagaccagtacttctagatatgggccactttgtagagggattatgccagaactcccatagtatgtatagagacccttgaaggagggtcctcaaacccataagggaatttattttaaaaatattttgcttatgggcccataacttcattttatgtctctctagctcacaatagaggattataatctattgggctgatatatctgagttaacatcagattaatcgtatcactttgtgtatgaatatcatataaaaatgttagtggctgctgttttcaccatgctctgtcataattaaacaatttatttcatgctgaagcttccctgtcctgattctgggattgtcagttttatggttctcattttacacagataaaaccaaacttttcagatgtcaaataatgtgctgcagacttccatgcagttctcagctgcagttataaatcactgttgttttaagtaagtgacctaaatgccatttttattaggaatagagtggctaggagagactaacataaagcctctgatggagttctaacatttctccttgagcagcaggaagagaattgcatttcctgctggctagagaagccaggtcaattttgtcctaccattctgggaactatcacttcagacacctaacatatccaggtcctgcttatttttcttgaatgagctattaaaatgcatgtatgtgtgcacatacacacatacatacacatcatgcagccatttgcctctgtgtatacatacatatcattgtgtagattgcactttttcagaaaagacaactgatcaccagcacgtcactctcacttcctcccatgtacattttgtatcttccccacagggaagtgaaactggtggtgggttggaagagattgagtttgctgaagtggattctgccaagtggctgtttgtggatgacctttgtcttatagggggtaatagtgggagttacggattcctggcaaaatgtctgttcacatctcatcacaattagaatcataaactatgggctttgtggatttgttcacctgagatagtgatgaactaggaatcaaaagatctgggttttagctctatctctaaatatctacatatatgtgaagatagctgtgtataccactgtggatattttccctcttttgtcttatcttctccatgagactttcaaatcctcaaaggcacagagcatctttaatttacacagcattcactttttcatctttgtttgttcctagactgcatttagtagagatgtaataagtacttactgactgatagaatgagaccacatcctgccttagatgaactggaattccatttgaaagtgtttccaaccagaaatattctgctttggtgccactgctactgttcagattcaactatagcagccacagtgtgatcagacaccttctcccctcaggcgccacccttggccaccctgagaagatgggcccccctgccagcatgtctttggggcccagtgtttctgtctctctgcttctcccaacactcagtggcctgaagaagaagagctttggtatataatttcttttttccccccagccaagaggaattgagcactcatgaatattttaagcgtgttacaaagaacacaaaagctgtgccttcatgggaggattaaatgttggtgtttgactcctcacaatcagcacattttaaaacataaaccagatcatgtcagtctcctgcttcagagccaccagtggtctcccacactcttgcaaccaaacccaaggctgggtgccagcctccaaggcactgcctgactcagccctgcccactgctctgaccacctcttgcagtaattccagccatgctgatctactctgggttcccagggcatcgtaagcatctttctctttaggacctttctacacatctcccctgcctgggaccctgccctgaaccctgtgctaccgcaggatcgtcactcagatctcagcctgaatgtcctgtctcagacaggactcccctgactgtcctatcagtatctacacccgatattttatttcctcacatcactcatcatatctgaaattgcctgctcatttcctggttttcttgtttactgttggaccctgactagggggtctcactctacaagggcagaaagaggttgtcttagtctggttctctgttgttacccagaagctggaacaacgcctgttccccagcggttgctcagtaaacacatgtggactcaatgagggattgaattggaagttatttacctctctcctggcttttgcttccctctcttcctttgtctctcttttgcggaatctgtaccatgaaaagggctgttgtccagtagtggaacacaggccttggattgaggtcctggttgactcacttgatctgaagcttctggtcatgcacaactgccaattggaaacagctactatagaaccaccctctttttccaaagggtcaacaaggaaatcaaaaatagaaatacatttcaggtagtcatgtaatactttactaatactaaccctaagaataactttgcgataactttgcaaccttaacttccattagtctcactaggcagttctgcttcttcaattcctttagtttgttacatgccctgcgatccagcccaaaacaggagaagccctgtagaatatatgttgctatatcctcagatatggccaataaaatttgtttgtgacctgtaaggagcagatggttcactgaaggccattcatagaggaggcaaagcaccaaaattcagtgtctagccttaatttttccttattagagagtctggaatagagggatacattttcaggatctttcctaatagaggagttctttttttatttggatgaagagattatttctgtaatttcccacagtcttaggctgaactctccaagtaatgaacttttactcagaatagtctaggctttgtgtactcatggaaagtgtaatatagcttgccttgttggtttttctggagatagcacatttgggtcacaggggttcagccagtcttcggctgttatgcagtgtaattttatgggaatagttttataatgttaacatctgtagactgagagcttgatgaagacatcacccagattgcctgggaaacgccactgactttgggagctaattcttgataggtaaaatatttagctctctctctgtctcttttttttctttgcctagatacagctaccaaccttaccatttccatcttttatggcagatgagctatgtgtgtatttttttttatctccttgcagtatgcatttttgcaagttaggggataaagcccaggcccttggctttttaacttttctgcttccttgatatttgtacatgagataagatgttaaaggatttctctttacagatttctgttgaagagttatagaattgactgaatattcatatgtgtactgtcctctgcttcattaactctatgttcatatttctttttcccatgaagcctctgtcgcccattttgtttaaaattgcaacctattcccacaccttaagctaaatctcccttaccctagtttgtttcccatagtaatgatcactttctaacatactgtatcatttgtcatttattacgtttattgtctgcctcccaccactagaatgtaaactacagggaaggatttctatctgttttattcacattgtatcccaagtgcctacagcagtgcttggtgcatagtaaggctttgataaatatttattaaatgaatgcactgacatcctagtgaaaagacagatactgtagtgtagtgatgaaaagcttgggctttggagtaaaacaagcctgggtttgaatcccagctttgctgcttaccagctgtgtgtctttagaaagtgatttaacctctctgagactcatttttctcatctataaaatgaatattatagcaccttgaaagtgtgttgtgaagataaaaaaaaaagataaataggcaatacagcatggtaggtaagaaacaaggctttatcgtccaatggatatgggttctgggctttagcttccagttatggctctcccattaccttatacaatttttagaagccctctaagctcattttctttacctgtcaaatgggtataaaatactatggcctgcctcacaggagagtggccaggattaaaggaggtaatctctgcgtagtgcttagcagactgatcaactcgtaacaagggactaattaattgaagatgacgatgatgataatgtttgaaaggtgcttagctttattgctcacacatcatagtaattgctcaataaatggtggccttgacaataaatgaaggacaactttattagaactctgggagcctcccaaatttgccattttctttttgttctcctttctccagggggaagtaaggcaaatgcatgaagttatctttgtgagatacttgtttcaactcgaaaatgaaacagcaagcaatttttgtgtgccacactttttgccctgtcaccaacagttctgttatgatttcagaacttaatttctaatttttggatgcagttgcacagaggcatttcttcaccacgtgatcactgtgggggcttaatataactcaggcatttgctcagctggtttggagctaatggaattggctgtagtggctgtacttaggggagattataatgtctcaagggtttcattggcttccacttccttctgcagacttatagtaaaagacaagagatgcctcttcctggctctatttctcatttgctgtgtgactctcagcaagacacttcgctgccgctgagaaccacacccactaagtggacgacccagttatgaatccttgctccattctgctgtatgaccctgaccaaattattcaatgttgccatatcttattttccatctttgtaaataaataaatgtatatgacaaatagaatgatcctataccttagggctttgtgaagattaaatgagatactacatgtaaagagcactttggaagtactcaataatacttattattatgttttctgtataaaaaattgaaatgttctattaccatggtattttgtttataaacactttatatatatatatatatatatatatatatattttttttttttttttttttttttttttttttttttttgagatggagtctctctctgtcacccaggctatagtgcagtggcgtgatctcggctcactgcaggctctgcccccgggttcacaccattctcctgcctcagcctccccagtagctgggactacaggtgcccaccaccttgcctggctaattttttgtatttttagtagagatggggtttcaccgtgttagccaggatggtctcgatctcttgacctggtgatccgcctgcctcggcctcccaaagtgctgggattacaggcgtgagccactgcgcctggcccaacactttctatattttaaaagttctagaacttcggcttctgcccatgatgtcctgtggggtcctgaaagcaactgttgaagaatatctttgcttgaaaagagccacgagtgaccactgtgtcttcctacaagtggtcagacacaattgtctcttgattatttagtgtaatgtaggggaataactgagattaactggtggttatgattttgcttaaggcagtgtgatgaggacactaaggttagggcagctcctgagcaggaggaggctgctatccagagtcaggaagtctcccaaggtgttttttgcctggtgatcagcttttggccaaaagcctattactctcaggtgaacctggccctgttcttggtcccaaagctcccggaccaggctgagctataaaaatagaatgccaaattattgatcctacagtgtaaaattaagctgttctatccactggataggcttgcctaagttcccctttaaggcaaattaagtgacaaatcaaattattggacagttgcttggtaagtacagaattgatgtgaggggagttaagtgattcaaatgcttatattatcaggccccgttagcctgctgttccacctctacagtgcagatctatctgtcaggtgaccacttgagtgggcacacagggcttcctggcaaccctgattaggttcggaacaagcacttccatcatttttcttttttttcttagagatgtgctctcactctgtcatacagagctggagtatagtggtgcaattatagctcactgcagcctcgaactcctgggctcaagcgatcctctcccatcagcatcctgagtagttgggattacaggtgtgagcctccatgccaggctatactttatataaaattttttagctgacagacttcctccccatatcctgttctacatattattttttatttaaattctatttttcatcagagtaaaacatgtataatgttttacaaatctagtaatagtatagatttgtactgaaaaccagtttcttgccccaatttccccactctcctttgcttcttatgcttcgggagcagccactttcaaatctcttgttgattctactagtgacccccacatttctaactgatatgcttgaattgctgtttcttaatttttctattttagacattatctcatgttttctatggacgatgaccatagggtacttacaccattctctccttccatttcactcttccccttcttttttccggtatgattatatcataatattcagttaatatttacattactgtgacaatgtaagcattcatggcagagctacaaaatgtaccatgattacatttactttcttccttcctttcttgtttgcattttaaaatttatctctggaacacacatttctctacccacatctcctatctttaaatcgataagggcatatgaaaccataatgccttgcctttactacacctaacaaaattaacaattcattaatatcatccaatacccagcccaaaatcagatttccctgattgtctcaaagatatccttttacagttgattagtttaaataaggacctaaataaggtccataaattgcatttggttgttatatccttttactttcttttattctggagtacttcccagaataaaataataaatgtcacaaataatgtcacaaataattaataattatgtcagaaataattacttccttactctccttttatttgtgacattaattatttggagaaattggatatcaaatgccctatattctagatttggctgatggcttcttcaccacgtccttttaacttgttctgctagatcttatatttcccataaactggtggttgctgctaaggtttgattagattagggtttagagggttttgttttgttttttctttttaggcaaaaacactctataggtggtgctagtacttcctattttatcatgtcacaaggcaataatgtctgactatatcacctttaatggtgattaagttgatcagtggttcgggatagtggcagcctgatcttcttcccatgaccaagatttctgtcaacttttcacctactggttttagcacccattgatgatcattgcctagatccattgtttaatgagacatatattctgtcctttcattctgcagttctgtcctgtgccagtgagtgctgattattatgcagtttaactccagaaggccatcttattttcctcatttccaagtctgtgttagagtcagggagtttctctgtgaccctcatgtgctacctgagaactgactaaatttatatgaaagtaacattcttatagttgtattgattaaaatttttatttgaacctctagttgagctttgctgttggctttgaaaacataatggaaaagtggaaagcattcttgtcagtcatgttgaaaagtaactggcagaaaaagtggacttaaaaaaaaaaagtagtggaacaaataaggggactctgctttggtttataatgcctcctttctctagggtaggaaaattttgaagtccagtggggtctctcctgcctgcgagggaattggcgagaagctatcaggatacgcatggatgacacacagtcacacagtcatttgaggactttttggttgctgttttgttttagtttttacccccttagagaagtctttcataaaaatttttcctaaaccctgttgcatgcaaattagggcttttcctttcctctgtaatggggcctgatattctttgatgtgttgtagcagaatttagcttctaaatacagtttgaaactagctctccacacacacacacacacacacacacacacacacacacacacacacacccttgaattctcagctgacatgttatttctatttttttgtccttactgcaagaacctgtcctgtaggaaccaagttcagtggtaggaggagattatgtagacatcttgcttctacttcctgtaaagttggatcatgcagacatgagatgcaggtgaacaggagaaggaagtcctctccagtgtctcccagctgggagcctgttttcatgcttttcaaagagctccttttttgagacagatgaatccctggtataaatacctgtgctgttattatagaaagagacagattggtcaccttgttaatgacttccagtattccagagttcctcctctgaaatactctgcagatccaaattatcataatataggggcctcttctgccatttagaatgaccttccacataactctcaatgtccaaattgggcccttccttcaaggcccagatcaaatgactcctcccctgagtctcccattgagaagtcataccttcccatctcctagcttcccatccatcctcttttcatggattacttgctacatttcattttagctcatttgcgtactcattttactttttttttaaacagaaaaatatcagtcttatctttgttttaaccacgatttgtatttaataagtattttcataacatttttaattttaataattaattacttgagtaattttgttttctgagatattcagcttttatttcaactatgcttccagtatctacaggggagtctgtcagtcacatgttgagccaggttttctatttcagaagaggaaggaaaagaatgtgtaggggaattagtatggaactggagtgagaagaactagattcaaaacccgtccccaccacttcagagcaactgctttagtgcaattggtatgtcagcaggggccttccctcaaaaatacacagctctgtagcaaaagtcatctgtaagacatatttaagacttagttcatcagaaagagggtagggaagaaaggactgtgtagatttatgagcagtggtggatggcacagggatggggtcttgggccctcaaagccctccgaggtagtactggctactgggaaaaggatgtcggggagcaggtcccacttttagctgcacttgaaaagatgagtgtacaaagcttatggagtactcaggacggagagaacatggtgagtgttagggaaggaagccttaaatataaactttactctttaacctccttgcaatctcactctgaacctccttagtcccaggtatgggtttctctcacttcttacttccatagtcctctcttggaagctctttggctgaattaatgaaggggaccactactcataaaccataaccagcacttacgaggagcctcacattagtaatggacgacaaccctcagagacagccataggtcctaatgctattattaatagtcaaacctgtgtagagaaaaaggagaagccaagatccagttccacgggacataacaattcacaagcagctcatccttatttcagaaagccagtaagacctagctttctcatggaggttattctttcaccgtcagtctgcctctttttctgggaggtgccctccccttcaggatcaaggaatgtaaagaccatgagatatggagtcagacttgggtttaggcccatttatatgctgtaaactttaggcaagtcactttttctctctgatacggaaagagatataatatataccttattgatgttgataaagatgttcagatgaaattttatattcatataaatgtgtatattatatatatggcccgttcattattttaaagcaatgtaaataattcttatctattaccatagtatttcaaaggctacatcttgccacaggtgagaatcagaggtatgttctgggggttttttttgtttgtttttgagacagagtctcgctttgtcatccaggctggagtgtagtggcataatcttggctcactgcaacctccgtctcccaggttcaagcaattctctcatgtgcctcagcctaccaaatagctgggactataggcgcgtgccaccatgcctggctaatttttgtatttttggtagagacagggttttgccatgttggccaggctggtcttgaactcctggactaaaatgatctgcccgtcttggcctcccaaaatgttgggattacaggcgtgagccactgcgaccagccagaggcgtgctgtgttctattggctcttttgcctaccagtgccagaaatttcctacacttcttggcatcttgcttttctctcctatgaaataggcaatactagttgccctagagaagaaatttatctagagaaaaaaatgtacaaggtagacacagctggtgagttacccttatactatttccagtactaccaatttcatttcttccagaaggatttagaatgccacatagtagttttcctggtgccatgcttgaaatggtgaatctatttgaaagaagggattttgtagtcacattgatgttgctgcttgctgcaagccaggcaagtcacttaatatctttatccttaaaagaggaataatgtcacctacctcatggtgttacgatgaggatgaaaggaggtctgtaactaaggcactgaacatggtgtttgatactcactgggtacccagtaaatgttagttttctttgtctagactatgtagtgctcttcagttttcaccctgatcaaattgcatttgttaaaaattccaagtaagacatggcactgggtactttaaataaaggggtgctaagggaaggtcagcatgcggtagagggctgaaagagccagttacatttgtttgtttgtttgttttgttttgtaataaacaacagtggcttctcatctcctttccctggtcctgagcctgctgagtcactgttccagcccttgggccacatgatctcaggctgtgtctatggaatacagcaaaacccacaagaaaccagcactaatagatggcaggtcattttgagggatttttctttgcgttcctgtgcttgctctcctggtgagataggaaacctttaataagacttttcctaaatgatgttgcatgtgaaatgcagatttttttttttctgttctcctaacaaatgaccatttcatgaggtttcttttcattttttcttctttcctgcttctcagtacattccacaaagagcttattcctctgctggttactgattgatggttctactctgtatgccctttaattttgcaataaaccaacaaggagttgagaccacaaacttaaagagaattgacttatttgactggattcactggagccaacaggcagatttagtcatttcagtgtggtgctagggagggcaggaggagtccatgagaaggaacaccgtgttgtcaataaccagacagaaaaaagcttgcttgtcctctcattccaaagcatgtgggcatctgttctcggcagtgatgcctttccaggccttgatgaaggcaggacggcttccatgagatttgctcagaactccaggattctgaattcagtgggactttaggtatgtaggattggtagtcagtgtttccagcttctgtgtcccttttttcaaagggatcatggtataccttgaaggactgcaggaacagccataaaccctcctcagttaccagtcgttaaacagcctggcctcttggctagatgacttcaaagaccaaagacaaacccctggccctatcacctctatcctagctgagtctttaacataaggccaggacctctgtcaggttatagaggtactaatatacttcatgcgctggttcccaaatatattaagaattaattattttttttcttatttagcactaccattgtacagagcaacccatccgaaaaataaatacaaatatcatttcaaataggaaaaacaagaaaatatttcttaaactaaagacctttagttttagaggtatgcatttgaaaacacagatactatcatcacgtatatttaagactggttccagacccatgctgctctctgtgcgttgaaatgaaactgagaagacaaatgcccaaatggaatttttcccacctgtgaactcctattccagatcccagtgttgtttgtggctcttccacatttaaccagctaactgcctgctcttattctgttcttatgtgacaaccaatcttctgaaactctcgtcatcacatttcagcagaagtgaaaatattagcagagtggttggtggccaagacagaaatagaacccaggagtctgtgtcctttcccttgccggacctactggagcatggttcctcctgcctgaagactcagtgtttccaactctaacaaacagaattctaacagttgactggtttcttcttgctactcaaaatttgttttatacttaaacattttgtacagttttttctttatgaatgattttgcattaaacaaatgggacttggttaatctgatatcagtgaatgccttattctgaggaaattaatccacaaatatccgtgggaccatgagttttcatattgagaacctttttatgtgatagactagagagccaggtagaccaggtctgcgtctggtgctcccatgtgccagctatttgatctcaaaaaatacctcaacttcttgaacctcagtttcctcatctttacaaccaggatgataacgtttacctcactgagttgtgaggataaaataagccaacacaactcaagcaattggtaggggtctgacacataggaaatgcttagtgaacgtgagtttcctctcttcctccttcactcctttagaatagggttagagatgtagaaacacataaaatctcatgaaatgtgcaccatagagagagaaggataacacaaatgacataaaaagtcttgtactaagttacttggtattgattctaaagtcagggtattatctagggcaaggtggctcacacctgtaaacccagcactttgggaggccaaggcaggaggatcacttgacccttggagtttgagaccagcctgggctgggaacatagggaaactccgtctctacaaaaaataaaacattggccgggtgtggtggtgcatgcctctgttcccagctcctcttgtgtctgaggtgggaggaacgcttgagctcaggagttcaaggctgcagtgagccgtgattgcactactgcagtttagtctggatggcagagcaagagcctgtctcaaaaaaaaatgaaaaaaaaaatagaagaaaaagaagtaaagtatgagtattaagaagtgagagaaaagttagggctagaatagttagcaaagatatcatggaaaaggtaggatttgaactggcccctcaaagatggaaacttacagagtaaaggaggctatttcagactggggcatttggggtgggtaaaccatgagaaatagagaaattagaacgagaatgttataagccttggttttcctattggaataattgaacgcaatagaataataagtaaaaggataatattaatatgtgttaggcactgtcttaagtgctttatatgctaactcatttatccttaaataggtaagattgctatgccaattatacagttgaagaaagtgaggcacagagacattaactaatctacctgagtaggtgtggaataaataatctacaactagtaggcagtggagctgagctggaagcccaggggatctgactccagagtccaccctcctaacccaggacagctgcttcagtcacttcccagctcccctcactctgcattgaggatcagctaagaccattctgtgaacataccctgaaaagtataaagtaccatatacgtgtaaaatgacatggttattcttattaatgatgtcatatgagaggcgacaaatagctacctgaaaatgagggagaaaaactatggtctagcacccacatgcagttgtactgggcaggtttagccagtgcacagcatatatgcctcaccttcctctctagcgactcttgagtcctgaaagcctcacgtttcccatttggacagtgttccaggaggccatttccaagccagtatcagagactaaaaacctgtttggcatctggcagtagggcttgtgcctcaagtgtgatctgcctttggccaggacatccttttttttttttttttcttttgagatggagttttgctcttgttgcctaggctggagtgcaatggcgtgaccttagctcactgtaacctccacctcctgggttcaagcgattctcctgcctcagcctccccagtagctgggattacaggcacgcaccacaacgcctgactaattttttgtagttttagtagagacagggtttcaccatgttggccaggctggtcttgaactcctgatctcaggtggtccacctgcctcggcctcccaaaatgctgggattacaggcatgagccaccatgcccagcctcaggacatcctttttaacgggcttgtaccacatgattgggagtttgaatgttagtaaccatgatagaagatctccactccaagggcatcaccgtgggaggaagcctgcccctacttaccatgtaaatatttagccatttcaatatatttgttctggacttgttcttcttatgtgtgtctcctgtgttgagtctgtttaattgtaggttattattgtgtgtctatattgatgtcatttctttaagtacagacacagacagcattgcttcagctgcccccacccctccttttaaaaataacaccttacacaatatcccttccttgaggacatcaaataaataacttttgttcaagagcatatctgatgaggtggctaacttggaaatttgttcctaggcagaccttgtgacctctgtttcaatacatagtgagtggcctttgctcccattttatgctacagattcactctggagatagaattggttgcacctctccaggcagtgagtttggagagcccttggtggttaggatgccatttgtgctggtggcacagaaatacaagcagtaagcccagagttgcttactctccactggaggtttctcagaggctgggggggacccgagactcctctgcttcaactccgctctactatatgccactggaagtgtagctgaggctgaagggtatcaatgttggtatttatcaggttggactcccccaagtgccctattttcatacctccaaggagcaagtgattcaacagaactgttttcttggcctcaaatgagtctaagaaggggaaatcacttaataccagccgtctgtgagggaccgatcacaaagctgtgtctttctaatcctccttgtaaatcaaagggaggggaatccccagagcccaggagtacacatgaatagaaagcaccacaggtaataaaaacacctaaaaaggtcagcagaaactcggggagctgctggaaattcacctcctctgcctttctatgggactcagtgggcagtgatcaggtagcaggcaaggatacccaactacacaccaaagcaacttggccacaggacacgtacagtgcagcagaaggctggtaggatagtttcttccacatccatgtgaacctcagagtcatctgaccattggccttgttctcttccaggttctagctggccagagacttttttggcctcatactaactgcaaaattgcacacagttggcgaatacaccactggaagccactgtggctgcattgtcacagttcaccaattgtgcatgttatttcctgcagtgggcccaagatcactgacaggatgccgtcggggttgggctgaaggtggaaacagcacactagcttgctgtttgtggcctctttacaactgccggccccatctgagatccggaaccaacacgtgctaacctcagcccattggggccagtggggcagccagcagtggaaccatagctctccacacctatgtctatggcacggtagctgccggcccacagtttccactgcatccccttgcatgtgcaccccaagagaagtaggccaaagagaaagctgccttagggagccacatggttatcttgtgtgtttacttttgccaaatggcagacacaattctacttcaatgcatttttctgaactcagtggtcaaaagtagcacggaagcactacttgcgtcagccccctctgtgattgagcgagtgtgtgcttgtgcaaagctgaggagattttttttcacctcctccttctgcattccctcagactgagccactctcttctttaggggctcccctactaggcagagtgtttctctagctttgcctgtggatttcacagtgaaatctacagaagacagttttcctcagggctgataataagaggtatgaacttattaagattggaagcattctcaccataaacacaaattatttcaagttgctccttcatccccttttccttggccactgccattggttctgtgtaggatggatttcttaaggttgaagataagcaatgcaaaggtggaattttgagtacagcactcatcctaatgtgggtgaaatatatgaaacatttattctaagcagactgctacattaacagttgttatacattcattctctgcatatcttttgtggactcaacacttttaggtacagagaggttaggagaatttcccagaattgcacagcaggttagtgacagtgccagaaataaaagtctgcctgactcccacacccatgttttcttcaagccaaattgaagtttggcctcttctccacaaatatttcacaagaaaaattccccacagcctttcagaatttcccagaaaacaattgttgtgcagtccttcaagatggaaatggcaggctggaatattgaaaccttatcagcttttattctagaactgacagttgatattttctgagctgaagctaagataaaagtttatttttgtgttttttttttttaatcgtggaatgatttttgattttccagagcatggcaaaactaagccagcaaatactaaaaccacatttgtttttgtgacgctcaaactccgtaacaaatattgggtatctctatacaaagctggatgtggacaggaagggtttgggatggggagaggcatgcgtctgggagcgtggcctttctggacctaccctgttctcactctcttccttctgcctcttgccctcattgctttccttattctctttcttcctcttgtctccttctcacctccagctcctaccacagcagacaggttggggcagacaccgtcatggttggggagcaggaggacagcatggggaaaaccactccaggcctttctctcaaaccttagtgatgaaaggactcaatggacctgaacaatttctcacaggaaagttccggtctctgtctccttaaaagcaaggcattcagtaacccttaacagagccaggattaaaacttgaatttctgacttatcccaggcctctgtttggatagaaaggctaggtcactgtcatatatggcaattaggatcacttcagatacaaaagtaacatttttaaagctgtgccttaagcagagagaccatttttagtacaaaaaggaaaaaaagattaactgtgccttcagagctgatgaaaggcagagcctcgtcactttgaaagcattggatttagtgccaggcgggttggtgagtagactcagcacccacattctcttcttgcgtctctctctggccacccagattatccaggggctgctgtttacttgagagctagaagtatcaggacggactatcactgcacctcgccatcctggcccagttaaagtgattttgaaacttcctgatgtgtgttagattgtggcaggtttctgccagggagtgggcgggaggaggaagcaggtgtttttatgggctagaaatgcccctgagatgcctgaggttgcttcgtgaatcctctagcccagcctaccccttcaactctgttgcacagagacatgagttccatgaaaaatttagtttcaaaacttcccgtgggcgccggaaatgataaccacatgttatcaagagccactgaaaaccaccaaaaatttgtcaaaattcatataagattgcctcacatacttgactttcatagaagcggaagccattgacctacttgatttatggtatttattagcagagtctgaaaagacttttatcacaagattgatcttgttacagtgtagcatcttgaccatctttcagtgtatttctggatattagatttatttgtttattacttttataggtggaattctctagaccatgacattaaggcctggagaagtcacctgtcagtagatctgagctgagagtttctctctcttctcctgtgtcccatgttgccttaggaaggagagcaggcagggaagcctgcatgcccttatctcatctgtactattggtcttaggtgactccagttcacttggtggaaaatggggattacaaaatttgcctctcagctgcccccacagaaatctcagtgatggcgtttgtcagattcttgggtccttaaaaaatctgacttttaaatatcgaataattattttgctgatcatgaatatctcttctgctgaccaaacaggaccagatatcacattccaacctattctatccctggctgaccacaaactccctcttctttgtcccccaccaaaagtcaggtaaaatgagctgtttctatcaaaggctgtgtcttcaggcctggccatttcccactcaggtctccagtgctatccaattttctcttcacctgtacattctagtactcatggaaggctccagtatacaaaatggctactcatggggccccctccccttccaccccaccaaagatatttctaaccttcaatgtagagtaagttagaattgacatatacattgtcccttaaaggccaggaacattaagcttgagcagagggtaggtgtagcctgggtatagtctagtcatagcctagctaaagaaagatgagtcagctgaaggcagagggtctgcattgggcacatagactggcagagagttgggctcagttggctcaatcctctgactaatgaccagttaattctgcttattctctcttaactcaaggtatttgctgccttaagctactttttaaatacttagtggaaataagtcatctattttcattagtgtgtgtgttgtgtgtgtgttggttggattttcctggccaggagcctctgccttctgaccaaaatgacattgattcccagccttctgccttagcagttcatcccatctttaactggttcccctctatctcttttctctagcttatatgccttgctggctgtgaaaggaggacctactgggtggtctatgaatctataccccgtatttcttttttaaagatcttaatttttctccctatttttccttgtgggaaggcattaaaaatgggactcaaggtctatgtgacactatatgaggtgccatttcctatacaggtgcacctctgtaagcagcatacagttaagagggcaatgcaaagaagctttgggagtaagcattctctcatatataaagttgagttgagacagaagttactttatacaaatatagggtttcttgttccttctaataggtggatggtattcttcttcctcgagagaagctgattaagttggattctgtctattcctggcttcagacctaatcatgaccattaaaaatatctatcttttcctttgtccaagaatcccactctggtcttgcattgtaattggtggtgttgggggtgtgttgcgtgttttcaataagccttattttagggaaatagcaaaaatagcatatgtactttcaattaaattgttattgcttttgaacatattgacagcaaatatttgttatttgtcagtagtggcctatatgctgtataaaagggaatcaggcatgggttttatagctaaacaagcaaggtataaatcagcaaaggataactaatgacagtggtggggtaacattttccataggccgggtactgtgctaaggactacctgtgcgttatccagctgaatcctcagaaccatgtgagctaagtattatcatacccagagagactatgaagcttgctccatgtcacacagcgagtaaatggtagagcccaggatctaagttcaggtctgattccaaagcccttgtcctaaacactgtgcaaattgctcttacacaaatttagtactgagcatcagaagactcagtctttcccatggagcaaagcagcaggaaaaccccatgaagcgtcagttagaaaccagactgtgttgagtctgtttataaattataatagtatttcatgtgttattttaagagtatagttttcaagtctcttgattgcctcagaggaaaatatacctatagtcttcttcccaagttgtgatgattgtaatcaatgctttgggaaatgttttcattctatcctttttgctgaaaacagatttagaaaaccacaacaattcagtaagatggcatgattagcaaagccctgagtttggttgctatgtatccctttggtgatttggctttaagacatgtaattaaaagggagaggattattagcaaaataagttaggagcttgttcttttgccattggggagtgaatattttcttccccatctactctttcaccagaagtggaaatgatgctgggtatcttttgaggtatatctgtagttcagttttaggttctgtaaggtagcatttcattagttctgtacaataaaaccgtcatctcagtacaggtttccattacagaaccagtgaagtgagaataaaactgaggaaaagtggtctaaatattttagtcagtgccttgtcattgaatttgtaagtttctggagcatacagtacctttatatcttgatttcccccatgtatatggtgacatgctttgcatggtaggtattaagtaagaatttttttctcattactattaaccatatcattggagtcccaatcattttcaccaagccatcatttaaaagaatcacaaaaatattagagctgacacatttagatctctcagaagttccacattttttttaactaagatagacaaatacattattcagtttattggtagataaagcacatagtattttcagagcaatgtcagtatcttattggccttgatttaaatgactatatttttcttactaagatttttacacaaattctttgcaattaaataaaacttaggaaggactaaaataggtagaaatgatcaggtaccaaagtatatcctgatatagaaaattgtgatttagtgttctattgttagaaccaactgcctggagcctatggcatatactaatttattaacctgtatatgctcattctgaaggaaataataacaataacaacaattgcttctatttattgaatatttactatgtgtcagatactttaagtatcttacattgattgtctcatttaattctcataaaaattctatgagatagatattattttacctatgaacaaatgaagctcaaaggtacacaggatcaaaattggaatttgaacccagttttactgaacttcaaagctcataccctatattataaaagagaaatggccgggcatggtggctcatgcctgtaatcccagcactctgggaggccgaggtgggtggatcattttaggtcaggagttctagaccagcctggccagcatggtgaaaccccatctctactaaaaatacaaaattagccgggcatggtggcacaagcctgtagtcccagctacttgggaagctgaggcaggagaaatgcttgaacctgggaggcagaggttgcagtgagctgagatcacgctattgcactccagactgggcaacagagtgagatcctgtctcaaaaaaaaaaaaaagagcaatgaacacagttccttatttatactcatagagctgaacagttatttcaaggaggctacttgaccatttccagccactttaattgaagacatatcttaggtgattctcaccagtctatggaaagtagcaatacgaaagaatatgagagataagattagcaaatactgagtggaatcctgcaatatctgattattgctgcagagtgactggagactcacaagcccagtgggcacacagaacttaaaagattgtctttgctactcgagtaattcatttctttacctgaccttgccgtcccggtccctctcagccctcaattaagctgccattgatataggatttataatgtgtcactggtccattcaggatacagtgacagaggtgtggctgaaaagctggataataaaaaatggaggcaacttccatttctgttcaaatcagggtagcaacaaaaccatagctgacccttgtttcagaccagcacagtccagctagacaaatattccaagcactgaattgtgcactaaatgcctagtgcccctttcagaagggacattgcctctgagtgaccaagatgctcatagtttcttcccacgatgagaacatctaaaccttggaaaatgattgtggtattcattatgttataattttccagaaaagaatctgtatttattcttcctctaggcttctaaacaataaggtaggttttacaaatgagaattttttaggaatagtttcttgactataccaaatttgaaaatttgtgtggcattcgaccacatgaattaggtagtattagagtcctttccagggatcttaaatgttatgaactttattttgtataagtaggattatgctcatttgtgtcttaaatacacagtgagactttggacttttttttgttagaattttatgttagaatttaactatttaaaagaggagtgttatttctttagagtcaaactcattcattcctatatcacaaatttggaaataaaactctgacttttaacgataacaagcaaagaagccacaggcatccaaattttattttatttatttatttttatttatttatttatttatttatttgagacagagtttctctcttgttgcccaggctggagtgcaatggcacgatctaagctcactgcaacctcggcctgccgggttcaagcaattctcctgtctcagcctcctgagtagctaggactacaggcgcctgctactatgcccggctaatttttggtatttttagtagagacagggtttctccacattggcaaggctggtctcaaactcctgacctcaggcgattcgcccgcctcagcctcccaaagtgctgggattacaggcatgagccactgtgcctgtccccaaattttaaattattaattgtattcaacaccagtaatatcttaggttgtggttgcaattttattttattttgtttttaatttatttttatttatttatttatttttgagatggaatttcgctcttgttgtccaggctagagtgcaatggtgcaatctcggctcaccacaacctccgcctctcggattcaagcgattctcctgcctcagcctcccgagtagagtagctgggattacagacatgtgccaccatgcctgactaattttgtatttttagtagagactggccttctccatttggtcaggctggtctcaaactcctgaccttaggtgatccgcctgcctcagcctcccaaagtgctgggattacaggcatgagccactgtgcctggtggatataactttaaaaattaaagtctgataaaatgtgtacatgtgcatttaattgtggttagctgcctattatttaaccaatatgataacacccctcagtcccaacttactcagcatttagaatgaattgatagaggttttactctgaaaaaagtcagtctatttcctcagttttctgggttttgaataactgctaggccttgccagataattctggcctaaagataaagctggtgaaagtcagggctggggttttgctacctgtgtatttatcagtcttctcctaaaccatagtctgccttttgatagctctaataattaatttggtcttccctgtctttcttctcccttgccccctaccccttctccctgtctgttcacaggttatcttgacgaatcagattacaacccatctgagtggagccctggcttctcaggcagacctggtgtctccagctgatgatttgtccctgtctgaaggtaaggaatctgtcctggagaggctgaaacttgacactgacatagagccccactgcctctccacctcctgttgagagctgggagatatggctaataggccctggccagtgaacccagccggagcctgttgatttaggtttggccacctttcctggcatctgatctcttatattggggagtcttttgccctgcctctataagggagctccatttggaggccagtcactcctctgtgtgttatttcaagtccttagtatgagggctgatgaattgttaaatgactttgtttttgagactgatactcaaaggttggctttcccagtggtcccctagcaatttagccttttgcttgtgctgagttcttttggactaaaaagcgtacatcagtttcatgtgccagagatatgacattcctgatcagctttacagaagattaagaaaaaaatctccacgctggtaaatctgcaaaattttctccaccctcccctgctagcaaaggtcaggctggctatggtttcgatggcaataagctttacgtagctggggaaataacaccaataaaccagagggtggtttctagttttattgaaagtgcttacttgacatttctgagttgttatccttgtagtctagtatctttcatgcagaatgctgtgggtctgggtagacatgcatagctcttccaggcccctcctccctttccactttctgagaattgctcatgaaggaatacaggagacttttaggcctagcaaggctcctggatggctgcccaggtgatcttctgcagatcagctttgctttatggtcttagaaattgcaagaaccacacctctgcttcttagtggtggctttaggagggaaaactagtggctaatttatgaaaactgtacaatgctttgtgtacgctccttccaagttcagggatacatcatcataacccctatcagcgaggctgaaaacctgaatcatcgagcattcctccctcctgaaacttttgtcatcaagtctgcttagtacttctttccgcatgtatctttcctttgtcccctcttttttgtaatgtgtgttgtgatcagcagatttactaaactcccaattgaattattttaataacatccagattggccttcccagctctagcctctacagtttccattctgccactaccaaattgaacttccccgtctggccttgttctgctctgttgctctcctactcagaaatcttagaatagttttttttgtttgtttcttttttgttgtttgttttgtttttgtttttgttttttctgagaatgagctaaaatcagtaagctgattttaacatatttagggatttgggatttgttagcttgaaatcagccatggtgaaagtatttataccatggaaatcagcaaatgctgaaaatcaggtggcttgtttttttatttcctccctttgcgtagactggttttcaaaacaccactagataaagtgaatgatttcaacccttcataatctgtcatttcctttctattcaaatttagttcctgccgatatcttaggtgaagctcctatgccaagtgtgccactcttggcctgcccctccccactcccagctccaggcctgtgcagagacagctcacctagaacagtgcttccccctttcacttcttctgcttctcgtcccacatccactccttcgaggcttatttaaagactgcctctttcacagaacctgcttgcctatggtctcagtctctttttcctctgtggccgctctatctgctcaactgtataaagaaaaagtctagaaaattaatttaacttttcatgtttttctgcctaaattggcagattttaaagacacgaccatgtcatattctttttgtatccatgttgttatccagtgactagcaaagttctagacacatactaggcagtaaataaatgctgaatgaatatcacagtaaatacttcagaagaacagtgaccatgagaatcatataaagcacctatgaacattgttaaaaattgttataattattacacacacacatacacacatatacacacacacttaattcagctctgaggagaccagaatagagtaaactgcttccttatttgaaaatcagtaagtacttttatttgtgttgccttcctggtttatcttaagcaaagaagaagagcaaaacacatagaaaagaaattgcttcagggttgcagtataactgccacaagaaacccctgacttgtgttcatagcaaaggaagagttaccaggttatcctcccagaaatccaacaaagaatggaaataattgatttttctagattttttttttgtatagctgagcagataaagaggctatataaatatattcctatagtctataatgaaggtttttattagtggattaaaatgaacaatgtcttagaacatttatagccattcaaatatattacaatggatgttaagttcctgtgatttacacacacacagacatgcacacgcatgtataaattgctctgttttgcttcaagcattcattgtatcagctttgccattgtgttattaactgtggtgttaggcaggcccttttgatgactttgggtctcagtttcttctgttacatgacaggttggaagaatacaagattgctaaagtgttttccagctctagcatataagatcatgaggtaggtctgaaggtcaggagcattcacccactgatggggttttaattctgacttacagagtaggaagaatggccgtgttgctgatgttgccctagattaaacacaataaaaaggatctttaataaatcttagcactgatacttcggcatacctgcaggagcctttcctccctgtatgttttctctttgtcactctggggacacttctggtcttgtctgtctgtctcttgctctctctgcctctctccacacaaaggtgtacaaaatcagaagtgtgtgcaaaccagtgagaatgagaaacacactgggatggggtgactggtcaatttgcataagttccaaaagttccattctcccaatagtttgtgaatgggatagtttgtgaaaggcaggctgcaaattgacaagcacactgcaaatatgaggagatattttaagtaaatagagaaaattcagtttgccctctcattccttctcaaggcacaaagctcaggggcaggagcaatgccgggaaagtccttggcccttggggtgtacttctcccttctttggctctcccacctgggagctggataactcaacagtggaatgaaacctcaatgaagggaattataccatgatgtcaagcagtgaacatgagtctacttaatccaagccaacaactcagccacaaatttaataagggtggtggggcggggagacccagcaacacaaaaacaaagaactctcaactttacaaacactgggagggcaacagctggtcagccgagattaaaggagcgtgagagagcacctcccatctcctgacttctcctcccccatagacgtccctgcagccagccagggctcgctttttacagccctgtgcagatgaccttgttccagctaagataggagctcttttgatctcagcagggggatgctctgggcctgcagctggcagatattaatagtacaggatctgttggggtggaagagatctctcggttgggccaggtcacttgtattccctcctctgcatcagagcagaagggacttcatttccctgagtcagcccctgctgcgtactactcctcttaggtcaactcagatcattttatcgctggctgctcttggctgcttgttctcacctcacaactgttttcaagggagcactgtttaagcagtgtactgtgcactgcagctgaaatctattacaggacagggtagaccttgccccccgcccccaaatcccagtgtgtgtctcatactcactggtttgcacacacttctgattttgtatacctttgtgtggagacaggcagagagagcaagagacaagatctgaagtgtacacagagtgagaaagagacagcaatacaggaaggggagactgttgcaggtatgccagagtaccaatgctaagatttctgaaggtcctttttgttgtgtttagggcaacatcaacaacacagtcatttttcccactctgtaaatcagaattaaaccctatcattgggtgaatgtttctgatcttcaggccctccttatgatcttaactgttagagctggaaaagactgtagcaatcttctagtatccactctgtcattcaacagaagagatagggacagaaataaggattttttctacattgttctagactaggtactttgagtcacagtattttcttcttcagatttcatttcattgacagaagttcagacatataggttattatagagttccctgctcagttattgtgactgttgtgtggccaaggacacatttcttagcccttgccaattcttccttatggtcattggagatactaagaactgttggacctcagtcataggtaacatctctttcccccagagtgattaatagagaagggatctaacagtccaaatggcctaagatgccatatcctattccaaagtcacctgggatttgagcagaaccagatgagtgcccacctacagttggtaggtgagatttgacaaatggtaacagtgagccctgtgcaagattgaagctatagaccattggcttgctttcttctgacgatttaacagagtagcagttacttcattatggtgacatggcccacttcaggagttccacatggctttatggaaaagaagacattattaggctgccatcttggtattcccagcatctggcatgttgtatcctgttttctgcattacttgttttccgatagaccatagcacatgaaaactaaaaatgtaaaatgtgtggataggtcaaggaaagaacacaagagaaatagcagcacttcctagaaccaagagtggtttctagttttattgttggaaggctttctattctggttggagtcaggggaattgatggctgatttcatgtgcaagagaaagtatttggggattcatattccctaccaaaccatccctgcgaaaagctggagtccatttgaaagattatatgcaagtttgtggcttgtgttctcttttaaaataagttcaacaagcaagacagctcagaatggttgggacaaatcagagactcatggttgtgaaagaagcaaacttcaaagcgcggtatgaattttcaagtcttatttccactcttgctttccagctggatctgctctggatttactgcaggatgtttgaaaatgtggctccctgctaatctcagacagttgctatgatcaatggtttctttcatttccgataaaaaacactggtgtttctacttaaattgtgtgtattttcagctttattattatagttatgatttattgtcctgcattacccaaatttgtaatccattaaccacagactttggggtgggttggtcaagttagcagaaatctctacatgctttagctccaaggcccttcacagcccaatctcagactaaatgttcattggtttgtgtagggccatgtaccaacgggtatgagtggagtagttttaaaaatccactccttgggggtatggtgcaagttggctgtaattagtactttgaaagcctaaggtgtcaccatgtgactacaaagttaatattaacaactatgatcaacattattaacattagcttttccatagtatttttaattgtcttaaaatgatgaatttcttaatctacctcaagcaactgaagcatgaaggagagaagagaattgctgaaaggccacacagtgagagctggtgtgctgggaacagaagtcagagcccctcccgtgaagttttaaatttggttactgctgcctcttaggagtgagttttggataaaaatgtttaagtgtcctggtgacctttcagtttttgtttccaaagccatagactatatcaacacacacgattttacatggttctattcacaagggcacacgccggccagtgctctacttccctggtattcaggagtccatagcacttgactgggcatatgtcttccagcagctgttcagatgccatgaaaggcctgatttatagaaaaagattaaaagcaccaaaaaatgtgtggtattcggctaaagaaagcttaaatattatgtgagtaggggaggctagagttgagaggagatgggcacagcctgcaaatgtcagaaaagctgtaaatcccaaaagggagaggaatgtgttgaggattttcagcctggaggccagggggcaatgtaacctcagctgggagaacaaaaggagaaagggaacattaaagtcaaccaccaggaagtgcttcttggtcaggagctctgttttgctggtgctagtttgtcaaaaggaggcacatttgaagcacaagatgcattacaatcaagttagatgagagccagagaggtttctttggggagcagtccttgaggtagtttgtgtgggagttgggctagctttaaaagtagtttcccctcaccctcaaatctttttaccgtctagaatttactgtctaatttctcaaatctgcactgtttctgttaaggtctcaatgtcaagaaagctggagggacaaaaacaccaaggcatctttgtcagttgcctcagctagagaggtgacgacagggccaaaagccgagagaatgggatgccaagaggtggtgtgatcccagaggccttcaagttagaaggactctctgagaagagatccttgttttccatcactgcagagaatgctataccaagggcgagaggcctctaggtcagagatcataaagaagaaaagaatggctggattttaggggtggtgcccaacgattagtttgtgttgtaatgtggcatgaagcgtcttcagaatgcatttgcgatgtttactgggatttggaaaaggatcgtaacaaggtctagcaaggcagtctagcccaaggagggtccagttgagttccgaactagtttctgatatctatcccttccaaaactgcatgtttaattaaagaacagccctcctctatcttccccagatagaggagggctgttcttcagtcgaagatatggagtggttgtgtttctctaccaaaacctttattccattttctcaaattttagcatacatcagaatcacctggggggcacattaatacacacattatggaccatatactgtatgcctggcatcgtatgtttattatctcatttagtcctcacaaccaccctctgaggatagtgcagttggccctccttatccatgagttctgcatccatagattcaaccaaccatgaatcaaaaaatagtaggggaaaaatggatgattgcatctgtactgaacacagacctttttccttgtcattattccctaaacagtacagtataacaactatctacatagcatttacactgtattaggtattataaataatctagagattatttaaagtatccaggaggatgtgtgtaggttacatgcaaatacagtgccattttatataaaggacttgagcatccatggattttggtgtctgcagcgggccctggaattattcccctgcagatactgagggacaactgtattaattatcccattttgtagatgaaggaactggggcttagaaggctacacaattagtggcagagtcaggatttccacctagggagactggctccagaggtacatttttatccactaagctcttttgtaaggatacaattgagattatcatgactatgtataaataggaactaaaagacagccagatcacatgggtattgggaaggttgaaacttaggttattctcttcatttatctcatctctgtcttgcctttccatgacactgacacttgactttatgatctaattgacccattttatctttcacacctagtaattgtgttcatgggttgccttttcatccattcagccataacagtaaagaagatggccagtacacctatcctttcagcagggtccattgatggggggcattttcttataaggggctatatatgaaggacagattccttttgaagggaggtaaatacccaaacataacatctaatagaaggactttgtccagctgagcagatattataagtttgttaagtaggactgtgtagctctgttgacccctttagtcattttcattctcagcatcttctccttcttccatttattatttatttatttatttagagacagggtctcactccattgccctcactgtagccttggcctcccaggctccagtgatcctcccacctcagcctcccaagtagctggtactacaggcatgcaccaccatgcctggctaattttttcagttttgttttgtagagacagggtcttgctatcctgcccaggctggtctcaaactcctggcttcaagcaatcctcctgcctctacctcccaacatgctgggattacaggtgtaagccaccacgcccagcgctctcctttcaaataaaaattttgatagaagttacctatcactagtccatgccatcaagccaatatactgttttaaaaatgaaatgtaaaaatattttcttttagccccaggtaacctggctcctccttgatctaattttctttataccaataatcagcctttgaatttgtcttcaggaggggagagacgtctcttctgtttatccagaatccactcgctactctaaactattattatctggtgagatatgaggcctaaatttaaccatgtataagttacctcatattcagggacatataacagaggcacattagctagcgcaggctgtccccatggtcagccatgatctatccactgcttgagcaagggaagccagagaagacaagagggcagctggataactaaaatatgtgcagtggagaactctgtgtctgttagttacatccttttcatgatttacggtatacaagagcaaaattactctctaccctcaggggagtgtctgagttttgtgggttaaaagcaaatgtatatgtgtatatgtgcagtgtatgtgtgtgtgttgaaggtggaggttcccgtctttaatagaaggcctttttaggttatgatgttgattttttttaaccatacttccatctaataggctcatcaaagcagctaaggtaatcacatttcctggcactgtcatctccagctatagaggatgaaagaaatccagtggacaggtttaaggagacaaatgtttttttgttttaaaatatgatgtttaggtaaatgaagctagaaaagcctcaaaataaattccttctgagtaggactctaggccagagatagaataagcaattgaaatctttcaatgtagaccccagaaaacaaacaacagtcgataagtggctgccagagaccaaggggtggatccaaggccagccaggaagaagtttcttcctccttcagggacaaaactagaactgagggaaacagctcttgccctttgactggatactacaaaactaaggtaaaccagcagaaagtcctgtcttagggtcattagaatgtgaggttttttttttgtttgtgtgttttttttttttttttttttttgagacatacttttactccatcgcccaggctggagtgcagtggcatgatctccactcactgcaacctccacctcccacactcaagcaattcccatgcctcagcctcctgagtagctgggattacaggcatgcaccaccacgcctggctaatttttttgtatttttagtggagatggggttttgccatgttagccaggctagtcaaactcctgacctcaagtgatccacctgccttggcctcccaaattggtgggattacaggagtgaaccactgcgcttggccagaatgtaagttcttgtgggcaggaatttttgtcacttttgttcagtgctggatctccacatcttagaaaagtgcttgacaataatagttaataaataattgatgttaataaatactgtatgatgaatggcaataggcaattcagggaaccatgtgagaaaggaaagaacagaagtggaacagctcagcttttgaaggagaaatctcccaccttcacacaagggtggtgactgagtagcttagtgtgatacactataatgatatttattagccacctaccatctgctaggtcatgtgttagacaggtgcttgggacacatagacaaatgctacagtccctgctctatgggaagctcacaatcaggggaggggaagggctgtggctatgacggacaagtaagcaggttacatttggtgtcatgatggcattaggtttgggatgtttttggggaacagataggagtcctggcttggggatggaggctctctaggaactttacaacaaggaggcatgtgaagaattaacagcagttcttaataggagagagagaaggggaaagtgcacctgacagagggaaaagcccccgtcatggaatccaggcaggggccggattgccgagaccagctcggttggggagaccctaacccagtggcgctagaggaattaaagactcacacagaaatatagaggtgtgaagtaggaaatcaggggtctcacagcctgcagagatgagagccccaaacagagatttatccacatatttattaacagcaagccagtcattagcattgtttctatagatattaaattaactaaaagtatcccttatgggaaacgaagggatgggccaaattaaaggaataggttgggctagttaactgcagcaggagcatatccttaaggcacagatcactcatgctattgtttgtggcttaagaatgcctttaagcagttttccaccctgggcaggccaggtgttcttgccctcattcccataaacccacaaccttccagcgtgggcattatggccatcatgaacatgtcacagtgctgcagagattttatttatggccagttttggggccagtttatggcaagattttggggggcttgctcccaacagaaaggtcttattcctcatgctgatcagtttgaattttttcctgagggtaatagggagccattgaaatagggaagtataaagaaaatgtggcacatacacactgtggaataccatgcagccataaaaaaggatgagctcatgtcctttgcagggacatggatgaagctggaaaccatcattctcagcaaactaatccaagaacagaaaaccaaacaccgcatgttctcactcataagtgggagctgaacaatgagaacacatggacacggggagagaaacatcacacaccaggttgggggctaggggaggtatagcattaggagaaatacctaatgtagatgacaggttgacgggtgcagcaaaccaccatggcacatgtatacccatgcaacaaacctgcacgttctgcacatgtatcccagaatataaagtataataaaaaaaaaaaaaaaaaaagaaaagaaaaagaaatacggaagtgacggagtcattttgtagttggaagcattttctcaggcagccatttacaggttagggggatggagatgaaactatagaacttggattttgatctctttgaggcaagtcactttggggtggggttagccctaaacttcttaaagcaatgagaactttagaataagttttaacctttctgagatgttgggtggccaggtctggttctagcttcctaccttaccaacccaggagagatttctttggtataccagccttctgaataacatcaggcgagccctccatttatcaaggcgcctaacagttagaaatggtgtcaggctatctataactctgctaggatgtgagagaaaatagcaaatgacttaaagtactaaatggaactatgagggctctgtgtggtggctcatacctataatcccagcactttgggaggctgaggtgggcagatcacttgaggccaggagttcaagaccagcctggacaacatggcgaaacaccatctctatgaaaaatacaaaaattagctggatgtgatggtgcatgcctgtaatcccagctacccaggaggctgaggcacaagaatcacttgagcctgtgaggcggaggttgcagtgagcagagatggcgccactgcactccagcctgggcgagagagcaagactctgtctcaaaaaaaaaaaaaggcactatggaaattaatacaagtgttatgttccttttgctaatgattgcaataataatattgagtgcctattatgcgtcaggcactatactaagcacataaaaatgcaacaacttagtggggttcaattatcaccctcaatttagaaacaaagaaactgaagtacgaagtatttccataacttgctgatgatcgcataactagtaattagttggcattcaaacctagagtcttgctctagagtctgtgctcttgaccagtataccatactcagctcttcaagatgatcatacaactacctcagctagagcttatgatcacatatttctgtcattgttagatttgagaggtttccatgcatcactataagtgcagctgtttctttatgtgtgccctgaaatctctatgctgatagtcagtagaaaagcagtgtgttttaacagaagctgaagcactgcatttagaattgggagacttgtattcaaggaccagctttgccacaaaccatctgtactattttgagcaaggcacttaacttccctggacctcaattccctcagctatacacataagagcttgcattaggtgaagctggcaggcctttcagtttgcttcttctgtcacattctgtcttcggtgagcaaattggtatgttcaagcctcagacaggcttctctgttcacctcttgaagaaggctggaccaacccatctatgagcattttgtcacatttcttttgtcactgttattatattggatatctagagcagcaatcttttgaatctataacccatcattttttagcatattgccccaaagtatggaaaattgctgccaaaaactatagtgctactatataaagttatataaaacacaccagaaatagaatttttaaaatatgaagtgggttctagtattttttccctacatcccgttgagtcattgtgatgtattcccaccacttggtatagttcaaatttctcccttccttgtttttactgcagaactctttactgtcccaagtagagtgagactgaaaccaaaatttgagcactgggtccattcattcaattgttcattcatttacacgttaagtatgaagcatctataatgtgaaatgcttgctgaattttcaggaggccataagaacggtatcaggcttggcctctcccctctcaaacataaaggctaattctagtgtttttcagttttatctggttggaaccctagaattcctgcatactgtaatgaagctaaactttacatctaaactggctatatgtattgcactacagtgcataagacaagaaaagttacaaaaagaaggaaaatccagaacgtgaggcccacagacatgaaacagttgaagtcacactgtagtacagcatctaatgaattgccaggatgagagaagcagatttttaatatcagaggcattcacagaaaggagagatcatcatgatctttgtgatggaggcttggaccactgccttaggatgtcagggcagaactaagatgggccccttggttggtctgtcctgactcactgtgtctgcagtgcctggatatcagccagcagaccacctccatcattgagttagacccacttacaaggtggcaggctattaaccagtcccctgttccactgagaacttgccaggctggccatcatagcatggtataggttgaagtagcttagtacctgtggtggatgactgtttttctcggccagctgtttaatgagcaccaaatgaagtaaaatgctgcttggttcctctcctctcttcagacacaaacaatcgagcacatcctagtggaagggccgtgttggggaactggctttcttgtgctgatcatcttggttcccacatccgtccctcccctctgggctagagtttggaggagctattgaagaaccttgagaaaactgttaaccttgaaagtttagttattcatcatcaaatatattaacaaacgtttgtagccaaagctttactgtctatggcagttttaaataattatcaaaatcatgatttaattaatttctctctccattttgggttggcttagaggagtaggagattgcaattcacaagtactttctggtcctgtaaccaacttgcactttcaagttcaggtaatcaccttgtccttttcagtttatttacccatgacttaggttaaagttgcccatgcctctggtgaaattcacaaatgaaacttcacctagctgggtttcatatttgtaagaaatcattttttttctccatgagaatgtgcaggtcagctgagacaagcatgattaattctagacatgaattagaacaagcccaagctgaacagctctctcagaggaagtcatctgaaattggtatgtgtgacccagtatatcttttgaccaatttgcattggaaaccacagtgagcatggaagaaatataaccttgatcctctggcctaataaacattcttgcaattctaaatgtacctagagtttgtgacaagtgtgtattggaaaactcgttgaaaacacatgagttagtaatgttctctttcagaagatgaacttgcatggccgaagtgagattccagtgggaaagacctggtagagaaagagtgggagaatgcgttgacctctggagggcagattatggcatgccaggcaatgggttgtgccatcagggaaggaatctagaaagacgaggagactcaggagaaaggagatgacttctgttgacaggtcattgttgctcagacttagtgcagatgagaaaggaaatccagaaacctacatgacagctcctcttggattggatgaaaatattgattttttttttttttccctatctggaatttgacagggtcagttcatgtctgggttttcagcacttaatacagggcgcttttgtcttgggaggcggctggactggtttttcctccaggcaggtgcacagagggcgtttattgtagcctgaaacacaaacaccaagcccctaggccctgatccacacactctccagtgtggctcaaggaaataaagtgaacaatgtctcttgcaacaggcgagcactgtaaatgccactcctgaatgatatatttcttaaaactttgtatccgtaacctgatcatctcttaaaacttaattatatgtcagagaaaaggaagctattggctcctccagctgtccaggttgaacgagagcacacaatggagcatatccgattcacagccttacttaggtaatcagattaatatctcctgaattgaatttacccttttgatatggagtctttcagctgccttgtttcacatctcaaattctgacaaagctgtgcggcctttgagtaatttccctgaaatctatatgtgggaagcctgtacttcaagcagtttttgggacttgcaccaattaaatctgtctctggcacacttttaatggcatgctttcccctgagtcaacaactgctccaaaatctgaagtcatttgtttaatttaaaagcaaaggttatggaacaaccatttcaagcttcaccagccaaactccagtggctttgaaaagggagatgaggcagaggaaaggctaataaactggatttcttatacacaaaataaattaattactgtgtttctgtaagctagtatcaaatcaagtttgttcacaccctccttgccaacctagctctccctttctcttcaaactcaccctctctgggctttcatattcacgattgaggctcaccctcttactgttgttcttgcaacacaaacatctggactggatttttgtcagctggagttgagagagaactgtaaatgatgcagtgatttttttttcgtccttattaaatttatttatagccagtctgaagccaggaaacatgctagagcctttgattggaggttctcgaggaatgtacggtggatggtattttctcctgttgttttctaaataatatcaaggatagaattacataactcccaacttgagtattttttgccctgaaggaccctttattaggacattttgcacatcagaattcttccattatatttgcttatccaatatgccttcttttctgtcagtgagagaaaaggaaatgtacatgacaggttatttctgaaaaattagaaagatggagagtgagtttctggttgtttgggacatgaaccagtggcatgagtattttcttttgccaaagggacacaacatggatcctatttctacctcttaacaacctctgcaatcttaaagctgccaaatctcaaagaatttcattcatttagtcattatttaagataataaaaggccctacaagcagcttacgaaaataatttataaaatatttttctctgcccttagaccttgttaaataacaatgccttggtgtttataaaattatttaagaaacaaaactttctagaggaggctgaatcagatgatgatttcttgaggtcccttcccagttctatgatttgagatgattctttaattttccttcactgtcatttatatctgtgtcattaaaaaaaaaaaaaaaaaaagggctgtttgggaatgagatttgctacacccgtaggcattttcttcttcagaaaagagactgtttagctttctgccacccaagtcagtcatcctcagcctgaacaatggagcttaatgttctccatcttcctaagagttagtgtctgttgttatgaaagtgaattgaaaccaaatgtactttctattggaaaagctgcccttgctctcagctcatggacaaaactgagagagaaggctcttacaaaacagagggaaaaatcctcgctgtcatgtcataacaccagttatttcactgttagacctatgaacatatctttgatgcaacactacactatttgatgatgtttctgtgtcacttaagatgggcgtttcatatttatctcttagaaatgttagcagatttttttcacgagttatcttgcttatggactggaaaagctattcttacagtaagacccttcattaactgagaaggcataaaagatagctcatgttctccaccaagaaaggaagctctgtttctctctgtctgatgggaagcatttgagacagagcagcttcatgaagtgtggatgtctgttacccacttcccagtttttaaagtaaaagccaagtcaatggcactggtacttgtagtgaaatgagccacagaggcatcattactcatcaccatcacgactcaaggatcagcaaatgagagtcctgaaggtaaagaatgtttattttcaggtagagaagaaagaaaaatcacggagaggtagagaaaagtgaagggcaaaggaagaatccagcagacattaagcaacactgtatcttccaagatcataaagccaaatagttcctgctagatttaacttttattattttgggagatgaaaatcactggggcatggagttctcattctgcatttaggaacttccataatattttaataataacaataatgataataatgccaatcactttaattaaatctccctaaataagcatcttttaatgcagtgttgtttgctgtaaaacatcccaactaatggtagaggctggatgtctgccaaagacatggtgagggaaccgccacagagccgctggtattggaccctggcagagctggttcctctagccaaaggaagtgaataatcatggggaagtggttattccagctgtgacactcaggaaatttcagtagaatgtgatggccttatatatggaatattcttagacatactaggatggcacatgtaaattatcatgggaaacataatttgaggaatacagaagattataaggtattatttgattcaggtttttttatgttagtttggagccattgtcaggcatggaaatactttcattgatattcctgtcttctataattcaaggccttaataataaactggttttgaatcaatcagttgtctgatagacggctcctgggaagactggagagccttatgagggtgcccacctctctcctgtgtaaaaggcccttcactctggcagcttcactcttgggtggtgttgggtagaagtaagatcagataccctgctcactgtaggatggaagggatcacatcaaagctctgagggctgttttccccttaggcatccaaacctgatttcctcttatcacctgatatgaattttcgactgtttcactttttccttctctgtgcttgtgttttttacaaaaccatgaagcctgtaaaccacacggtagatatgatcacaacaatattagtggagaaccccatgctgttgtcagtatcaccatcataggtatgagtgcttgatgcagggtgtgagggggaagggggcagtctttttaaaaagcaggtcacggctggacgtggtggctcacgcctgtaatcccagcactttgggaggccgaggtgggcagatcactttaggtcaggagttcaagaccagcctgaccaacatggtgaaacccgtctctattaaaaatacaaaaattagctgggtgtggtggtgcacatctgtaatcccggctactcgggaggctgaggcaggagaatcacttgaacctgggaggcagaggtttcagtaagcagagatcacgccactgcactctagcctgggccacagagcaagactccatctcaaaaaattaattaattaattaaaaattaagaagcagattacctttgaacctgtttagatagtggtcttccatccatcacctcttaactcctcatctcccattttcccaaccccacacacctcatctttgcatggatgaagtgcagtctctccagaacgtttttgtgagtggagggatgcagagtagattgtcggtgccatgtctacgttgttaactgcagtccaacatgtaatctagttaaaaaaagaaagaaaagaaaaacccataaaataaattttaatagactacccctaggcaactttgaagaggaaatcattgcaagaaaatgagacttactaaataggccatttgagaagcaggcaatggctattttaaaggcttgaggttttaatatatgtatatgccttttttccctcatctcttgcaaataaataatggtttacatcaggagacaattcaggaaaaaagccttttaaaaaattttcaggaaatctggccaccgtgtttctgcagccactgataaatgacaatgccaccagcagtgacctaggacatcctgaattcttgctcttctgaagagcttgcattctcttttcaaagggtatcctgttcctattgcaatctttaagctatctcagctcaagatcaccttttttccttttattatcatacttaaaacagcactagtgctgttaagaagactccacccatagatgttgatgtcatttgtgaggaggacaagatttaaagagaaggtaactgggccaggtgtggtggcttaagcctgtaatcccagcactttgggaggccgaggcgggtggatcactaggtcagaagttcaagaccagcctggccaacatggtgaaaccctgtctctactaaaaatacaaaaattagctgggcatggtggcatgtgcctgtaatcccagctactcgggaggctgaggcaggagaattgcttgaactgggacctgggaggtggaggttgcagtgagccaagatcgtgccactgcactccagcctgggctgcagagcaagactccctctcaaaaataaataaataaataaatagaaggtaactggatattggccccaaacatattctaattcagcaaacagacccattgaaactcagcattgttatttcaattcatgttgtacaaatcaactaaatacaattttgtctattttcagggataactgagtgttcttcatccacaaaggcccaagtccgtataggacagtagcacaacggggaagaaatgtgtgtttttttttgttttgttttgttttttagtgctgatgaaaggtgttatatccaagggtaagttataaacagagaagctgtttctgattgtgaagattggctcagcctgcactgacacttctgaaaaggtggaaagagcaaaatcgcagttccctagagtctctcagttgtgtgatatccatgcatgttcggagcagaatgtataacggatccaccgttctgcttctctgctgtcttctagtttaaaacatgttgcaggctaaaatgcagagggagaagattctattggtttactcatccagttattaagacaaggatgggatgaaggatcagtcttcacagacctgcaaattccctccagtattgaccctgttgttgcctgagggcagctgggtcaacaggtataacctccctttttttccctgaacaaaggtagctggactttcaaggaaaaaaaaataatccagccctggtaatcacacaaacagttctcaaagctcaattaaactaaaatgccttgtttcagtttctttccacagtttatagattttaccagcataattatcaaactttaaatgtttctctcttccattgtcttgttctgtttggttcacctggtgatgtttgttatagcctttctatttgaggaattagtggaagataaaatgttgctaagagcaatttcgttagtattgaaaatagcaggaaagaaatagagggagcagccattgttagcaaagtagcctggttatgtgtattaagcttgggaaagaattaaggccatttggtctattgatgcaaaataccttcgttttactaaccacagaaaaagcccttggttgggttgtcttgagtagttagaactgggggtggccaagatgactggttgctgatttccagcactgtgcatcaaccaccaaatgattttaactttcaaagtttatggggaaagggtacgatatgaattttgaggtttttgctgcttcttatgcaaaacattatttcggtttcaagcagctgatcacaattgcaactgcttatacctggtgaattataatattctctatgggaactgcactgcatgtctgtgggggccgtcccatctgcctcctttgtgaatctcttctcctttcagtgcctcctaacttgggccccaaagaggggtacagcagctgaatgtcattctcttgggctgtggcccaggcatgcatctttctggaaggatgactgaatcccattcttaaatctgaagttcctcttgattagcggctccttttgtttgttgtttttaacggcatttctgtctttcatgggtagcttacagggatgtgttttagagccccttccagctgggaagccgcccaactcccaccagctgagtcgggggatggcttccctttagttccgctgctgtctgtggactacaaggactccacttccagccccagcaacagtggcccttgtctgctgtgcaaacttggctctcttctctgggttttcattctccagccatctgggcattttgggcacccctcttatcttagtaccttggcactcaggaccacatgtcatcctatcatagagatgcaaacaaaggaatccttcacctctagcttgcagttcccctggaaccatcatagattgagtgacaatcagggagatgggggcttgggcattggtcttgagtgatataaatggtttttctaatagaaggcatttggaatgggctgacaatagctaggattgttcactaccaggattcttagtgcctagcttcctcctttttctctggctatcttgaaatctaggaggaaggagctaaagaccccgtggcctctgattgccatagcctctctaggcctggaagcttcagcttagggactagaatactgctgtgtgccagagcagttcatctagcttcctattaagaattctatgtgcattacccacttttaaaattcctcctcctacttcctcaacttctggcttggggagggtttgatcagagtcattctctcttcagagaagcatctggaaagattgatccaagagtgctgatagcaagttcgctatcatcgccctgcctcgaggaaaataagcattcgataaaaggacacttccactgcccagttcactcctactccactgtgtcttctcctgtccctccccctacccctctgacccctgcactcattctgatccctcttcctgcccgaatgtctctcagtggtcaacaaggcatgagctagccaaagaaaatgcaaccaaatagtgttaatcacttccatttagacctcagtagtcaggtggggctgcaggtctttgaaaggcagacttaaaatgcttgcctcttttcagcgaatctgattttacatttggctgctgatcattcagcccctggcatttgttcatacattggaagcccaaagcttccacacagttgagtctacagagcagagtaatattaacaagacttatcttggttatgatgccaaaaccatggtgccacttcatttcacaccaaagtggatggatcttatttatttattttttaagagttgaggcagcacagagaagctcagagattcattcaggatcatccactgtgtccaagctttgatcctctggcccttatgacaggcaatgatggttcagagtacagacagagctcctgtagagcgtgcgaccaatttaactggaaccatgggttcttaattacgacttcccctccccacccactgccaccaccatccagttgccagaacccagttggttttctgtgaaacggcagctagtgacactttgcatgggttcaccagaaggcctttcagtctttgtctcattttaattgtgtatctcaaccaagaagatcaactctccacatgtaaagttaactccctttagttttcaaagtttctttccaagaaccacctattgtcagtccctcatcctgtgtctggcaaacttagaagaaacaatgaagttcacagtacagactgagctcccgaagcactgatcttttatgtatctaaatgagggaagaaggaatgcatattctctggcacaagctggctctaccatgtgatttgaagtaaatggccattttatttcacattaggaggagagacttggagcagtttggcagcagatctgtagcgggttattaatctaagaactatagttttcttccacataggagattaaatacccatctttcgtcagatcaaagcaggcctcttggactatctgatctttgcaaaaggccccatgttgggccagcacaacagtctttgcatgtattgctccctatgttaaaaacaacaacatcatcatcattttagtatgtgtaaataataaggtctgccagcattagcagctctctaggcccaaagtaaaactttaggttttttttctttttttctttttttgagacagagtctcactctatcacccaggctggagtgcagtggcgtgatctctgctcactgcaagctccacctcccgggttcacaccattctcctgcctcagcctcccgagtagctgggactacaggtgcccgccaccacgcccggctaatttttttgtatttttagtagagacagggtttcaccatgttagccaggatagtctccatctcctgacctcatgatctgcccgccttggcctcccaaagtgctgggattacaggcgtgaaccactgcacccagcccctaaaactttagttttacttgaactgactttatattaattttctactactagaacaagtcactgccccccagagtttgaagaaatgtgaatattaactagggcttatctgaatgagaacaacagcattgctcttttcgtagtgttgtaataaatatcatcttagacttatacggcattttctttagggcattaatagagtttatataacctattgttcatttacttgatagctcattgagacagtttaggtattgatgctatattcaccatctataaaatgggaagaataaaaatattaagttcaacttaaatgggttacaagaaagaatacagacatttgtatgatctatgtctccaagatactgcctagagcttttaaactttgtaagttctgcatttcacctacccaagggagtctgagagtgtgtaatttgggccagggcacaacagcccttggccaggttgaagtggacaaacaaatggaattggttccagtttaccaacctggcacgaattatgtgctggtcaaggaagtgtttttcaaatcatggggagccactagtgaaaatctactggtgctttgatggtggcctttggagatacttttataatttgaaaccattcccatggcaggccagggagaggtcttactttagccaacatgcaacattaggtagaagaaatggggcctttctgactggtttgacctgtgggtgggccctcttccacatgtttctaattaggatgcaagaaagagtagatattctgtggcgactctcctttccttctcggctgtgagacagaacaacagcgcctttgtgatgacctttacagggctgtttacatttggtgacctgcctgaacactcccgccagagtggacgcacctcttggctaatgaggaacagccatgctgtcttttactatggtagaccttggaggttaaaatgaaaaataagaggatcctctgttgatgactagtcgaagttaattttctttacagatttattgaggtataatttacatactataaaattcacccattgtaagtatacaattcaatgatttttagtataataaatttataaagtcttgtcatcatataatccagtcttagaacttcgttggagttattttgaaaacaccaaataatgatcataattggaatgtagatcatgctgaagtgaaacagaaatttatgaggctatcttgggttaaggaagagggccacccaggaaactatttgagacaattaagtctcaagcttctcaaaatacatgaaaccttgagattagcacttatatttcagaacattttccatatttttgcttaccaaatggtatgacctacttgaaaaaaaatgagaagctgctgcagaacctgcctcaggtgtcagcatcaattaatgtttcatggttataatgagaaggagcagaagatgagagtctaagctccccttaaagggcttatagttcactttgaacatatttatttacgtgccctctcattttcaagtactgtgttaggtactgcagacacatggatagtgagacaatgtctctacccttaagaactagtagtccagtggtttctgttaaatttcagtatgatgtcataaattctgtggtaaagtgccgtgtgatgtcaggaaggtcatcagtaaagactttctagagttgatgttactaagaaatcaatgacatggttaataagctcactagtcctgctgacactgagtccctaccctcggctccatttggatgaggctctgtgagatccagtccctgccttgggggctttgtcattcatgagagaaacaagtccatcactccttccagttagatatctgtgaaaaggtggaaaaagcaaagaacacttggaatttgggagagaaagagagaccatttaagggaagaattgcatttgagttgaattttgaaaaaattgagataggcttttgcccggcatgggtaaaagtgggaaacagtccagaagaaagatgtgagcaaaggctcagggacaggagaacttgggatgtgttctgagaacagtgagtaatccaaaatggattgatacatatatcacatagtatagctatttctatatacttatgtcagaaacaagggaattaagggaatcacaaggctctgctttgcctgtatcaaggaaggcttcctagagaagccattaatttcactctgtctgttatgcatgctttacaccaaggtgatgtgattagttttcttctttggtttcttctttctgaattcatcaggtggtcacacccactgggccacagaaagcaccagtggattttcactagtgattcctgtgattaaaaaacgtttttgaccagcacgtaatttgtgccagatttgtaagctagagtgaattctatttttgtccagttcaacctggccataggctgctgtaacctggcccaagagcttaatgtaatactttcaagaagattaaaaatccaacaatcccttgaaacattggttgctaacctttgaaagagtagtcactgcacctgagtagccttaggaaatgaataggaggtctgagaaaaagaaaaaaaagaagagtggtaccatttgcttaaaatccctagggccttatagggtaaacctatttctaaatttaagttgctaagaccttgaacctggggttgtttggggatattttggaaagtaaggaatattattgactttccatcaggaaggaaagaactcagttgtttttgatattactaagaaagagagagttttgcatttatttgtttgcatggacggtctacctaccgtgtggccttgttcatgacatggcggacctccctctctggggtcagtgtgaatagccaggctgcagctgtagctagagacaatggccagcactgttgggccttgccccttaagccccgaaggttaatttcctagtatttagtggcattgaacccgccaaagaaaatgctgtttcatctgggggaagataatttctgcatgtgtatttttttcatgaagaataaagaagagatatttttggaagaacataacttaacctgttggccttggctaggaaagctaaaaaagcaaggggtcagtactcttacaagtatcatgtcttaaacgtcagccaaccagtaattatttagatgccatcagaggggaagtcccatcccattgttattttttctctagactgtgagatgctttaaaaaaacctctctgtagggaaatgatctttaaaaaacaaacaaacaaaaagcctgagaatttagtgctgcatttgttgagaagtaagggccctggaaacggaggagtttttgttgttgttgttttggtgactgctttgccactctgcatgttacaaagggcaaattcttggccactgtttagggttcccaaaaaattccaagatgtccagttaaattagaattttagataaacaacaatttttgtatgagtacatctaaaatattgtactgggacctactcatacttcaaaattattcattgtttacctgaaatttaaatttaactgagccttgtatttctttttgccaaatctgcagtgctttgttacttcaataaaaaaactgtccaaggagcctgggagcttttatgattattgaaaatcactgtcaattttaaacctaaacaaaacaatagataaagctttgaaaatagaatcaagtccagtcataccaagtgaaaggagtcctttctcatttttttatcttcttgtagccagctctggagatccaattctattgggaatggctcacctaggtctactgtagctcagagttataccttgtagatcacctggatgcttctgtgttccagctttaactcagaggatcaggtcagaatggaggctccctttgaaatctaaagtgcttagcttctttagggtagctccacaccctttttaattcttctgtaaaatgtctatctagcctagagaagtggagtctcactagacatggttctgagaataatagctatcatttactgagtgcctaatatgtgccagtgccttacctgcattacctgcctgagttcatactgccttctaacaaccctatgagacagatactgttatctccattttacagatgaggaaataaagacccagagaggtttagtaactttctgcaggtcacagagccattgaaaggcagaagtgggataagcattcaaatcaatctgactccaaaaccccttcagtaaccattgtactactgcatgtgatgcccttagattctccacttttcctctccctccccaagcccccagtttggcttgatattggaatcatccctttctctccttgttctttactggctggaattaatagagtactttcggtctgaaactggccttaaagaatctttgtccgtgtgtatcacactgcaatgcaatagacgcagaaatctgggcactagaagatgttaactttggatgcctcctgttttatatgcatatgattaaaccaatggggaaagaaagccctgaaactttattacaacatttttgtagtattaaatttgacatattaaaatgtgttatcattttaatatctttaaagagcctgaggagactctcaagccttagactgtaaatagctaacagctttgagatgagcttacataggagtcaaatgattgttccaagatggctgttctaattctgcagagctaccgtagtattcagcctactgcctgccaaaggcaaggggccttgcccctctcttcctcctccctgctttcctctttgttaagaagtaacaaaaatatactgcccaacacccactttcttttagaaccaacacatattccttctggctcactccctctataaaatgatttgtcagcattttgatctcattaaataaaaagttttacttggtcaaactgggaaagtttatgaagttagcccttccatcccatcatctgctgtggccacagttgttgactgtgaaatagctctgtgggtgtggtctaccaagtatcccaatagcatttcttacactgtgggctatggacccaaaggtctggaagagttgttttcatagggtcacactagaacactggctctttctggttaaaagcttccctagcctttctcctccaactcttaacacatctctcatgtttctttcccccctgcagaagtatagaaacctcctcttttcttttcctctgcactctcctcatctgtctccaagtccccattgtgccatgtttctcctacttcctgtttcctttaaccactaacttctcacgatttttaaaatcaagcctatccaattctaaaaggaaattgaaaccctgcccaccaaaaaagtaaaactagggggaaaaagccatagtaggaggtataatgttatgatcttctctcttagccctacacatctgtaaaaagtaatcttgctccgtactgcaagactagggcagcccagtcgcccactccccttttattctccctcctcacattcccctgtccttttctaacccaccttcccacttagggtctaatttagccaatttatacactcgccaagcttgcaaaggttttggttctctccttttgggtgtggaatgctggtgccacaggggctttcagaaacaatttagtaagtgatagacttggaagagttcaaaagcagctctgggaagacatcactgatgagtctctgctcttagcattttgttgcctcttagaggcttagcaaatagcagcatttgatccataatctgctctttcttggtacccagagaggcagcacaagggtagaccttgagcaagttacttaaactctgagcttctgttgccctttctgtaaaaaaaggcaaaataatcattctgacctcacattgttgctatgaggattcagttagttaatttttaaattttttaaaattaatgtgtttatttttttgagacagggtcttgctctgtcatccctgctggagtacagtgctgcgatcatggctcactgcagcctcaatttcccaggccccaattatcctcccacttcagcctcctgagtagctgggaccacagctactcccacttcagcctcctgagtagctgggaccacacctggctaatttttgtatttttggtagaggtggagtttcaccatgttgcccaggctggtctcaaactcctgagctcaggggatctacctgcctcagcctccaaaagtgctgggattacagccatagccactgcgcccaacacaatgacttaatatttataatacacttagaacagtgcttagcatgtagtaagcactagattaaataaatgtataaaatgaaggaagaaataataatagtgtttttcttttaattcatgcatgaagaactatgttcgacttctgtatggtatcttgaaggggtccaaaataaatctgactggcagtttgaaggcctataagagagcatattacataatttcactcaaggattttgacaattagtccagcttgatggatctcttctcacctgtattttggccaaactgaccaattatttcccattccaactgccatccaaatttccttccccatcccttccacatgtttcagttgcttttgctgcctttgcttcatattgactgtcaggatgtatggccctgtaatactaggtttttatttaaaaagcctttctctcattcataagcttcttttgaggagtgaggcctgcatttctgatggttgtgtatcattcccatgccttgtgcataagtggtactctatccatgtgttttgattggctgatttgagcttttgcagattaggaaatagttggcctagagctaagtggcacctgagagaatcttcccctccaggcctcacagatgcactctgtggaaaggccattgtctccttgctttgtgttggactattaggaacctaaaagctaggacaggcctgggtagagatagccacctttaagttaggggaatgttggggagtctactgggatttgactgtgaggtgaaaggagggctgcctacaagcagaaagcttaaggcattggctttgtgtaattaccaggaatgcttttagctagcaccttgaacggttggttaaaaagggacagttagatgtttgttagatgtgtggtgttaataaccttgaccagtagattcgtgactatgagaatttcaaaaggcgaagcaagaacacacacagagggaaaacatctcttgtttctaggggcagccttcccagcagcactcagcccagagctgtttttcccccaaggagaacacagggacaaaataaatatgccttcctgacccaaagacaggagcgcccagggagaccatgggatctgggagtgagagcagattgtagggaggaagtatccaggatgagactggtattagctacaggctggacagttagtcggtggcagctaggtactgctgctagtggctgagggcagggtttcttagagacctgaagatgtgagcattcatttatttgttccttcatcattcagcaaacctttactcagtgcttattatgtactggatactgggctgagcccccacttgtgacctcactgggcattgagtctgaggccttggcagctaagggtggtgttccttagggaactgggaggccatccagacaggaggcacagtacaaacaagaaagaactaggggccaggtatggtgtctcaggcctgtaatcctaacactttgagaggccaaggcaggtggatcacttgaggccaggagttcaaaaccagcctgatcaaaatggtgaaaccccatctctactagaaatagaaaaacagttagctgggtgtggtggcaggcacctgtaatcccaactactccggaagctgaggcaggagaatcgcatgaacctgggaggcggaggttacagtgagctgagatcgtgccactgcactccagcctgaatgacagagtgagactcctggggaagcccagccctgcatcagagaaagtgatgcactgatgcttcacacacagagaatggaagcgggagtggaggcatttttctggagttcaagcttcaccttcaagcatgatattcagattccatgagagcatgcagaaagagcccagcggacctgttgaacagggcataccattgtgagtccttagaagctaaaagacagccaagaacagtaggaaagaagctgagaataaaagctaagacaggtacctccaatctctaaaaagttaaacctcttagaggattataaataaagccacactcacaggtgtacatgctataatttattttataagtgcctggcatattaataaatggtatgtagtttacttacagtgctgtttgggtggttctcaagtaatctcttgttttacattctaaagtccactcagtgttagaatggaccatttgagcccaagtagattcaacaaaccatctatacccaacccgcacatctgggcagggatgacacttgatgagccatccaggcctcatctcatagactctattcatcccctgctgtcatgggcaccaaaacattttatagtaaattgcacagtagtttgtctttcccaataaactgtatgcttcttgagggtaggtaccctatctctttatctctgacacctggcacacagcccagcacatgacaagatcaagaaccaggactggccggggctcagtctgcacgtgctctggctttcaagtggcatcttctaatgatctgaaagacctctctagaacttttttccttttatgttatgtaaataatatacttaagatagaaacttttgtgtttcatgttgtatattaatgttgaatataaagtttttttctagagtgtgactattttttcacctagttccttcaaattttcatccctaccattagtttttcaaagtctctggattcctgttgaagtatccttttctctggaggtttatatcacctcctaggctgcttttgacttatctactcatgctttacttcggtagtgctgatgctcacccccagttattcctcacctgtaccatgtggtattattaatgcaaatgaggctttacccggctatcccctcccctagcatttatgcattcttcagggaaaactctgttgtatatgtctctgagtctcccacagcaactaacacagtgccttacactccattagctcctcaacgagtatgttttaataaattccattagtggagtgaggtagttaggagcaggtatgagctcaggcctttgagtgggacaacctgggtctaatgctgcctccttcactaactacttttatgatcttgagcagtctgctaatcctccttgtgtccaacttcttaatgtttaaaatgaggataatagtagtacctacctaataaggattaagtgagttaagatatgtttttgagggttaaatgcattaaaatatgtaaaacacttagcacaatgcctggcctgtagtgagagctatcattatcaacaaccaccatcataggtacccattatcagaagttgggggtttggataaagaaattaagtttctctaggttatatttttgtgaagtctgaactggaatgaacttcttcagattcctcatagagtacttcatgccccgcccttttattgcacagggactatatctgcttcagtatgatgtagaacatcttgattaagagtatttttttatctttcgtccttgacttatcttttggtgtgtaggtatattgtttcatcacattctcattttttttttttttaaaaagagttgttccatttcccctttttctgtctactgctttctccttctacgcttaggccaagagtatattacacttggaggcatctagttagcgtggtgcttcccaaacctttccaggacccaaaataggctaaataccacaccaagggagacatcgatgatgttctattaagaacagtgaaagggaacccaggcataaatatacactcagtatacacaactgtcaccacccatagcactgaccatcctattgtaccttagaacttaacactgtaatttatctgagtgttttttaatggctctctactaagtgtcaagctctgtgctaggtctggggaatggaaaaatggtaagacatggttcttgctgttgaggtgcttagttgtaacaatttattttcatcttttattaaatactaattgaataatgttgttattctttttcttttctttttttttttttttttttgagacggagtttcacgcttgtttcccaggctggagtgcaatggtgcaatctcggctcactgcaaccttcgcctcccaggttcaagcaattctcctgtctcagcctcccgagtagctggtattacaggcatgcaccaccacacccggctaatgttgtatttttaatagagacggagtttctccatgttggtcaggctggtcttgaactcctgacctcaggtgatccacctgcctcggcctcccagagtgctaggattacaggcatgagccaccaagcccggccaatgttattattctttaagtaaaacatgtttccccaagtaaacttactgtgtgtttagtaccatcctggaccctcttactcacagtgctatttgccccactactacccagtaaaaagaaagggtgacaggttgtaaggacatgtaggggtttgaggaaagttgggcttgtgtcaatgtaataaaagccaagtagttcttcttccagcccagtctgtatctatgactagatcatgaacagagaactaaaggcttttgattataaacctccttatgcctaggcttggcccacactcaactctaatacaaatagtagtaaatgttaggagtagacataaaatgagcacaggttgccactagaactttttctataacctaattacatttttttcaacctaaaatattacatattgtgtcagccaggatgccatcaggaaagagatggtgcactttagtattccgaggctaattacagtggggctccattagtgcccctagattgagaaggtgagggaacaggctggtttctggaagcaaggagatagagggggctgtgtggaaaagactgcctagcaggatctgagaccttccatcaagaggcacagccagtccatagcccaacatcactctgctccttcaaatctcctaccggtgcaccccagtggcccaacccaggagagtcctgttgatgtgacacacacaggccaggtcccagggcagagagcaggtgaagaatgattgtgagtaaatctagaggggcacacaggaagatatccagcaaacatgtttcacacttgattttagaggtaagggtgtgtatcttaattttatctgttttagaaaactaaaattttaatagatttaaagtatttctgccatagttcttaaactatcaatctgatgatgtcagatatttttctcagtgtcattagtttgacctcccgccacatttttttggtggagaggggtgagggattgtgtataaatttcctccagagcacacagagaataaaaatgctattcttcagtttgtttttttttgttgtttttttttttttaacaaagagttgttccatttcccctttttctgtctactgctttctccttctacgcttaggccaagagtatattacgcttggaggcatctagctagtgtggtgcttcccaaacctttctcagccaaagactcctctgggaatccaactaaatttcctggttcccttttgcttttaatatcaatgaccatattacccaatgaggttatttttatttcttacaaatatttttataattaacttaagattcaacaaggagccaaaggtaaacagactgtaattatttcaagttctaaccattatgagtagatattaatcttcgagaaggtattattaaaaaaaagtatataatattcataaattaaagtcaacttataagtacaaaggaatatctgtgactataaaaggaaaaataaactggaatttaaaatttaatcactgtgccttagtaaacacgatcctggtacatttcagcacagtatttgtgtttcagaataggattttgtcttctagttattcactaatacgtatttattttactatcattcagcaagaaaccctttaaatcactgtcaaaaggtaggtgatttactggaacagctaacctacctctgcctagagtcccataggcactcacttccctatggaaccctctgtcccttcttcccttcctatatacctcaggtacctttatgcagccttgttctattgccactctgcctgttttactaagctgccctaaagtcactgcaaaattttgatcagaacattactgaaccaggacacaaagaaatgctcattacaggctttaaatatatgctttttcttagatctatgggaacaatttctctaattcttaggttttgctccctgaaattacacagaaagtactgtatcttcttaaccctttctccacccctcctttcatttcaacccaacaaacttttctcctgtgcattgctaggcagtgcttccattgtccttaagtgtttaaggtcttgtgctggtaatgagccagtagtcacaaagctagccagtggatttgttcttcaagcctttagtgattccatactccatataatggactataccatttgtggattccttgacagccatgaggagacactgagggagctatgaatagaagaaccctgtgttctcccctgtccagctcccctggcttttggaaacagaacttcaatttttcttctccatctatgtggttcacatggaactgaccccatcctccaactctagaggttgtctctgaacttgggtcagaccaaacgagtttcagtgcttggtttagaaatgaatatgtaaccgaagctgagcatgtgagaatccaaccataagaatttggccgagccttctggggaagaggagcctctgtaagctagggtcactaaattggtacagtgaaagcctgtagccaccactttggagaagcctgcctaagactaacaacacactgcaaggaagagctgaaagatggagagagactggttctcatcatcatttgaccactcaagttcagctaccttggtcatacaacccgttaaatctatccccagccctaccagttattttgtatattatgtcactttttatttttatttatgtatatattttttgagacagggtcttttgctgttgcccaggctggagtgcagtggcatgatcatagcacactataacttcacactcctaggctcaagtgatcctcccaccttagcttcccaagtagctaagacaagaggtgtatgccaccacatccagctaattttttattttttgtagagatggggtctcactatgttgcccaatctggtctcaaactcctggcctcaagccatcctcctgccttagcctcccaaagtgctggaattacaggcatgagctaccacacccaggcttattatgtcaatttgaatgtgcactctgtcacttataacccaaactcctgagtcaaataccagcacatctgagaattcaacaacttctgggatccacagccccatggaggctacaagctactaaaaagataggaatgtcagcttcagctaagaattccagaaatctacagaaggtacctttccttttctttggttccagagagcatgataatatacatacagaattctggaaacttgggaccaataatagggtgtattaccaactgtgtgtggtatctgtaattaaatattgctaaaaccctgtagaggctggtttttacctttaaaaagatcatcttaaataatctgaggatttttattttaaataagttaatgttaaaaatattttttgggccgggcccggtggctcacgcctataatcccagcactttgggaggccgaggcaggtggatcacgaggtcaggagatcgagaccatcctgaccaacatggtgaaaccccgtctctactaaaagtacgaaaaaatgggctgggcatggcgctgcacacctgtagtcccagctactcgggaggctgaggcaggagaaaggcatgaacccaggaggtggagtgtgcagtgagccgagatcgtgccacagcactccagcctgggcaacagaccgagactctgtctcaaaaaaaaaaaaaaaaaaattgatagcatgaaaatttgaagtaaagagtcaattatgttaaagaaaaaaacactccaaaatctaacatgatgctaggctacgttaacaagagcctggcattaaaaactgagtcaccatattcagcattaataagatactagcaaagctctcattcagctgccatgcctaggttgtgcttctgcatgttcagaggatgtggaaagcaattgaaatgattaaaagcatggaaaatcacatctctgaagagcgatgaaagtaggctatttaactaaaagaaaagaagattgaaggaagaaaataaatggtgtttaagtatagaaagagttcttataaagaaaaaggtgtccagatgtttcccccttccactgagtatattaagagaaaattgccttagacatttcatttttacaaaggaaggattttttcaagcaaataggattcttgtactgggtgtgacattggactagatgacctttaagatttttcttcactaagattctatgattaccagattgaggatgtacttatcaaaagagtgtggaaccacttgctgtatgtcttaaaaggtaagatgaggaaacactggctggtttgccttaggtgtcattctgcccaggagttacttccaacattcataacatgcctttgaagaagcaaatattgtatatagacaaacagcatatcagaaaaaaatcaaaacaaaaacaaaggaatactagcattaaagtaataataaaatataggatttttattttctactctttcagtatagccattagcaattcacagttagtttcttcattaactagataagataagtgaggcaaatcatgggacagtttagtattggtgacagtgtgtttggaggggtagaattaagtgttccatatggaatcaggagcatttaatgtcagctctagtatgtatgtggcatatttcctactgcaacttaattggcataattttggatccagagaatacaaaccaagactcagaaaactatattttacttttaaaatatagttttaaaaacaattctaggtttatacatggaaaagctattctaaagaacaatagctggccgggcgcggtggctcacgcctgtaatcccagcactttggaaggccaaggcgggtagatcatgaggtcaggagttcaagaccagcctggctaacagggtgaaaccccgtctctactaaaaatacaaaaattagctgggcatggtggcgcgtgcctataatcctagctactcgggaggctgaggcaggagaattgcttgaaccaggacctgggaggcagaggttgcaatgagccaagatcatgccactgcactccagcctgggctacagaacgagactctgtctcaaaaaaaaaaaaaaaaaagcaatggtgttggcattattgtggtttcaatggatctatacttatttaaaacttaaagtttaaaaaaaaaaaagtccatatgttgctccacatctttctgtactagttgggccattttgttgagttctactatgtggcaagtcaggatgttttgtgtaagtacaagctcctgtgactatagttttcatgcatccacatatctactaattagctccacaactgggttctgcaatttcctgggccacatcgctgagacagattccgcatgttctgcaccagcagtcatttccccttcatggagcccacatagtcacttaaaagtaatttatccaggagggtttccagcttttaagtgagtctgctaataacagaggttgtctgacttcacaatcaattatcctgcatagattcaagtgataatttctatatttgtagttttcaagttgcagggaaaaactgggaagggagaagaatatcaattctgcaaactggttattgaaagtattgggggggtttgctgaatatggtgattttgatggaaaggaatcttaacaataccccattcatatgcattttccaattgaattatggaagaaaaattaacttagaaaaccaagcaagcaagcaaacaaaaagccccaaacaacagcagcaaaacccgacttccaaaaagagttcacattataggcttacttttaaaaactgatctagaaacaagaagctggtttctaagtttatttccacacttgccctctgaaccctgtcttgttgaaagattcaggatatcagattctctcccataatttcctttcaacagaacttactgtattacccacccatcccccaaatataaatggctaaaacagctggctctttcagtcttggtgtatacacacaaacacaaatgagatacacacacacacacatgtatattatacatctctgcatatataaacacatactttggtcatttatttttttaacagaataaaggtaattaatcaaaatacaattcattttaatagttgaggcttgacagagatcattatttcaagaaaagccaaggagaataagctccctttcatagtattgttttctttctaaacctctatagggtgcatggctcttaactactgagaaagtttgggacagcaccatggagcagcctcctggcctacatgttaaaagatctaaattctcttggggaaggagcttataactatgtattcactcaccccacagaagagaagattttgcatctgttttatttctaattctaggctgtctctagttagccatagggcaaaaaaaccaaaactatttccccctctttccctgaagaaaaaaactgaagtgcagagagagaaataaatatctttttcttattccagttcaatttagtttcatttgttcttttctttaatattttgtgagcggagaagaaacatctttaaatcatctcatctatgtgaaacctgtttttagagagtccagactttttctccttcattctgtgattccatcagtgatgctgaaatgactgatttataattctccttcctactgactgggaaatagaggtgtatcatagtggagggaccaggaaaatggataggtagatgaaagagaaccagaggaccctgtccacaacccacccacccagctgaggactgttagctggtccatgaatagaatgctctcaccctttctgcctctgcatatactgctctgctacagagccactcagcagagtggtgtccccttgacccagttggggccatcccgggactcctgtaacctaggaccttctagccttaatcatatcatcatatgtaaagaatgcctacaaatcaataaagaaaaatagaaaaatagacgagggatataaactggtgatttttagaagaaacctgggcattcaactttacaagtcattaaggaaataaaaattaatacaaaaatgagatcccactcttgccatcagtttggcaaaacaaaacaaaaaccctaaatgttggtgagcatataagaaaacaggaactcaaactgctaatggaagacgaaactggtaaagccactttgaagaactatctggcagcctctagtctgatgtgaacaggcacaagcactgcagcccagcagctacacttctagctgtgagccttagagatacctttgcttcacaggtaaaattatgtacaacaaaggctatatttatttttatgttttaaaaaggccagaaggatgaacaccaattttttctttttaaaattaatagataacattgtacgttataatcatatacaacatgatgttttaaagtacacatacattgtagaatggttaaatctagctaattaaacaaatgtattgatcacatagttaccattttgtggtaagagcatataacatccactctctacatttttcaagaatgtaatatatttttaaccatagacaccttgctctttcataggtgtcttgaaatttattcctcttgtctcattgcaattgtgtatcctttgaccaacatcttcccatccccctctccaccacaccccagcctctggtaaccaccattctactgtctacttctatgtaatcaacttttttggattccacaaagaagtgaaatcatgtggtattttgttttctgtgcccggcttatttcatttaacataatgtcttccaggttcatctatattgtcacaaatggtggaatctcattcttttttatggctgaatagtagagtcaaccctagaaaaatgcagggatgaggggtgctaaccctcacacagtcagaaatccacaaataccttttggcttctccaaaactttattagcctactgttgattggaagccttactgataacataaacagtcaacacatactttgtatattatatataatatatactgtattcttacagtaagtaagctagagaaaagaaaatgttattaagaaaatcataaggaagagaaaacatatttaccattcattaaatgaaagtggatctttgtaaaattcttcacccatatcgtctacacattgagtaggctgaagaacaggaggagctggtcttgctgtctcagaggtggcagaggtagaagaggtggaggaatgtagtgggagataggagagacaggttggagtagctttattgaaaaaatccatatgtaagtggaccttgcagttcaaacctgtgttgttcaagcatcagctgtgttccattatgcatataggccacattttttttatccattcatctgttgatggacctttaagttgattccatatcttggccattgtgaatagtgcttccataacatggtagcacagataacctctccaaattcttggtagtggttgtcactggaggaagaaatgtgattggcatactttacttgatatatcatgtgatatataggatagatatatattttatgatatataggatagatatatcatatattttatgatatataggatagatatatattttatgatatataggatagatatattttatgatatatatacacacacatatataagtattatatatgttttatatatatatatataaaaaaacaaacaagaactgaagaaaatatagaaaatatgttggctgggcgcagtggctcatgcctgtaatctcagcactttgtggggccgaggcaggcagatcacttgagatcaggagtttgagaccagcctggccaacatagtcaaaccacatctctactaaaaatacaaaaattagctgggcatggtggcgggtgcttgtaattccagctactccggaagctgaagcaggagtatcgcttgaacccaggaggtggaggttgtagtgagccgagatcgcaccactgcactccagcctgggtgacagagtgagaccctgtgtcaaaaaaaaaaaaaaaaagaaaagaaaaaagaaacagaaaatatgttatatttttctctgtacttttctgcatttacatttttctcaaaattaaaaaagcagatagccactctttcagttgattagtacaatcagcatactttagtctcttagtaattttctgatttgcatctttgcagtccctaaacagtctttcctctatgatactaacaggtttcactgcaaccagctcaccttcctggatctggttttaagcttggtgaaggcagtgctgataaggtctgacaatgtggggagtggtagaagaggcttggaatcttttactgtttttcatagcatttcagagagttggaaaatagcttcagggatcatctaatagaatttatttatttaaatgaagaaattgtggtcttgagagccttgttcagatgcacctggctaattaaaggtagagttagaatctgtaactactgattttctagtaacaagagcagaaagttctacagagccttccccatggacaatcaggcacccaccatgggtttggtattttggaaatagccattaggttagcaatactttaagggactagaaggagaggttaaaagtctctgtggtcactacattcaagaagcagtatagcataaaggctgagagaaggtttatcagaagccatacttgcattggtgtatatcttggctctgccacttccagctgttttatcttggataagttacttaacctgtctgtgccacagtttctttaattgtaaaagtaacaataataatagtacctatttcagaggttattcggagagttaaaagagttaataatatgtgagaatgatgtctgatatataatgtattcaacaaatgttagctattattatttcatttggagaacaagctattaaggaaactgaatgtttaattatggttctgccatcttttgctttaaaccacttatctctcaaaactgtcctatcttcctttgtatttaacttggatgagtcttggttttacaataaagaaagcagaattcaaaaaggtaagatcatttactttcctagaatgatgtcatacatctgtggtaatgattatatttccttttcattatatttcactcaacacttattcatccctattggtatacatgggggctacccatgggagatgtgaagcaatctagttgacaaaagaaataaaggactgagtccctgggggtgttactgtccaatacatagattgctattttgatgcgctctgatcaattacaagcaaattcttcaagtttttaaacaaattacactccaaattcctacattttgacaaaagtgctttgaaccttaatataaaatgatgatagaattctacttgccaccaatgcatctattaaacagtgtaggtttctaggacccaaatcagattttctttctttgtatcagtttcttgaaactaatgctataatcctgatgtggcttttagacaccaacccattcaatggtggagaattcattcccagggtttgaaagacagctaaccatttctttgtttgtccccagtgcttttaaccaaataatgtagttcttaaaagatgcatttatataaggtagaatactctacatttcctttttatggttgtttaaaaatgtttttaacaaacattacagtaatttttctcatctacctcagaaaagttccatgttctaactgagatgaattcctttgtcaaactagtaagagggtgatttcatttgtagtttacttactaatttattccataatttgagtgttaatcttgctgtcagatgaatataatcaacttttggactcaatttcttcctgtggaggggagaatttctgtgtaccaaattcccacataattgcctcttttgcacacacccacatcttatttttgttggtgcctatcctagcccatcgcaacctgtaattgtccagctaaataatttttaaaagatttgatgctttcaggtaccaaaatgattcagatttaaagctgcagtggatagtttattgatacatgaattaaacctgaaataccccctcagaaccttaaatctcttttcaggacagatgtctaaagttgaccacagtttttctgtgtgaaagtagatgctaaaattagccattgtagcatgcagctttgtggaagtggctgtactcttgcatcctgtggttctttcttccctattggcatggttattttgatctgaaatgtcctttttcctttgctgtctagctttctgctgtctacctattgccattccatgggccataattctcaggtggaggtttttaaaattttcccttgcctaggctatatcccagaccagctgaatcagaatccctggggacagagcaggggtatttgagtttttaaaacctcttcaggacattctgatgctcaacctgaattaagaaccacttgcttattgcctaggttagaaatttttatttgttttgttttgttttgtttgacaggatctcactctgtcccccaggctggagtgcagtgacatgatcacagctcactgcagcctcgacctccttggctcaggcaatcctcccacctcagcctccttagtagctgggactacaggcctgtgccaccacactcagcaaattttttagtttttgtgttttgttttgttttgttttaagagatggggtctcactatattgcccaggctggtcttgaactcctgggttcaagcaatcctcctgcctcacactccgaaagtgctgggattatagtcatgagccaccgtgccaggcccaaaaatcttttatttgtaaataactgaaacccaaactatcttaacagcaacaaaacaatttgtcataaggaatcacgagactctcacataacccaacagcatgaaatacaactggacttcataagagaccagagcctggaacaggagcatttacaaggacccaggcaactagtccctgttgcccaggtgtagctctctgtctgcctggctcccttcaggggcttgtggattcagatctctgcttctctctgtacatctgctttctttcttttctctttctcagctagccactttcgctgctgctgagcacatggccaaacatggtgcatcctcattacccacatttgtacgtccttagttcgacttcccagcccagggagactagcatcaatgaatctaaattcctgagagaggatctgatcagtctggcacaggtgatatgtctgcccttaatccaaccagacaacatggcttaaacatggctgccaagggcccacccatgtgtaggttaagtttggaggctatttagctatctcaaagtgtatctttatgcttgccatattttttttcttttttgaaggaaattttgtattattttaattatttttatggacagaaaactcaacagtgtacatttaacccagttcagtggcaaagttctttaacctttgccttttcgagcttgataatgtgagctacagacttgagacccaggacattgcctccccagtgacagtggatctcatcgtatctgtcgtagttggtcctgatagcttccaccagcttagccaaagctcctttgtcttccgagttaacctttgtgaagacaacagtggtgcaggtcttcctgtggactagatgtcccagtcttgccttccccttgataatgcagtaagggaccccctttttacaacatggggcaggcaggcagaagacagccagctcgatgggatcgacatcgtgtgcagtcatcaccagctgagctttcttgttctccaccaaggtggtgaccatgttaactcctgctcgaaggacaggtggtctcttagtggggatgtcccctttgctggtagctttcttcttggcctgggccaacagcctctgcttcttctcttgctttgtctctggcctgtacttgtgggccagcttaagcagctgagtagctgtttggtggtccagggcctgggtgaactggttaatggcaggaggcacttacatccacttacagaggatggctctctgccgctgcaacctgatatagtggggccatttcacaaagcgggtgaggtctctttggggctggatatcctgtccaatgccaaaattcttaagccttttctcaaacaggggattcaccacttccttggcctcctgcttctttatgacagcaggagctggagccattttttctccttggctttctttcctttcagcatcttgggtggcgggaggagagacttatggttgccatatttttcatctagcattataccaaataactttgtttctaatttcagttttattgatgatattttcgcctttaaagaaggtgaaaagcaacaattttcatatatcaggggtgatttaacgttacagatgccactaagatgaacattgaatgtactgttctctctctaagcctagttcttcctcttataaatagggatcagtctaaatgttgagaaaattagagaattgggaaatctgcctctcctaagtagtaaaagttgaaaagtagtacagtaagatagcaatctaatagcacagtcattttctacaatgtatataattttaatcatcacaataaagaatgtttaaagaaattgaggtagtttaatcataggcagtgctgagatgtgaccatataatgatcttttagagagaaggctgctactttttctttgtctacacaagggttaaaaaaagaagaaatgtttttaggaggaatgtaacatagtgcctggcacatggttagtattcaatagtattttactaatagtgtttacttagaaatatttatcagaaataacttcaaggtgtctttggaccgatacaatgagttaccaaggaaagtaaatacatctttccttcttcctttttttaccattaaaggaaaccaaaatacttcaccctcaaatatacttctttgacatatttgagatggctattcagagaacctgcagacaggaatagccctgtaaaactaccttttgtgggggagatttacatctgtagagaaaatctacattgctgaaataaacagccagcctttctgtgctgtgacttgtctggatctaggacagatgggctcctgggagagagagactgagagtttgacacctctggggatctaatagaaacttactcttttggagggctgctacctgtgaggtttcatctgcattacaagactgcctttgctagccatgcttttcttctcttccacccataactggtcttgccagactctaagcctctattccttctgtaacctcaggatgaaaacttcaactatctgaccctttctttgagtttttcttattttttataactcctgtgcacatgcgtgcatattactatttttgtatgccttttttcctattaacctgccttttgtcagttgattttcagtaaacactcagaggttgaaggggaggttttccctaggctcctataccatcttgcatatttgggatatcccaagacatccatgacgcttggctctctaggacattgaaatctggttagggaagtaaaatatgaaagcaatggagaacagtctgcctttggcactcagagatctctagatgttttcacttgtcccatttcatccttataggttaagaagcagggaaatagagttcattacaatttcaaattataattttgctgatattttccccttcagggaaggtgagaagcaagaattttcacatatcaaaggtgattttaccttgaagatgccactaagatgagctgggcagagagaatgttaaggcaaagcacaatgttaatgactaaattagaactgaaaatgaatttaatctctttaaagaacaagaatcaaggtaactgtatttcagtaatgtgtaatgcaaaaaatgcatgatgaataaaatacatcatagaaatatgaagggttgagttatatgcaagtatattataggaaaaattagttgatctgatactgtatcagagtagcttcatcattaaatgacactgtgtcatttatggaatcattggcaattcctagaacatctattacagcactaaagtggtcagggttttcataaagttttgtggaagtctgaaccttattttcttaggtcaaagacatggtagaagcaatttataagtaatgttttattaataaagtgatttctaagtttatgataaatacaagtgacagatccagtggaatttattggctaatgtaattgcgaaggctaagaagtggatctaatgggtttccaacaatgtcatcatcgtttctgctgtaattccatctctctgctctgctttcctcctgttggtttcattcgcagcaggttttgccatatgggaggagcaatgcagcagtctctggtctgtatcacttaggatctcataaggcataaggtcttttttctctccaactttgtcagtacgttcaaaaagagtcctattggcccattagatcttttgtctaccccagtggcaggaagacagggccccagaggtaggggtggagcagttctccaaaggaaaggaaggtttcagttattagaaaaggggtggaaagaatatatgtccaccaatatatcacacaactgcatatagtgcactttcacatcctgtggcaaacaaaaatctttcactaatggaaaggaaatgatggcttgacatattgtgtatagtgtaagaaaaaaaaaatccagatgcttttttcatattcactctaattccctaggttacaactaattagtacttcctgtttgctccccatataatttgcttaccccttgactctatcacatgtttatcttccttctagaggcctatcttacagaaataggatgtgaacacttgaagacagaactttgtcttttatctctttatttccagtgcctagtccaatccttggaacacagaagccacttgatgcttactgagtggaattaaattctatcctatctactgcttatattaggaaagaaaaaaaatttactagtcaagggcttcagggggaaagtctttgttctctaggaggaaggattttccctaagtcactcttggcctttctgcttcttcactgttcctccttagggaaagtggaatggcttatctaactggtgagtctgagataaggaagcacttcgcacattcagatattgtcctccaccagccatagagggacgggacagggggccctgcctaacccagttttggggaagctcactgttgctatgtacccatgccttctctctctctctttctctctctctccctctctctctctgtctctctctttctaatgaagagtttagctttggagttaatgagcaaaagatttccttaccataaagtgaagcccatcaagtgaaagcaagtagaaaggcgcagaaaggtttatccttgtcaccatgtggaaggacacttggggagcagatcatttggtaactgttggtacttgtggcctctacatcttgtaaattcatacatgtccacgtttgacctaattgtagacttttttgaaattttcagttttaggtgaataccaatgagtacccagagttttctgtctttgttgtcctctggatgttggtcccaaatccactcaggcaacaaatcctggagttacctgctccttatctttaaagtatatgtagcccttggtctccatttctgctgcctttttttttttgcttatttttaaatttaaaattgacaaatacagttgtatgtatttatgggcacaatgtaatgttataattaataaatataatatgggataattaaataaaactaattaagatatccatcgctccaaatacttaccagttttgtggtaagcacatttgaaatttactctcttaacaattttcaaatgtacagtacataattattcactatactcgccacacaatttgagctccttatatattttggatattaaaccctaatcagatgtatgccttgaaaatattttctctcaatccaaaggttgtcgcttcatgcagttgttttccttgcggtacaggggctttttattttgatataatcccatttttctatttttgcttttgttgcatgaacttttagggtcaggtctaaaatatcattgcccagaataatgttgtgtaattttccccctatctcttttgacagcctacaatcagatatatgagcaaagaaatgatttaaagttggaacttacatttaaaagggaagcagagtgtaaaattttggataatttgcagcctggctatgtggccagagaaataaaaagcatttttaggagaggaatacaagcaggctgaggaacaaccacttgcttagaaagattagcgtgactaaaagggagccaagtgctaatttccaagacaatggggaaaaggcatatcagagatcttggagacagactctgctatcagacccagagcattatgaggaaataatggtttcagggaccaggcctgggccattgccctgctcaggcttgagacactgctgtctgcatgtgggctgcttcagctccatctccagctccagctcaaagggccccaagtacagcttgggctgctggctctggagggcacaagctgtaagctttagtggctttcatgtggtattaagtctgcaggtgcacagagtgcaaaagtgaaggaaacttcgcagattcccctagatttcagaggatgtattggaaatcctgggtgcccaggcagtagcctgctgcagaggtggagcccttacagagaacctctactagagcagtgtggagaggaaatgtggagttgaagccccccacatagagtcctcaccagggcactgccttgtggagtgatgggaagagggccaccacccgccacgtcccagaatggtagagccatgggcagcttgtatcctgagcttggaaaagctgcagacactcaactccaacccatgagagcagtcatggggtctgcatcctgcaaagccacagggacagcgctgcccatgcaccagtgtgccctggatgtgggacatggagtcaaagatgattattttggagctttaagatttaatgactgccgccgagcgtagtggctcacgcctgtaatcccagcactttgggaggctgaggtgggtggatcacgaggtcaggagatcaagaccatcctggctaacacagtgaaaccccgtctctactaaaagtacaaaaaattagcacggcgtggtggtgggcgcctgtagtcccagctactcgggaagctgaggcaggagaatggcgtgaacctgggaggcggagcttgcagtgagcaaagatcacgccactgcactccagcctgggcgacagagcgagactccgtctcaaaaataaataaataaatagcctgggtgcggtggctcacgcctgtaatcccagcactttaggaggccaaggcaggcagatcacgaggtcaggagttcgagaccagtctggccaacatgatgaaacccagtctctactaaaaatacaaaaaactagccaggcatggtggcgggtgcctgtagtcccagctactcgggaggctgaggcaggagaatggcgtgaacccaggaggcggagcttgcagtgagccgagatcatgccactgcactccagcctgggcaacagtgtaagactcaatctcaaaaaaaaaaaaaaaaaaaaacaacatttaatgactgcccttctgggtttcagacctgcatgggaactgtagcccctttcttttggccagtttttccctttggaatgggaatatttacccaatgcccatattaccattgtatctcggaaataaataacttgtttttgatcttacaggctcataggtggaaggaactcatctccagatgaaactttggacttcagacttgggacttttgattgagttggaattggaacaaattaagacttgggagaactattgagaaaggatgattatattttgcaatgtgagaaggacatgagatttggggagctagaggcataatgatatagtttagatatttgtcccctccaaatctcatgttaaaatccccagtgttggaggtggggcttggtggaaggtgttctgattatgggggcagatccttcatgaatggcttagtccatccatttggtgatgaatgagttcttgctctggtggttaacatgaaatgtggttatttaaagagtgtggcacctccccccactcttgttcctactctcaacttgtgacatgctagcttcccttcacctgccaccatgactataagcttcctgaggccttaccagaagctgagcagatgccagcaccatgatttctgtagagcctgcagagctgtgagccaattaagctcagcgtcaggtgtttctttctttttttttttttttgagacagagtattgctctgttgcccaggctggagtgcctggaggcatgatctcagctcactgcaacctccacctcctgggttcaagagcgactctcatgcttcagccacccaaggagctgggattacaggagtgtgctaccacgcccagctaatttttgtattttagtggagatggggtttcaccatgttggccaggctggcctcgaactcctgacctcaagtgattcacccaccttggcctccaaaagtgcatgaggcgtgagccactgtgcctgggcagttatttgtttatagtgatgcaagaacagactaacacaaatgggttcagaatgcagttgtggaaaaggtgtataatttaatagttccctcaaacctcacagaagaatttcagaaagatcctatatttgtttttgaatgcatgcagagaatagattaaaatataaatatcttgatgttttttatattacatatttatatcccatctttttccaaaacagatttaaagtggtttcatctttgacatggtaatctaacccatgacattcaaaagccacaaggacagaaaaagaattttctaagactgcctgaagcgcaacttcatttgatatgatttcctagcctagaatataatcaggaaggcactgatttctttctgttactgttgtttttaagcaaaaaagatcccattcctcctcttctatttctttgcatggtgaatagcttcgctagttacccagccactaaacaacaacctgggaatcaacttcctctctattctgttgccccttcccccaaacaaccactcgatcatcaagatttcttcctcgatttcatgttcagctctacatccagggtctaaattcacaccttggatttctgctgcctgaactaatccagcagtcgcactctgtagcccttcagtccctcttctgtagcatgtccaaagtgttctttctagcagaacaatgtgattgtgttactcttgtacttgaaatccctcaatgtctttttcactgtctctgggatttattccagactccctagcatacatacagggacctcaaggtctggcagctgctcagttctccagccgtatatctctgaatggtttctctctcggcctcatttctccatcacccctcctcccagtaaacacatacactagaaccattgtgaatttctcagagtacttcttatggtctaggatagtttacatttttgggtcccttttgctgctcctctgcctataatttatcccttcccctcttgccttccctctaccccccaaggctggctcagcttttaagactcaatcgaagtgccaccacctctctgaagcctttttcacacttcacccttaggaagaatgaagcatcttcttcctcttcttcccttccatgtctataatcctcaacacattttttttttcatgaattgtctgcaacactgtttgctttcgctagactgaaagatcttagggacaaagtccaagttatgctccttctgctgtctctaatatctagcatcattcctgacactttagcagtatttcataaatgtttattgactaaatgcatatttacctatgcatgaaagagtaacagtttcagagtttttgttagctgcattcctttacttcctatcagtttggggaagtagatttagtatccacaaaatgattgggggtcccctgtactgcaaagatttgactttaagaagtaggtggctgggtacgatagctcatgcttataatcccaacatattgggaggccaaggcagaaggatcgcttaagcccaggagtttgagaccagcctgagcgacgtagtagggacccattccgtatgaaaaaccatatatattagccaggcatggtggcgtgtgcctcccaaattggctgaagcaggaggattgcttgagcctgggaggtcaaggctgtagtgagccatgattgtgccactgcacgccagcctggatgacagagcgagaccctgtctcaaaataataataataaataaagaaacaggcccgtgaacagcatcagcagtttcagctactaatactagcagtctttgttcctcttagagtgcagagagctgctggtcacttttgatctttattaaaacacccatacacagtaagattgcttgggaatccaaggcagaatatatctgtgtggtttgagagaggactttaaagtgttagagagtctaatcttagagcacactaaaaagagagtagatacactaccccaggacagagatgaaataatgaatttgctgaatattccatgtgggccctgaacatcaacagggcaagagagaagtcaagaaatgaaaagtgctggtaaggtcagcaagtacctatcttggcacccaatggtaccaagtgaccattgcatggaccatgctctgggagggcatgagaaaaattaagggcaaaggacattccctcaaagagtttaccagtttaaagctttaatgtcactgaaactaatatgtcttctgtgacaagctttgatgataaatgtagactaagttttttaaaatcatataaaaatttaaaatactttgcaaagcacaaacaattttcttaggcctgccttggtagcaagaacagtttgtaatgactaaaaagtgaagaatctatggtatattcatggtctaaatcagatattgcaagctggtgccctctggactggagtcatacgatattttcaaattcaggaaattttaaataaaaattaagatttcttacttgtgatttccttgtgctctcaggttaaaatggtttatgcaagacttgatggtttgaaataaaattggctaaatggattctagtataaatgcaaaggatatttaactcacttgggagctcataggcataatgcatatgtttgtttaaaaacaaaagaagcaattgaagattaacattgactttgtctcgcctggcgcggtggctcacgcctgtaatcccagcactttgggaggccgaggtgggcggatcatgaggtcaggagattgagaccatcctggctaacagggtgaaaccccgtctctactaaaatacaaaaaaattaaccaggcatggtggggggcgcctgtagtcccagctgctcaggaggctgaggcaggagaatggcatgaacccgggaggcagagctttcagtgagccaagatcctgccactgcactccagcctgggcgatactgactttgtctcatagtttagatctgggataaacaaaccttttctgtaaagggccagaatattttaggcctttatttattttaggttttgcaggtcctataatctctgttgcagctaaacagctctgccactgtagtgtgaagtcaccatagatgatacctggacaaatgagcatggctgtgttcaataaaactttgtttatgaacactgaaatttgaaatttatataatttctacatgtcacaaaattttttttgtctttttttcagctatttaaaactgtaataactattctgagctcatgggccatataaaaacaagagatggacctcatttgacatataggccaaatggacattggctgagtgtcattgtaaaatcttggtcttaggctttttagacctgattagcctaaaaggaacaaactagaatgttctgttctctttacagggcaaaggaattctcctttccctactttttattttttattttttcattttttttggatggagtcttactctgtcacccaggctggagtgcagtggcaccatcttggctcactgcaacctccgcctcccaggttcaagcaattcttctgcctcaccctctctagaagctgggattgcaggttcgtgcccgacgcccagctaatttctgtattttcagtagagatgggttttcaccatgttggccaggctggtctcgaactccagacctcaggtgatccacccacctcggcctcccaaagtgctgggattacaggcatgagccaccatgcctggcttccctacttttttatatccatggggagcttggttgatatcctgcttgaacatggaagacccaagttgctcaccctgtgttttccaaagccttaaaggctagtctacatttcagacagcccaggtgatgagggagccttgtgttttctgtgaggaaccttatcccttaagcatctatatcccagtcatacttatgcatggaaaggctaagtaaaatctattaatatcctagctagaaagaaaactataaaattacacatagatgcaagcttgtgtgtattctgcagttcaaagtgtagtcagcaaaaaaagcatacacgctatcgcactgggaggaaatcggtgtctttgaaatcaaataccctgccattggcatatccaggcttgaaactcagctgcagcttttagcttccaccacatgtttacattggaaatctctctgtgcacatatagagtttgttctcttatgaaatcatgtctctagggaaggataatttaaagccatttccgtttgttatgtctgagctgaactagactattagggcttgttaacgctggataaacttgagccctataactgccttcatctgcagattatagaatctgtccaacaaattgcattctgatgttttcagaatgatggctaagcaagcaagggccttttaatttatattctatcaccatggttgtcaggaatcacagttttgactttcatgcttacttggtatagcagcgatgatatgactcttgaatggaccaaatccagaagtaattgagacactaaactgcatctgcatgttactatagcagagtgagcaaaggctgacagtcagaaaattgctggtgaagcatctttcttcagagtgcctcccttccccgagtcttagcataaatcagtgttaggtccactgaaatatcgtgtgtggtctgcatttagaaattttatttgaaaatgagacagatggataaatgaaaacaagttttctttaggctagtgttaagtaaatagaattaagtgaagatagacagttttcctgatttagtggaggggagatggtggttgccccaggatatctaactccctctgcctctattcatcaaatccactgaacacatttgccttcagtttggcttaatatcattcaccattttagatagtgggatactggaaggtagaaattacatctgtttgacttcttttgtgaaccagtgtagcagaactaccagtacaacttaagtaaaatcacaaataggatggcaccaggcaatagtgtgactatccaacatggcatcccctagctgggaaaggaatcctttcttcatggctctggccttattttcagtagctccactgaattcacttcttttcaataaacttgtagaaggtactgccctacgccctgaggttggggacagtggcagtggtaggatacagagacaagtaagacatagaccctgcccaaaaggtgactgtatacataaagcaccctaatccagaccagactcaaagaatgctagaaatgaagggcagacataggacagtggcattttgagtaagaaatagggtttcaactggtgggagaaagaagaacctgctagactaagggaacagcatgaactaaagaccagaagtagaaaagtactactttttgtaccaaaagtagaaaagaccaaaagtgttgagggagaatgggaataattcctctctctctctttccttttttccctttattctttattcaataattatttgatgaatgtttatggtaaaccgaacagacacagctcctgcccacacaaagcttacagtctagaggaggaacaaccaggaatcaaagaagcccaaagtaaataacaaattacagccctgacccttacctcaaaggagaggggtacattgactaagagagcacattacaggagagtggaacatactttacaagcctttactggagagatgtcctgccacctgaagagagaggaggcattgattagaggagagcgctctatggagaggagtcagcgtggacactgagactgcaagagtgagggaatgtgcgggattagaccacagtcagggagcagaacacagtggggtttttggtctttattctaagagcaaagaaaagctattgacctgtttctagcaaaagatggggtaaggtaatgagatttgctagttggaaagatcccactagctgcagtgtagagaatgaattagatgggtgaagagggacccctgccaggaggcagatgcaattgtccatgggggatattctggtttctttgcactggagtaatgaggatggggatgaaaagaagggaatatgtttaagagctgataatgagcttggccttggcaacactgagtttgatgcacctttgagatactaaggagacataccaggaagatataggtgtactggagctcactgaagaggtctgggctggagataaacaattgagtcatctccttataggtgataattgagccataaaagtggataaataaatataagttgaatgaatgatagaattaatgaatagatggtattgggtgaggaaagagcacagagtaacgagggcttaaacaacgttgtggtgctgtatttctgtaactattacttatcagttgtgagactggacaaagtgattttcctctggccaggtctgatgcctcctatggacacattctgaaagccagcaggaacctagaaagtgaccaggccacccccttgcccacatagaaacatgtctgctaactcttccaccttaccaataggtggattccaagagttcacataaaaggtggttgtttggattgtagaagtctcttcccaaaagaaactcctattttcctagggagatgccaccatagaccctaattaaccaaggtcctttctgtgagacattatgttcaataggaccttgaggtgttacaaactatttcctcacagatgcctgggcataggcctggactcttccccagaatcctcccatcccacttgccaggcactgagaaacaggactttccacttgtttgtcactggcaaggacttcatggcttcagagagggagctccaggggtttctgggacacttaccagtataaattccctgaggttcttctaagtctgtgcttgaattcattcattcattcccttcttatcttttctgaggaccccaagaattggcctgcctgtgtcctttgcttttacttgcagcaggtgggggtctggcacggtcgggggaagggttttgatgggaaaagtgaggctggtactatttttcctcccatgtttagcctatagagtatagtcataaaacttttcctcaatgtttcagtcctgaagcaagcgcacagctcattggaagtttctaaggatttttattattagcaatgtcagaaagcaagttgaaagcaaaacagccccctctgggcctcttccctagcctttccttattttgtgttgctttcctcacacccaggaggaacacatatcccaattcctgaggacagtcctgatttgcaactggcatcgtggcacaactgccaatagtaccacctttaaaaagtttagacactgaattatggtcatgctacttaaccccataaagaaaaataaagtaatgcattgggggtaatagtggatttacaaaagactacaataatctcgatctgcattttagcgagaggatatgagccacagagtgatttctttggtattttgtcccaacagctggactgggcctctatgtgtgtaggtgagggatggggtacagagaggaggacttgtgggaagtgctggaatatcagggctagaatattgccacagaaatgtgtctattttttctcctgtctctttctcagtaaccagatctaccttggaagactcagactggcactttggcaaggtgagatgaaaaatcagggctgaggaaggtgcatttgcaggcactgtggggtccacagcagagaggataaaaacgtggaggcagaggtgcatccgagtcataatagcacagagccgggcgttggggttggggcctgagccattgttgtctggctgtcgcagcagggggaaaggaggacagaagtgtcaatgtttcgtttagaatttttctaaaaagttgccactttgggtgaagggctcagtaagaccttcccctccacactccacataactatgcttctattagaagtattctgagcagttcaggccttccacgtggtggaactgtgtggggtaccctcaagcccatgggtctctaggggttgtgcctaagtcacatgtatacgttccacctgtgatgttaggcaagcaagcatatgatcctttctcatcaccacttccatgaaacaaagacattttagaactgttgacgatagcaatgttttctcgacaaagagattacttgtaaagtagtaaagaacattagaaaaaggagctatagtcatatggtcactgttctttgtggtgctatataggtggtgtgtatattataagaacttttgtgtcttccaataatgttttttggtttttggttttttggtttttttttttttttttttgagatggagtctcgctctgttgccagtctggagtgcaagggcacgatttcggctcacggcaaccttcacctcccaggttcaagcgattttcctgcctcagcctccagagtagctgggactacaggcacacaccaccacgcccagctaatttttactgttagtagagacgaggtttcaccatgttagccaggatggtctcgatcccttgacctcgtgatctacccacctcagcctcccaaagtgttgggattacaggcgtgagccaccgcgcctggccccaataatgttttaaacgagtaaaatgaagtttgtcacttctgcatgcttacaagcttaaacatcaaaagaattggccaggtgtggtggctcacacctgtaatcccagaactttaggagacgaagttgggaggatcacttgagtctgggagtccaagaccagcctgggcaacaaagcaaaatctgtctctacaaaagatttattttttaattttttttttttaattattaagaatccaaagagtttatacatttaggtgggaaaggtaacccttgggaagccctgggctagcctctcggcttgctcatgattcaagtagcaaaaagaagtagtggactcaggacagaattttgacgtgggagccccatttcaagctctgaggtctgaaatgccaagtttaagcctcttggcctcattgtgactcgatttccctttctgtgaaatgagaagataatcccagtattagggtactatccgagtaccttcaggctttttaggaagaactctagtgagtaagctctctggctgtagaggggaccgtgatgcacagtaaaaagaaccccatcttgtcactggagggatataggcagccgcccaatgggagctcccatactgtagagatggcactcttgctttggtgggactagtacagatgtattttttatgtcccatttcttatgttgcctattttttggagacatatttgtttgttaactctttgagtttcataaagaaaacattaatacaaattttattgagtggtaggttagctccaatatcctcaaaatagattgagcattttagaattcaccttaatgttacctggaatgcaaaaagatttgcctaaaacgtttagctcctcattttgttactggcttcattctgattttggaaacaacagaaagtaaagtggaactggggttttgggtctattagattctccaatttaatctcgcccatctattcctgatattaataaactctttctaatatcagttggccatggttgtcattctggtaaatacctccctggaaccggactgaataaaattcatgagacttgctggtcacagctggagattggttcagtggtttgggtttttttttctaccaaagtgaaaatagaattattgttattattgttttctagttttaaaatgactaaaagtacaaaggaaaaatggaaaagtcaatttaaatcctactgctgagagaaataacattttggtgagcaactctccagatcactctcagaatgtgcatattatacttccatgtgccattgttagaaaacaagagtgtactttctcattgtggacaactctatgtccataaataatgacaccattaattatagtgacagtatataatattccattaaacagctgtgctattatccatttatgcatttcccaattattattcatttaggtttttttatattgcttactatcatttaaaaattgcagtaaacattcttttacatccagatttccaaatttgtctaattatctcccaggttatatagccatatcttgaggatattgtagacatggttccagaccattgcaataaagtaaatattgcaataaagtgaaatacattttttggtttcccagtgcatataaaagttatgttggccgggcgcggtggctcacgcctgtaatcccagcactttgggaggccgaggtgggcggatcacaaggtcaggagatcgagactatcctggctaacagggtgaaaccccgtctctactaaataaatacaaaaaaattagccgggtgcagtggcgggcgcctgtggtcccagctactccggaggctgaggcgggagaatggcgtgaacccaggaggcggagcttgcagtgagccgaggttgtgtcactgcaccccaacctgggcgacagagcgagactccgtctcaaaaaaaaaaaaaaaaaaaaagttatgtttacactctactctattaaaagtgcaatagtattatattttttaaaaacaatatagattacctaaatttaaaatacttaattgctaaaaaaaaaaatgctagggatcatcggagccttcagtgagttataatcttgctggtgaagggtcttgccttagtgttgaaggttgctgactgttcagggggtggttgctgaaggttggagtggctgtagcaatttcttaaaaaatgacaataggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaaattagccgggcgcggtggcgggcgcctgtagtcccagctacttgggaggctgaggcaggagaatggcatgaacccgggaggcggagcttgcagtgagccgagatcccgccactgcactccagcctgggcgacagagcgagactccgtctcaaaaaaaaaaaaaaaaaaaaatgacaataatgaagtttgccttatggattgactcttatgaaagattgctctgtagcatgtcatgctgtttgataacattttatccacggtagaacttctttcaaaattggagtcaatcctttcaaaccctgccactgctttgtcaactaagtttctgtgatattctaaatcccttgttgtcatttcaacattgttcatagcatcctcaccagtagattccatctcaagagaccactttctttgcttatccaaaagaagcaactcctcatcatgttttgtcatgagattgcagcaattcagtcacatattcgggctccatttctaattctaattctcttgctatttccgccacatctgcagtaacttcttccaatgaagtcttgaacccctcaaagtcattcatgaaggttagaatcttattccaagctcctattaaggatggtattttgacctcctcctatgaatcacgaatcttctgaatggcatctagaatgctgaatcctttctagaagattttcaacttactttgcccagatccataagaggaatcactatctatggcagctatagccttacaaattgtatttcttaaataataagtcttaaaagtcaaaattactccttgatccatgggccgcagcaggcatgaaaacaacattaaccttgtacatcttcatcagagctcttcagtgaccagctacattgtcagtgagtagtactattttgaaagagatctctttttttctgagcagtaagtctcaatggtgggcttaaaatattcagtaaaccatgctacaaacagatgtgctgccatccattccttgttgttccatttctagagcacagacagccattttcaacatgccttcctcactaagcttaatcatttctagctttaaagtgagagatatgtgactcttcctttcacttgaacacttagaggccattgtagggttaattggcctaatttcaatgttcttggcctaatttcaatgttgtcgtgtctcaggaaatagagaggcctgagaagaggaaaagatggggaagggctggttgttggaaagtcagaatacacacatttattaagtttgctgtcttacagaggtgtggttgatggtgcccaaaacaattacaagagtaacataaaagatcactgatcatagatcaccataacagatataattataatgaaaaagtctgaaatagtgcgagaatgaccaaaacatgacacagacatgaagcaagcacatgctgttggaaaaagggtgttgaaagacttgtcaacgcgcttgccacaaacgttcaatttgtagaaaaacatagcatctgcaaagtgcaatacagcaacacacaataaagctagacatgcctgtactcctgaagtgatgttgatgatcgatgggtccgaggcatgtttcagtttttgtatgtattgcaaaactacctgtcaggaatgtatcagtttgcatgaccatcagcagtgtttgtgaattattggtcccccacactattgcctacactgcagctaattttttttctcaatctttgtgagtctcttgagtgaaacaatatcttactgtcatttatgtttgctttactttgattactagtgagatgaagcatctttttgtatgtttattgcccacttgtatagtatttctcctattatgaaacagaataggtcctgtccaaaaactctaggaaggttatggtctggttggtccatggaatgtaggatctggactgtaaattattcttcagtcagatcgtgtgatataaaagcctatatcacacaatgtgtgatggtaaagaaattattaaaaattatttgaaaaatattttaagaatagcttgttttatgattatatcatggagtttgagtatccttaacaaaggaagaaattcaccatgcttattggagacatgtaatcctagagaaggtgggactgggccatgcccctctgctgcagtaccagcacagaatgacagaattgttggaaacctctcctaattcataccaccccacagaggagcagctgccacagtggagcacaccccacctgcttggaggtgccataggccagcctctctgagttttatgatgcatctgaaatggagttttactgcatcctcccacgaccttacgaaaaaccacgggggaggaaagaaaaacagaacccaccaagaggagcaagcagacctgtccgagggtggggaattggctactccataaggcagcaggagagtaaactacaaaagacataaagcacaccttgctttaatcccttccatccgcccagagcccccagaaagctcataaagtctccctttctgggtgattggattcctttagctcaggggcaagtagggcatttttttggttttgttttggaagagggctgggtaaaggagaatggtaatcactggggttggaggagggagaatgaaaacgggggcaatcactggggttgggggagtcccttctcttcttgcttcgaggtagtgagtgggaaacgcaaacagctgctgcctgaaatcacagcgcgtgggtactgggcagccagaccagatcagcagccattaagcagggcccacagttcctatggccgttacctctctcagaagccaggcagagctgtgagttctttcaccttttgagggctcctcttggctacctcaaaggaatcatttggaatgctgctggcaaaaacgttgctgaaagttgtgtgttgtaggggggcagtgttttttctctctctaaaaagagtggtggtggttctttgccaggatttagaagccagaactgtctgtcctttttgtttgaaatagagactttagagactagtcttttcgtttactgaaagaaggagaaagaaaggaaaaaaaatttgtctactttgcctttggtctgggtactttccacttgtttgcttttaacctttctcagtgtttgcagggtgcagggaaacggccttgtcagcctgggctgggctccttaagtcttgaacaacaaacacttaaaataatcaaaatgttatatttggcagttaaaagaagaatctcctaaaactatgtctagtcttatttgtttctgaactcctggtagaggcggggagaccatgttctccattctgtggcctagccactcttccgggccttctcttgttcctcttcactccctcttccccagatgtactcctagactgagctgcttcccagctcagagcccaccacgtgcctctgcagcttctgtgcctttgcagatgccgctccctctcctggaatgccttctccccacccttccctggctgaagtcctcctggccataaaaggctaccctaagtgcactgagcttccttgctaggcacatcttatcatcgttatttctgtaattcttcctttcattggctgacatccatgacatcagggcccaaccttaggtggctagcacaatgcctgtggcagtagtggcagcagtagtcttcgtgttaccagcagcagcagtaatgactcttactgggcatgtgccatgtactaggtctttttcatactcatctctaatcctcccaacaactctacatcgtatatgatattgtctcctttttagagatgaggaaattgggacttaggtggggtggaaagatgtgatacctttcctcactcatcatgagggtcacagctgacacccctttaacaaaagacaggttgatgataaaagcataacaaatgtatttcatcaaagttttacatgacaagggagtcttcagaaatgtagacccaaaggcccagggaagatggtctgtttctatgctttggtctgaggaagaatgggcagctgtgtagaaatgtgattggacaaaaaagggtctgatctaatgatgacagactgagggggtagacagagcaaggcctgtctgttcagattcttcttggcctccctatagcattccttcctccaggtagggggtaggacccctctgaaatgaagggttttagggagaagggagagaatgacctttctaggttttatggattgctttgggagagaggggttctagattctatgacctgtcttgaggaagaggaattctggtttctgtgattccctttaggggagatgggagacaaggagggcaggagaaggtcagagaaagactttgcttctgaggcagctctgaggctacccaatatcctttagttcagagtactcagcctgccaaagcaccatagtttgggatactgttttctgcgccctggcacttacaagttaagcaactcacccagggtcatagagctaacaaatggttggaccaaagttagaagccaggtcttactcatttccaccctgtttcaaggactctgattagatgctcaataagtacctactgagtgaatgagcggccttgaaattgttttctgaggctggggaactcttgccaggaatttcaagagccactgcttttacacttggccacttaactttgctccctagagctttagtttctcttcttctacacccaatatcatcatgtctactgttttcttcctgagtcatatcctctcattatgttttagctatggggggtaaggatggagaaaggggagagtctcctggtgcttgtttcatgtatcttattcccttgacctggtccttgttcccttgaagtcttttgtttgtctgtttgtttttgagacagggtctcactctgtcacccaggctggagtatggcggcacgatctcagctcactgcaacctccatgtcccaggttcgagagattcttctgcctcagcctcccgagtagctgggattacaggcacctgccaccacattcagctaatttttgtatttttagtagagatagggttttaccatgttagccaggctggtctcaaactcctgacctcaagcgatcctcccacctcagcctcccaaagtgctaggattacaggcatgaaccactgcacctggccccttgaagtctttatagtcgccccaaagaaattaggctaaacttaagaagtcactgcttctgtagatctaaggtggctgaatatcggccacagcatacagttcaaactaatgcagtgtatctattaaaggttataagaagatacctacaaacttccctcatgggattgttgtgagaattaaatacatataatacatataaaggacctctagtgcctaacacattgtgagctctcaaaaaaatataaatgttagctcttgtcattatttttgttaatccttgactggggtactaaaattcctaaaagagagtaagccaagaaaaatatgttaattattacagcaactaatatttattactatgcatcaagccatttttgtaaggatttttcatatattaattcattattaactaattttcatagcaatctgatgatgtaagtgttagccccattttacagataagaaggtgaggacagagaggcgaagttggggagcttgggatcaagtttctggttctagaacctacgttctttcataaccatcactgctctgaaaaagagtaagcaccagacctgaaagaaacataacagaggccgggcgcagtggctcacacctgtaatcccaacactttgggaggccaaggtgggcggatcacgagatcaggagatcgagaccatcctggctaacagggtgaaaccccgtctctactaaaaatacaaaaaattagccgggcatggtggtgggcgcctgtagtcccagctactcaggaggctgaggcaagagaattgcttgaacccaggaggcagaggttgcagtgagctgagattgtgccgctgcactccagcctgggtgacagagtgagattccgtctcaaaaaaaaaattaaaaaaaaaaagaaacgaacagaaatgttgttagctccttctcacttttatctctagtttgaatgagtgtgtttgtgaaaggcaaatgcctctggggttcttgcacagtcctgggcaccactgggaggagagagggcaacctagagacatttgtgttcctggtaaacaactgaaaataggcggagcctttgtgcactgaacccagctactttcaaatcgcagtacttcccaattgcaaacttggtgcaaaaaaacctacattgccacagttgagactttcatgaggaaagattttgggtacaagatagtttttcataccgctttgcttacccctgagactgcaaagtaccatgtctccttgttttatagaagccaaaacaaattctatcgataaacagaatttttgaaactctggtattttcagaaatttgtactgtgcataaagtaatggtttggtgaattaacataggtgattaaacaataaagtgatgcatacccatttccatagaaaatatatgcatatataaaaggaattttacagataaactgtatgatatatctgttaatatatcatgttttattttcagtgtttttgtgtattctcagtgtccgccagtatggagacaggctcatctccaggtgtgcaggctctgagtgaagggggcctcctcattggagtgtgcaggggcctcctcattggagtgtgcagggctctcctgcggcggcgcccactctgtgtccttcttccctgtttttgtttgccaccttgtggttaacatagctctgtggctcaaggaggagggttgggccggtatcatctctgaaggtaaaatgcatacatgcgatgctgtaacacagtctttctcccggcggggagtgggagtgtgtgtgcacacgcgtgtgtgggtgcagtgaaggtggagttgcccacttagtgagactcagagtctaccctcaaccactgtgcttctgtgtgctcccgtgtaggctggaagtcgtatcagccgctccattgcacagagattgcagagaaggggccacatcggtcagtgttagcgtccacaggaggaagttgtgtggtgggaaggccgcttctggctggactgcaggcttgtttgcccacacgcgccccagtgagagcgaggcctccacgggcttccttctccagtgcggggagtgtgtggcgaaggaagtatctgctgctgagctcagctttgcttcgccatgttccttcccgatccgctcatcctaaccctctctccttccgcctccatcctccctgctctccgattgccccagtgtgtgtgtccccttccccagccacccctctgatccctgactaccctcttctccctccctccctctgcgcccactcctcatcgcgggcctcaggggagccctgtctccactcaagacacccgtgaaacagagggagacactagcagtcagcgggcactttgtggggagggccaatttagaggacagattgaccagggcgagcagcaggatatctagaaagacgctttgcttctaaggagcgggagcctaatcccgttacaggctggagggagactcctggggccggcaagcctccttcccgctgtgcctggagggatatcattggaggaccgccgggcgcggtggagggctccactcgccagcagccccctcccccagccccttccactctcttttcttttgcagtgacacatactgcagtgcctctgaggtcatttgtttcccacagcctcacagggcgctgtggcaacaagggggacaatgatctctcacaggaatgatgggaggccttgttttgccttaaataagccccttcaagggagcagtaaggtctgttgtgtgtgtggtttgttttttcagaaaatcctcttgcacgtagttccagtgtgaagtactctggcaacttcaattgaagacataaagaatcttatgtgtgtgtgtgagggtttaattttatttttattgctgctttgagaccaggattgtgttttcccttctgccagttacccttttcccgctcaagctccctggacctccgcattctttcaatagttttagggcaggaattggcaggtgttaggggcagagagacgcccatgtctgggtgctggcttctgactgcccttagctttggtgagggagtgaaggttagcgtggcaggaatgtagtgctcctacacatttctcatcctatcctgggtctgaggaaagcacagggcactgggtggctagggctgggattcacaacaaagtgacagtggaggctgagggagacgtactttatgggccacctcggaatagatcatcagctttaacgccagagcttcagaggcatgtgcagaaagaaaaaggcctgtaagtagaataaagaggaggcaggttctgtgtctgattcggctgtccggtgaggaaagatgtgaagtgatctctacccacaccctggtaacaccactggaagacaaagaactgtcctgtttgtcttactgctctgtcctatgttttaaagtcttcaagctgctgaaggcagtcccacctcagagcttacatgcgtaaacattattatctgtaaaggcttcctatttgatgaatcatggtgtatcatacaatctagatatttcatctggagaaactgagatgaggcagattaaagtcttttccaaaaccacatgaggaattaatttcaaagcttgagattaaaacctacatcttgtagtttcagattattaacttaccagtgtgatctacaagttctttctccatgttctaaaaaacaaattttttaaggcaatcaagacattttcattctctcatgtgagcagtatgtatcagaaaaattcatctgtataaactgtatggcagtctaaattatatttttaacctgtcttttctttttttactttttataaatcatatcttccactgtttacaaattttgttatgtctttcacatatcagactcaaaaacagttggctttatgattgggccactagaagaaatataatattttttcacttaccttttcatttcctgacttttttttagtgataatctgaatatatttgtgaaatatttaggcaggaaggtgagttttccagatgtttctgttgattattgcaaacacagagcaattcaaagactagtgtcgctttttgataaattaaaaatactttttttgataactagttattcttgactttaataaacattcctaagattaattcttcccttaacaactttagtgtaattttaatttttcacaaatcctgaagtgggagtactggaattttggagaaataaattaacatgttgccttatttctctggaccatctgttaatgcttattctcaactaaagtactgttcatcagcttcaagtaacaaacataccatagacaaatagcctatgtctgtgacggtgataagacattggccaaatcatcctctctctgaccatgacaaaagtgtaccagtcgtagctaaagcaagactgaatctatttggtattcattgtaaaggaaacaacaacaacaaaaataactaataaaggtctgagacaagatgatggatggcaaaagaaccccctatggtcataaataagctaactttggaaatgtttgacttaaggaagtacagactatgcttagtctgcctcgtgtccctggactaaagcagccttgaaggctcatctgaacatttccccaggggtttcttgcctattgacaaatcccaccacatcttccagatgcacagaagaaagttccgttaaatccaaaatggtaaccaaaaatgttgaatagcaagaaactggcaggggtggctttgggaactggtaaataaataacaggcttgttgtcccacaccctagtttaatgctctcaagaggttcttatgttgctcgcattagtgggcatgtaaatgaaacccctgttggccttggcagatattggcctcttccgtgaccttgtttgactgaaacaaaaagtcattggtggaacaaaaattcagagctctgaacttggttgaaagaaaagggcaattctctgaattgggtaattggatcaccctcccaagtgccctagggcttatatcaaacatataagaaggggattaataacttcagtgtataaatgagcttcaggcagcttccaactgtaacatttcactctcaggagctttaggacataacagatttttttcagagcattttgaagtgctctttataaaatgcaggaagggactacagactactgtggaatctttgtaattgtacatggtccagtctgacaggcaggcaacccgaaagcctcttcaaaatggccacttaataaaactgttcatgaaatataccattttgggactgaaagatgatgacagtgatatgttttcaaactgtacttgatattcccttccttagtcataattttatgatctagactaaattacatgtatcattgagtgtgaggattccaagacttgagacagacttacgtatttatgtgtgagttgtaagggaccattggaaaagctgagaattttaaaattcatttatattaattaatttgttcactcagtatttattcaatgcctactatatatcagacttgaggatataaaaaagtataaagtagagcaaggctgacagacatttgaaaggcaggttcatgaggattgaaggaacatgtgggaagggagccattacttcttaggagtggggaaaatccagaggagactagaggagataacgagagatgagtcgacagcacaggaaaataaagaagagtattccaggcggaggatacaacacttgaaatagttacccagaaaagctggcctggtgattaatcggcccagataaaagaggtaggctaacactgttattcgtcttttaaaggagaaggatcaagaagcagttctgttgggtcctgaggaagtgggattattagtgatggacacaaagtgctggtgtcacagctgtggtagaaaaagggaaacaagagaaagcttctgaaaaaaatgttttgacaactatttttatggctgtggacatcctgagacctctgacaatcacatagaaaagagagcccatagggaacattttagaattgattcttatcttaatagctatctttttggcctgtctggttgccaaaaagaattagcagaattctgctgtttatgtattgctgaatcagtttacaggtgatgttttattactagggaaatattgctaaagctaggtagaggtgcttctaagaactaaagcaccagaaacctaattgggaaaggaattaactttagtcatgtacatattttcatttttctcctttaatttttatattaacagaaaccctgtgaggcaggtgttttacctacattttcacaaatgagcacacagcctcgaacaagttaattcctcagaatcccacagccagtgcatgctaaggcccaagtccccttcatcctccattctcccaccggtcatagctaagtcttcaagctaatgttcacctgccagagtaaaggcagaatatttgaattctcttgtatttgttttagtttagttattgactatgtttttcttcctataaagtaaatatgtttcattctttctgcacaggttttcctataatgcctgggtgcttctagctagagagggcaaattgatttcatcttccattcaactccagaaggtctatagtggccgcttggactgctgtaatggagttgctcagcagccgctcccatatgctctatgatggggcagtggtggtacaagtgctgcatccctgctaccgaggctgctgctttagtatctttacttcactcttaaagtggggaatgagagaaattgtctaaagtcctaacacaagacagccatacctacttcccaaagtagtaaacactctgctgctgcatgtagaatgaaatagagcagtgaaattataaaggagatttgcagtctaataattgggagggaaaatgaagtataaggctaaatgaagtagactacaaacacctgaagcatgactacaaaatcaagttgacattttgtggctcattttcagggtagctgccggaatctggttatggtcgttgtttttattttttagggttttcccccatctgtgtacagtgagatagcaaccacaaaaaaactaacagccttcctgagtctcttggctgtagagtacccagctcttttccctgaagcttgccctgaagaggcctggtgatacatccctcttgggagatgtgacatggttccatattgacattacccactgggctcattgcttgagtctcaaggttgtttatgtatttgatgtttcatttaaaaataaaagttacttacggcaaaaatagcctagtgccagtgggtttggctattgtaaaatttagaaacccatttaggaaaccaccatcaggatcttgttggtgctgtatcagcttgggcatattgcccttcagcacaccggctcttgcacagattgcgtccactgagttgaattatggaaaccttccgtgagaaaatgagagcactcaggaagtagtattggtgatccacaaagcattgctgtgtcctctaaggttctttcctggtctcataccatggtttcttcctgggtaaaaagtgaaactggggttctgcctttctcaagggaaaacgtgtttgctgcttggctttggaattttggggcaactcagtcagtgacatttctctttcacaaactcctcctgttctttcaaataggtgccatatctttcactttccctatcgatacttcatatgttatgcctggctgctaggtttcattccagagcctcttgtgtttaagtaatgaatggactaatcataatgactagctcagtacaggttgctgagttggagaccatggcctagtcatttctctgatcacacagaagtcatttctggacaaaaagtgctacatactatatatctatatctgtctatatatttttttcttgatctttcttctattttgtgctgcaaaaacaaacttcgaggggatgattctctcacaggatatggaaatggccttggacaatgtccagggttagtggcacagctgctgtttcctgcaagggacatctcaaatccagaagggaaaaaagacaaagttaaatatatagcaggaggataatgactgaacctattaacccatttatgcctagtgttccattagtggaacactaagcttgtgggagttatttatatcctcatgcttaagctcatcaccaaggtctgatttttcacataaaaattttgcaacctctggcataaatgggttaacaagaaggaagggatttgcctgttacaagatctgtctgtaatcacatatagccattggcagaaattacagtttacatttagaagacatgtttaaaactctttaccaaagggcaactgatccaataataatgatagcaacaacaataacatctatttatggcacctaataattttaaagttcctttgtgtacgtagttttatattcacaacaacctagtaaggcctgtaagttgactggagagggctagggtatgtaaaactaggtaaagaacttggattttatcctaagcataatgcaaagttttcagccagggatggacatgacttgactgacagtttaggaagattacttggcctgctctgtaggagtatagactgtaagggggccacatgaaagccaggagacaagtcagcaaacataacactaatccaggagagagattatggtggctcagactggggggtgtggtataggggatggcaagtggtcagattcaagataaatatgaagacattccttacaaaatctgcaaacagattgaatgtgaagtgtattttaaaaaatgaagaattggccgggcgcagtggctcatgcctgtaatcccagcactttgggaggctgaggcgagcagatcacgaggtcaggagttcgacccaatatggtgaaaccccatctctactaaaaatacaaaaaaaaattagccggacgtggtggcacacacctgtagtcccagctgctcaggaagtggaggctggagaatcacttgaacctgggaggtggaggctgcagtgagccaagactgtgctgctgcactccagcctgggcaacagagcaagactctgtctcaaaaaaaaaaaaaaaaaaagaaaaaaagaaaagaaaattaaaaaaaaagaattatctgtgtattttttatcttaaacaactgagaatggtgtcattttttccattcctagagttatttaggccaaaaaaatctagaatgttgaagagaacagattggggtgggaggtgcaggttaggggattaagagttctgtcctagagggccgggtgtggtggcttacgcctgtaatcccagcactttgggaggctgaggtaggcagatcacaaggtcaagagatggagaccatcctggccaacgtggtgaaaccccgtctctactaaaaataccaaaaattagctgggcgtggtggtgcatgcctgtagtcctagctacttgggaggctgaggcagaagaattgcttgaacgcgggaggcggaggttgcagtgagctgagatcacgccactgcatttcagcctggcgacacaatgagactccatctgaagaaaaaaaaaaggggttctgtcctagaatagttgcatttgagatatgtaagtgaccgggcgtggtggcttccagcactttgggaggctgaggcagcaggattgcttaagcctaggaattcaagaccagttacctgggcaacaaacacagtgagaccctgtctctacaaaaaaaataaacaaaattaaccaggcctggtggtgtgcacctgtagtcccagctacttggggggctgaggtgggagaatggcttgggcctggaaggccaaggctacagtgagccctgattgtgccactgcactccaacctaggccatagtgtgagaccctgtctcaaaaaataaataaataagaagagaaagatatgcaagtggacaatgacaaagcagctgaataaatgagtctgagtctagagctcaggagaatgggctgagctgtagtgagaatatggcagagattgatcctggggatacatcaacatttagaatagaagagaaacctgcaaaggagactggcagggaggagaggatcaggtgggaagaaatccatgagagtgtgctttttctggaagccaagtgaagctaatatttcaagaagcaaggagttaggtccagtgctgctaagaggtccaataagatgaggactgagaattgacccttggatttggcagatacaatcaatggtgaccttgacaagagtgatttcagtagagtgtaggggacataagcctgcctggggtaggttaaagagaaaaacaaagagcatgttcaattctttaaggtttttcactacaaatggaaacagtgaaatggagtggtagctggggaagtcaaaggaggttttttttttaaggtgggtgttttttatttcgcattttgatattgatgtacataatgcagcaaaaagagaacatgtagtaatgctggagaggaaaggataggtaaccattggtaaaagacctcaaaggtattagaagggattgagatgctcgtccaagtgtatgggctggccttaggctgaagcaagactgcttcaagagatacaaaagcaaattcattaccctaagaatggagtacatcacagcaggattcctggagagaaacagaaaagagggtcattaaaaacttatgtcaccactttaaagagggaagaaagttctgtttggctcttttggggactccagaagaaaagtaaaggtatactcataagcccaactttttaactttctagttaccagaacaccaaacaaggatcttagaatatcagattttcaattaaccctagaaaactaacagcatttgagtagaattcaaatatatgtgagagaacataatacataaataccatctgggaagttctctaatcaacattctccttccctagcactcactgttggatctgtagtacatgcatatgtgagtgaagagctctttcacaaatatgaaagaagcatagtatggatgtagggtgatgatttacttagtgtggtaagtgtctccaagcaacacagtaagggacagaaaaagctgggccagcctgcctctgggagagacatgccaagcttttctatctctgtgaatctcacaagtaaatgaaaataagtgcaagtagtactatagtaattaaatcaaactatcttctttgagagtggctttgtatgtgtgtccccattatttgctaatttactatttcccactgcttactgattaccctgagtatgttgcatttattgtcctatttaatcctctaaactctatcattgccattttacagatgaaaacatagaggccagagaggtttaaatggcttgttcaaggccacatatctaggaagtgggagagtcaagattctaagtttaatgcccatcaatgatagactggataaagaaaatgtggcacatatacactatggagtactatgcagccctaaaaaagtgagtttatgtccttttcagggacatggatgaagctggaaaccatcattctcagcaaactaacgcaggaacagaaaaccaaacactgcatgttctcagtcataagtgggatttaatgatgagaacacatggacacagggaggggaacttcatacaccggggcctgttggtgggtggggggcaagggcaaggggagcattaggacaaatacctaattcatgcagggcttaaaacctagatgatgggttgatgggtgcagcaaaccaccatggcacaagtatacctatgtaagaaacctgcacattctacacgtgtatcccataacttaaagtataataaataagaatttttaaaaaagattttaagttcagtctttgtttccaaagccagagatctttccactataccacactgcctcttatgtagtcagtgataataatagcttggtcatttgcatttgtgaagcaccttttatttgaagagctgaaactctgtaagccttatctttgtaatctggagagaggaagaaaagaaccgacatttattgggcaccttatatttgtgtgtgatgtaattttaagcactttcataccagacatgttaattatcttcattttaaagatgaggaaatgaaactcaacaaagaaattaagtaaattgcccaatatcacacaactcccatatagtcaatcctggcactttccctcagcagattctaagcaccgttggagcagagagcaagtctgtttttaatcattctgattttcctagtgcctaggacagggtctcactctggcacataataggtgctcagaaaaaaaatgattgaatgaataatgagcaaatgtgctgtaagctgaactggaatgcattgagtcttgtgttgtacttcctggtatcttccagtggatgtcaacatgatataatgagaagattctgagaaggaatcagtgaaggcatgcatgttcctgactgtgaaacttttgctcttctcagagctatacaacctaggtgatagacttccttttctttcattgggaaaactgaggcaaagtttccttggcaaagattttgcaagtcagtggacaatttgtggcacaactgaaatcttgagattctcacctttatagccctaaccacttaacaaccctgtggtcctggtggggttatagctttccataaatctggtacttaatcatttaaagagatggcaatttatcttaaatacacgcctcattatagatgtgtcacacttagcacagatggtctcagaagtttttcctggcttcccataccctaacagtatctagtatgttaatgtcaatattagctttactgttttaggtaactttggtatgcttctcattagctgaaaccgtaaagagctcagttttacctgcgctgagggatcactaaattcctattggcatctgaatgcacagtcccatgtcgaaagtgaggtcatgtttctcctggattatgcccgtatctgatgagcctcggctggcgtgaatccgagacaatgaaataatcacacccattagctcaccagggccctattaagatgtggcctggctttccatccatttctcctgcttggaaaaactgacacagtcatggtttgtaaaggttagtgcagatggaactgcttcaacaaccaaaacttagcgttaccctatttaaacttgggaagggtctgctgcttaatcttaagaaatagcacttcaggagccagggtgtgaggatgtcctttaatctctttgtatgtgatggtaaagctgaattttcctaacaccctccttccccgctctcagcttcagtggctggggtgggtgaggtgggggagctctggagttgtggtttccatactttctactttttattctatttttctttagagatcccaggttttgaaggcttgagtctagtaaacaaactgtaatggttaaatcacgattttattttctcgttgacacctagtgtgtgttatatgcagcgtcctctgcctcatgtcattctccaatatgctttctcagggctactttcccagaccctatgccttcttatgggttgtagctaacagttacacttccagagtatgccgtccctcacccacagagctcttctcacaactgtaactaactgattatttgtgtaactgtttgcatgtttaggctgtaaggatgcagaccatgtctgtcttgctcacagctgtttctctagtgcctaagtctttgcttgatacatagtgggcacttggtaaacatttgttgaatgcattaatgaatcagcttatttaattctagtgaaaaatataaagaaatatcccccttatattggcttggggagccttattctggatatatttgataggatttttgaaatgttgtcaacaacttgaatgaaaatcaccaagtttaaaatgaaggttcactctgggcaggagagaagatgatgctattggagaaggattacacaagaggcttctggaatattgataatattctatttattaagctggaggactcctagggacccaggggcctcagacttactcctgaactggagggacatgccaaataagccacctgctatttatttcacgcacacccaaggcaaagctgttggggccacttaaggattttgtaaaatgtgagggtgttattaaagtaggcttattattttacagctcttatgattgttcacctaactaccttgaacaatactgcaagtatttttctctgctcacatatttggagacatgcagagccacttcaaacaaaccatcctgacttcccatttgtatctacgacctcatgaacccatctcaaccccccaaaccacacactgaaactaagccaaattaaaaacaaaaaacaacccaccacccagcagtatttagttgagcacctactgtttgctttgtattataagctgtaattacaacagcttgagtcttgtcctcagcttcctgaaatctcccagtggatggcatcatggaagaatgagaaagttatccaagaatgaatggtctgatgtcaaggaagcttttcagcctttcctaatggtctgatgccctctgtgtgggttacaatctttggaagtataagatttcttgtaaaagtcacagcacctgccaacatagttgggcagggacccaagtggggtgacttgtaccgcattcctccctggtattcagagaccacatagtaccagaagcttgctaggcccagctcctggggactgtcagaggaacaggcccaggcagtcttctcctcagattgcaatcaaaagttgcttgataaatcagtaagattgaaaatattcttggcagtttacataggcaatggtaagaacatgtttttttgtagttacaatgagtacattatacaagggccggaagtgaccaaaatcattgattggctaattagacataactgaagggtcataatgcttcagtcgttatgtgggaatattcataaagcacttgagttcagctccaataaagaggagaaatgtacccagggaaattgcagagtaaaagtctgggaatgtagatagtataggatgttacaggtctgaaatggaagggtttactatattattgagttttgcaaacagattcttggaaaacagattcctcaagtctttcccagctttcagatgggatatgaaactagaggctttagcctttacttgtggttgtctaaaaatccaccctatttttcttaggaagggaagcagttgccttaacaccctggccagattcccaacatgtacagggtggcccatttaaaacaggcctgtggatgcttcagagtgagcgaaggggtttgttgtaaagcaccatgtgtatgtgggtgtttaatgaatatgagctgattaaattggccaccctgaattataacctcataccttctctagttcctctccagtttttagctcaggaccatattcttcctactttctgctcaaacttgttagggagaaacgttcccactattaaaactgccagtgttttccacccagtgtttctttgtttcaacgatgagcagaagaatccagccttggaaatacctttctttcaaattgcttgtccagctgcaatgacgtctgcatcagccacacccacatcacttccccttcgaaccttctcgcctccatctgcttccctgtctctggtgtaggacaataccagtatctgtctggagcagatagtgaactctgccacaaacagaggagggcttgtgtgaagaaggaaaaagctctgctttcgaaatcaagcagcctgggcttgtgccccgtttttgctaatagccatctgtgtggcttagggagtcactgtcttcacaggcccgagttccttcatctgtaaagggaaggagcgagacaaaatcagcacttctcaaattgggagctgtagattcttgaggtctgcaagtttaatgagattttaaactttttatgaagtttttttttaaatcataaagacaatactttgcaattaaaagtcatttaaaaaaataagtcttaagtttgttaagctggtcattctgaaacttaatcttaggtctcctagagattttttaacagttttgcaagtctcaatttttcccctttaaaaggactccacatatcactccagtttgagaaacactgaactcttttcatctactcagaaactgaatctagcggtaggataaaacattagctttaactttcttatccttaccctactcaacctaattacttttggcccacttcaatatgtttaagtcttttagcacatgggctccttttgttttcataactgaagtatttcctgttttcaatcactatatgttaaattataaaaagcatgtttctcccaatagctctttccctttccctttaagactcagatcatttaatttattagtgcccaacctggttaattgagaccaccttcctctattaatgtttctttgttggttgaagtgaagagatatatggtctgttccctaagtacccatgaaggattggttcaaggactcagccccatactaaaatcttcagatgcccaagtcccttatataaaatcacataatgtttgcatataacctatgcacatcctcccatatactttaatctctagattacttataatacctcatacaatgtaaatgctatttaaatagttatcatgctgtattttaaatttgtattatttttattgttatattgttatttttcattgctttttttttttcaaatattttcaatccacattggttgaatctacagatggggaaaccctagatatggagggctgactatactgcttttatctgtgatctcaagattgaatactcacagtagtttatgtatgcattctgctttcataatttgcagaatgctctcatatacattatctcttgattttcactgcagtcttgtctaataaatgatgtaggtagcatgatccccattttacagatgagacactcaggcccagaaattttgcttcatatcttctgattcagtctacttgttctcccaacaatgcttcttcatccaattacagcaacaaatacatactaggtacctgttatttgccatatgtgctgctttattgttacttgttccgggaaataacaagtggagcttctcattcaaggataaactgatattgccaggccttgctcagtctgacataagtctcatgccattatttactaaaatagctagctactctcacccagtccggttcctggtacataaaggaactcaataaatatttattggatgattgagtgaatgaataaatctaaaataaattatatcattaattaaaatttatatattggagataatttttgctaatagatttttgccaacattttttcagattccaagtcaataggatttactcagagactgccaagtgctttaaggggaaaacagagggactgctgggagaagggggtgcactggtagacaagtagaggaaatcccctttctggcttcatccatcttcctgtctatgatcggtgtcctaggccttagagtggacatggagaatggtatcactttgtctgcctgcagttaaccaaaatacttactcccaccatagggagaagagaggaatgacagaggtatgtgaagattaagtagaaagaccgacaaatgtaatcacattggaaggtagaatggagggtagaaaagttggtgggaagacaatttctgtggtcaggatacatctgaatggaaaggggagagagattttgtccattcctcccatagtatggtttggctactttccctctacttcccaagagaattattagtgaccagggacatcacattttaatcaaggcaactgttgctgggctggtaagcaaggctcccatgggtgtggtgaagttagcagggtgaagagtgaggctgctagtcacaaagggatccactcaccctcttccgctgttggcggctgctgtggtatctataaacatagagtgtgtactcacatactcataaatgctagttattgtcatacgattgcattgtgtataaaagtagattgcctggaaaaaatgattccacttcatttttatatacacattgttcctggaaccacttcctgaaatcccaggcttttattttgctgtcattctcttaaattgcctctttctcaaagcatccgggttctggagatgttctcgtgcttaaagtgtgtttctaagtagcttctgggaaccacgtaaaattgtctggctccacttgaccaatgaggagcttacttttcctcccaattattcctctctgacagaggccgttggtcatcttgaaaagctaagaatgttagatgggaccaaagtaaaattgcaaagcctattcacccagccaaactgaaacacacctgattaactgaccacacacatggtctcagaatgacatctcacttggggagtaaaagccaacagttgtggttagtgccccagcaggccccagatggttagagttaatatacacctatgttttctgccaggtagttttcatcagtttcctcaggatgtcagtgtgtgtgtataattaagagtatttaatcatattataattccccacagagagatggagtgggggatgaaggatcgctggcttttacagtctcagcaagagtcatcagtggaaaaaaataaaaacagaaaaatgccaagtctctgggctgtgcctgtgccataactcactcagaagtctggctggcaccactacctcagtgtcatttcagtgaagatgtaatcccaaatcttttgttgcaatcttagggttctcactattttaacattagcttagaacatgtggattgcaaaggaaaactgtgttctaattccctgttcatcaaggctgtgatttgtgtacacccacataaggcaaccttcagtttataagactgatgacttcagtcttgtaaaaataaatgagatgggcacttcaaatattttaagttagatcaatcagtagggtgagcacagtttaattggcatctattgatacatttctaaattaaaagagcagaatatagagccatgaatcttagccatgaaatcatgttcacatttattacaaatccataattctttcctatttccccatatatcctgttttctttgtcctgtcaattgtcaaatttagctgctggaaatgatctcttattttggattaggaaaccaagtcctaatgaccgtaagtgacttttcagagtcacacagctagttagctagttagaatctgactcaccagaattccagtctttctactttgccagatagtctttactgggaaatacttttttacctatttcttagaagaatttacttatgtgagcttcacttaaagcaatattggtctatttcctagttcccttaaactgatcatggtgcatttctgttaaaaaagccatagagttggccgggcacggtggctcacacctgtaatcccagcactttgggaggccgaggcaggcagatcacaaggtcaggagatcgagaccatcctggccaacatggtgaaaccccgtctctactaaaaatacaaaaaaattaaccaggcatggtggcgggcgcctttagtcccagctactcgggaggctgaggcaggagaatggcgtgaacccaggaggcagagcttgcagtgagccgagtttgcgccactgcactccagcctgctcaggcgacagagcaagactccgtctcaaaataaataaataaataaaaagccatagagtttctttataattaggttctaacactacttcttcctattagtcaataacagtgccacaataagtggattgggttaaaatgaaaatcaccaattgagtctctacccaaaaccccttccagttgctcttatttaggaggaaacagcttctgctcagtttctgtccactcacaagacctctcctgcatggaaccctgtccacagtttctatcactccacctgtgcttacttcagattatctctgaaacaatcagatgtaatggccagtggatgcaaaatacatataaagtaagatttgggattaggaggctcaagggggatggatatgtagagaaaagacctaggaagaacaagaacagggactggcagaaaacacattctgagacaaaggccatttatttagctctggccagttggtttatctagcctgacatttctcaacctgggcgctattggcgttttgtgccaaattattcttgattgtagagagctatcctgtgcattatggtatgtttagtagcatttctgcctcttcccactgggtagatgccaatggcatcccttcatttgtgacaaccaaaaatgtctccagacattagcaaataccctggggagtgggaaagggagagagaggaagaattgtctccggatgagaatcactgatctcactcaaggttttatctttgacatcagcgccataagatattttgtgagaggacagagtggcctttctaattcttaaaagttagggttctactccagacattccttatctactgcaaatacaaattatttatttgttcattcattcaaataacagttattacagatgacactatgtcaggctctctgctaagtctaggtgaaaagacagaacctccccacaaagacttagaacttaatactcttaaaaatcctagtcattggagttgatttgctcaccaatgctaacaaagttaagactttgaggttgtattcccttatctggctttaactcagaccaaccatttcactgattggaccagcacaatgtatcctggctactctaaaagtcacttaaaaaaacatatcctactggtggtatgttgatagtttcctgggatatgaaggtgggcatggttaaagctgaaaggactcttagcgacaagtgaaaaaaacctctttggtaaatcactagcatagtattacatggcttttttttggcctgggtgcagccccctttagactcaaaccactgttcttcctgataacacatggccttatttatgttcattgtatttatttagcttattttgattcctctttctacataagaaaccacaactggaaaaatcaattaatttttaatttgctcataaatttctacccattagaaggaaccaaggactcttgtaatttggcacaaatttcctttcagtatttttaatctctttggatatgtgtgagttgaattctctttaaacaacatgaaaatatataagctatttatataacttttaaaagtatcaaagagaagactctaacatccctcactgaagcttttccagaatttaccatgtgtaccagtgtaccagttgttctcaacccagggtactttgcccccagaggacttttgacaatgtcacagatgtggagggatgctactggtgtctacccagggacaatgctaagcatcctacaataaacaggatggtccctccaaccaagacttatccagcccaaagtgacagggtgctgaggttgagaagccatgtggtatataacacagatgtacacactggaggaaacgtcactgaagtagatgctggtcacttaccagtttcactccttcaggatatcctcttctttaaacgaggaggttgtgactagttacttcccatgaaaagcagctgacccttagggttgaaaagtatgtttattcccaatagcagtgaatgaaaaaaaaaaaacacaatgaatttctacttgcaagaatgccatctgtggttttctccaagtgttgctctcagccctcagtgttcagggtcttcttcacctgtgcattctgctgccctgcgttatcagagttagaatcagggtggaatacaaatatttccccaggcat[450 bp omitted]tattttcttccggaaaatcttgttgtttacgtggttggaactttattattacacagattattataaaaatgaaccaacactcaaaagtacaaggcaggatttcccacaatggctatgtcctggctggccttgttgctagctggcacagtaatatgccacctggaagcaatgaccattggaaaagaagccaggaaaaaaccttatgagaggcacagggcagtagataatttgtgaagcggtcgtttgcctcccagagtggcaaggctggcatgtctggcctaagtgtacactcacgtcatttatcacatcctctggtagcagcgcctctctccactgcctgtgaaggaaactgttgcacaatcctgaagatctgactgaaggaaagttgtcttgggatcagaattaaggttcctttttcttgttttcatttccgagttgcaagttatgcccctttttagcgtttccatacccagctgtctacattttaagcaatcgttatatggaattatatcttaaatgtaaaataacaagaattcatttaaaataactgctttccctccagaaccagaggtatctcaccaaagctgtcacctccccaccagtatactccaattgtgggtgacagttgtgtttagaaagtggtgttatagctccttttatgtaggatgattactctgtggccatgaccttctgggatgaacggaaagggctggacagagttacacagcacgacgacagaggagaagcttgtggaagtgcattgcaaacagagatgggcgagttaagttactcaattgccatctgcctctgttttgctaactcattagttcggacaccacattgtgttaatccccacttccctggctctgagcttggtccaggtctcgggggaacagtgagactgctcagctcgaccctcctgtcagctgggcctcagcttctctgcatcgacagcatgccaggcctgccaccctcgctgccacatcacatcaaggtgaagttttctccccagcccctggcaacagaaattgaagcctttggacttcgctcattcttccaaaagacttttctaggcagtgggatagattttcgccttacaccccctagcactctcttcccttccggcactccttcaaggcaactgcaatttcaggctgaccatcttggaagtttgatggcactgagtaccaccagccaaatgctctcacattttctgtgcctctcagaagaagagcccatatggcagctaagaaccaatgagtgaggcctaatttgtcccccaagactatacgagaagggcagtcttacttctggacctaatctagcattacgagcatccagtgatgacccttacggtactttctgagagtagttgctcataatcatcattgtctctgctggtgagctgactgggatacgcaaattgttcctatcaatttattttgacctctctggacttcagtattctatgtgtgaaagggtattttctgagaatgattagataatttgtgatgtctttttcagctttaagtatgaaaatgatatgctaattttatatgttgtcagacactactctaggcatttaacatatgcaatcccatttattggtacccaggaagtagacactattacatctctgatttgcagatgaaaaactcaggcactgagagattgtttgttcaaaggcaaaggtaataagtgacagcccagagattggctcccgagtctgtgctcttagccacttgtggtcacttaagatagtcccttaatcacttcattgctctatttcccgtcttctttccaaagtctgtgggttctcaaatgtgatctcatcaacatttagggcagtatcctttggaggttattgttgcccccttttttacaaatgggcactttgagataaaagcaggccacatacaagctattggcagaacccaggagtccagcttttgtgctgtgggttccatctgctatgtgtctctcccagtcataattaggatgatcaaaaaattcagatataacctgcttacccctctcaaccagggcaaatcagaaacagctccatagacaattgggttaagtttccaactcaaatgttgaatgatctatgcagaatataaaggcgtttacaagccaatgactgatacagatgcagcaataacatacctttccccagtcctctctttgctgtaaggcacccactgaatatcttacacctctctggatagcaggagttacagcaaattctgcatatgccctcccacatttagcacatgcagggctcatccaagaattttagcagcaggggatgatagagtttgttctctggttctttctgactgtctctgccctgatagtgcctagtacctgagtggcccttcctctgtcctctaatcccactggattgcacgtgccttttagcactggaggttctgaaagccaagcaagaactcctcctaatggcattcagtacctctttcttcccagtcccaggaggggtttcccagcaagcagagggaaggtgattgtttctacctctcatttagtccttcctttccaacttgatggtataccacctgcaaagctatcccagaaacagatgaagtttaggatgcccgaagactggtttgtgacatagaaaaattggaattgaaatgaaactgcacattcattgatatcacctctcctttgtgagtctggacctaatagagtggaatgaacaacaatactgaaataccaaacttatttatgcatttaagtcaccaagtgatttgggtttttgtatcagggatggttgttgcttttccctctgcaatgttaaactactgacccgtttcctctcaaattccagttccacgtttaactgaagacacacagaaataaatgtgtgttggcagaaagacaaaccctgagatgaagcaggaggtatgttggctgatagaaaggctgttattttaatttcttttacattgcagcagtctcagatggatagtatccaggtaacttgtagcgcctgcatcttattaaactcctgtttgattcagaatttacagctaaaatgcacctggaatacttaaagtaggaactagactttggttcatttgttctcaaaagggatgtacaaatcgattgcacaacctacagcaagtggcataaaaaccttcagaataagatgatggcacgtttttgttaataactatatttcttgatttataaattcaacaatgctaatttagtgtttactgtttgacagacattgtgcctctatagcaggatgaactcacaggcatgttttctgtacgtctgtctctttttattgcatgtgacagaaaccatactcaaagtagctgaagcagaaagtaaagttatcacaaggatactggcatatctatagaaactaaggactgggatgcagctgactcaaagaagagatggaaccagtgttaaataacattaagttagttggtctcacactcttacacacacactatctcttacacacacactctaccactacaaccactaaatagctgcactgtcgctacatagccaccacccacatgtagctactgagcacatgaaaggtgccttaagtgtaaaatatgcactgaatttcaaggacagtatgagggaaaaaaacataaaatgtcttaattttcatattgattacacgttgaaatgataatgttttggatatattgtgctaactaaatatatttgacatttattttaccaatttctatttttttcatgtgcctactggaaaattttaacttacatatgtgacttgcattgtgtgtgtgtgtgtgtgtgtgtgtatatatatatatatatttttttttttttttaattgaggcagcctctctctgtcacccaggctggagtgcagtggcacagtctcagctcactgcaacctctgcctccctggttcaagcgattctcccacctcagcctcccgagtaggtgagcttgcaggcgtgcatcatcatgcccagctaatttttgtatttttactacagacggggtttcttttgctgtgttggcccggttgatctcgaactcctgacctcaagtgatctacccaccttggcctcccaaagtgctgggattacaggcatgagccaccacactcagcctggacagtgttgttcttctagttggttttcctaaacatctacagcaacataaatcttcccatgccttagttagcctgatttagttgagaaacactgaagggacaatcagagacatatatcaccaatcaagtatatatcattctatttcatccttttctctctcctttactgtccctcataatttctacatgagccgaacacacacacttctttttgaaagtgaatgtatatattcactcacttcaaaaatacttactgaaccccaattctatgctaggtcttacatcaggcggtgaggatacaaagtccctgccctcacagagcttcctttctagcagcctcagccacttttagcttgttttcatgaatggagccctgatgtgggaagtgcacctcccagcgtggctgcatctggtccaggctgaatgattaacccttatagtgagtctaagttgaatgaaaacttggattttcagagtcgccattaataccatgttgtcaagggagatggcaaacgatgttgttattcacaagtcgggagccttcaatgatgtaaatttgtatttctcttcccatttttatggagccatatttcagaattcagaaatggaactatggaaatatggctctccccgtccccaaaaagagtccttcttctagacttcttgacaatatgtgtgaggaagcctctggattcagttgttttgtttttttaagtaactttttaaatgaagtataatatgtaaacaaaaaagtgtgtacatcgtagtgtatagctccatgaactttctcactgagcacacatgtaaccagcacccagattaagaaacataacattaatagcgcccatggaagctcctccttcctgtcatgaccccatcccacccctccaccctcatcccaaaggtaactaactactatctggacttctacaaccatggattagttttgcctgtttttgaactttatataaatggagtcatatagcaggttctctttggtactattttcttttactcaatgttatgtttatgaagtttattcatgctgttttattaacccatagaaaatatagatagctcccaagaagaaacataaaaattataatcctactacattaatatgtcagtgtttgtccttctagccacttttctatgtatatacttatgttaactttttttccaaaattagaccatagtgtgcatactactttgtgatttgctttgttgtttgatatatcagatctaccaatgtgttctaaatgttggtcgttgtaatgaggctatattctgaattgactaataggtaatacagaaaagtagaaaattattttttaagtacccataagtatttatattaatcattttgtccgatgtagatttgatccgtctcagtcaggcttccaaaagacttccaaataaaggtagcgaacaaatggatcactgattgctagggaaatctggtaatcaagaccaagttgggcctcttgtttctcaatgaatcttctaaatcactctctactgttttaaacctaggtattctgcgaatatgtaacagattaggaactgaataattctgagaatggcttgttagagtctctgttcaactcttggcttactctataatctgagacaagtctgtaaaatgttccttatttctcagacgaagagcctcatctccacatctgtttgggatcataagaaataatacttacataacattttggaatccttgaatgaaaagttttttggagttgctgactgttcctaaaatttcctcaactaacattgtggaaatccattgttgtggatatagttgctgagctaggtcataactagattgcaaatcttgagtagtggaaaaatctacgcctcgaagttctggtcatttattttaaaagctattcatttattcctagatgttcatactgtgagcttagcctgttatcattttggtttacttgctaaatattcacatttggggtcttcatccttacccatttaggattgtatctattggcatatgccattggatttgtctgagtgaggtcacctggaacactagtgttctgacattgagtttacactgcagggatgagagaagtaaatattcctattagtcagtaaggtttgaatttatagcctgagactcctcagacactgactgtctgggacccttggagacagaccagcattgaatgaaactgaaaggtagagaatatactgtggctgggaaaagtgatggagcaaatctatgcagagatacaatagtaggatatttaagagttggaagggatattagaggccctgtggtcatacttcatttttcagttggggaaactgaggcttaaggaggtcacagaatgagttagtcacagagctgggttagaagcttactttagtgtttcaccaactactcagatgtctgcactactgagatacatagagaaagagcgtcagaggaaggattagggtgtcctctagacctcattacactaatgcagtccctggtaggatctaaagacgtacttgtctccaagacacctgacaagctgagagtattgattcattctttcccaacttgggattgcaatggtgaaaggaatttggcattttatctaatcagcattggaaacttggctttcttttggagaattcaaaagttcagtttaggatatgttcacaagatactttcctccagaattaggtgggagataaattattaaatttatgagacttgtctttctttctttctttctttctttctttctttctttctttctttcttctttcctttcttctttcttttcatgtagcatttctttttcacattgtttctgatgacccttaacccctgctttttaaattcagtttcatttgtgttgtcacatatatatcagttgttgagtctttagtatgcggagatgctgagcttgcccttccaagatgttggaaggtcaactcactttatggtctaggtccaggaaacaagaatatttccaactcgctggggaccatcttggccttgagcagaaatgggatctgaattattacctaagagacctttgtagattgtcacagttggcagcctcaggacttgagctaatcctggaaattctttaacttcccagaaagaaggttccacaagggcaggctgaggtcctcagagagagcagatggaatagagcttacaaccagttgcctttacaactggacttggagataaataataacattatacccattttttttttatcatgaagcctttgactttcaggggatatctattctttattccttttaccctgtatgtggaaaaaaaatgctctgtatgaaagaaaagcaagcaaacttgttgactcagttcccatggtgaatgcaaggcagaccaggccaatagaaacaactcagatattacaaaaatgtgtttctttctggcagctgcacagtcagtcctttatatccagtcactgcaatcgccccatcacacaaaaccatttccaaggtcattattctggttgcgggggctgcttcccctacaaataaatgttggttttactaaatgtcctctctctccaactcactttatggcaaatgaggagtagcaaagcatcatttaggaagagaaagtgtagaaaatcagagagatgaaatactacaggttttctaaaggctcaggtttatctggctcaagcaatacaaattacaaactatggcaccacctgtataatctggttttaattaacttgaggaaggtacatcaatgttatttcattaaaatcaaattctgtttaaatggaaaaccaccactacagggtacattggggcattgttcacttgggttttggggttggcaagtaaatcctgtatttagaaaaacccaagcaaaccctgtttttttggaatcttcttatgcttcggaaggcttgtcataggttccttggaatgtagggggtgccctggtgaggaccaaggcacagctcaagatgttgtttgccaattcttccttttatgacccttctagtcttctgtcttcctgctccctgcctgtctccatatctctttagtgcttggccttgatgccctataggactctctctcccatttgccactttgaactgaatgatttgatccccactgggtggacagtggatgacatagggcactctataaacaaagatgctatttcaggcttacaagaggaatgaggcccacgtgatcacaaggggctggtgaataatagaaccctcttttgaaactctcacttcaccaattacctaagagctgggaggaacctgaaagatcctataatctacacacctccttttccgaggaggacactgagattcggaggtaaagaaactggtccatactagtgaaggctgtttgagtggggcctccccatttcgactcatgccctttcccctccagcctggtgccccagttctgcagacctgttgattacaacacagcccacgccgagaaaatcctgccctgtcagcagaacagctttacaagctgacataggacatgtgtgtgtttggagtcaggagaatggctgagttttagttccagttctgcctctgctttgctggcttcagcgagtcacttctccttcctttgtctatttcccctattgggaaggagaagataattaacctttccacctatcaggctcacttgagtgttataaagaataatgaggtgatatttgtaaagtgctttgagctgctgggaaagaggagggggtgagctccgtggaaaacattattagctggaaggacttatcaattgagctatttaacaatagcagagagtaaggatactcagaaatgaattccagggactagccctgctttgaatttaggaggaggattagtgggaacctaataggtattccgcttctccagtttcttcagtgcaccgtcaaactaggaaaggtaattacattcttctatgtcggattcagcccggagtttcaattgggatgtcaaagtgtgcttgtcctctattctcatactgaggctgtgttatggtgtgattgttaaagccttgggcatcttctatcccctggggtaatttcgcttaggagctatacaaagtaatttctatgcagtggctgggctgctgtttataaggttgattagtagagcttctaaatctaaagcgcctggggagcaatttggttgaagcagggaaataaaaggcaaggtctttatcatggttgatctttttttattgagccgctccatgggaattttctcagtgactcagatgcatctacagtgcaaaacgtggggcttggtggctctttgacatggcaatggaggcctagccccaggtaaaggtgaacttgccaggtcactaaatatatttagggcccccttttaacttcctttactctcacagagggtgatgtttttggggccctgaaatgtgtgggaatgtttccaaaagattgttctgatgagggatctgtttctgcaaactcctgccccactgtttgaaagaccgtctgccccaaattcaggtctttctcatttttagggccagggaagaagacagaggaagagaagaactgggggaattttgttttgaacttgtgcagtctctgtgggctgactgaacagtgagccaggcagaaggtggctccctctttagtcggcaggagcagggctgaattttatcaacatcttctgcaggtgtagggagaggtcaagatgtcatttggaatgataatttctctgatcaaagttaagttaaggaaattacagtgattgcatctttgtcccctaaagtttatgagcctctttgtaatcgctgcttccgcaaacccttccccaccttcccaagttctcaggcctccatctgcaggggctgctgggcttttccctccaggaaggacgggctcgccagctggccagaggttcctgtattagtgctgccctgtactgacttgtgagtctccagtaacaatcctccggtgtggcacagctacaagcaatgaccagggaggcccaccttgaatcctgaacctctttgggggctgactcagtcctctgaaactgactcttggattccttcctgggtttgccaccaactcatttttgtttttctcagcaaatcacttctctgccttgagactccatgaaataatataaggtttccttggcaggattctctgacctttttcagagacccagatttcttgtttattttaatttgaatgtctcaatcctctgaaagcatttggaatattttcttcatttccctctcccaaggtatctactttatcccagacagggctcccccagtgggttttgaggggaaggatgctgaggctttgggcccgggctcctgtcctttacttcacctctgccagggcaaagaccagcactgggctgacctccctgggctgggccaaaagagaaggctgtggaagccgcacgtctccgatgctgcccactgtcctttccctctgcagccacagctgcctccagcccccctcacccccgcctgctctttttctcagtgagcctcagcgccagtgccccagtgagctgctgggaacagaggtccgtcccctgcactggcctcggctccccgcaccagaacattcaggcatcaatgggaaacagcaagatctgtcggcatccccccctttcttcaggctttgagggccacattctccacggccatctgttccctttcacctctctggacaatgttgctttttaaagccagcgattcttcctcctttatcccctcctctcccgcctccccttcttctgtgctcccaccctttctacctctcctctctttgcccgattcctatgaaattagcctctcttaagataagatttgcccttcctccatacaaagctgttttgcaaacactatgggtttttgaatttttatttttacattttgtttgaagtgagggcttgctacttttaaagtttgtgattgtcttgtggagggggtagtcttttgatagggataggaagggggaggatagaaaaactttttagtcatgaaaaaagaaaatacagaataataatgagttttaggttcctgctggcaggcacttgcctctttaaagaaggaatcctccctttcctttccttgatgatcagtttaaggaaatttttatgctctcgaggtcttcccaccttttattgtattactattttgttgttgctgcaatgttgttgttgtgctgtttttaatttagagccagggcttctgtggatctggtacagcggattcctttgtcttggacagagccatatacaactccagaggttcctggattcaggcagagtgcccatggtgccttctagatgaagcaatcatcctgactcaagggctggacatcaaggggtgtttgccccaggactgaccagtgactaagtgtgtgaccttgggtacatcactttctttaagaataatgatgacagaatcatttacttcaaaaaatttttaacacatgattcttctgtttttactattacttggtttcacaagcaagacgagtccgtggtaatgtcatgaaaacttatgggttatccttgggtaaggatgtaccaagaatccaccgttagggtctagttgagcagcagacatgggaaatatctaaaacaaggacggactcctggctgtggctgcctgtcaggatcacagagcagggacacgggcaccggcagagttgggctgacagattgaatcctgtctctcctacttactagctatacagatatcagtaaggttttgtcatctataaaataggggcaacactagagatatacttcgtatggtcgttgagacaattaagagatttttatcacgtaaagcacttggaatagtttctggaacctggtcggtactatgtcgttgtccctcttcctatcccacatccacattacagatgaaaacatgggctaacgggttttctgcagggctcttcttagtctttcacattcaccttctgctggttcattttttcattgcagagtgaacactgataaaataaataatgtaattatcagattataatgatgattaacacagcgattctatttagaaatgtcataaaatagtgaaacatcctaagatacagaaagatatatgatcatgtacttctggcaaagaaggtgaaccagatgtggagatgatagtcatagaaggaaagccagtcatgattttggcaactgggatcaccttacatattttcagttggagaaaacctggagatttatttttcttttggtatcaatttctagaaacctgtcgtatgactaagagtttcccaacaatagggagagaacattattaaaatatgcttttctagaaaggcccaaatgactctgaataagaaactgaatattataatttaatgaggaaaagaaaatgaatgggatgtccagaaaattggggcggggagggggtagtttccatgcattttccctcctagaaagggagattaatggccattcttgtaatatctaaatggccaaaagaaacaatgaaaagaaaaataatgaatcagactctggggtttaaatcctgactctgccacttgccaggtggccttgggcaaatcactttctttgtagcgcagcttccttcactagaaaattggtatgataatggtacctccctcacagagataatgtatgtaaggtgtttagcctggaaaacaataattatcccaaagtgttacctcataattctttactgtaatgtcttatatcaactgacatctgagatgtgggacacattacccaaagttggtagtcttgatcactttgcggatgctggtcatttgcagtaaacccatagttctgtctcatttctggataagcattggccttcgaggaagaaggaaattggtttgcttaagaattcatattttgcagatgtgaactgactggctactgacaccaaaaccagttcccccaattaaaataaccctgctagcctcagcacattttgttcatgagctccctctcccgccatgaggcggctgcctgaaagtacttgactgccctaccctccactccccggggattgggacatgcttgtgaagagatacttgaggaagttaaagcaaggtcatctccattgcctaagccccacaccctggtaaactgcacactgtttggaccttgaaacttgtgagctgcgaattcctgtcataaatggagttttcctccctcctgtggccccagtttgtggtgagccttgtgttggcatggtggccatggggacacccctcgtgtgtgtgtgtgtaggcccccaaaaggagaagtgtagcagcttccctcagccttgcctcagaaagccgggtccagatggccaaggaagcacactgcattgaaggaactctgcagccagagtgaatttaccagtgtgggaaacaaaaacgttcgggttctggtctaaaattctgggagcaaaggacactgggattgcctccaccaaatgtcaacattttacttcttcccccacccccttctcagagcctcgagggcagcaaacatatgtgaggccagcattccattccctcccacgcaggaacatatgctgattcctatcaggatcctctgcttcccaaagaggctgatggagatggggagggaggaaagcataaccataaatcctcacactctgggcaaggtgataattgaaagcattctccaccatgacgtgctctccagtgccagggcagcaggcagctgggacagctaaagctggggaaggcctgggccggggcccagctctccctctgaccaggtgaattttggtggtcaagtcacttctctgcctatgaaacgggaataaggattgtatccatgttgtgggatcaaaggaagcactttaagtcaaattcatcagatgcacttaggcactctggagttttcaaagcacctcagcatttctgtcttgtctcacttgattctttttgctcccctacttgcactctgttcctgctgtcactgaggaaacacagcagagtgtgaactctgaaagctgacccttgtttggtgtcttgaagcaatgcaggtcaaggagcaagactgaggaggggccttaatgagggtctctgagtgaggacctgggcccggtaaccagccctggcctgtttcatgcccaggctatcagccgcccctcctaccaagtctctctgaattaatattttgggtgtctcctcagacaacagctccaagcagatgaattatggcagttctaaagggtatttacatctcttctctctattcctcttgggaagcagggtgggggattaagtcagtcttaaaaactggctaaagggcattctccagaatgatgtcttctgagattaaaaggacacagagccacatcacaagatactaggtggagattttctaatacaaatgcatgcatgatggtacatggactgtctgcgggatctgaggagtctgtaattgcaggcaaaacagcaaatgcctaatacatgattttttttcaaatgttagcatatattaggatcatctgagagaggtttttgaaaatatggactcttgggcatcacctccaaagattctgattcatcaggtttgggatggggcctaggattctgcattttacaaagttaacagatgattctgatgtatagaaacatatgaatgccctagtaatttctccagagatccaatcccatgtcttgattttatatcaatgaccaagtaatctctctggaaaggccaacctacattttcccactaatttttttgggggggaaggagagttcaaacctacagaaaagttccaagaaaagtatattgaactccccatataccctttacctgatttttttttgtgtttttttttttttttgagatggagtcttactgtgtcgcccaggctggagtgcagtggcgcaatctcggctcactgcaaactcctcttcccgggttcacgccattctcctgcctcagcctcccgagtagctgggactacaggcacccgccacaatgcccggctaattttttagtagttttggtagagatggggtttcaccgtgttagccaggatggcctccatctcctgacttcatgatccacccgccttggcctcccaaagtgccgggattacaggcgtgagccaccaagcccagctctttacctgatttttaacactttgcctcatttatttttatctcttgtatattagttaccaatttattttataatattgttaacttattataattatctttgctgaaccatctgagggcaagttacagatatcatatcctttcatccccaaatacttcagcatttatctcttaagaacaagaacttctcttacataaccacagtacaatgatctcacccaggaaattagtattgatacaatactattatataatatactggcaatattcaaactttgccaggtgtcccaataatgtactctatggcagttttttccaggatgcagtccaggattagacatggcattttagttgaaatgtctttttgcactaatggtttttaaagccattgatgttctcccagaaaaatttttcttcaagaacatatttcctaataaacaaatcatatttcttttctcttctgttcttactgcttgcaaagagccagtgatccaaagtgggcctgaagcaacagcaggcttacccaggcctgattcttcacaagctaaggcctgggcaaaggaccctctctcagccctgggtttgccttgtgagctgatttcctgaaggcaaaccacatgactgctggtgtgtccccttgctgttcagtcaagtgggtggccacctggctttctccttgtcccaaagtacttcgttggatatgtaaagcgaccaaatgttacttcactgtagtttgaatcttacccagaaagagtgactggtaaaggacatgccactttgcacccttcccagctctctccaaaggcagctggctgaatgcacacttctgagggtgatgttttttccagcactcagggatatacccagtgtgagatcagaatcagcagctgtattcattctgcctcagccagtgccatctgaaacaaacatcaagtggtcaaaaaatgagatggtgaccatgtataatacacaagacttattagaattcaactctggtatccgcctgctgcctctgactctacaatgggagcaggaaagcaaagctcataccaggacagctgaaaggtgtggtctgaggatttcatggtgaacagatagaacacactgtgggggaaaaaaaacatattttatgcaagcatctttctggcttgtcttgaatgaagctaaatttaaagagaaagtgccacagatttctttaaatggttaggtttttgttttctttgttttattttgctagtatttacttaagggtaatatgtgttttctgtaatgagtgaatttatttttaattaaaaacttatttgcaaaggtcaagagatttcactacaagtcaccattcaggattttttttttcctttccttaagtagaaggtagcaaggggaaagctgtattggagaaaaggttcaggggcatggcctcctggagaatgttgggagttgagctgatgggaggagattgcttctttttattcagacaatctagttctgttcttcttatgcctactattgttttccttgccatctttgagaccttgatgatcgacactgcagacacagcagagaatcctagtacagactgaagcttttcgtataaagtgagcatgctcactgtgattctggacagttcctacatagtatctctgtaggataacatatgtcttggttttctcagggcaagctcagtttatctctgttatcccagtataactattaaaatgtccccatttcattttcaaaaatgtcctggttggataagaacttaaagtattttgttaagactctgggaaactgaaggtattttctccctgtccatgagccagtggagttgttgagtgatttgtgctggtgcataccagtctctagcctagtggatggctcacccccgcttctcccctaccttgtgctatggaggatccatccctaactcttgcattccagaggttctgattgcctcacttcttcctgtcttctgcttcacatttcttacctttctcagtaacgagtttgctgagacttgcatcagcctaggtatgttgtgcaagtaaagcctctggactgcattcactcctttcacctccagccaagagacatcaggaatgaaattttctgctttactaaagtgaagcagcccattctttaccagccaaatgccttcctcggtgggtaaatggtattagttgaagcagttattacatagttttatgcctcagatcctgtatttataaatctgaaagacgactaatagctttaaagtattttgagaatctcaaagctcagaagattataaataacaaaagatatattttttcgtatctaaaatggtagcacaaatactgcggttgcttacttaatagatagcgtgtggtccctgagccattgcagctgatgggttttttccagtgctctatttatagagctaggtcagaaatatcacttccgttggaacctgacctatagaccattgtcaattttagagacccaaggaagtagaatgcaccctaaatacagctggttcacagattcagttagtgaaccacaagccctcaaggaaattaattttgctggaagataaatgtctgagcctatcccagtctcttttctttgacacctttgtcctgtggtctcacagagcttgtaggtcatcttgaatctttattctaaaaataacctattataggcagtttcccagctttaataacttactcatcctcttcgccttttgttgctaaaattctgcattgaatggaacaagaactgatgacctgccaagagaggtaaccaagattctcagtcccttccccagttcaaatggatggtccaataaagaaccatgctcagcaagtgccaggggcctagttttaaacaggagaagctgaattgaatggatgatgaattgaatgaatgaattgaatccttctgatccctagtctcgcactcagactcccgtctttaagctttgttactatgaagttgtgtttgctgggacttggccactggtcagcacaggtttacccatcataaagtcttactaagtagggtagactaagaaaatctctagtctggagagaaatctgctatcagcaaaagaacccatgcctgtgctcttttcaagcacaaacgggtgctgggtagggcacagcgattcaaagacagcgcatggagtggtgcattctcaaacttcctggaacaagtgaggttctcgatgaggaactcattcatatcatcaaaataccaaagactcaaagttttttaataaggcaggaactattgaggtcatttaccccttcttgtcatggatgaggaaactgaggctcagtgaggttaggtaactgctcattaccaaggcctactctgaggttctttgttacactactctccttctcccacctggtctcatcaaaagcccagacggagtcagaaatagaactgcagggtcctgctttctagccagcagctggccacaggctatcatgcattacatggaatgtgcttcaggacgtgaggacaagagatatgaacgagaatgcagttccagtggtaacataccatcttcttccctggatttatttcaatcctgaaaacatttgtaggtattgttattcctttatttttttaaatttcctctttctactctaaataaatgggctttcatctgcagggactggagggaccaaatatccagaatatccagtccgctaaggccatgaacttttccttcccctctgttcctattttgggagtcattgctttgtttttttgacttttttttttttaacatggaaaagcattcttttaaagttgacccttttgctgcagggcaaatgcttttctgttatgcactagagattcagtttgatctcctagaaatgcttagcacaggagtcataaattgaaatgttttcagagaaggagctttctcattaagagctttccaacaggcctcttctaaatactgacacgggttggtaccagaagcccatcacctttttggaaatcaaggctacatagcaacctggttatcctcctccagtctgattgcacgagggctacaccccatgtatacagagcagagagacagctccttgccttgtgagaaattcgtcttcataaccaactcccacaccaaatgagtaaggaattggatccaaaagatagtcatgaaagatattccagaatccaaatcatgtgttttaaccactttgcaactaagatttactatcttgcctcattgttaacagaataaaaaatgcaggagataatgattaaacttctttcctccctagaatttcatcttcagtgtttgatcatcattgttcctgtcacttatacatatcaagtatcttcatctaagggtcatcaagaacctctggttgcctggaggccagaattattattcacattttacagatgggttagcaatcacagaaagagaacatgctttgacttacctaaaagagtctctgagagagtggagaatgaatgttcccacagtcttttacagagccctgacttcagtgtgagtagattagatttgctctatgtagcttacacagagacttctacaggctcaatcccataacaatgaaaatcctcaaaaatgaaaatattttcaaagctcagttcacgtatttgatttttgtatttgcattggaattaaccaaattccagacaatgaagttatactgctttggcaggtctaaatatcacaatcatcaaaaaggagagagagggagtgagcacctcaatttttagaacttcctcttaaagtgaacatagagaaggttcacttatctgtttcctaaccaattaggtcatcttgcaggaaatcaccttttcttaaaagccagtaggcagattcctcctactttaaatttcccatcaacagcattaacaatcatttatgccagccctctcacaggaatgcttgaaagtcaaaagacataagagaccactaagttttctagtttaaaataaggtcacaactttatagtaacttacagtttccctacctccctctctcaagtgattctatcactgcaatcacccttcaattgctttcctatacttgaggccctattaagtaaactatctttccaatccttgccagatttttaattctacaaccagagaggatcagttccaggccacctgacttgcgtgaatccagctgctgggccagttgagtgagattaagtaacttgctgagccagagtatgtgctgtctttctggaaaccccttgccctgggttatcactgtacatcagaacagaggaagccgagtatggagcctgagtgacatgcagagctcagatgagtgataagatcctcatgacacacttccatcggtatcctcccagagatgggcctttgagctctcaagactcttgtgggctggcagaataacacgttatttgacatgagagacatgataagcccagagaaagctaattggagtagtggttaaaactcagttggcctggtttcgaaccctggctgtgtcagtaactaaccatgtgaactggagtgacttagtttctcatagcctcattctgtcaatagggatgttaatattactcacttcataggattgttgtaaggatcaaaagagatgtagctaagatatgaagctcagcaagatttaagcttacatagtgcctagcacatagtaccttaaaaaatattgcctttccaccttgggcaacatagtgagaccctgtctctacagaaaaataaaaataagttagccaatcattgtggcatgtgcctgtggtcccagctactcggtaggctgaggtgggaggattgcttgagcatgggaattcaaggttacagtgggctatgatcatactactgcattccagcctgggcaataagggagaccctttctctaaaaaaaaatttaaaaattgcctttcattatcattaactttcaaggccttgctgttattacttttatggtggattaatatttgtaagaactcctaaaaatacaaatggatatttttaaagtctatagtagactacagtcaagcttgctcactcagggtttcctttggaaacttttctgtggtcatctgtactcatggcccttacttaagacttgggtttacctgtccagaaaacaaccaaatacatgggtacttttttatactattcttattgttttagcgacgcggagtcctttaaatagttgctcctggcccaaatgtggctccaatctctgaagacatcctgtgtcttcctttagacccgagaaactcctacagtttatcaccaaaaaaaaaaaaaaaaaaaaaaagtttgagtgcttaactagcaactcctaattattcacatgtagctttttcttgacaaactttagagcttagcctcccttgatcccatcacttagcaggcatctaagcaactaatttctagagtttacttgaaaaatgtaaacctgttaattttagctaagcaagatagaattaaggatgtaaatctgctgccaaaacaaggatacaatatgattcaaaatttagtggaaataactttttaattagtcatttagtcagtattataagcatcctctgtgtctcagaccttgtgttaagtaactcaggcatgctgacatacatcaggcgtgggtttggcctctttataatatacagtcatatgtcacttaacaatgaagatgggttctgagaaatgcatcattaagcaattttgacattgtgtgaacatcatagaatgtatttacacaaactgagatggtatagcctactacaaacccaggctgtatagtatagcccattgctcctagtctacagacccattcagcatgttgctgtactgaatactataggcaattggaacacagtagtaagtatttgtgtatctaaacacatctaaacagaaaaggtacaataaaaatggtaaaaggattaaaaatggtacacctgtgtagggcacttactatgactgcagcttataggactggagttgctctgggtccgttggtgagtgcacctactgatgaatgaacatgaaggcctaggacactgctgtacactactgtagacttcataaaccccgtatccttaggctatattcattgatagagacatttttctttcttcaataataaattaacctttgattactatcacttttttacttcataaatgttttaattttttaactttttgatcttgtaataacataactgaaaatacaaacattgcatagctgttcaaaaacattttctttatatccttattctataatcttatttctgttttttagatttttttacctttttaaacttttttgttaaaaattaagacacagacacacacattagcctaggactacacaggatcaatatcatcaatatcactgtcttccacccgcccatcttgtctcactggaaagtcttcaggggcaataacacgcatgaagctgtcatctcctatgataacaatgccttcttctgcaatacctcctgaaggatcttcctgaggctgttttacagttaacttcttaaaataagtagaatatactctaaaatcatgattaaaaaaagtatagtaagtacatagtacataaaagtatagtaaatacattaaaagtatagtaaatacataaactacataaaagtatatatagtaaatacatcaatatagatatgataaaaagtatagtaaatacataaaagtgtagtaactacataactggtttttgtatttactaaactggttattataagtagaatagactctaaaatattgataaaaagtatagtaaatacatataataagatcaagtattatgtactatgcataactgtatgtgctatacttttatacagctgagattatagtaggtttatttaccctgcatcaccacaagcatgtgagtatgcattgtgctatgatgttaccattgctgtgacatcactaggtgataggaatttattagctgcatgataatgttatggggccactgtcatatttgcagtctgtcatttgctgaaacatcattgtgcagagcacgactctgtattaaaggtgataagaaaagcacacaaataatataccacaggtagaaaatgattgtaatatgagacagtaaaataaagtattatagaagtttacaggaggaagacattatttctgtgaagattagagaaattggcacataggaagtagcattgaaggcagagtagatttgggacatgtgaacataggggagttccagatgagggagggacatgggaaataagtgattaagtaggaacacagttgtgggaaatggagcagggggaagaagtctggaagggcaggtgggcgcagggtagaaagtccttgaatgccagtgttaggaatttagaattctctgaagacacttgggagccactgaaaggttttgagcctgctggttgtaaatgggagggtggtgtgcttaggtgtgtgcttggaggaggttaatcaggtagtaaaacagagggtggctttagtagggagaaagccacagcagcacagacaacaggcaactaaagcagtcacaccaggtgaaagctaatgtgggtctaaggttgatttaggaggaatggagagtcaggaatggatctaagggtgaggtaggagaaatgaatggatggatataggtaggattttacagttaaatcagtaagacctctcaatttattgcaagtgagaagcatgagagaaggaaacattttgaaaatggagctgaggttttaaaccagattaactggagggtcaaaggaaggaacagagatggagtagatttatatgggaaaatatgagcttgctttgatgatactgaatttgcagtgctaaaatttatgatgtagacttgcagttcttgtggttaaaagtggaagacaagtgttgagacaagccaaaggttgcgacaaaggcgtagaaaccatccaccttgtcaaatgggctctcatccttttcaaagtggagccatgccatgtagagcagacactgcaagcttgatgggaatgaggcatatctggctcaaaagcatgtttatttgtgtgtttttaaaagtgtaaatattgaaccaacattttaaaatcaggaaattatacttaaaaagcattgatttctggcttccgttttaaaaatcaaaattgcgctttaaagttagcgcaattaaaaaatcatatcactatgatttttaaaaatcaaaagatgtgattataaaagttttttacaattttaaaataaataaataagatgtgactaactatgaactcacattgccacatgacaacagctagagctgaacagagactgcccccttgagatcctggatgaattctcgaactcaccacagtactcaccacttcccctcatctcctaaggctttaattgaaagtcagttactaaatctatagagaaaaaaaaaataggttaatggttgccaagagctggaggtgggcagggaatgaggtgttggggactgatggccagtgggtgtgggatttctttttaggggtttgaaatgttctaaagttaattgtggtaatggctgaacatctctgtgaatatagaaaaagctgctgaactgtacacttgaaattggaggaggtatgatagcaaattatctcaatagagctgtttttctaaaatgcaaatatagttgctattgcccttgcagtgttgattttcttatagtagaaaatatttttctataagtctatttctatcaaaaaggggaaaatgaaaagttagactgagagggttgtgaatttcaagagaaatggtaaagactatatctcttagtgggggtgaagaagttctacatgttaatatgcaagcacttggcctctttactaatgtacattattttcctggatactgaaagcatctggtattagacaagaaaaaatgtggtcatgccccactccctaaggtccacccacaactaagaagaaagagaaaacaaaggcagaaaaaggaaaggagtaatcaacatggtaaaaggagaagcagaagaggccagtagattggatgccaaggaagggggaagctttatcaactgctgacaagaggtcaaggaggatgaggccagggaagtcaggaggtcatgggagaccatccagtgaggaggctgagagaggtgaagccagagagagatgcagaggcagctgacaaagtgctcagagtgcattgtttaggagatagtatttaatctcaggcatgaaggactactgaaggcattttaagtaggggaatgatgtgatcagatcggaacaatctagattatttgttttcacattaatttgtgcatattttgaattgtgtgcataatgaactgaggttaccccaaattttattctttcttacactaaattctctttcaatctgatatccccaggcttgttgagaccttggttattgatttccatctcattcattcctgttcctgcttgaaccaggaaatagatatatatggttggtgttatctgacccaggggttctcaacttcagcactgctgtattttgggctggataattctttgttgtaggatgctgtcctatgcattataaaatggttagcagcatcaccagcctctaccctctagatgccagtaacactgcgagttagacattgccaataaaatcaccctccagccaagaaccactgaactacatttgtctgttgcagcatttgggcccaggtgcttaaggccatgtgcagttagtagaccaccctgaaaggtgtctgccctggaaaaaaaaagaccaattcctactccacactgaggcgtacaaatcagatgatgtagtaaggggacaacggatgacacattcaaggcctcattttgttttagctaattcagtggacttcaacctctatgtagtctcctcatagaaaaaagatcgcatctggaggcaacaaggcacactaaatgtccaactgtgccctcctaaggttaggattcctgtcatggcctagggccaaagttggttcagaggaggccttgggcacagggcacaggggttcagaggaggcctcgggcacagggcacaggggttcagaggaggccttgggatgtgctggacatgatagtgggagctggcttctatgcagcaggacttgttggcttgccttcaagggggaaggagcaggtagggaacagaaagggttttctcatggtgatatcaagaagggtcagtaaagctttggagatgtaagatgcaatttggaggaggctaggaactcagatagagtttacttcagaccctcttccttataggaaagtcttagaaggtaaaggaatgtttctcttggaatagggatgtctaaaacagcttacctatgaaatgctgagatcttctagattcctttttttgcgttgtgtatacgggggggtgggaggaccagggaattttacatgtatatgccaccatttctatattgatagggaaaattgagttaagactcttgtctagctaaaaatgtctaacaactctattaaactaagactatttcataactggttcttattctgtggagtagcattatgccttagatattgaatggctagatttactagtagcaatggctctgagctatcttgcaatgcaacctctttttgatatataactctgttattatttggcccagtggtggtcactttcaccaaggctgaaggaaacccctgctggtttttagtctcatattccttaacccctctcctacttcactgattcctcaagttctgtggtaatgaactgagcctccaagtactctctggactactggcaatgagtaatgtctggacttcatgtgaaatgccatctcaagaaagggcatctgaaagcgtgcttttaccatttcatttcaggcacttctggatccagctgtgtgatagccgcactaggaaatacctggagtcacagtgtgaatacccggctgatcctccagtaccttgattcagagagaagacaggtgggtgctttgacagtattctctgactatgaaggtcggggaatgagatataccaagcaatctgagcgtcttctgaaaatgctggccgcattgtctgtcctgagccagcagcagctattagggcctaaagaaaccagcatttctgcttgtcccaacaacagttataataaagtggggagacaagtcacacacaggaaaaaacataagaattgatcccacagagtcagcatttctctgatatttgtaagtgaccaaggaccacacctctaagggtatccaattctctatctctaaatgatcatttcacttagattgtatttgttgaggactaatttgtatatgaattaaataatgatgatgctttttcttgaagtatgtgtactttgaaaatcttaggccagcagatgctgccaagtgaataaattattccccagatactaggtacttttacattaacgcatacacctgtagtgtaaagtactgaatgatgctagaaagacctccaaatggttggtcactttctcagagttccctatttgtggtttctatcctggccaaaactgaaaatccttcccttacatccagaaagtttactttctacctccttttaagtcttctgtcttcattcttcattccaaagaaaaggacaccactgtctgacctctttggtaaagctttggtaaaatgtttcataataaaaaaattctttttcctaatgactaacctcaactttatcctgctgtgtgaccagattcaatctagtttctcctaaaagcaggaggaagaagacgggtgattattttgattttttggataggacagaattcagaagccagatttgcccaccttgctaaatatatatcaaatccaggccatttagatacagaggcatgaaatgtcacactggtgatcctttctggagaaaatggcagaaaagctgttgttgcctttacctgcattaggtaaactggctctttttcaaggaagcaggaatcatcaaaaacaggcgtgagctattgcctgttctagacataattttccaaaccagagaattcttcttggtttgctttggactatgtaaataatattccagcttggtgatcacgtcagccatgtcctgagaagatagagctgcttgtttctattcagggaaacattcttgagttttcaggccctggactactcattacctcaatggcaccttttccctgaagagtctggtatcctaggttctgaagctgttatttctctttttagtggaacacattccaaaatattcctggggaatctaatgacctttggtagtaaatcatgttaaatagctgtgttgcagctttcagggatatcattaaggattgttgaacacacctatgtaaactttatcagaggaagcaaaattccttgtgaatcaatgttgagtcattcgttttcatggatccttgatcccactccttgaaaacttatagtttatctctgtttcaggttttagattttagaagccattcttactgttacacacggaatttatgatttcatctattatatatggtatcatgggttcaaggctcccaaatcctagttttactaattccagttagaatttataagtgaataaagaaattagagccatatttttacttttcttttgttttaataaattaaccagtcagtgtcaacaggaagtagctggtaggacaaatgctattttttatgtctctttggtgactggaggatgttggtggctcttggcttttggctgataaggtcaaatgcaggccagtggtcataaggagaaccaggagcaaagtgtagatggatcagtgacagttcatcaactcccatcccattagatgggtcagtcatgttatcttaatttacaaaagacaacttgttactatcattactaatcaataagaagcagacttaaatgccttggaatcatgttttcaaacaataattagaaattaatgtaaaatatggccagtgttaaaatggccaacccaggcaaagaacatacatttaattaatctatagaaatatgcatgcctttggggaccagttgttaaatttgtgacctaataactagaataaagtttgatatagaaaaaacatgtctctgtctagtgaccttatcttgccttagcagagggtgtgcttagtgattccctgagtctttcctgtggtcttattttatgaaaaaccatagaagccatacgaagcgaaggcttttctgggatatgtgcataaaacagtactttaaagctaacctttaaggtaattgcaccaagtagtactttcttataacaccatttagtagcagaacgtgcctagataattctagggtagtaagacctctgggacaccagccacttagagaagataacaggtatagttttttgttttttagggttttttttccaatgcccaagcagaggccactacacccagggatcaaggttatgggatgaggattatattttatcccgtttctatgacattgagctctacaccagggctcttgaatgtgaggcttagtttcagatcacaggcctggaagggggtcaggtcaagctgagcagaccttcaagccgattaacccaagagctgaattgtgttgtctgagggaaggagtcctccctggctgattattttctttacaccctggaaactttgcaaaattttataaccaagaaagaaatcttatcagggccacaagccaagttaattttcttgcttattctgcttcagtgtttgcaaaaactctcttaagaagctggaaaacattttcttttggactaatttagctttttttccatttgacttttatttactcttttcctactctgcttcaatcctgccccaccctttttgcaacatttttattcttaccaaagacatgttcttagagtagaattaaaatggcctctcctactttttgtagttgttgttgttttaaaccatcgaaaatatgttttggtctaccccgtgcatggtatggggatataaagaagtagaagactagttcctgccctcgaggtccaaacaaactaatactgaggtactgttacaaggcagtgtttgatttgttgtctaatgagtggttaaaacagtaactgctttgactctaaaggaaggtaacatcatcagaggcatattaagtcttttcaggaaaaggtgagacttgagtattaccttaaaatcagtgattctcggcaggacgcagtggctcatgcctgtaatcccagcacttttgggaggccaaggtgggtgaatcgcctcaggtcaggagttcgagaccagcctgaccaacatggtaaaaccccatctctactaaaaaaaaaaaaaaaaaaaaaaaatagccaggcgtggtggcgcatacctgtagtcccagctacccaggaggctgaggtaggagaatcacttgaacccaggaggcaaaggttacagtgagtagagagtgtgccactgcactcaagcctgggtgacagagcaagactctgtctcaaaaaaaaaaaaaaaaaaaaaaaaaaaatcagtggttctcaaacctggctgcacttaaggctcatcacaggagcatttataccaatgccaatgccccaccctgaccagttaaatcaaaatctctgccagtagagctgagcatcagtgtttattttatttgtaaagctcccccatgtgattctaatgtgcagccaaggttgggaacctctgccttaaataatagataagattcaggtagtcagaaaggggaggtgctggggtagagtgagctgcagctgaagaacaaacaggaggataggctgcatcgtcagagggcacaggctgggttttgccttgtaacaagagcagagggtttgggcactcattcatttgacaaacctttatttaatcacctcttctctgctagtcactgtgtaactagttgcgctggagattcaagaaaacaaaaacaggtaagagatggttgataccctctggttgttcacagtctacttgaggaaacagataagcatgtaaaccggacttgcagtaagagcacagtgaatgaagtaagtctagaggagatggggggtcctggcactaaggaaggttctctagcgatgaatgaggcagagcatgaggcagagaggagtggccgaggccttcacttgggaaactcttgctattacaaagtgccttctagcgagggctggaaaagctagagtaaggctggttatacttgaaagaaggaagaaaaactcgataaaaatattcacatttatacaatttctcctcaaatcctcatgaagtctggtcttacaaactacaaatgggattatataaattttcaagtgccctagaaagagtaatgaagtaaatgaatcctgactaagcctcacacccgcttgatgaaataaatattatgactctcttatttcaacaaattggaaagaggtctttttttcatataggaggtttatttaaatgaactttctaataatattttcatttctatttaggaggcaccctgaaattatgggatgcttgaggggcgagcctgaagtacctagtaaattgttgacagaaccaatatcactcaagctgctgatccacacttgaatctgtaggcttttctcaaagtcctagttttgcatcttagaagtattgcatcttggaagtatttctttgcatcttggaaatattcaatgtttcctttctggtgataggattctcagtgtccattttatattttcgaagactcaaatatcatcactgtgaagacttccctgacaccagctgtgatccgtccctcttccctctggcccacacttgcacctggcccttgtctctattcttagacttctgagccctgaattatgagccccttgaggtctataactgaatttatctgcataccctcaaatgtaagggcagtgcttgacacttacacagtagatacatttattttgaaagagagagagaaagcaagaaaaagaaatgcactccctgtagctactcgtgaacccagtctgaaggacgaaggactgcttatttagaatcattcttccgcatagaaattgagttttacaatttaaccattcctttaaaatgttagtaattgtcggtttaaaatgttagcatcaaaccttgacaattataagcagatacttaaatagaaatactgtaagaatactgaagataggaatactttttgcagaaccagcctgctgtagtctatgggaggatgggagtcaggcttcccctggaatcttatgggatagcctttgtgtaagcaagccagaaccctaaacacagacccaggctgagggagagaagggttctgcagctgctttcagggaccagatagcatgaggagggtaggaaatctttgttgctatcttctacaagtcttaacttctcctctctgtggttggacaggcttaatgaaagactgaataaccaaagaaaagttgataaattttttttcccagataagctaaagggtagatgtggggcagcatgtcaggcttatattcatattcacccaaagaaagatatcgaggatgatgttttacctgatgtaagtcatagttgtatatctccctactcctagattcctccaaagaaggattcaggcttagttgccctaactcaaaaggaacctctctcccttggtggcatggttccaggtcgctgtacttgttctcttgttttctactccagctcacctgctgtttttaggcaaggaggattatgtgagtatgtgtgtgtgtgactagatcccgccagaggagaagttcggctgtgctgcaggggtagatgaaaactctttttaagcataaatacctatagaaatagcaaagggaacataaaatccagtcaagtacattatcttgggtataaatgtctcctccctttccagagctgctcaagtgtgaaatccaagcccctgcccacactcttgcaacagaagtgctctaacaggtattaagtggattggggaaataaataaaaggggaacccagaatggtggcattaaaagaatcccttttttcaggcaatgtattggcactaggcactaggcaaatgtattaaaatctgaggaaatcctacggaaagtgtgtggtcccagtgaatgaatacaatgagctgctactcacagtgcagggactgagaaagggcaacacagacacccaagtggtcatctcccatttccatctccacatttgagataagaatacctgtatctttcctaccacccacaaacaaacaagcaaaccatgggactccctttgaaaaaagtcaatatatccaagaaatcactatttctgaatgagctcaagtagagagaactttctcttaagagggttccgctggaaattgccagctgaaaatacacaggtacaatgactcccacgctggagatgaagggtcccctttcccatgctttgaccacgatagaccgtgtacctttgctaaggtggagagtcagtctttcctaggagattttgagccaaataaaataaaaacaaaacacgggtgagagaaccaccatgatgttttaaaaggcgaaagatttacgcgatttgaagagaaaccagagtataccaccatgatgttttaaacatcattttttatcaaatatagttacaaaattaaccgttaccaccatttcaaaaaggtaaaggcactttaacaccaaaaagtagaaaggacatatctagaaggaagaatacatgtattgatatatttaaactgaaaacatttctttttatggcagacttagcacatgtccttacttctctctttgaggcgcatgagctctgaccatcacaggacaaatgactggtcctcttacagagcatgtaggtggtttaccctttaatgagccactcatttcactagcattttatcacctctgttgttctcctccagctctgacttattttatttttatatgctgtttgtctggtaccaattccccttgtgcagtgaccctgcctgctctaacttgctaagtaaactaggccaaatacctgggcaggagatttctagagaaatctgagcagttgcaggaagtagaagagacacagggctttggaaccaaattgaagaccctgttgtctggcttgggaagaaaaatattttcagttgggaaacaacatcggaaacagctatgagatctcttggacaaggcgctgccctgaaagtcaaggaccttgaaatttatttggctcatttgagaatgaagattggacaggatgttttattttagccttagctggttagctgtgagtgagaagaaaatgggcaacctcattggctagggaaagtaaaaaggaaagaagggttcaatacctgcctaaactatgaactgatttacaaatgaatcagcactttcactagaacaaaaagcatttagaatatgacagtgcccatctgagatacagtctagagatcatcttctccagtgagtctcaagtacagtaaatttaaaaatcccaggtgtttgtgaacaatgaagatcccaggccccatccccagtgctgtattcagtgagggcagtgccaagcctaggatctgcagtttttagcaagcactttgggtgattcttacatgggtgttcttcagtttcatactccattctagcccctttgttttacagatggcggtaagcaattgatattaactaatttattcagggtcacacaactagtaggtagcagaaatggaacagaaattcaattctttcaattctgaatgtgttgctattttcactttactctggtgacttttagtagatagattctaggcaaaaaagtccccaaacccaatcaaattattgggtttgcaggtgatatatttatatctctcatgactttcagtggtttataaagagctcctaaagaactgtgcaggaaaaaaaaaaaatttaagcaccatctcaccccacattgcaatcaattacaagataaaagtcatcttttaaattcttgaacccaaatctgaatatgtggctttttccaagttaaacttcacagtgagcatgaactccccagtcaagtgactttccttatagacaacatcctgccacagggctggctatgctaccgctctcctacagacagccatttgtgctcatggacatctcccttaaatcctggctccctagtccccatcttcataggctaaaggtgtgtaatgggagaaccaactttgtctgatcttgcgagcatgggagctttttggttatcacatttttgagtcagtcaatctttattttgaaaaagcagggcaggacagagggaggaagagaggctgagggcaggcagcagcctgtgtgggaacccatttcctgccatcctagggtcccatagttgataatggacaacatccttgcttggttcttgtgcaccaggtgatactaatttaaattcctctttattttctagtgatggaaaggagttagcctttactgagtacctatgagtttgcagggatcatttttgaccctttgtgttttatttccatcaattcctccaataacccttcagcatagatctgatcatctctatttttacaaatagaagaacttagctgataacataaataactcatattcagtgatagcatcaatatttgaaaccaagtttgtatagttccagaccctcagttctttttcctgtaccatgtgctctgagatgtaagatggtggttgtgttaccggaaagggatctcaatccagaccccaagagagggttcttggacctcatgcaagaaagaatttggggtgagtccataaagagtctactttgtgccagagttcataaagtgaaagcaagtttattaagaaagtaaaggaataaagtatggctactccacagcacagcaacccgaagagctgctggctcgctatttttatgggttttttttttattatatgctaaacaagaagtggattattcatgagttttcctgtaaagaggtgggcaattcccagaactgggcgttcctcccctttttagaccatatacggtaacttcctgatgttgtcatgccatttgtaaactgtcatgatgttggtgggagtgtcttttaacatgctaatgcattataattagcgtataatgagcagtgaggacaccagagatcatgttcatcatcatcttggattggtgggctttggccaacttctttactgcaacctgctttatcagcaatgtctttgtgacctgtatcttttctgacctcctatctcatgctgtgacttggaatgcctaacctcctgggaatacagaccaataggtctcagccttatttttacagcttgttttcaagacagagtcactctggttcaaatgcctctgacagttatcactgttttaatttaggaataaaatgaggtgctagaaaaggaggccttgacttggtgatgattctgctgggttgcaatgaatggtccttattatcttcctctctgactttcctgaacgatgattagacctagaatgtcatttggtttacctgtaaaacttagtgagttatgtattaggatagcccctcccaccctggggcaggaacatgaaagcagtgagatgaggagcttcttcttgctttttttctcttgctctaggcattatttgactttgaaatactcctggcattttcctgtgattctgaagtgccccttcctctgcttgtgtgtgtgagatttgaaagcttatcacacatgtggctaaagcaggtccagcttggagcattcgtcttctggctgctgttgctgggggagtatccctgctgtgagatgctacgccgcctgagcctgtggcctctgcttatctcctggggtggctgtggctgtgaggtgcacagcatggtacaatgctagttttcatttcaagtcctttcttgatgtcactgatgggtgcaatgagtggagtggggggacctcaggcccttccaaattctttcttttttgttgttgttatttagtttttatttcataatcataaacttaactctgcaatccatctaggcatgggagggaacaaggaaaacatggaacccaaagggaactgcagcgagagcacaaagattctaggatactgcgagcaaacggggtggaggggtgctctcctgagctacggaaggaatggtctggtggttaagataaaacacaagtcaaacttattcgagttgtccacagtcagcaatggtgatcttcttgctggtcttgccattcctggacccaaagcactccatgcctccacaatattcgtgccttctttcactttgccaaagagcacgtgcttgccatccaaccactcagtcttggcagtgcagatgaaaaactgggaaccatttgtgttgggtccagcatttgccatggacaagatgccaggacctgtatgctttaggatgaagttctcattttcaaatttctccgtgtagatggacttgccaccagtgccattatggtgacttcacagtcaccaccctgacacataaaccctggaataattctgtgaaagcaggaaaccttataaccaaatcctttctctccagtgctcggagcacgaaaattttctgctgtctttgggatcttgtctgcaaacagctcgaaggagacatggcccaagggctcgctgtcgacggcaaattcaaagaacatggtggggttgaccatggctaatagtacacggttttcctcagcggtggcgtccgcagagcacccaaattcttaatagcttataaaattaggggtagaggaggttgggtgcggcagctcacgcctgtaatcccagcactttgggaggccgaggcaggtggatcacgaggtcaggagtttgagcccagcctggccaaggtggtgaaaccccgtctctactaaaaatacaaaaattagccaagtatggtggcagacacctgtaatcccagctacttgggaggctgaggcagggaattgcttgaacccgggaggtggaagttgcagtgagccaagatcgcaccactgcactccagcctgggtgacatggcgagtctccatctcaaaaaaaaaaaaaaaaaaattaggggtagaggaatgggaagcagacaaaaggtttacattgtggaggtttgaggagaaatgaatcaaataagtctctagcattctgtttgactttatgttagtctgattatgttaccataacattttatgatatgctacacattatctgatgggtgattaattttcaaatgtaatacaaatcattgagctttcctgatttctgccgctgtaaataatttggaattttcagttactgcaaagttgacatagtcactccttccttcctgtaaccttcaccttaccttgttgtcccctccctgcccccaagcttccctggatttttaaatcagccagtggctcctggcaactgtcttagaatgcttgaagccgaggttttttttcactgagggtctctttctagaagtttctcttcttaccttggcagagcttaagagttcttgcatctcagacaaagactgtgtgtgcttgactgttggacattcattttattgttacaaagggaccatgattttgagaacacctttggagagcccagctcccatggttgtatcccactgcccattttctgaatcctcaactcagaattggcaatgaaagagtgaactgggattatgatctgtgattctctaacagaattctctgagagtcaaactccagaaagaggctcatctttacaaaccttaaagaattagagctaaggcacctggtatgtctgggagggattgaaaacaatccccccaaagccccagcggccctggctctctggttgctatgctgagttgattcatccatttattgagagtctactttgtaccagttattctgctaagtgctttgtgggcattttctttttcaagcctcacgaaaactctgaggtgggtattactagatatactttacaattggagcacattgaacgttatggagtttgaaaattttgctctaaatcacatggttctaaggggcaaagccagaactttccttttcctttgcctctccctcccccatcacatacatacactccctcttttatatccctaggttcttaacctttattctacaatgagtaccatgttcatgtaagattattcatgcatgttacttggaattaattgcagaacaattttttttcaacccctgtggtgtggtcaccttcaatacttatacttggtggaatactcccttcaaagagtggaatgatccattgctttgagagagctttttcgatctctgttaagtaatgattagttatttccttataactgtgtggctctgtgtggcaacagaacacttttgaggaagaataaactctacaggacatggtcttctgaatctcaccattcaatcaggggaagttctggttcttcttctctgttccaagtactagcctttccagccagcaccttttctgtgctctgggtttggcttcagtgttctgtcatttatcgtcaaagaagaaagagaagtctctgtggcatcttgcccacagtggggatggacctgtgctcacctctctcctccagtaagaacctaagggcccaggaggtatagtggtgcctcccatagatacttcccttccctcatggatgatacagaatgacatataaatgatatctatttcttcatttttttccttgcaaagtcacttttccacatactaatccatttcacggtttatctttaaatcctttctcagttgtctattcttctctgaaagtattatcccagcatcctaatgaagattccatcaatgtctagtaaaatgacaaaactctctagcagtactatgttttgtttttggttttggtttgtttgttttgtttttactggtgcctctttataataaaaagatttggtggctccagcacagcttctaacccttcaacagctgtgcctataccaagctgttctctcttatttgtaactatttatgcagtgttctctccagatatactgttccatactgacctgcattggaatgttaggctcttctttgtgactgatctctatttcctacttgtgactccgttctgacactacctttgcctttttataccatcctccctacttttctcatgtagatttgctaaaagatccccatgactccaagatccctgtaactggctctgctgagtctgtcagcatttgatccctttgacttgaggaggccagtccttctcaggaaccacctgtaatctcttttttttccttagagacagggtcttgctgtgtcgcccaggctggaatacagtggcatgatcataactcactgcagccttgaactcctgagctcaagcaattcttccaccttagcctcccaagtagcttggactacaggcacataccaccacacctggctatttttaaaattttatgtagagatggggtcttgctgtgttgcccaggctgggcttgaattcctggtttcatgtaatcctcctgcctcagtcatccaaagggctgagattacaggcatgagccacagcacctggcctatacctataatctcagtttgaattaaacagtagtctctaggacccctctgtgtaggggatcttgttacatgttgtggttgttcaaaggccaagtattttcaaagaaaacccactgagataagttggatgagtgactgccatagcagtcaatatgacacctttgtcactttttttcatatcctaatagtctaatatttttcctcaagaaaaggtatatgctgcggtttgaatgtgtctccaaaacagcatacttaagtagtagtttacttaatggccattataaactattaaaaggtaggacctgtaagaggtgatcagcccatgagggccctgccctcatgaatgattaatgccattatcaagagaagtgggtttgttattgcaggagtaggttctttataagaagacaagttcagcccccatttgtctctctgtcaccctctctttgcccttccaccatgcaatgatgcagcaagaaggccctcaccagatgctggccccttgattttggacttagcccccagaactgtgaaaaataaatttctgttcattgtaaattatctagtctgtggtatttggttataccaggacaaaatggactaagacagaagattggtactaggagtgtggtgattgttataataaatacctgaaaatatggaagtggctttggtattgggtgatgggtaaaggctggaagaatctggagtagcaggctaacaaaagcttagattgctataaatggagtattaacagtaattctggaggactcagaagaagagaatgagaaacttcttagagattacataagtgattgtgatcagaatgttagtagaaatagagacagtaaaggccattctttttctttctttctttctttctttctttctttctttctttcttccttccttccttccttccttccttccttcctttctttctttctttctttctctctttctttctctctttctctctctctctctttctttctttctttttttgtttttgagatggagtttcactcttgttgcctgggctggagtgcaatggcacgatctcggctcaccacaacctccgcctcccaggctcaagcaattctcccacctcagcctcccgagtagctgggattacaggcgcccaccaccacacctggctaattttgtatttttttttttttggtagagacggggtttctctatgttggtcaggctgctttcgaactcccgacctcaggtgatccacccacctcagcctcccaaagtgctgggattacaggcgtgagccaccgggcctggtcagtaaaggccattctgatgaggtatcagacagaagagatgaatatcttattggaaactgaagtaaaggccatgattgttatgaagtggcaaacaacttggttgaattgcatccacgccttgaggtcttgtgaaaagcagaatttaagagcaatgaactaggatatctggtagaagaaattttaaaccatgacatcgaagaactgtgcggcttcttttaactgcatacagtaaaatgagagaagagagaaataatttaaagatgggatctataattaaaagggatctgaaggattctcagcctggttgcctggtagagaaagaaagagagcattttctggagaggaaatgtgtggctaagcaaccatttgataaggagattagtatgaatagaagaaagccagatactattcatcaagacaatgggagaatgaccccgaggggattttggagatttttaaggctgcccctcccatcacaatcccggagctctaggagggcagatggtttccagggacagacccagggtaccatccacaggctgactttccagggccactcaggacgctaccttctgcatcccagaggagcatttctctgccacccagtcatagctcaagcaggcccaggtgtgactcatgttgccactctagaggcacgagtagtaagccttggtggtgcccacatagtgctaattctgcaggcatgcagaatgtatgagctcttaggccatggtagcctccacctagatttgaaaggatatattggatagcctggacatccaggcagaaatttatcacaggggcagagccatggcagagagccccatctagggcaatgcttactggaactgtggggttgcagctgccacagggagtcccctctacacctagtataggtgtcatggcagggtcacttgagactccagaactgcagagcaaccaatgtgcagccccagcctcggacagctgaagcagcaagactaacccgtaagagctgctgtgagggtgagactagcaaagccatggggttggagcttcccaaggtcttctgggtacaacccctgccttagtgtgaacagaaggtggaaatggagtaaaaggaggttattctggagccttatttgaggttgttttccctgttgagttttggactaacttgggatcagttactcctttcttttttatttctcccttttggaatgggaatgtctatcctatgcctttcctatcattgtattttggaggcacataacttgtttaattttataggctcacaactaacagggaatttgctttaggatgaatcatgccttgagtctcactcatatatgatttagatgagactctggactttggacttttaagttgatgctagaatgagttaacactttgcagctattgggatggaataatgtatttatatgtgagaaggacatgaatttggggggctggggccagaatgctatggtttgaacatgtcccaaaaaatacatgtgttggaaacttaatgaccattgtgatagtattaagaggtgggatctttaagaattgatttaggccataagagctcatctgtcatgaatggattaatgctgttattgtgaaagtgagtttgttatcacaggagtgagttccttataaaaatttgagttttgtttctttttcaccttctctttgcccttccaccatgggatgatgcagcaaaaaggccatggcaagatgatgtcctctcaatcttggactttccagcatacaggactatgagaaataaatttctgttcattataaattacccagtctgtggtattcagttatagcagcacaaaatggactaagacaatatgtattacaacttaaaatatttagtaataaatcttctagagactgtaattgtaataataatcctttgtgtgtcctctagccacagacacaatcctcttctaactcttccaatttttttgcattttaaattttttttaatttttactttttattgtggtaagaccacttaacatgagatctatccttttgacaaacagtctaagaacacagtaccttattaactgtatgcacattgtcatacagcagatgtctggaacttattcgcattgcataactgaaacggtgtatccattgaaagagaactccccattttccacttctcccaatccctggaaatcatcattcatcattctactctgtttctatctttttgactattttagatacctcgtaagtggactcatataatattcgttttctatgactggcttatgtcacctagcataatgtcccccaggttcatccatgttgcatatggcaggattttctttatatatatatatatatatatatatatatatatatatatatatatatatatatatataattattatactttaagttctagggtacatgtgcacaaggtgcaggtttgttacatatgtatacatgtgccatgttggtgtgctgcacccattaactcgtcatttacattaggtatatctcctaatgctgtccctccccactccccccaccccacgacaggccccagtgtgtgatcttccccttcctgtgtccaagtgttctccttgttcaattcccactatgagtgagaacatgcagtgtttggttttttgtccttgcgatagtttgctgagcatgatggtttccagcttcatccatgtccctacaaaggacatgaactcatcattttttatggctgcgtagtattccacggtgtatatgtgccacattttcttaatccagtctatcattgatggacatttgggttggttccaagtctttgctattgtgtatagtgctgcaataaacatacgtgtacatgtgtctttatagcaccatgatttataatcctttgggtatatacccagtaatgggatggctgggtcaaatggtatatctagttctagatccttgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtgattttgatttgcatttctctgatggccagtggtaatgagcattttttcacgtgtctgttggctgcataaatgtcttcttttgaaaagtgtctgttcatatcctttgcccactttttgatggggtttttttcctgtaaatttgtttgagttctttgtagattgtggatattagccctttgtcagatgagtagattgcaaaaattttctcccattctgtaggttgcctgttcactctgatggtagtttcttttgctgtgcagaagctctttagtttaattagatcccatttgtcaattttggcttttgtggcccttgcttttggtttttagacatgaagtccttacccatgcctatgtcctgaatggtattgcctaggttttcttctagggtttttatggttttaggtccaacatgtaagtctttaatccatcttgaattaatttttgtacaaggtgtatggaagggatccagtttcagctttctacatatggccagccagttttcccagcaccgtttattaaatagggaatcctttccccatttcttgattttgtcaggtttgtcaaagatcagatggttgtagatgtgtggtattatttctgagggctctgttccgttccattggtctatatctctgttttggtaccagtaccatgctgttttggttactgtagctttgtggtatagtttgaagtcaggtagggtgatgcctccagctgtgttcttttggcttaggattgtcttggcaatgtgggctcttttttggttccatatgaactgtaaagtagttttttccaattctgtgaagaaagtcatcggtagctttatggggatggcattgaatctataaattaccttgggcagtatggccattttcacgatactgattcttcctatccatgagcatggaatgttcttccatttgtttgtgtcctcttttatttcattgaccagtggtttgtagttctccttgaagaggtccttcacatcccttggaagttggattcctaggtattttattctctttgaagcaattgtgaatgggaattcactcaggatttgactctcggtttgtctgttattggtgtataagaatgcttgtgatttttgcacattgattttgtatcctgagactttgctgaagttgcttatcagcttaaggagattttaggctgagacgatggggttttctacatatacaatcatatatcatctgcaaacagggacaattttacttcctcttttcctaattgaataccctttatttctttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcataaatagctcttattattttgagatatgtcccatcaatacctaatttattgagagtttttagcatgaagggctgttgaattttgtcaagggccttttctgcatctaccgatataatcatgtggtttttgtctttggttctgtttatatgctggattacgtttattgatttttgtatgttgaaccagccttgcatcctagggatgaagcccacttgatcatggtggataagctttttgatgtgctgctggattcagtttgccagtattttattgaggatttttgcatcgatgttcatcagggatattggtctaaaattctctttttttgttgtgtctctgccaggctttggtatgtggatgatgctggcctcataaaatgagttagggaggattccctctttttctattgattggaatagtttcagaaggaatggtaccagctccttcttgtacctctggtagaattcggctgtgaatccatctggtcctggactttttttggttggtaggctattaattgttgcctcaatttcagagcctgttattagtctattcagggattcaacttcttcctggtttagtcttgggagggtgtatgtgtccagaaattcatccatttcttctagattttctagtttatttgcacagaggtgtttatagtattctctgatggtagtttgtatttctgtgggatcagtggtgatatcccctttatcattttttattgcatctatttgattcttctctcttttcttctttattagtcttgctagtggtctatcaattttgttgatcttttcaaaaaaccagctcctggattcattgattttttgaagggttttttatgtctctatctctttcagttctgctccgatcttagttatttcttgccttctgctagcttttgaatgtgttgttcttgcttctctagttcttttaattgtgatgttagggtgtcaattttagatctttcctgctttctcttgcgggcatttagtgctataaatttccctctacaccctgctttaaatgtgtcccagagattctggtatgttgtgtctttgttctcactggtttcaaagaacatctttatttctgccttcatttcgttatgtacccagtagtcattcagcagcaggttgttcagtttccatgtagttgagcggttttgagtgagtttcttaatcctgagttctagtttgattgcactgtggtctgagagacagtttgttataatttctgttcttttacatttactgagaagtgctttacttccaactatgtggtcaattttggaataagtatgatgtggtgctaagaagaatgtatattctgttgatttggggtggagagttctatagatgtctattaggtccacttggtgcagagctgagttcaattcctggatatcctagttaactttctgtctcattgatctgtctaatgttgacagtggggtgttaaagtctcccattattattgtgtgggcgtctaagtccctttgtagttctctaaggactcgctttatgaatctgggtgctcctgtattgggtgcatatatatttaggatagttagctcttcttgttgaattgatccctttaccattatgtaatgaccttctttgtctcttttgatctttgttggttgaaagtctgttttatcagagactaggattgcaactcctgcctttttttgttttccatttgcttggtagatcttcctccatccctttattttgagcctatgtgtgtctctgcatgtgagatgggtcttctgaatacagcacactgataggtcttgactctttatccaacttgccagtctgtgtcttttaattggagcatttagcccatttacatttaaggttaatattgttatgtgtgaatttgatcctgtcattatgttagctggttattttgctcattagttgatgcagtttcttcctggcatcgatggtctttacaatttggcgtgcttttgcagtggctggtaccagttattcctttccatgtttagtgtttccttcaggagctcttttagggcaggcctggtggtgacaaaatctctcagcatttgcttgtctgtaaagtattttatttttccttcacttatgaagcttagtttggctggatatgaaattctgggctgaaaattctttctttaagaatgttgaatattggcccccactctcttctagcttgtagagtttctgctgagagatcagctgttagtttgatgggcttccctttgtgggtaacctgacctttctctctggctgcccttaacattttttcctttatttcaactttggtgaatctgacaattatgtgtcttggagttgctcttcttgaggagtatctttgtggcgttctctgtatttcctgaattgaatgttggcctgccttgctaggttggagaagttctcctgggtaatatcctgcagagtgttttccaacttggttccattctccccatcactttcaggtacaccaatcagacgtagatttggtcttttcacatagtcccatatttcttggaggctttgttcatttctttttattcttttttctctaaacttctcttcttgctttatttcattcatttgatcttcaatcgctgataccctttcttccagttgatcgactcggctcctgaagcttatgcattcatcacgtagttctcatgccatggttctcagctccatcaggtcatttaaggacttctctacactggttattctagttagccattcgtctaatcttttttcaaggtttttagcttctttgcgatgggcttgaacttcctcctttagctcggagaagtttgatcatctgaagccttcttctctcaactcgtcaaggtcattctccgtccagctttgttccattgctggcgaggagctgcgttcctttggagggggagaggcactctgatttttagaattttcagcttttctgctctgttttttccccatctttgtggttttatctacttttggtctttgatgatggtgatgtacagatggggttttggtgtggatgttctttctgtttgttagttttccttctaacaggaccctcagctgtaggtctgttggtgtttgctggatgtccactccagaccctgtttgcctgggtatctgcagcggaggctgcagaacactgaatattgctaaacagcaaatgttgctgcctcatcgttcctctggaagcttcgtctcacaggggtacctggccatgtgaagtgtcagtctgcccctacttgggggtgcctcccagttaagctactcgggggtcagggacccacttgaggaggcagtctgtctgttctcagatctcaaactctgtgctgggagaaccactactctcttcaaaactgtcagacagggacatttaagtctgcagaggtttctgctgccttttgttcagctatgtcctgccccccagaggtggagtctacagaagcaggcaggcctccttgagctgctgtgggctccacccagtttgagcttccccgccactttgtttacctattcaagcctcagcaatggcaggtgcctctcccccagcctcgctgctgccttgcagttcaatctcagactgttgtgctagcaatgagcgaggctccatgggcatgggatcctccaagccaggcgtgcgttataatctcctggtgtgtcatttgctaagaccattggaaaagcgcagtattagggtgagagtgacctgattttccaggtgctgtcggtcacagcttcccttggctaggaaagagaattccctgaccccttgcacttcccgggtgaggcgatgcctcgccctgcttcagcttatgctcggtgggctgcacccactgtcctgcacccactgtctgacaagccccggtgagatgaacccggtacctgagttggaaatgcagaaatcacccgtcttctgcattgctcatgctgggagctgtagactggagctgttcctattcagccatcttggaaccgccccaccacattttctttatccatttatttgttgatacacctttagattgtttccataccttggctattgtaaataatgctacaatgaacatgggtgtgctgatatctctttgggataagtttacaagttttaaaatataatttcaacttttattttagattcaggaacatatgtgcaggtttgttacatgggtatgttacgagatgctgaagtttgaggtgcgaataatcccatcacccgggtagtaagcatagtaccccataggtgttgttttaaaccctttcccccatcctcctcttccccatctagttcccagtgtctattattctcatctttatgtccatgggtaccctgtacttagctcccacttataagtgagaacatgcggtatttggttttctggtcctatgttaattcacttaggataatggcctccagctgcatccatgttgctgcaaacgatatgacttcattcttttttatggctgtatatgtaccgcattttctttatccagtccaccattgatgggcacctaggttgattccatgtctttactattgtgaatagtgctgcaatgaacatctaagtacatgtggtttttggttttttttttttttttttgggagaacaatttattttcctttgggtatatacccagcaatgggattgctaagtcaaatgatagtttttaagttctttgcaaaatctccaaactgctttctacagtggctgaactatctacattcccaccaacagtgtatgagcattttcttctctccacagcctcaccagcatctgttgctttttaactttttaataaagccattctgactggtgtgagatggtatctcattgtggttttgatttacatttctctgatgattagtaattttgagcattttttcatgtatttgttggctacctgtgtatcttcttttgggaactgtctgttcatgtattttgcccattttttaatggggttatttattttttgcttgttgaattgtttaagttccttatagattctggatattagacctttgtcagatgcatagtttgtaaatattttctccaattctgtaggttgtctgtttactctgttgttagtttcttttgctgttcagaagctctttaattaggttttgtttgtcaatttttgtttttgttccatttgcttttgagggcttagtcaaaaattctttctcaaggccaacatcagaatggtatttcctagattttcttctaggattcttatagtttgagggcctacatttaagcatttaatccaccttgagttaatttttatatatggtaaaatgtaggggtctagttttattcttctgcctatggctacccagctatcccagcaccatgtattgactagggagtcttttccccattgcttatttttctcaactttgctgaagatcagatgactgtaggtgtgcagctttatttctgaattctctattctgttccattggtctgtatgtctatttttgtagcagtagcatggcgtttgggttactgtagcattatagtatagtttaaagtcaggtaatgtgatgcttctggctttattatttctgcttaggattgctttgtctattcaggctgctttttggttccatgtgaattttaggacagttttttgtaattctgtgaagaattatgttggtagtttgataggaattgtgttgaatctgcaggtttctttgcacagtatggccattttaatgatattgattattctaatccatgaacatggaatgtgttttggcggggggatcctctctgatttcttttagcagttacttgtagttctccttgttgagatatttcacttccctagtttgatgtattcctaggtgttttttgttgttgtgactactgtaaatgggattgtgttcttgatttggctctgagcttgaacattattggtgtataggaatgctactaattttctgtacattgattttgtatcctgaaacttactgaagtcatttatcagctgtaggaggctttagtggagtctttagggttttctcagtatatgatcatattgtcagtaaagagggataatttgacttattgttttcttacttggatccctattatttctttcttttgcctgactgctctggctaggacttccagtactatgttgaataggagtggtgagagtgggcatctttgtcctattcctgttcttaaagagaatgcttctaacttttgcccattcagtatgatgttggctgtgggtttgttatagatgactctattttgagatatgttacttatatgcctaatttgttgaggattttttcatgaaggaatatggattttctcagaagcttccgcatctattgagatgatcatatggtttttctcttgaattctgtttatgtgatgaatcataaatatcgatttgcatatgttgaaccaaccttgcacctcagaaatgaagcttacttgatcgtggtgaattaacttttttatgtactactggatttggtttcctactgttttgttgaggatttttacacatatgtccatcagggcctgaagttttcctttttcattgtgtctttgccagattttggcttcaggctgatgctagctttgtagaacgtaactcttctatttttatctagacaagacaactaagtgttctttatgttgaacacctcccctttccctccattcctgcctcattttttcatccttcatatcctttctgggtacatatgtgtgccaaatgctgggaaaagtaagtcaaataaagctcagtttccttctatgaagagccatagtagtagaggagaatacccagtgttaatagagggaagcatacaggcaaataaatataagaaggaattgaaggaattgtggaagaggacagtgtagctatcgttgttgggatggtcagaacactcacaaggaagtgatggccagagaaggattcagaagagggtgtgatactggaaacaaaacttgaaaagtgcattggtatttgcttgatagatgaagtaggagactgaggaagatgtttgaacaaaggctctgaggtgggaactacaaatggtccttctttagtgctacaggggagcactaaatgtgtctgtacaatgagtagggatcggggaggatggggcctgtatgtagttaaagataaagtaaggaaaggaaagacaaaccagactcagtcctgcaggttttcagaagccccactaaggaacttccagcaagcctgcgacatcagatttgtaccttccaagtctccctttggcaagagttttccatacagatttggagggatttgaaataagatgcaaagaaatgagggcctgaaccaagacagtggatattgagagggaaaagagggaagagttatgagatggttaggaggcaggatccacaacatttaagcacaaagaggagatctggaagggtgtgggaagggggttgttcctgaggcaaatgagtgagtggatgaggttttactcactgaaacaggctggtaaaggagaaaaaggaggcctgggagggaggcaagagctggccctgcttggaacatgcgttgtttcctgcttacgtggacagtgtatggctgcttccattcttccatccaggcctcaatgactgccatcaagaattaggttggagatcagaaatgatttcttataattgcacagaatctttagtcaacattttgtcttcccctgcctcccaccactgtttatagcacatcatgtcatctccactctcaatgccatttccttatttcggatccctggcttctgtatagagacaatggttatcagagtgtgggaaaaatgaaaagttaagagacgccttctgcagaaagggaagatgcaaactattttcagtaaagcgcctgagctgagagaggagagggccctatggagagctatgtctccctctccactgaattctagcaaatgtaaagtccaggggagtggcatcagtagctaatttgcagaaataccagtacaggcttcaaagttttctgaaagacccacatctgcaaattgggaatcaggaatccttgctttcgtggatcatgccagtcagtggattgtttgctctcagatccgctccctgcccttcccctgctctacttgataccacagggaactgacctttacaatttgcatttcccagtctccctttccattgagtctggttagtttggagaggagggatgaagggcagaagtatgagagaagccatgtatttttgtacacacacacacacacacacacacacacacacactctctcacacacacattcctctgccttgcttccagtggtgtcccaggcagtgacattagttcctctccacgatccctttgctgtccccactctagttgggcagctccagcctctgggctctagtaacagcatctcatccttgattcctccagccctggggatggtggtagcttcttgttgttgctaatctctgggttgactcattgtcccctattttcatttcagctcttctaacacatttgtaactaattccccaaattgaatgctctctcttgaactaccaggatatgtcccattttactgatggaccttgacagatacaggtctacataagcaccctggttggtacatggttaatataagacccccaatctcttctccattgtccctgttcccccaaaggactcttctgtctaccatggttctccatccctcagagttgggctcctggcctggactgtcttgaagggcaaacatttgtgctgtgcttcctgaatggcatgagaaaaggagctcttttggcctagcctccttcctgtaggattttccaaaactttccagatgtatctaagctcaggaaacattttaatggctggaaataatgtctcatgggggttgggggtttgaaaccaacagaaccttctccaaaagaggtgtgttgaaatgttccagggtctgtatgcacacatccaaaccctgcccctcccctgttgaaagcatggcaggctcccaccctttaattggttcatgtcgtagaagagttggcattctctgaatgccctaatgacatggagcagaggaacagctccaaaggccagaactctctccaggagggaaaggattattaagcggttagtgatgcatttggattctaattcagattccacctcagattctgtaaagagactcctataaccctcttcttttggccttatttggctagtaataatggttgtaagattgatctaaatcataataaatgttgtctaaggctgctcttactgacttaatgaattggagcattctgagttttttgtgaggataggcattatccaactgcagaatacatattgattctttttcaaacaggctgtggcttttactttgcaatgttgcccacatttcatgacaactttcagaacaaactctgttgagggatgaagattattgctatctgaatgcattcatcaaagaaaagtagaagtggaagaactatacttctgccttctcatattcttcagcattgggccaagagtagaaagtaaccatcatttcagccaggcacagtggctcacgcttgtaatcccagcactctgggaggccaaggcaggtggatcacctgaggtcacgagttcgagaccagcctggccaacatggtgaaaccccgtctctactaaaaaatacaaaaattagttgggcatggtggcggacacctgtaatcccaggtacttgggaggctgaggcaagagaatcacttgaacctgggaggtggaggttgcagtgaggcaagatcgtgccattgcattccagcctgggcaacaagagcgaaactccatctcaaaaaaaaaagaaagaaagaaagaaagaaagtaaccatcatttctagtctgtggggatcaaactccagaaattgctaaattattgcatgttctaatactacagggaacagctgaaacctcatccttttgagaactggacttgaatccaagccaatattgatttatttgggatgtgtcttgcaagtccacaaatgctttaacacagtaatcactaaccaggatacttatgtagttgtttgatgactcatagaactttatagaccttggggtcagatatatgttttatatgaaaagagcaagattttaatgaaaaggaagtaggtcatgtgcaacaatgtaactacagtttctgtgtctctgaagtgttcagttttgtatgacattgttagttctttcttctgaccaagtttccttcattagcctacaagggagcctatgaagtgaattcacagcaccagaaataacatgagaagaccataattttttaattatttcagagattaagattaatttaggccaggcacggtggctcacgcctgtaatcccagcactttgggaggccgaggtgggtggatcacgaggtcaggagatcaagaccatcctggctaacacggtgaaaccccgtctctagtaaaaaaacaaaaaattagccgggcgcggtggcaggcacctgtagtcccagctactcgggaagctgaggcaggagaatggagtgaacccgggaggaggagtttgcaatgagccaagatggcgccactgcactccagcctgggcgacagagcaagactccatctcaaaaaaaaaaaaaaaaaaaaaaagattaatttatggattctagtatataacatacatacataaactactgtcttcatatgtgggtacctggaaaaatttttccattgcaaaaaagataatgttattctaaagtaaaattctagctctgtttctaattagatatgtgatcttggacaaatgactctgagtcacaggttccccttctataagagaatttcatgatctagaagatgatttcactttctggttctatgaagaagaagcaatgccatgctatacctcagttactattttatacagtgggaaaagtctcattatcaacgggcgctggccacattgtttgtgctaaaccataggatataaccctaacactctgctcagttatttatttggctgacgacttcctcttgtaatacttcttgacaggtggtcagaggaatacctcttggaatccactggcagagcttgttaaaaattcagattcctggacttcccagactaaatcagcagctttgggggtgggtctagaaatctgcatttctacattgctgggcaattcttaaagatacaaagtctgagatccatggccagtcaacagcacgtagtgttaatatattctatgatgtgaattactttaactctctttactctgcgtccagtctgcagggtcttagcccagggcctactactgactggatgatttggtcacaacctttctctctctaggactgttttcttatttatgaaatatggggtctggagtattagtctctaaggaatctttgtgttctaacagttcatgaaaatagttctctagcagcatctgagagagttactgaaactaccttaacaaatcctatttcttgagtgcctactatgtagtaggcattgtgctttttttttttttttttttttttttagctagagtctcgctctgttgctaggctggagagcagtggcgcgatttcagctcactgcaacctccgcctcctgggttcaagctattctcctaccttagcctcctgagtagctgggactacaggtgcatgccaccatgcccagctaatttttgtatttttagtagacatggggtttcaccatgttggccagcatggtctcaatctcttgagcttgtgatccgcccgcctcggcctcccaaagtgctgggattacaggcatgagccactacacccggccggtgcagcttttatgtatgtttcatttattctttatgctaacctgtgatattattattattattattattattcacacttaacacttaaggaagtggaggctgtgaaaagttaagtaacttgtccaagccgacttaatcaataagaggagctgcagtaaagtggaatgaaactggggctgtgaacacctaaagaatgacccaggttgttgctccccctgaaacttcacaaggcctgggcctcatgcagtgcactgctcattcaccctgtgttccactctcccagcaaaggagtcctggttttggtttctttcgatgtttacttggcctcttgcttaagcatttgcctttcctcctcaataacagtgaaaggactgaaaaataataaaataaagaaaagaaaatcccagggctggaaacattttgtttcctacaaaaagaatattttgcggccagctctgtggttgaaagtatttttcctgtggtctagggatgagttggatcccatctcttcttggccagggtctgagaacttagcctgtggcttcccatcgagtcagcacatagcatgctattttttgaacgagtgtctgatgatgttgaatgtgttcacgagtggacgaataggtctgtttgggtgtataagaaatgtgcgcatgtgcctctgactcttccagggcagaaggaacctgggagtggttttccacatgctatacatatcaacgtagcttttaagttttcatcactcacatgatgaccaaaaaaattcagatgctgacaaatgagaggagggtgatatgtgagccttatgtggatttgcaagtaatcagaaagccagggaatctaagattccctatcacatttctttccattttcaaatggaaaatgtcacatttctttccatttttcaaatgctcaaaaccaagacatggggttggttttattatggcagggtggtctgatggtaatgcagaagatgggaattctgagagctgccccagcttgtccaccttcagcctttgggacaccaactttgcctagccttgaataagtcactttttctcaaggactgcattttcctatatgaaaacatgaatttgtgtttaaaaaaaaaaaacaaaactttctgctttcaagaataaaagcttctctagtgagggatgaattttgaatattcaaaccgaattcatggataagaaatagtagtgctaggtaccttttctttactcataaagcattatgtactcatatttgtatgcttccagtatgactttgaagtgtatattagtgcctagaacttttcagcctgttctccatggcatggccttcatgattctatctcttacattcttgtaaagaatgaagaacgggtgttctctggactctcattgcacatggttttatgttcagttacctgctgactgcctccctgtcatgccagctgcaagtcacagcacagtgcctggcacagagcagatgcccaacttgtatttgttgacttaaataaaacttctccaaagatgacaagctactgtttgtaacttcagtattctcttgtgcgaagtcctctacatagctctccattcagggacatttctagagctcaaatcatcatgacttccaggaagaaaagttgtagtcactggattagggggcattgtttgaggaaataagcaaattccacaggtggaaagaattgtgaattgtgtgtgtgtgtgtgtgtgtgtgtgtgtgttttgaggtgaaagaggtttagggaaaatttgaaaagctattggaatggaaattaaaccatccagagtgttttattttagagggatagggtttaagatagactcagcagtggtggcattggccacagggctgcacctaccctgggatgcagaaactggcccatccaagtcagctccatgggaaagaatgaccacaaagtgatcaggggtcaccagtgagaaaaactggcatttgctgtattttgtcacacaggacagtagaactgttctcacagtaggagcagggatggggtggaggtggtggtggtgattttagtaaaccagttttctggtgatgggggggcatatttctgtttttaccccttaataatgagacagcaacccaaataacagatccctcagtacactgaaatgccaaggctaaatgaactggtggaactttgtggctttggctcttggcccacaggcatatccgtgcattagagccatggcttggcagtagacaaagcagctgtgtgggtcctcggggagctctctggctctgtggctttctttgatatgcaactgaactttggcaaatttttcctctcatggcactgtttatgaggtccagagaccttcattatggaacccaatgccaacagcaaactagaactacaggatgtcttcccacattcacactctgcttgcaggctgaagagttagcccacaaggctttcaacaaagggacaatttaggggaagagactgcagaattctcttctcagcttcacatggctgtaaacccataggattggccagacctcttaaactttctttccttcagaaggaaaagatctcttacttaaaaatgattctgtataagattactaatttactgatttccaattcaatagtatttaaaaacaacaacgacagtaacaataatagctagcattcatcaagtacttgaccatttgctaagtactaaagtgctgtgcatgtattaataaaaatgcatttattatcaacatctttgtaaggtaagtactattatccccattttatacatgaagaaactcaatcccaaagagattaattgttagttgttattggtcttaataattattcaccaatttaaggtataatcctgcagatatagcttataattgactggctttcctgaaccccaccttcctcagtctatgacactgggccacagatactaaaataattaaaattatcattcttaattgttaacccacctcaaactgtaactgggtcttgatgagtttcaagtagtatcatccttatattgggaaatctataattaagacttttctaaagtcatgagcaggtatacagaaagtgattgacttggtgaatgagagggatcaactatcctccagagcttgtacagtagagtggaaacaaatgtggtgttggactgagaacggtttaaggtattggaggcaatgattctgttcaagtgccaagattaaaccaatagactctagaggggctcaaaagtgaggctacatgtcatggtttgacgtctaaattatagctatgcaactttctttcctacccatttctactgtatcctctgtgctttctataatagccgctccagggaatgctgataataacattatcggctgccatttttatgccaggcacatgataagagctatacaaacatcatctttataatatgctgtgaggtgggtttttacaataacactgtgaagtgggtattactaccctgaatttacagatggaagaaatgggctatggagattatgaagtgctctgaagttaaaacaactagtaaatggtagaaaagagactctgaagtgacttgtagctactagtttgtcttgcctcataaacaatgtgatagacatctggtatttctgcttgcccttgatctcttaccccttctctcatacctacactatgattttcctgtaaggaaacatgcctcttcaatttttttcagcctatgttgtctagttagagctgagggctgattgtacccactgggttcatgtctgaccaatggaaggatcacatttcctttctacagagattggtttgcaatagttggttaacccaagctaagttgaatagagtaagcccagaattttgctgaacaataagagttgctaaattggtaggatataagcctggagctccttgtggctgtctttgccaccatatgaaggaactcacctcagaatgacaataaatcaacgtagagaaaaacaagagattgagagaatgttccaggtggaaggaggaattgaataattgaattaatataagattatgaggccatcatctgaggccctggatccaactgtgcctcaggtcagttactcctgacattccagttaagtgagccaataaattcccttttttgtttggtctcaatcacatctctgttacttgcaacagaaagaatactaaataatacacatattaagctgggtgcggtggctcatgcctgtaatcccagcactttaggaggccgaggcgggcggatcacctgcagtcaggagttcgagaccagcctgaccaacgtggtctactaaacccatctctactaaaaatacaaaattagccgggcgtggtggcacatgcctgtaattccagctactcgggaggctgaggcaggagaatcacttgacccaggaggcagaggttgtggtgagccaggattgtgctactgcactccagcctgggcaacaagagtgaaactccatctcaataaaaataataataataatacacatattagatcctcatagttacatacaaatgtgggccagaaaattctaataatgagaacctgtattgttaagttaaagagtttattcccccattaagtagagataatttctgattacttaggtctactttcctggttcctatattattccattccttttcttttcctcttccatcttatgcatttgctgttcttcttcctagtttccttttggcctttttattattcacctccaccacagtagagagaaaaaaaaaaagcatgaaacttacaataaacagcttttctggcttataaggctctttgaaaagtttcagatgaagagtaagttaaaaaatattaactaaaaagcattaaacttacaataaacagcttttctggcttataaggctctttgaaaagtttcagatgaagagtaagttaaaaaatattaacttaaaagcaattacgaaatcatttttgggttttagttagccattctatccatgacctttttttttttaaaccacatattaagcttgatgaaagtccttgatgtcattgcttccacgacaaaaatacaaccttttctgggttagtttcccttaatcattaatgatgagctgtaaaatattctttccagttcaaaagtggcatcaaataagtaactaagatgaaattagtaataattttggaaatgtggtcatttagcaagctgatatttactgaacatctactgtgtactaggttaggctctggaaaaagcaaagatgaataaaacataattttcaaaatctagctggatcggcaagtctgaattgggagtgagcaggaggggcagaggtgagggctgagcctggagcagccagttggcccatactgaggaggaccttccaaaggctttggaaagtagatactatagggagctgaggatggtcttcaagaagtgaaaaatgtgctaatccactggggagagcttacgggttatatacaagggtgttatttgtctgacagagaaaactcactttaagattacatgaatatatgatccatatagtctaccaggacatctcttttatatattgaccagaataatctgagaaagctggaagtacaggcatttaagccactaaagctgtggactacagttcaccctaagcaaggaagcgagtgttttttaacatgtcatctcctggattcccgaggctttctgggttagctcaaacctgggccatttagcttcttatgggcagggacctcatcatgttcatctttgctttccctaatgtctaagccagtacttggaacataggaggtactcagtaaatatttgttgaattaatataacattaaataaatcattcagttctgagtagtcattgtttatacttgctgtaaatatggttttatgtaatttccaagtgtgtctgccctttttaggtcctgtattttcattttggcatagtctgctttcagtggcacccagctagaatttgcctgctaaacagaaaatctctggtgacaccgaattgcatatcctggcttgattgctgatggagaatggcagagcacacactcttatctttagcttgactttccatgtataagagaggggatgtttttgtttgtttattctgaaatggaaaacaaaaaagtaatgcatgctagttgtgaaaaaaaaatcaagcaatatagtaggagggaaaatcctctaatggtatataatcttctaggctttttctatgcatatatcaaaatatttatgtactcaccatatataatgttatataaactactttaaaattaatccacacattatggataatttttcatgtaaatatacatattactaaccgtttttcatagcagcatagtattcatggtatggatatacaggaatgcagttaagaggataacataaaaatgaacgaaatgttgtgttccttaaaaactcatatcaggaaaatctaaagtattttcatttctaattatttttaaaaaacaacaaaactttgtttcaaaccaaagaggtagcaatatagcttcatttcagaaattgctaactccgtgcatgaatattgtagccgtgctttgcttcatcattaaccttctctaattcttctacctagggaccccaaagagcatggtaaacattttacaaagtctccttaaagatgctggtctggactgaatggatctttaaatctaactgtttttaaatgtcttttagtaaggcccaccttaattgagcttttttcttaagatcctgattttaaaggggtggatggctcagaaaactgctccagatcaccaaataaaaaatcaagttctgaacagtgagacacctttaggcccatccccccagctgtccccaagatcacactccttcatcatgtgtctcctgagagtcagagatcctgcagctgtgcctgaggaggactgaggtctccaggctcttgtattgctaaacctagtttttgtttttgttttgtttccattctcttttttcttgcctttttttcctctgtggtgtctcatttctcctagagtcccggctgactcccctggggatgaatctgcctgcctgtgcatacaggaatccacagtgtcattagggtagttatctctaatttattcttcctccttgtgattagaagaactcggtctgaatattgaagaaaactcatgtgggctcttgtctttgtgataaaagcttctgtcccatagtaattaggcagagctctagtttacttctaaaacatgattaactccttggaaaggaggggaaaaaacggaaagttatttaagatgggtaccctaggggaacaaaggagaggcttttcccattgttatgcctcctaattaggccaagcccaaggttgctgtgtgtcattccaggaggcagtggcctgcctggtaggcggataggagcagaggggtgacagaatgaagctgacatcagaaaggcccaaaaagagcttagggctttttttttttttttttttttttttttttaagatggagtttcactcttgttacccagactggagtgcaatggcacgatctctgctcactgcaacgtccacctcccgggttcaaacatttcttctgcctcagcgtctcgagtagctgggaatacccaagtgcaccaccacacccagctaatttttgtatttttagtagagacggggtttcgccctgttgaccaggctggtctcgaactcctgacctcaggtgatccacccgccttggccgcccgaagtgctgggattataggcgtgaaccaccacgcctggccaggactttttaaaagactatatcttctgaacttgcctcctgttccacctctgaagggccctcggggagagacggagcttagataccacactctgttctgtagttcctcacatagtttttctcactcagaaccactgaaagaggttaggttgctttattcctcatgactctctgttttgcttgacttgtttatggtgaacatgtggtatttacataatcagaaaaacataaagccatattcatagtgtaccaaccgggaaagagagagaaaaattaattgtttgttgggactggcaaatagtctcacagtgtagtcaagtcaacattaacagtaagaagggtatatgggattatgaaactgtaaaaggcccctgaggattctgagcagagttcattcttagcatgactgtgggggctcagtgccaggccatgctgcaccccacagagggccctgtccagacttctcagcacagggaatgcctcatattggacagtttttgactcctgtgatggtcagtattctcagcttcagggccctctgtttcaggcaagataacctattcactcattctatagaatgctcagcctgatggtatgtgtgttaagtaggtagactgcctggaaacacagattgagcaccaacaaatgattctaatgagaattttagaattttaaactccttatatatccagtctggttgctatcaagctcttcctaccaagttctttctgagatccttctggtgcctatacctgtttcttgaattatttcagtctgtgagcttatttctatgaattaaagataccttaattcccttataatagttgataagtgagtcattctatggttatatatagtgtaagatttagaaacattcacattaaaaatattgaaaatacaaaagacgaagctgacaggttcctggttataccctgacagcactggggagagttattgtataaagttctagctctcctccatcttactgaaactaatttcgtttgtgcttaaaggaaaagacaggaagggtgccctgttgtctctctgttacactcttcaactcatctgaaatcctgtcttgtgttttcttcttgtcctttgcccttgcatttgctggaggaggactttagggaaatagtaagaatgctgcggtaacagagagaattaatttgaccgtgctctgaagaaagagcatgttgatttctcactagaattggttcctccacccatcagagcagggccagggatgtggtacattacacaaaccagtcccatttgaccagctgtttttggatgtgtcaagcccagatttcagcccctttacatagaaacatgttgccttccttgaatgggttcctgtgagactaaagaaagtcccgtgtggtccaagcatgatgtaacagggatgtgtgcttcagaattcaagacacaccctctgagttcctggcatctttttactatagtaatcacacagccatagtcttccttctgtgacccttgaaggccagagctgccttgcctctgctgcattttctaatgggcctggacaggaggacccagctctgtttcttatgggtcttgtggatggcgctgggaaatcaggcttgcctaactggatatacagagcttagcattaacagctggacagagctcttgtgcatcttgttttttttggttatttaaatactcctgatttagggtggagaaagggaatggatttctgttgcttgaaattccttgcgacagtatttgtttgctttaattggcgctagattgaagttaccaaattcagatgatgatgaaaccagttcacacttatttgaaaattgaaattggtgatacttatgttaacttttgattttttaaaaaaacaataaaaaataaaatttaaatgtagtatttgatggcgatgagcttactgacaataaagtcaattctcacttccttcagcatacccaatggtaatattaaacaaatggtaacattaacaattttagaaatggttagaaatatgtacagttctgtagcatgtgtgtgaagttgtacattagccttgcacacataggcactctcacatggacagcaaggaaaggcagaccattgaactaactctttagcctttaaaatggggcaagttactaacttttctgcaatttttatccccataagattctctcatcatagtggaaagaaactaatatttctcaggttcctatgacgtaccgcatttttcactaatttctttcatctctttaatcctcacaataagcctatgagatgagtgctattgtgttcattttagagatgaggaaagtaagtcttgaagaggttagagtacccaaaatcatatagccaagatttgaagccatgcttgaccagatctaaggtgtgttacattttgtaataatgatgattgtacttgaccccaagcctcctttttttagccccctataaccatgacttgataatagctaaaaaattgtattgagtagccttaagaggagctatttggtacatattcacatgtgggatgtgtgtgtgtgtgcacatgtgtgtgtatgtgcataaccctcaaactgatattaagataatgttactaaatcactacctaattggagatagaaaaactaaagttcacaaagagtgcctgcactttaatgtggaggtttgaccacatatgtatattctttctcatgattcatttgaaattatgtctgtatgataaactaataaagttaatccaaaaagacaaagagagcatgaatctttttgagatatcaacaggcttcagcaaataatagaacacatgaagtgatacaagattggcaagaaagaacagagacacttttgtgccctcaaagtagtgtagcagtagaacacttgagagatttcttcaggacttagaagaaccagatatcatagaagacagaagagacaaaaacagcagattggtttaaaattgtatatgaaatatatgaagtagctgaaccccctttttcaccctggaaagctaagtgacaagtctccaacccaggataaaagccataatttatctttggagaaagacttgggactctagacaaagcataggacaaaaatgggcattttattaaaacaggggattatgcctgccagatggtgagtctacagcccctttctctgccctgcttctagaatgtagcaaccaaacaagagatttttataaatatcaatccacctctgagaaggtatctccagttattgactctacagtggatcccaccgtttacaaatgctgtgtatatacatggtgcttttaactgtatttttagtaaaaaaatattttatgttttaaatatgattgaaaaccaaggatcaccagactttggaaaatgcctctcatagcaaggagagaagaaaatagagataatgtgagactcaaaagaaaacttaaagtataattaatttcctcagagagttaaagatgacataagaacaagaataggaagcactgaattagaagtggtcagaagacaaggaagagcacctggaaattaataatataataggtgacagattcaattaaagagctagaagataatacaaaagtgaaatcatttgctgttttcaattttatgtgtaaacattaagttgattaaaagatcagttgtctagtgctgtgaaaacttttaaaacagaaaaaggaggagtcaaaattgaatagggggagataaccaagatagatactgaatcaggatgtttacattttggcttaggagactcaattttcagcatagtggaataaggcactcccaaactctacacctccataaaagtaacaagaacattgacaaaaacttaaaaaaaacttcttcagaattctggaaattaaataaaggctcacaacagtctgaggagtgtttatttgagaaaaaaaacaagtgactctcaggaagaacagcaagacttgtggaattttaacttgccctaattccattctcctttcatcagtgctacagtaaccttgcacaccaacaatctttatttgtggcatctttgaaagccagcatggtagcagccactggagaggatagaacaggtttggagcaccttaaaaaccccatcccagagaattgctattatttgacctgtccaacagcatgctaaaaagctccattctcagggcttgtctttatttgacttagattcagaacttggcctgtgtgaacagcactatccacagagcatttgtcaaaaacagccagtggtaattgctcaccatcatggctgcccaaggctccattaccaggtagtgccaacaagaggctgaccaaaaaatacaaaaggaaaatctgggggaatgagatagctacagtgggttttataaagctcctacatacaccaggaatctagagggccacatagatatccagggctttgtaagagctgagaaaacctgaagatctcacttccagctgaccttgaggctgtgtgcaagaaggaagtgaagaatgaaacagagttatatggcttgatggagtattgaatgcatgccccaacatacacacacacaggctgaaagatttactgattcacagcatttaaggaaatctgtcatgtcattagtggaccacgaagtggcttcatgtataagggaccttcaataaaattaactgactgacttctcatcagaaaccacagaagccagaaggtaattgaataacatattcaaactgttgaaacaaaaagattgtcaatccagaattctatatccagcaatattatccttcaaaactgaaggagaaattaagacatttccagagaaaacaaaatataagagaaacacctgccatacagaaaatactacaaagaattcttcaggctgaaatgaaaggacactagagagtaactcaaatcagtatgaaaaagtaaagtgtgtagccaggtgtggtggctcacacctgtaatcccagcactttgggaggtcaagacaggtagatcacgaggtaaggagatcaagaccatcctggctaacatggtgagaccccatctctactaaaaatacaaaaaaaaattagccagacgtggtggcgggcgcctgtagtcccagctactcgggaggctgaggcaggagaatggcatgaacccaggaggcggaggttgcagtgagccgagattgcgccactgcactccagcctgggtgacagagcgagactctgtctcaaaaaattaaaaaaaaaatttttttttaaaaagtgtgttggtaaagataaatatgtaggtaaatgcaaaagacaatagaatgtattttcatttgtaagtcttttcctctcccatctgatttgaaagataactgcaaaaagcaagaattataaaactgtgtagatgggcttataatgtataaagatgtaatttgtatgacaatagtacaaggaaggggaagagaatagagctatattgatgcacattttttgcaaacaattgaaattaaggtggtatcaatctgaactagttttaagttaaaatgttaatggcaatcctcagggcagcctctaagaaaataactcaaaaatgcatagtggaagaaacaacaagagagttaaaattgtacactagaaaaatacctaacacaaagaatgcagtaatgacagaagatagtaatggcaaaacagaggaacaaaaaggaaatacacacagaaaacaaatagcaaaatggcaggcatatatcctactttatcaataattacattaaacgtgagttgattaatgctccaaccaaaaggcagagattgacagaataattttttttaaaaacaacatgatccaactatatatgctgtctacaggagacacactttgagtcagacacaaataggttgaaagtaaaaagatggaaaaatacatgtcatgcaaacagtaaagaaagctggaatggctatgctactatcagacagattagactgtaagacaaaaatcattactggaaacaaaaaaagagacattttataattataaaaggattgctccatcaggaagacataactataaatgtatgtgcacctaacacctatgccccaagatacatgaagcaaaaactaatagaattgaagggagaaatagaaattcaatgataatagctggaggcttcaataccccactttcaataatggataggacaactggacagaagttcagcaaagaaatagaagactcaaacaatactctatgccaactagacctcaaaggcatctatagaacactctaaacaacagcagatacatgttcttctcaagtataaattagactacaagttgagcctcaataaatttaaaagattgaaatcatacaaacttctccaatcacaatggaatgattttttttttttttttttttttttttttttttttttttttttttttttttttgctttttttgagacagagtctcactctgtcacccaggctggagtgcagtagcacgatcttggctcactgcaacctctgcctcccaggttcaagcaattcttgtgcctcagccacctgagtagctgggattacaggcatgcaccaccacacccaactaatttttgtatgtttagtagagacagggttttgccatgttggtcagggtggtcttgaactcctggcctcaagtgatctgctcacctcggcctcccaaagtgctggtattatagatgtgagccaacacgcccagccctgggatgaaatcgataatcagtaacaaaaggaaaatttggaaattctcagttctgtgcaaatttaaaaacacacacagacacacccctaaataagcaatagttcaaagaataaatcacaagagaaattagaaatgagtgaaaatgaaaacaaaaatacaacatatcaaagcttatgtggtgtagttaaagcagtagttatagggaaatatacagtttaaatgcttatgttaaaaaattattgcatgtatattatacctaaataaagctgatattaatgtagaaagaattggtggcccatatttttgactgtataaatttgcatactaccatatatttgtagttgataagttttctctgattgtggtataattcaggaagaattactaatactttctttttttttgagacggagtctagctttgttgccaggctggagtgcagtgacacaatctcagctcactgcaacctccacctcctgggttcaagcgattctcctgcctcagcctcccgagtagctgggattacaggcacgtgccaccacgcccagctaatttttgtatttttttttttttttttttttagtagagacagggtttcactatgttacccaggatggtctcaatctcctgacctcgtgatacgcccacctcagcctcccaaagtgctgggattacaggcgtgagccactgcgcccagccctaggaattattaacactttcaaaccacatgtaaagttcactgaaaaaaaaaaaaaaaccaacatggtttttaaattgtgttaataaatattaagcttgtagttaactatatgcatgctaaagtagttagagaaaagtgtactgatgtttgcaatttactttgaaatgtaataacaaccagaacaaaaaataagatgggttgatagataaatagatatgtgctaaaaaacaagtgtaataaaattattttggtctttttgtttccgttttttgagacagggccttggtctgtcacccaggctggagagctaatcatagctcattacaacctcaaattcctgggttcaagtaataaaatgttaatggcagaaccagttgatatgtttatgggtattcactataaaattctttcacttttgttttatgtttgaaaaggttcataataaaatgttgaggaaaaaaccgtaaactcaaaatgtcattctgaccctgaactatttactattccataatttactaagttaacatcctactgatcagaaaaaattaatattttctttaaggagccctagctcttttctaggcaatactttcttatactttgggaacttgatgtgttatattataggtaaacattttgaaaacaatcaccagagaggtgttatacaagagcataatgatattctatgaggaaataggatcttataacctcagggtcaaaattcctaagagactcttcccagagactacaattatattatttatatatcatattattatattgtatattattatttatattatattttttagggattcagatcagcttactttatgtcccctaatttctgtagaaaaacttgggaagtaggccacatgtagacaaattaataaattcatgcctgctcaaatacagttcatttttccatcctgccattttccagcactgtattacttctacagatcttgctcttctattatgagaaggcagtttagatgccgctaaactcattctctgctctgcccgcataatcctgcaaagctgctggtgttgaggcttcagtgttccatgcagagtgattttccaagtgatgaagcagattctaatcagtctaagatccaactacagactgggagttggacctctgccacctttccctccagctctcgcaacacaatggggaattcctgtgaggatcactgggtacacttcaagctcccctgatcctatggcctcattccagtcacagatcttcctgtctggagcatttccggcccttctgtcctttggcttggagagttcagctcaacctgggaagggacagaagactttggggttatcaaaagcctgttgaattatctgatgcaagactaactggtttgtttgcctccctggctctcttcctgagcttcaaagcagctgagaaaacaacttttttctaagtcttggacaaggaggaaaaccctggcatgaaggatttctgtcgcagacacttggcatagctagaggaaaggtttgtttaacttaccaatgggttttattagcctaggactccagttgaagtgagataatagggtccctgtagaaggacatttcagtcagtgggcttcctccctaatttctcgacaggacccttgcatgcagatgaaaagcatcagacacattcaacaaggaaatccccactgaatttatcaacgaccacgtaatcttgctgatcatgagggagactgagacaggattaaaaaactagcaggacaggaaattgtgtatggatgcaaagtcatattggggagctatctacttcaattgcttcttgctgaacttctctttgctgaacgtattacattgtctctgggccccacatcttatagcagatagcagggatagaaagaaagccagtcctaccacctgtccttacaggaagaaactcttctgcttatacttttcctctgccaggtcatttcactcttcctttcacctcccaaccaatgtgagatttggggttggggtgggaaggggaaggaaatagaagagaggaagaattcatgactggtgtacaggaagccttcctggcacaggaattagagaagagaaagtagaagaatcagtgccagcttaccctcagcctcatggccgcctattcatgtctgctttcctgggccacataggcaaaactcactttttcctaaggttggggctgtattgcaggaactcatgtaaactgccaggaccagaagtctataaaagcagcctccaggccgggcacagtggctcacacctataatcccagcactttgggaggctgaagcaggtggatcacctgaggtcaggagttcgagaccagcctggccaacatggtgaaatctggtctctactaaaaatacaaaaaattagctgggtgtggtggcaggtgcctgtaatcccagctactcgggaggctgaggcaggagaatcacctgaacctgtgaggcggaggttgcagtgagccaagatcacaccactgcactccaacctgagcaacaagagcaagactccatctcaaaaaaacaaacaaacaaaagcagcctccagggtagcctgtgcccaaggttcctgacatctctgtgctgcctgctccacactggccttcctagccacccatggagaaggactgggctgggttgcctcagatgagggccacacctatactttaaaaaggaggacccagacactatccctagaaggtgtcgccatcctggagaaggcctggggtgactatgcccagcactttctgttctgtggctccttttccactttctgagcctcttggaagtgggatcaggccaggaaaaacatgtgatgctatagcaagctgaaaccaaagacttgactttgggcctggccaagccaagaatcttggcagtgattgactgggaagcctgctgttttctatggcattttctgagtcccctaactctgggaagagggaaccagataagtcctaaaaatggatatgaatcagtagagcttctgtgggtcatcaatttgtgcatttattcactcattcattcttgtatttcataatgaagcttctcttacgtatatagcaccacactagaggtttgtgggaccagaaggagcagcaacaacaagaatgggtcaaatagattatgttaaattgaggtaacattaaccataaaacagtaaagaaaactaataattagagagtacagataaagtatgaagagattagagagagatgactttaggctggagaaatcggctgaagcttctggaagaggtgacatttgtatttagactttcagggatgaagggcagaatgaagactgccagtgtggaagcttgcgaacagctgaggcagcccgcacggataccctgtccagctcccttctttgtcttgaatcatgcaatatccatgcagggaaaaaaaaaaaaaaaaaaagcccttatttgctgttatgtatcctgcctcatttaatgtattatcccagaaaagtagattgagttgtatgtggcagattgggagctgccatcatggtggttaaaagtacagaccaggtagtacagaaccaggtagcctgggttggaacccagcttcagtacttataagctacctacctttgaggattattgtgaagattaacgtccattggttgttgttgttctcatcagcattattactgtaggaaccctggaagtctcccctacccacccaagtcctattgcactttctatcatgacagaccatttctcttttttgagagtcttatattacaatgcagacacacctgagagggctaatgcgtgaaggtttaccagccctcactttaggggtagagataattagctgacagcttatttactaagagcaaaatagaaacctggggagagggacataaaagaaggaggagagagtttacaaggagaagcccatgggccccaatggccaattttccttccacgctttatttagagtacataggcctctgtgtttctacttgtcattggagagaaacctccacacaccagcatagggatgaagtgaagaacagtgaggaagatgcctgcccatcattctaggagccctcagctgaaaagcaccgtattgggccctagagaagggaacagagtgagattacagaaaatgccccagatctgctgagtcccactgaaaattcagagcttgcctctaaaaaataaactgaggtagaaacaggtagcagtattttaataagtgcacatttacagagtgtaaattgaatctgcctggcccagagtgtggtactcaataaatgtttgttgatggatggattgaatgccctagagtgaggagcacgtagtggaatgtcacagtggaaaaagcccaaaggcttccctgtattgtctgtcttctgccaccagaatgtcagctctatgagatcaaggacctctctgtcttattccctgctctatcccctgcacctacaacagtgccaagcacaaagaaaagagcccagtaaatatttgtggattgaataagtgcatggatgggtgggtggatggcacaaataacgaaaattgcttccagatggtagtgggattggggatccagcatcgagtacatattggatataccttaaatgttcctccaaagaattgatggatagttggatcaattaatcaaaacagagtctcacgatgttgcccaggctggtctcaaactcctggcctccagcagtcctcctgcctcaacttcccaaagtgctgagattacaggcccgacacctccaaagaattttaaaatatgggtgaccactttccttgcaaggataggtaaagagaggagaaagtgtatttgttagagtgcagttaaagccaagctggtctgatatgaaggaaatattcaagaagaaacaatttggctatttgtgggagatgggattaactgcccacataccacatacctaccacaaggagccccaggctttctgagccacatatatctacactcattcttgctcagttacatatttctttgaaccctcagacttccaaagccaactttcacacattgcacacaggtttgagtgcgatcagaatttttcactagggccctgttgttttattaagtacctaggcctccctgcagggcaccatgtattgaagaagatagaatgatacttgaaaaccacctaagtcagacaatgattagaactccccagatttatgggatggatgaacatctgaaccagcacagcctaaattacctgctggggggttgtctgctttggaagaggatagtttatagtttgaatggcagaagggtcatggggcattaattcagatcaaaaaaagggaggaatctatatgtatccacaaagatacatggcaagcatcactttttttcctgaaatatattgggctagaaagctaatttacacttcccctcactagtatataatactatagaatcttcaggttagaaaactcaaaagcaatgtgcatcttcatatagtatatactactagcatataatattacagaatcttcaggttagaaaactcatagtgaaagcaatatacatcttaatatagtatatgctagtatataatattacagaatcttcaggttagaaaactcatagtgaaagcaatatgcatcttcacataatatgtactagtgtataatactagcatatgacagaatcttcaggttagaaaactcatagtaaaagcaatatgcatcttcacatagtatatactagtatataatattatagaatcttcaggttagaaaacccatagaaaagcaatatgaattttcactccagtcctcttaccatgatgtttgcattgaagtgtttgtggtcattgattgctttgggcctctaaccaccttcttgtttgtcattttttcttttggaatttgggccccagtccaaacacattgcatcaggcatggtttcctgggtgaggaggagagcaggactatcacctcccttgttccacatactatatctccattgatataacctgagaacttgctagatttttgaaaattacatctcacagctgactaatattgaactatagttaaccaacattccattttctgaatgctgaatctcattctggctgttccataatgaatcattggtgctctgttctcaaggacaaggcatttcatttagttcaataaaattgcatcccaaacaatgtgtaggatttgttccaacattctaaccaaattgagatttgttttgatatcatgtttatctgatctaatatatgacctctttctctaaattttttgtcttctgttaccttcccatcaattcagcatctcatcattgggtttagttacatgattcacaagtccaaatgtcacctcttcagtgagatctcatgatactctattcaaaattgatgcccccacctccaatccagtacacttcctgtattctttatctgctcttttcatccattgcacatatactcattgaacataacatattttatttattttgtacttcttatctttctttagaatgtaagctctattagaggagcagtttttgtcagttctgttccctgctagatttcatatttgttgtatgggtgtaattgaatacatcagcaatcttattcaagtcagtaagaccaagctagaattctgtacattctactagaggttgctgcccctcaccaggttactactgaccttttggtcactcacaagtccacttaatggtattagcacccagctcaacttatcttcactttatccagaaggctatcaagagagtttgtcacattttttgctgaaatcagatattttttattggtgctagccctctgatctatcactctggaagttcttttccaaagaaaggaaatggaattcatctgacataacttatcacttccttttttctgactgcacacagatcatccttttgatgactcattataaatcctgctccagaaggacagtgcattaatcagtgacctgtccgaactctttgatttccggcagagaggtccctccaggtgtgagatccttttggctggggttcagggcttgctcatagactggctattagaaggtggagttagcaccacagagttggaaggcttaggctcagatgccattcttgtgtctcattgaaatattacattctttttttctgggtctcagtttctgcagtgcataaaataaaaagggtaatatttttaaaaatatagcatgatactttatttattgctatttacacccttttggtttcatgtctagttgctacatacagacaacaaagatctgagatttttttatatgtttagtttatttttactgctatttgatctaaaggatttacgtttatcttatccatttccttttttaccactctttctggcacagctatagtttaggcccttatcatctcatcactgaattattggagttgcttcctaactggccccacatctcccatctcttgcttctccatcttagactcttcaatcaggctaattgcctagaacctggctactcaaaatgtagtctatgaaccacagcatcatcgtctcttgggagcctgttagaaatgcagactctctcaggctccactcaaaacctaaagaatcagaatatgtaggtcaacaggacccataggtgatgcaaacccacattaaaatcgagaaccactgttttttcttctaccatgccattccccttctaagggatatccttaaaattcacattgaaccgggccaggcgtggtggctcacacctgtaatcccagcactttgggaggccagggcaggcggatcacgaggtcaggagattgagaccatcctggctaacacagtaaaaccccgtctccactaaaaatataaaaaattagctgggtgtggtggtgggtgcctgtagtcccagctactcaggaggctgaggcaggagaatggtgtgaacccaggaggtggagcttgcagtgagccgagattgcgccactgcactccagcctgggtgacagagctagactctgtctcaaaaaaaaaaaaaataaataaataaataaataaataaataaataaataaataaattcacattgaaccatctccgaactgtctcaggcagaaagcaatctaccttaattttcaaatgagatatttttgacatgaaagtgtaaattcccacctatactttcttctcattggttctgagaatgatgaattagtgtatctaaataactttagaacatttgtaaaaattactgcaactcaactggagactttcttctggtaggagccaagtatattgttatttggtgagtgagggttaagggaaccatatgtgatgggttagttggaaatgttcctattatttattgtgaacttattttgtgtttgacacagtgacaggtattttgtatacttaatttaatcctcataataatgccacttaggaaggtgtttttatcaccattttacaggtggggaaactgagacttaacaagtttaggttgtccagagtcacagttttggttagaattcaggctgcactgtagcatcaaagatgtcaaaatacagtggttgagccaagtggctctgccctgagaggactggtgaccccgagtgggagacactgatgctctctgaagccacccagcttccctctctcatgctgccttgtcatccccagagtgttgtccacacccatttgcttggatctggttcctgccttgggaagagcgaaagagaaagtggagggcacgcagttttcttatgaaaacataatccagaatttctacctatcatttgtactcacattctgctagtcaaagcttggtcacatagccacacctacttgcaaaagaagcagagaaatgtggaaacttggggagttatttactaaagggaagaaggggaatggctgctagaggaaaattgtaggctctgccataggctcctagccaatcagtggaagagctagattccaagcctatgactaaaacctgtgatcttttcatcacattttcccaccacttctcatagttgacagcaaatatttgttgaattaagataggccaagatattatatataagccttttgatcatttgaaattgtttcttccttctctcttgcctccctgattacctacacggttcagtgttcaaactgtctttgtttctgataatgttttaatgtgtaaaacaggaaactgataattaatcttcttcagtagaaatactataataaaataatctactaattattagaggttctgtagaaccatatgagatgtgataatggcttaatgatactgatttttttaaatgatcaaataaccatctcctttaaaataagtgttgtcttaggaaaatgccattgctgaaaacattttttgatattttggctggtatatcagttaactcttgctgcacgcactaatgcttcatgactccactaccaaaatctcagaggcacacagtgatatttaacttgtgtatctgtgggtctctaggggtcaactctttagcctgagccttcctggccaactctgtttcaggtatctattgcccttcttctgagatagcagactagcatggacatatttttctctgacaatggcacaaacgttaagagaacaactagaaatacttgaggctttttgaggcctcggctgggaactggcacaacctatgtcatgccacctggcaagtcatatgcccaaacccacaatcaagggccatgggaaatgctctacaccttaagtaatagaaaatgtagtcacgtagtagagggtttggtgaaggaccagggccaacaaagaaaccttcaattgctttgcctttcgcaagttattttgaatatttgcagtgatagtaaatcttttaaaggtagctttgaatttttttagtaaaacagctaagtttataaataaaattagagaatcaagctaggtttatttttgggcagaaaggtagctatttaagcatgtgttataaaataatgagacttatttctagaagaattgattcaagaatatggcatttgatgacagaatagttggaataagcatacagccttttaaggtgaccactttgaaaggataacactcatttaaacattgggttataaaatggtttttttttttttaaataagccttgtgacttacagtcctatgttaccactttgtctcaaagtgggaaggggagtgaatagaggcccatccctgatcctttgactaaccctagaaaaatgtgctttatgtgcagattcttattgccaagtcccctctggctcccttcacctcatttgtctacaccatcaaggaggaaggcctggttcttcaaggtaagatccttggattaagccatttctttaagcttatgctcagtgctgcccattgctagtggtaattagtgctatggttctgatagaagctagctccagacagaatcaaaaaccaagatgcattggccagtgatatttaccctagtgagagcaagagagcggcagttgtggcaagaatttgacagagaagattgaggtagggccgaaggagacctacagaatttcctaacagaatgagacaatcaaaacatgaggatcaaaccaagaaagctcggaattgctaccaccccattcctctttgcagatcctatggcatgaagtgggcaatgattctgacaccagtgtggaggtgaggagccagtgctgccccagagccttcttgcttaacaagctaaagaaccatctgggttggcagcctctggggcacaatgtcatggctccatgagccctacttccctgactccttctggttatcttgtttccttttcctgtcctgtcctgacatggtcttcctgctggggaccagacctttaggacctgcaccttgtgacgtgagcccaggacttagaaggagctgagttcttgcttagggtatagcaccctgaggccacatcctggaactcactgatctacaatggtgattcattctcagatgctagatacgccagtggttaggaaaggcacccgattacaggtctttccagaaagcaattaacatgaaggggtaaattccagcactgttagaagagtcagcccacaatgtcagatgtacaaaactgctttgtggatgaggaaggatctgcacagaagtgctcaggatatacatctgtcctctgctgtggggcaggagaccccaaccacagagatgcttaggtgaatatctggcctgaccctagaggagcatattgtcactgctgtccatgggagaagtcctgccctgaaggatttataagttaaatatttttcccaggtttatgaaacagggcagtccctgtaatttccccatggagacacaatgcagtgcaaagacctagcagggaatatgcagggcaggctggagagttcatgcttctaactaaggaacaggctgcagccttccctttccttccccttctaaaatgtctgcttcttaatggactcacaaagcggcatgtttgtttggtgcagctgagctccacagcggggactctcaggtccacgaaatttggggtgagaactacgacctttggctcttagcctttgacttatgctatccaagttccttggtaaatatttttttttacaattgcaaatagtgttttctgacaaaggagcagagattttaacaccagattaagcaaagcaaacagcaggcctctttgttacatactctctacgggtgtataactaataagcaatcagaaagctggacttttatttacccagtacacagggtggcattcagctcttcatttttagaggccttcttaaaagattagaagtatagtaagtagcaaatttcgttgaagatttcaagaaattctatggaagattacaagacaatttcaggaggaaaaaagtttgttctgctcagatgacgtgtgtgaagaggcttgatgtgatacacgcaccctgatcactaggcattttgttaaatagcatttctaagcccggtcaaatctggataacttttgggataacatttgtgagaagaagagtcactgagttgcctctctgatgttcattgctaagatcatgattttaagagggaagagaaagttatttagagaaagtagagcctggaaatacaatgaattggtagagtttaaaaaactgcaaggaatgacttttcgaaaaagttggaaaacaggggagaaagtggatcactaaaggaggctgacctggagctgtgtccaggaaagagaaaaattcaggaaaatgtcttataattcaagaacaacaaccagtaaataaaatgcttggttaggagacctcagaacctcacctggttgctttctaagttgttttctctatcccactcccccaagctacacatccctctctgaggtttcccagaagcagtggaacacctctgcttttaccagcaatgcccttgaaaacaaacctcttggcacactctgccttcttgctgtgtgctcccaaagactttgggaaaacaaaaaatgcaggtccccagaaaatgcaggcccctcatttactagaaagaacctttggattttaccttcagctttggtatgatcttgagaaaatctctgggccttgcttttgtcagctggaaaatgaaaacattaaccttgattcaagactttgaaaactgtcgcaacccattggtgggtcatgaagtgaaattgatgaatcacaaccagcatttgaaaacagagagagagagaagacagaagaaagagtgaagaaaaaatatcagattatatcacacatattgtttcatttcataaaatatttcttgtgtgattgtgtgtttgtgaatgtccacatacattatgagtttgtgtgggggctgcagcataaaacgtttttcttacgtggattgttgtaaccatcctgcgggatctctaacagccttgtcacatcagctttgtccgatcctcctaggagaggatgtactcatcattcccttagctcagcccagttgtacccttgagatctccacatactgcaacatcaaagctaatttttcccccttcttaccacatgaccaaactaaaagacacctgcatgattccccaggtttaaagcaaagaaacccttggtccctgggtggaaaacttggaaaggtaccatcagtcaaggccaagtagcttttcttacatgaggagctgcactggcaggtgagccccgagttggtgtggaggttggcacctggagctctgggtgggatgtgcagcccatgtccagggacttagagacagacagggcagctcctgtgctgccaactagaagggaggccgccagccactgtggccgacattcggtcttcaatagagccacctggatggtggaaacaagccaaccacaccagctacccgtgggggtagggaatgatccctcagtgccttttatcccttggcaagccccaagatgcctactggcctgctagcccggagattttataatacctgaagaactcctgagtgctcaagcagagggagggaataaaaggtgagggcagaattcgatttaccagctccacaggccatttccctcaccggttctcaaggattaggatgctgagaacagtcagcaactgggggacttctacccttccctcccctttgttcactgggatgggaaggacaataaagcggcaggctggagagactgaggggctggttagagatttctcaggctgctttttgaaactcttgaaggagccggtccatgctattgttgtagtaaaatagaaagcggaactattctccttttgcaaaaaaaaaaaaaaggaagaaaaaaagtaaatgaaagaacccccctcctcccagcatcttcaggaggcctcaactcaggccattaacatggtaataccatcctgtttgcatctcctttgtctgtccagcgtttgtctgggatcctggcctctggatgctggaaatacttaggccccaaaggagagggagctcacagccaccagtttcctgagggtttggactctgagatcccaggcagagagagagttgagcctctctgtgcaatgaagtgggaaatgttggggtaggaggggatctcatgaatccatttttcctttggtccccagagttcaccatgcaagtctcagtgcccactaagtgaaaaagctcagcagtttggctagcctcttagagtgatgctcaagtgtgctggggcctagtggagaggtaagagcaggagttggttctgggaatcagctttaatggtgtgtgcccacagaagcatctggcagcagaaaggaaagggagtttacagtgagctccaggttgacccacctctcctctggtcatgtcctttgttcccttagcaagccccgaatgttgtgccacccagaacacagctgggactcaaggccaagaataaagattctgtcattgaaagcagctgggctgtgttgctggcgctgcaggaggcctagaggaaaacccaggtcccagctctccgggagccctcctagttttcaggggctcataggcacaaacacctgcggacttggtgaaacagaacctaaggaaggggaggtccaggggaatgaagggttgatctagcacagcctccccgttactcctttcctcagggatctggggaggatttgtaaaagaaaagccaggttgtttggaacaggacagaagatagtggcttagttcctcagtaagacagaagtgtgttttttatatcatttttgcaaaatcaaagtcaggtatgacaggtttaatttggatcctggggctgtcgtctattagtgtaggtttgaatgagcgggagctggggagaccagggcaccctgagacaggtccggagaaggtgctggagatgaaattagtttcccatatctccaaccacttggcatagggtggcagaagaaaacagaaaacaaagcaacagcgatcttttttagagctggaaagctatgtgcctcatctttcttgctttgcttttgcaatcaagaacagtttgatcaccttttgaaatgtatcaggacaggcattaatctcttctgtttgttcccttgtcacaaacttgcgttaagttttcccaccccatttttttagtcactgagccagctggatgatttattgacaaaaatgtccccccaaataccaccacttgagttcatcagatttcagtttgaatcagtaacctatcaaaatgttttatgctgctggactcaaagtgacccagaagattctcaatttatttccatccaggtacagaggtatctgcatggtaaataccacctccgcacctggcacagcctggcattcttgtaggagcctgggcaaagagccctggaactcaatggagcaaagagagtgaactcctctcccagaggtcatggagaagaaggcaaagcaggcctgtcacattgtccccagcctgccaggtgccactgcagcctcggaaagtttgtctaggccaaggcgctctcctttgctgcttctgcctgcctcttagtgtgggacctcccagggagatgagaaaggagaggaaggactcgtatctgttcagttctcttctcccctgtgcacattcactttacatcccctccctccatgacatcttctcacacaggctctctgctttgtttactttttttttctggcaatcagccttgaagagagattttacaatatttggaaatattttataatatatgaaaaaaaattttaaatacagaacagtacagaaaatcataaaagaaaacaggtgaatctaacaccccaaataaatactaaaattttgtcccatttgtttcagattttttttttatttacaggaatgaaacttgacaaactttaggactcctttgtacctattcctggtccattccctccttatcccacattcctccacaaaagtggaaactctccagagtttggtctacatctttcctctccattcttaaaaacttttctacatatatgtgaatccacacatagtataatgattgattttgagtgcattctgaaatttgcataaatgatttattgtacacgatttcacaacttgcttttgttgcttaacactgtttttgtaatatagccatgtgatacacaggtcacatgatacacaggccacgtgatacacaggtcacattctttcaccttagatatccacatccattcagtgtgtgaatgtaccacatgctacccactcccctacttatggaaattttgattatttgtaacaattttattacctgtgcttcttgatgtttaggtatgagagtttcactaggtatatataaaaaatggaatggctggtcagagtgtctacacgtttccatttactatatcttcccaaattgctctccaaagacttttaccaatttatactcgttctggagatagtagaccaatttctctgcagcctcgtataatcgttaagtttgttgtcatctttccataggcagtcttctcatgccttctttagggatgcactgcactctagcctgagtgacagagcaaaaccccatctctctctatcttaaaaaaattcttcatttccctaaagttaactatataatagttcccagaaagtgagcttttaatctcatccatcaccctgattctcacttgaggaaactgagttccagaaaggtaaagtaatgttcactgcctcaaaattgggtttgtagccatttctaagccctcagcctgggctcctaagattttagaaaatccgaagtgggtttgggccctctcatcttccatcagggaagcccctgtgacaacttacctctcaggcttcatgagcctctgttgagatacttcaggcctgtcctgaaatttgaatctggaaattctaagctaaaatggattggtcatactgatacaataatccttcaacgaagtccctgagtgcagttagattataagtttggccaggtgtaactataacctaaactaacagtggtatacatgatagagatgtactgcttcctcctgtagtgccgaggaggaatgcagtccagagctggtttggcagcttagctctacatgtctatcgaagagcccaggccattgactttttgctctgtcacacctaggatgttgccgttaccatggtccagaatggttcagcatcatgccctccatcccagtagcaggatgtgcatgagatagagaatggtggtgggagagaaagcatcccccatcccttaaggacattaaccagaagttatacacattatttctgtttatatgatgttggccagtctgtaaatatatgatcagaaaggctaaaaatatagtcattaatctgggtggccatatacccagctaaatttcgggatttctgttatcatgagaaaagaaaatgaatattcggtgacacagccctttctgaagagcccagttgcagagattaggtgcaatagtacagacgtaagggctgggcttgttgcataatagagttatactcttaaaatgcagcataaatattgtatgtattgaaaagtgccatcaggaccctctttggttccagactctaaagtagaagagaaagggtatcacttcaccaaggatcagcacccaaaaatcttgttctgcccacccaaaacagaatctccttcaggaaggaactttagtatgtgttttgcttttatgcagtatccaggaaagaaacttcaatgagagctactattgcttatagcacaaggcagggcatgaacttgggtccaaagtcatagaccaaacacttttttttttccaaaatgttttttcctacctccacttttaaaaaaaaaatgaaacaaaatatcagttgaaataacattattgagaaaaactttattccaaggcctggactatagttagactggatttacatttctcttttagaacctggaagccacttggctatctttgcagagttaacaatttgcatttgcaaaaatggccaggtaacagtaccaaaatatgttaaatcaattcaggttgttgattttctttgaaagtctcttccaaagaacttcatgttctttctggaatatgatttaagctgcatttcagtgagttcagttcagcaaatatttgttgagcatctattgttcacaaagcatggtgctcaggggtcaagagatataaggctgaaaaaaaaaaaaaaaaggtcccttccttttagtagcccagaatctagttaggagagatgtagttaaataagtttaatcaaaagccaactgtgatacctattaccaaggttcaaacagtggaatatagaaggataaagggaatagacttattccaagtaggatgactgaggtaggttcttgagagtacgtgggacttggactggatttcagcttgtgaatactgacaaaaaccgcattccattgtctcttgacagaagccaatttcttttgctatttgaggatagattcagggacactggggaatgctgattagttccatcactaatgctgattagtagtgaatgttgagtcatgctgactaatgtgttctaaatggattgactcaacaataaaggcaacgttgagagtcaagagttcagatcctgaatttcaccgatgaagtgtaaatcatttcgccacttagtgcttaatttttttgtcaattaaaatgtgctcgtgggtgagaatccagtaagtcatcttgacccatgagggctttacaaacttcaaggataacagacagcttaacagcaactaccaggacaggcttatgcaacctcaggttattcatagctcacacagagtcagaacacccatcacatgctgctcgccagccatgcgaaacttctgtttcctcacacatgccatgagaactgacaaacagtgcactgaactcacaaaacccgacaaatagaggagcttttgaaaaatcttcctatctacctactggggtgtctgtgtctttctacaacaaatgtcgccacagaactaagggcttgcattgcagacacagctctttctctcttttgacatctccccagctagactgcttgagaacctggccttccatgtccagatgtttactgaattctgaagccctcccagagagcccaggttcttttgttgctctccaaatcatttcccacagaggctgaccagtgtcctgaaggagcccttcaatagggaggataaatgaaggcagatgaagacatgaccccctgaggcttgcccacatccactggaacaaagggtgtgaggcacaaccttgtaaggagtgttttggtcagccgcgtccctatgcgaggccaagtctcccccacagggctgctttcaatggctaccatcatagtggaagtattgggcatttgttaaggactgtggtgtgctagatatagcacaaaacatctaaatcatggtcccctgcctttgtgagggcttcctggctacagatggcagctggctttctcaggggaaacttgggggtcatagagaaagctgaagaggggtgcttgcttctgtggatgacctcttcccacccagtgcagcgacactccccttttgtctatagctatccttagtcaagccagggctgcgggaccctaacccacacttccgctgtgtttctggatctctggtttgcaaggccagtggctctgtgggcaatacgtatgaaagaggactgctgttggaggaaagttccatttaggttgctggtgggaagttagtgcatttcataacaatttttttttttcaaactttctcttttttttttttttcctttaggccaagagaagccatagggatactgtgacctttgtctagagttgatgggggtgtgatttgtgaaataaaacaggaccgtactgcttggaagaaggaaacggaagctgacataatggggattaattagttgattgctgttgagatggtaacagatttgctcctaaaccattgagctagcgatttcagacctagcagggaaggtgaagatgaagaagcctttgttcaggtctctagatgtgtagggctgagggctttgccgccatgggatgtcaacagccataataataatttgcacttatatagcacctttcaaccaggcacctcaaagcggtttaaccacattaattaattaaagcccacaatcctcctggggagaggaggaggatgactaacaagatttgtaattacaggagggaacatttccgaataaagtattgtctaccagataaaaagagtaggtgtaaaggaattggggtctccaaatagtaaccgattcagaaatgaaatcatggaatgatgtgggaggctgggggcgggcatgggcaagggggtcgactctgtgtcagagggaggtcgatgggctcagaattcactgacaggttcagatccagccgagaagtggagcatgtatggtattagtggcatttgaaggtcattagtggcataactattgtagtgtaaattcaagttttattggtatattgtgtatagccctgcagaacaaagactgagactcatgcagtatttaataaaggatgaaatgatttctttagatttaaagcccaaagctgggccagtcaattagcaaataaatcaattggtgacccgtaggataatttagtcgtttccagtagaacacccagcctacacactcctactgccatgaggctctgattgaagcatcagactgggttcagggcaaggtctgggggctttagccccttcaaagccaggcattaaatctttccagcctttggccttgtgacctatcttacccaggttgttagtgacctcaagctgtcctctgtagaatcactttgtacctgctcctccatcagagatttttagtgcattgagggctagaatcaagtctcatcctatttcatgtctcctatgagtgcccaacagagtgctgtgcaccaagtaggtgcagattgatgaagattgatgaagaaagactgagtcctttaacgactcagtatttgttgagcgcataccaagtgctcaggtaaagcttgaaaacaaagctcagtgtgtgcctgccctccaaaaatgtactccaaggaatgggaaaagacttacaaactattaactataatataaagcagaatcacatccaagccccgggcagcaagggcaataggaagagcatcttattcagctggagtgaatcagggaaggtattggtgtgctgtgcatcggaaggcaagaaggatttgggtagacctggaagaggcagagcaggaagatgtcccaggctgtgaccatgtgtctccctctgagtgaggtacattttgagaacttgggatgttcaatagaatgttggtgaaaaccaaggtgagttttcgtatttaatcaggaaatatacatttcctgtggattcttatgacatgaattggttaatttcagacatcaagggactatttgagaagttggaggtagggttcaggatacagtactccaaaatccggcacgttggccttgaaaaaacagcagaggcaggaaggccgttgtcaccttcccctcacccctcctctcctgaagcaggttgtaaaatgttcattcctgaagtgttcactctctacccagaggaaaggaatgtccttatctctgaagacacagggacagagaagaatctgaacaaacaggccttgctaaatttcccccagtttattcccattagatcatactctttagtcctccaatcatacttctgcctgactgtctactcttcatcaaacttaagcataaaaatacacagatttccctggtttgggggtggtctttcttcttattcttctttttttttttttttttttttgccagagtctcactctgtctcccagtctggagtacagcagtgctatcacagctcactgcagcctcaacctcccaggctcaagcaatactccaacctcagcctccgaagtagctgggaccacagatgggcatcaccacacctggctaattttttattttttgtagagacagagtctctactgtgttgcccaggctggtcttgaactcctgggctcaagtgatcttccaggctcaagccaccttcccagctcagcctcctaaagttctgggattacaggcatgagccaccgcgcccagccaggtcttcatttctaaaggttctcatgtcacataaaacttacgttaaataaatttttatgcttttctcttgtaaatcttgttgttgttgctgttattgttgtttgagatggagtgttgctctgtcacccaggttggagtgcagtggcatgatcttggcccactgcaacccctgcctcccgggttcaagcaattctcctgcctcagcctcccatgtagccaggattacaggcatgtgccaccatgcccggttaacttttgtacttttttttagtagagatgaagtttcaccatgttggccaggctggtctcgaactcctgtcctcaggagatctgccctcgtcggcctcccaaagtgctgggattacaggtgtgagcccggccttctcttgtaaatctgtcttttgttatgggggccttggccatgaaccttgcaatgcgttcatgcaagatattactttttctcccctacagtttctggtgcccaatatggggtgactgagacaccccactcattctggatcttgcagatgagatcctggggcaactgacaaaaagctggaaaaattagaattcttatcaaagtcagctctcccagatctctgtctgtagtgcttggtcaagagagacgttagaaatttctccttgtcccttccttcccaaattcagattatcaggaaaaaaaaaaaaatgtctatattgtgactctctgactaaatctggctttaaggtactcgtttgttactgatcctttccctcgcagggactgctgtctctttccttgtttttctcaatttctgtcctgataacttggtttgattttctccctgttggggcatgcaagctgtcttgagttccccaaccaacttcaggggagggaactcaagaatacggctggacagaaatgtgggttgcaccctatttccagctatcctaccaagtattgccagctcttggggggtttatttgtatatttcttttgactctctttgggggtagttctggatttgggagggctgcactctcttttgagaaccccttcttagtccatggtgaagtcataaaaggctctttggttttggttgagtcacttagtaggtactttcagtttaaaacaagaaaaaggtaaatgtatatgtttttctcttgttaatctgtgttttcttgtagtgctctcagccacgaaccttgagataggtgaggaaaatatattatttttcctcccttacattgagcaagatgctgtctgttctctgcaactcctaattgttctctcttcacctccattgtctgccacgaaaaaaaaaatgctacattgttcacacattaaaatggatcactcaaaagtgtctgaaaaaagcaagaggaaaacatatcctaattccaaatgtcaaaaattaagtggctcctccttgagactacctttttgaccccaagaaacaataagagagtgccctatacccagtgtttgacaaaccaatacagtactctcctgcccaaggccctccaggccttcaccacaaaccatgctgcagggacaggacgtaagcactgcctctgatatggagcacttgctgcgtgtctgacacacactttacatacacaatcttctctaatgcttccagtaatcttacaggtagaattttgtattattccttctctacagatgaggaactgaagcaggagaggttcagtttgtcaccagaaaggatgaaatgtggatttgaactcaggcagttctactctcttttctctttcatcccttgccctgtaatatttctgttcacaactcttattcatcctaagttcactaaagtactcagcataatactacacacacaatagtaaagaactcagtgaatattttctaaataaaagaatcaccaggaacaatgctagtagtttgatcttctactctgagcagtgatgctcagaatatagtagaggttccatcactgccttatcatgtcaccatttttaaggagcagaagacatgcacaggaaagttgccccaggaaatgttcacaagaaagaaggacacaggtagcattcttccccgtgagctgataatctgccaagctggtaccacccatgagattctagtgtggcattttgtatcattaattacttttactgaaagtaattacttttactgaaagtaattaatgatgcaattcagagatattttaggggtgtgtgtgtgtgtgtgtgtgtatgtgtgtgtgtatcaaagttcaactttgtctccctaatcctgctagccttctggccattctattaaggtattgcagtcctggtgaagattcagaaatgtgtggtccccgtcagcctacagggtgaacattttggattaacccagagagccttgaactctgtgcataatgtcttttaggttgtgtgttgtgaacaaagcaaaatgactgctcagagacagggttgtaaaagtttgtccagcaaaaccaggattgccaaatgagaattctggaaagggaggataaggattaggtaatgggagaaaagtgagtgaaggcaaggagaagtgcaaaatatctgattctagcctaaaaactggtcttggaaccatttggaagggtcattttttccatgttttattttcaatatcatcaccatcacttttatcctgtggctgtgaaaggactttcttcattccactccagaattcaaagaggcttcttttgcacaaatggagggaaggcactcatcacacttctcagccaaacatcctaagtgtgagagaaaacacactgcctacttctgaatttcggtgagggcagggttcagatggaacacatattttccaaaactccaaatagatctgggaggagaggaaaccattaaatcactagacataagtcaggacacatttggttttgttccctatcaaacagtccccccaaatctcagtgacttgcaaaatccatgcatgtctgagactctccagacaagctctccatgtgtgactcaatattgcacttcagtattaacatgcactgccacagttgccacagtaggggaagggaaaggtggatgggggagagagagaagaaagtaagaaagagagagagattgagcactgataattaagtccttccctcaaaaaatgatatacattccttctactctcctggccatgcagccactcctaacttccaggaggcaggaaggtaccacttcctccatgttctgaaggaaaggggaactggatattggtgaacacctgtaatgtttggcatgcacagctatacccagtgggcttgcaaatgtttccttcttccatattcacgcttgtatatacctttccctcagattacctggcatacatcaaagatttatggggtagtgttcaggaagaccaaacagttttgcagcctattttagtccacaggtgaccttttgaaatagaggggtagccaagaaagaccagttaactctgggtacttttcccctagagctttcagacacaagtaactctgggaagggatagtgggttcaagggagccatggcctgatttcaatgacacattcaagatagaacaactagtttgagtgaccccagaccatcatgccttgtgtgaaaagacttttggaaatgtgcccttccatttccattctgccgcttgttaccagacatgatgcacgttccttcaaagccctgtgacttttccagaaagcagctctccctgcaagagagagaaactttcccttattattctttcagtaatgaattcctgctctgaatgggctgcctccatgtgttttcagtcaagtgctgatggcagccttgcctgggggcatttccaaagctgaggacataagagatgaaggaggtctcatattgacaagagctgcttttggttttccttccagtttagccctcctgagccttgaaatgggagataacaaatgattcatcagttcttgttggtgaaccaacatgaccaccacacctctttgctcctttcaaccaatgaaaaaatcatgttttaaagctttcctcagagaggtttgtggacctggattttggtgacttaacagggatttaactttctcagaccaaaccagtattttgtagatgccaagacttcctttcttcaggtctcaaacatagacttcgcgtaccctgaggtgataagaacaaaggagaaattaggtcaccctgtttcctgcctaaaacctaatctcaagtacacaagctgcttccaagtaagctgtggtggtaggccatgtttgctgagagccagcccactcactctccctaaagcaaatgtcttcagacaataattcagctttcaacctacctgcatgaaacttgtacaaacttttagttacagttgggctattttctttctttttcttttttttttttttttgagacagagttttgctctgtcgcccaggctggagtacagtggcgcgatctcagctcactgcaacctccgccttccgggttcacgctattctcctgcctcagcctcccgagtagctgggactacaggcgcccaccaccacgcccggctaattttttgtatttttagtagagacggagtttcaccgtgttagccaggacggtcttgatctcctgacctcgtgatccacccgcctcggcctcccaaagtgctgggattacaggcgtgagccaccgtgcctggcccagttgggctattttcattgggaagaggagtctcaattatctccggtaaaaggggacacatactgttaaggatataggtggtgcagaattggaaagccttctggaggggaggcagccctgggaattcattatcctggggtctctgcttttctttacatgtctgcccagggctactctcactctcccagcagattttgtcctgcatactatagtttatttactcaaaacttcagtttgcacatggctcaccctgtgtttctctcttagcctttcaacttcagttcccattggcttttttccttggttaaaattctgaagagagaatctgattagctcggacttatcttagtgttttgtctcagacaacatcattggtcactggctaaccaaacctttgttggataaggaagtcgctgaaaacatagctgcccaagcagcaggaggtgtgggaaggccagcttttcctagaggggctgtgagagggcaagacagtgatgaactccagggcatgctttacaccctctaactggactactgcaagcatactcattccctcttgcttcttgctcataactgtagacctggtccccttacaccctcacagcctaggcatctcttttcactgctcacctccagcccctgactccaggatcttacttctcaccctgttaaagtgcccagtcacagaggtataggactagtgagtgggaaggaagagctgttgagatttatttaagaatatacagaagattagggaaggtgtgtaatgaaaagaggaatgaaaataaaatccctctctcagctaaagaaaattgtgttcccaccatgggacccagctacctttcctccttccaccagtctttggagttacttccttttcaaaaaaaaacagacatcagcagaagcaagaggagcttccattgaggaaccctgaccaagcaagtgggaagatattctctcttcattaacccccaaggtcttctctgtcccctgcaaggatcccttgtccctatccctgatccttgcatttctccagcccccaccctcaggtcttgtaaagtccagattcttgactaagaagtcccaaataactttcaaactaagattttaaaacacaagtgaaggactcggtttggatcaagtttttgccaattgtgttcttagtgcccaaagctctttattggaagttattcacaaatcttcatgatggtttttggacgactagtcacgtgtggtgttgccctatttcaaatgagtcagagaaattgtgctttatatgaattcatgcatcaaccagaggattagggggaaaactgaattgtggtagtatgctttaccatttattcattagatactattacttttgtacctcatcagatggctaaaagccaaacccaaaccaaatgtattcaaatttcagtctgcccatattatttttagtggacgtgagtctaggagtgaaggagaggctagtctaaatgtctgtgtttccttgccctttcttgaactccgggtatgtcaaaggtgattaaatcattggtcaaactttgtcctgtgactgacacttttatctagtgactagaattgcaacatttccctaggagcctatgatagtttttccaaacctgctactgtggggttctagtcagttcctccagagcacctccagatccctgcccattctatttagaatcggaggtttaagtctattgccactggctgtcctctggggcccagaaacctatatggggtttgtccagcctctcatcccagcaccatcgtccaaaccccacagtcattaccaatctaacagcttgaaagttgatacaaagatgaggcagaagccagtttggctttctcccagttctctgtgcccctccggagttaatcaacaacgacctatctttgtgtcaataacataagcctctctaactagaacacctggtgaaaagccggaggaaagcttaaaatgaagcaaattttgcagtgattattctgaccctcactgtttaagctggactcaggatctccagacaaaaactgcttgttaaacccaaccaactagttggatgaaccttaagccaccttgggttttgctaatatttttcatgcccacacctcaactccaaagtctgtaaactttaagcatcaactccccatttcaagcacacagggtttagtgagatggcctgagttcatctcgctggtagaattctttagtggcatctcctcatccctttcccaccctcaaagcccatcctgatggtgcggtcacaccactggagaaaccatagaccttcttaactgggattaccaacaccttctcttagtacgtattcacatggccttggatgttaggtgactgcctgttcagagaaagtggggagggtgaaagggagtgaaaaggcagagggcacatggacaacagttccttgctgtattcgtctgctcaggctgcataaaagaataccacaaactgcatggcttaaagatcagaaatgtattttcacacggctctggagactggaaatccgcaatccaggctccagcaggtttggtttctccggaggcctctccccttgtcttgcaggtggacgtcatctctctgtgtcctcacatggcttgttctgtgtgtgtgagctcttagtgtctcattcacttcttataaagacactagttctattggattagaactagtatcttcttgctttttattttctgtgtatccattgtatgttttttggtttgaggtcaccatgaggctaggacctcatatttatgaccttgtttaaccttaattacatccttttgttttatttttggttgttgatcatgatgtacaattcattacttttttttctttttttttttgagttaagtctcactctgttgcccaggctggggtgcagtggcacaatcttgactcactgcagtctccacctcccaggttcaagcaattctcctgcctcagcctcccgagtagctgggactacaagcatgtgccaccacacctggttaatttttgtatttttagtaaagatggggttttgcaatgttagccaggctggtcttgaactcctgaccagaggtaatctgcctgactgggcctctcaaagtgttggattacaggtgtgagccaccatgcctgctcattaattaccttcttttaaaggccttatctccaaatacaatctcactggaggttagcacttcacatatgaattttgaggggacacagctcagttcataacacctaccataactgttttcctcacagaacatcccttatcctctgatcttgcccttcttatctgattgggaaaaaagtagatgctggccaagaaatgcaagtatgactatgcagtttgagaattgctaagctaggtggggagggtgcatgagacaggaagaatgaaaacgtgggtggatggatacatgaatggatggttattacatggaaagacaaatgaatgaataaatggctttggcagtgtgttgatggcaccaggacagaaattacgttctgtttctttagggtttgtcttttttttttttttttttttttcaataatacagggcttacaaactcaaatgtgcatgccagacaggtaaaaagagttgcaaaaagaggccaggtgcaataataggcagttgtagggactgacagattagagagagcctaccgtatataaaggggcaccagttactgacaaagactctcattctgaccaaacttgagtcaggctcctctgagtcctctttctgactaggccccaaccttgggctctgtccttggcttgcttagtccagttttagcaagaatcctgctaagtcaattgagtgaaaattccccaccctttgtatttgatcaccctcagtacctaatcaaattcctcagcccccacccttaataccctatcacccttgcctgccttcagtaagaatcctgccatgtcagtttagcgggaatccccctagccttggtgtttcttcttagtaatttttcatccactgacatccaccctgctctttggctacacattatcacttttccttgttgtattcggagttgagcccatctctctccaaggctgcaaaaccccattgcagtgttccttcttgaataatgtcttacttaaagtctttaacaactgtcatgaaaaatttctctttcacagtctcagctctagacaattgttatcttgtgggatgctgacctcatgttgccagaatgtcggattttacaagggaagccagaaatctgggttttcagataaattttttcactatttttattttatttatttattttttgagatggagtttcactcttgttgcccaaggcggagtgcaatggcgcaatctcagctcaccacaacctccacctcccaggttcaagcaattctcctgcctcagcctcccaagtagctgggattacaggcgcacgccaccacgcctggctaactttttttttttttattaaatttttctttaaatcttgaaattcaaaaattataaaatattgtataagccaaatgaatgctcttgtagtccgaatgcaccctggaggctgccagatttcaactcttgggatgctagaaaggcatctgtaatgttatcacatgaagatatagatgcttgtgagtttaggctcatgagtagactgcctgggttcatactgcaatccaccacttactagctttgtgatctcaggcaattatgcatataattcttagagttattataaggttaaaattatttaatgcatgtaagtacctagaacaatgcctgctgcctagtaagaaagcagtaactgtgagctggtattattagctagtatcatgaaatctcttggtttccaataataccatttctgtaaaatgggggaaacccacttgccttttttaccccctaaaggcttgttgtgcaagtaaaagaacaactgtgaaagagcttgaaaaagtagacacattgctaagaaatacaccaggcatttctatgttcctattcccacagatgaggcacagcctttcccagtgcagggctgggactctgtaggaagaggaaaatagcagtaactagaaccagtcctttattcttctcagggtcatttgctgttttgttgttcttagaatttggtgagtttttctttttctttcttttttcaattatgataaatttcaacattcagaaaagtaaagaaaataatataatgaacacccaaatgcccttatctagatttcctaattattacatttggcagatgtgcttcacttggtgagttttcctggcagatatatgtgaatggaacatgcagagatgtggtagagaagtggggagaattgcagaataaagacagactgggaagctgagagccgtaactaccgcagcctctacttattttttaaacttgtaagatccaatcaagtgtggatggttgccttttggataggaccctggagaagggacttctgtgcagaatggtttgttatggagaatacattgttagcaccttaaagaaagtaatataaatgggataacagaaatgattttattatttatgtgattttaatttatttttaaagtatcaattcttttgcaaagagaatatattcatgtattgcttatgtcattgaaaattaaaaatttctagagagactttcaatgtggaaatgtctctgccatgaagaactcaggggttgaaacttgtggatctgagagaagtctgataaaatcagtgatttaaaaaatgttggtcactaaaattgaaaggttttaaaggcagaaacactccgattcaaagaaagtatatgctaattataagtgattcgtttctggtagattatttgaaaagattctctaagacatattgccccatttctcaacatcaactattactgcatttaaatgctaactcttctctctggaaaggatgtcttaacaacatgaaagcaactaaactttgctttaaaattctattattcagactccacattaatttaagctgacactccttctcaattggggcaaatcatcaaagctttattgtattgagaaccttgaattcagcaacaaagagcgtggggtatggagggaaaacgttgagaggggaagggtggagagctcccaaggccaaaagaagggaggggcagggaggaacactgcaggaaggacagcagagagaaagatggaccttggagaggccaaggggagagcggggagttagaaaaaggctgagataagcaatgggaggcctcctcagaggggccttacactgtcaaactgcccctggagcctctgctcattaacatggtagaagcaaaactagcctacaactttgtagtcacaaatttttctccagagttatggataaaaagggagctaggagatagagaaagggaaaacattccctttcttcctacatttggatgcctctccaatgtccttcctaaggcaccctgcccagtggccagtgcctgccagtaagcccactccacagaccctgaggcctggagccccagccctggtcatggattagtgcctggccaagttgcactccaaccccaggcccgcagccgcccttcctcctcctttctgttgtgattgactctgagatatatgatgtgggatatactaggtgcaacgcatcatgttcgttattgaggcataaggtaaggaaggatcttttgaaatgtgaggacatcatccacaaactgtcactgaccatttacgatttataactagaatgtaataagatttataagatgcactttaaagcctaaaagaaaactgagttttttcaacatgtaacaacatgtaataaatattaatttcaaaaaccaaagtagccccagttggtcttttctctacaccaaaacaatcctcaaggatgcatgaaagcccatggacactgtggagcagacagctcctagtgtccagaaacccgtcttagtccaagtgggggggcactgcaagaattcagtccccagcctaccaccttccagctctgggccctcagagaatgcccatagccttcccgagtcccaattccccagtttgtaaaatgggaatagaaataatctgcctaatcttcatgccagggggcctgtgaagatgacagggtagataaatgattggttttccaaccttcatggaaggcctaagcctgagtctatgacctcctctccagttttaagacataaatcagatcatgccattcgtctgctcaaaactctcaagtaacgctttttcactcagagtgaaagtggagtccttccacaggcctagaaagccccaccgattccagcggcacctgcttcttcgcctctcacagctcctcgcttgctcacctgttgcagccacactgcctcctagctgaaccctctcacaggcaggctttcaccttagagcctttgcacttctgaacccttgctggaacccttttctccagagtaccatagctgactccctcacctcctttcctcacataatggatgactccctcacctttaagtttttgctaaaatatcaccttctctatgagactgacccacttaaaattgcaacccgctctgcttacccccatcctgctctacttatattttcccaaagtacttatcgctatacaaggtaataaataatcaatagctcacaatgtttacccttcattctgtgtcttctctgctaccatataagccctggagggcagccgtctttgatttattcatttttttcttaagcacctagagcagtgtcaggtatattaatgacctgcaataaataggttggatctttcttagaagtccaggatataacatcaataaaagaagggctgctacaactgaagggatttgtgagctcaaaatccctcctgctatctctctacgagcaagtgcaaaaactgctgacatttgttcttgtgtgtgaaaccagttttgaagttacaaattgctacttgatgtcaggtccaagggcctacacaatagcttgcacatagcaggtgcctagtggtacagattataaggggaagggaagtaacatttgttgagcagctaccaaatgataggcagtgtctgtgcctagtgaactatagaagtgatttcatgaaactgtcaacccttctaccattgtctctccaggacctcataccaagcctggcatgtattaagtactcagtaaatgcctgcttatttccctaacaaccctctgaggcaagtaccattatccccatcttggaagggcccaagattcagatttagatagcttgcttaatgtcatacagctcgtgatcagagccaggatttaaattcttctcagacaagctgcagcctctctgatcctttgagagaatgtacattagcatccctccgagcttccctgaagcagagctgtctcccagcgacaccggagatgaggggaggggtctctttctccacctggactcacttcctccctttgtgcatttggctcacctggaggggtcccctgctaccttttgattaatgggtctgcccttcccatccccccggccgaatgaccccagagttagctgcagttcatcttgaatcataaatcaagttctcaaagacattgcagctttgtgctcaaaatctcactagaattcacattctttgtgaaaggcatttgcttatgagtagaatgatggattcatcaagtctctccttttaagaaaaatctggatggtatctgctggtttctccctgctccctccaagaaaaaaacagccctagttactcaatttcatgtagttagaattcccccaaggacctcatactcagcttccaccctggccatactaaagaagagccccaatcatgttgccattttacatagatagaaatcatttgcaacttgcacatttgttgtgctttccatatacccacgattagctcggattttattttttagccattgctgaagtgtcacgcgtcagctatttacactgtatggggacaaaacaacctaatgtatgtcccagacctattttatagaagccgagaggcagcctctgagtctccggttcccagaactctagccctgggagaaagcatatccataaatctcccaatgctttatgccaggttagaatttctcttgggaattttggagtttgtataagagttgcctctaaaggcaattgatgaactatagatgtcaggcgggttttcattttctgtgtgctttttatttcatctagaaccaacagtggcctttagaattggattcttttcagagactctctctataggtttcatgttcaaaggctccaggttggaggagctcgaggttcagctgagtgtcagaaatgaccaattctggctggacgcagtggctcatgcctgtaatcccagcactatgggaggccgagggaggcggatcagttgaggtcaggagtttgagaccagcctggccaacatggtgaaaccctgtctctactaaaaatacaaaaaaaaattatctgggcatggtggcacatgcctgtaatcccagctactcaggagactgaggcaggagaatcccttgaacctgggaggcagaggttgtagtgagctgaggtcacgccattgcactccagcctgggcgacagagtgagattccgtctcaaaaaaaaaaaaaaaaaaatgaccaatttcaccagtactgctctattagaaaaagggtgggggtagttcttcggttttgtgactatcctgtgtactggaggacatttgtacttgcagcctcatccagaaaatgccaggagcattccccgaggcactctaacagtcagaggtgtctgtgggcaatactccaagcacccccggttgaaaacaccaacaaggctatctctgaaagacggtgaactggggcagcaccactaagtttcaccatcagtgaggcgtcagtctagatgggcactttctttccactgtaagctgcttcctattcttgttgcctttgatgatctttgtttgccttcaagtcgggtttgttacatttgttttcatctccaattcctgccatataaaaatgagggcagtgagaaagagaaaggaaatactgaaattttccctcggactatagcctcccaagaagggtcgtgttctctggaatgacttttaactctttatccagttaatgatcgggaaagtttactagatgtaggttcccaagcccagcaagcagagtatgtgataagagatagaaacagggacagaaaaaaatggatccatcaggacccagacattggggtgcaaccagtgggtcttctccagctccacagcgcatcagttctgactcgcttgtagattcctgagtactgctcatctgccctacaaggcatagtgggttttctctgatttctagaaatgtcagcattctctgcaaggtgaacggccagagtcgggatcttctattcaggcagagattatataactccctgggccctggaagagcatgactgtctaccaggaaccatccagagaggctgtcagatgaatcagcatctgttcatgccctgccttgcttctcctgggcatgactgcctcacatgccaacacccaggcttacaggtcaactattccaaccctgcatcctgcccaccccacttgctggggagtgctctctacagctctcagtgcatcctgtttgttcagacccctttgtcttccactggcgcaaccgagagaggattcctccgagcccctttgcttttggctttgaaatcagatcctggcacacctgattatactcaatagctggaaatggtaaggatgtccgatggcagagagctcttgttttaagttctgcatgccaggaaggcagggggctgggtctccttctcagggctaggctggaggggcaggatgctctagcggaggaagcagtgttaacttgaagggaaacgcagttgaaaaggaactcgaagcacgggctgccaagcgcgtagaagtggtaactgacgacacactgtggggctcagaccccttcctctctgctcatatgcccctagatgggaaacattcagttcctgctcaagggaaccaggagaatcaaacctgtctgtcctgctttttctgtagaagtgtcagctctgaggccttgactaggtggaataaatagtgacttacctcttaaccacagtgaaaaacccatcaagcatttggatattaagggctgcccctgtgttctcaagggaccctcagcctcagacactgcctcctttcaagcaaagatgctgccctaacacgcaagtccagtggctttaagagtcattatgaaaatttcacacaaaaaggcacaaagagcatccatgtaccgaaacccagcttaagaaatgaaatgttactgatgcaattaaagccgcctttgtccttttggtcccatccttccatcctgccttcccccagcagtaaccactcagtcattgacaaacagtgtgtcaaacatgcacaaacggtgatgtgtccatccctctttggaattacttaacctttttgaacctcagtgtattcatcggtaaaagggggctactgacaggatgaaggaaaatgatttatgacaaatatttggctgttgttcctataaaaaggaaaaagtcaccggaaaaaatgggtcaaatgtaagaccctttccagcctggccccaacttgccccggcagcctcctctcctcttgtagccatattccctcctctcctctctgcagcagtgttccccagatatgccacctgtgtccatgcctctgggccaatgtggatgctgtgcttacttgcctgtaatgctggtctcctgtcaccatcttcctttaacactggggtccactgtccccacctctgacagggcccagatgcagtgactccttggtgctcccatggcctgatacctctgtctgagcacttgccgtatggctgtgatgttcctggtatgtctgcctggctttttcactgagctgcttatgcagcaaggcagggatggggtcttctccatccagtggcctggcctattgccttctggcgcatggcaggaccatatgcagtgaatgaatgaattccattaagaacattcgtgattcataggaggaggtcaaaatatcaacattaacaggagcttggaagaagctgatttccaccctcatgaatgacttcaagggttcaggtgcatgagtaaatgacagttccatcaacagactacaactttctgccctagttaacacagggcatctccatgtccccagttctccctatgggcatttttctctttgaaattccaaatcttttctgttctagaagcacgaaactacaagttctctctcaactcttcaaatgaggttggaacaaacagaatgggggcatgaacttttttccccataacttcaataaacaacagttttagcctcagtaggctttatgcaagccttcaacatctttttctaggtatcttgacactcatgttctttttcttcttgcagcctatggaaattcctagagacagataaatgtgcaaacctgttcatcttgccaagaaaaatccgcttttctgccacagaaacaaaatattgggaaagagtcttgtggtgaaacacccatcgttctctgctaaaacatttggttgctactgtgtagactcagcttaagtcatggaattctagaggatgtatctcacaagtaggatcaagaacaagcccaacagtaatctgcatcataagctgatttgataccatggcactgacaatgggcactgatttgataccatggcactgacaatgggcacacagggaacaggaaatgggaatgagagcaagggttgggttgtgttcgtggaacacataggttttttttttttaactttctctttctaaaatatttcattttgatggaggtgaaatttatataagatgaaattaaccattttaaagtaaacaattccgtggcaactagatatcatgatgtgcaaccagcatctctgtctagttccaaatattttcatcaccccaaaagcaagacccataaccattatgcaagtgttcctatttccccctcctcccagctcctggaaacccaccaatctactttgttgctatggctttacctattctggatatttcatataaatggaatcatatagtgtctgtcttctttcactagtatgttttcaagtctcctccatggtgtagcgtgcatcagtacttcattctttttatggctgaataatattgcattgtcaggatatactgcattttgttcattcattcatccgtcagtggtcatttgggctggttccacccttcaactattgtgaatattgtactgctatgaacttgcatacacatgtatttatttgaaacctattttcaattttttaaggtatgtacctaggagtggatttacttgacatatggtgattctatgtttaactttttgaagaactgcaatactattctccacatggctgaatcattttgtatttccatcagcaatgtatgagcacaggtcagattttttgggagtcacattttaaagtggcacaagacccttctagagggctctgttccatgcacacaaaactcatagtctccacgtgaagacacaaatttttcacaaacatgcaggcagagaaaggagagaaagtggaccctcagcagacaagttgaaagatggttcagagaagcagtggacttcacccatcatcttgctgtgctctccatagctaagcaaggggcagactggagattccactggctactttgtcttattttcacttctttccagttagtccccactactctaccctttccacaggactgtagggttacggtgactttcctacccctagccaggttccagtggtgggggactctgtgaatataggatctagtgttcagagctcccagatttgtgcagactgaactctacacatgctacttgtcaacatctgtgagccagaaataggaggaacacctttaaaaagaaacctacaaacacaaagttattcatagatgctcttgaagggcaaagcagggccaccaccagagccccatgcaattagactcatcagagggaaagggcataacactggcttttttcttaaaaccacctggaaggagctgagacgtatactaaatgtatatagaagtattatttgattggaagaaacaaaaaatgcattgtattataatctgtcttcccttgccgtctggtagcttaactgtcagcaattttggaggaaagcccttcccagcaggggactgggaacccctgggcaatgtctttcctatgacacatggatctctatggttgaataaggggctgaaggaggaaatagacaacaggggtcagagagcaaggctagaggaggcctttgagaaaagagagttgtgcccccttttcagtgagtgtggggcctctggaggttggcaagaagaggagaaggtgaagggtttcagcactgagagaatgatgtttctggtggggctttgccagaagggggctcatcacatgtgagtttttgcactcgtaagcctaaggggcacaatgggttttgaaatcccaacatatccaactaagaacaggaagccctgggactcagcacagacttgagtcccccattggatgcaatgtttcttactaagcggaaagaacttgttttcactccctgccaatgagtaaagaatgaagagctagatttttctttgaaggtggtggatcatgacccctccttgagactaagcaaagaagcactgatgttaccatggagaggagtgagcccctcacccaccccaggtgagaggtcttatcctgactttttagtcataatccaatgtgatattttgcagggttagtggatgcagtaggttaaatggtggctcccaaaaagatacgtccatgtccttacccccagaacgtgtaaatatggcctgatttgtataaacggtctttgcagaggtaattaaggatgttgagatgagatcatcctgaactacccaggtgggccctaaatctaatgacaagcatcctgataagagacacagaggaggacagtcacaaagaggaggaggcagtgtgactacggaggcagagactggagttaagcagccccaagccaaggaacacctggagccaccggaatctggaagaggcgaggaagaggtctccccaagagccttcagagggagcctggccctgcagacaccttgatgtggggcttctggctgccaggactatagagaatacatttctgtggttttaggccactctgtttgtgacactttgttgctgcagccctagaaaactaatgcagtcaggttgcccagagagatgaaatgactggagagagagagaatctggtcgtctagaaaactgagttcagcccctggacttgctgctggggtctgaggtgaactttcctaaacgttgtgctgtggagtctcttccctcttgcgttcctcatacattaacttctcatggcagagatcggagctcatggttcacctgaggacactactaaggaccaaggaagttcaatcagatcctcacatctatttgaaatagtggtagtaataatgaccacactctatagaatgtttaacatgtgctaagtatgtcacatacattatcccatttaatcctcgaaacaatcctacatggttgctattctcatccccatcttacagatgaggaaactgaggctctgggaggtaatggaatctgctcaaggtcatttggcaaatgctggtggagccagaccttggccccaggtttgcctgtgcttaagccacagtattacagaaggctcaagacccacagagatggtcgggccagcagcccgtagcacccagctgtcagatgagaaaggatttatttattgatgtatgtattttactagcagcactggcattagagtttctttgtcagtgagggttggagtgatgggttgattgaaatgaaggttgctgagatgacctggtgggtcctgctaacagcagatggatgtcaaaacatttgcattcagggggagataaagtcaaaactgggacaaatcaactttctctcagctccagggctctaaggtcctttcttcgctctcagccttgttgggaaaagagaagaaccccctgccacatggtctctctggtgtgagaagctgacagtccactgctgagctttccctgctttgccacaaatagaggcacctccccacacaactccctctcctgctggaatgggaagagaggacactggctgttaagaagagctctggggatctcctgtcctggggcaaactcagtttctggagtcccctcttatagggctaaacccaggtgggctctgactgtttggggtccctgtgcctctcacagtcatgttttcagagttttgggagatctgggctggtttccctcttgccatggttcatgctggggtgtggccaacatggcagcatctcccctgccctcccagatttcaggttggagggagttcggcttcagagagacaatccacaggcctgcagatttcctcccatgcagacctcagtgcaagataaagtcaggcaaggctgtgccacagcacaacagcataataaatccccctctggcctcctcccagacttattgttctattgcagttgttttgaatatgatcaaaaggaaggaagagactatgctatcagactgaggaagaaggatgctctcctgaccgctcctgttgcccttggccaccttattttaaatatgaggaaaccaaagggcaacgtgcagcctaaccccatccacatcatgaggagtgatgagctgcagccaaggccccatggagctttggtgaggcagcaacccctgtgcaaactcgctgacagctaccttagatgtccagccctgtccttttacacaccatggggggctggaaggcccaagcacagggtcagcagcactttgaggctggagccggaagtaggccctggagcagctgaggtagctgatgttaaccccttggactgagaactaaggctgtaaggccacaaccgttggaaataatgggccagaacaggaactgcccaagctcagctggcccggtgcccacttctcaagatagtgaatggctcaagttctttggaaatgttgtcaatgtcagggctttggccttgcctatgtgcagcccaggttcaggcacaggcatggggtgggctgtgacatcggccaccactgctggattcctgcaaggaactagagcagaaagcagcgacttgccttagccttcaaaggtagaaagggcggagccgagtgttcctcttcacagacttgcaggctcacacagtcctctgccctgcccaatgcccagatgctgattcgccaggtgcctggctgccacagcccggtcacctttatctgggctggaaggccacgtctgagccatcaaaggagcctcaatgggaggggacgtcaatgtgcttcctcaaccagaaaggtggtttgagtttggccaaagcagcccaaccaaataagtaaaagcctgtcaatggaaagatgggggctgctgggagatcacacgacaacagaatgagaaccattatcagtctcatcccagcctgaaggagggagagcctttgaagccacagacaggctgaacagaactttccacctgagagacgctggagatgggaggtcaggctgcactcagcccctacgaaaactgatcaaagcctgctgcagaagggaggggggcgcacagctgcagttccgactccccccacgggccgcccgggactttctgaaggcaacagggctgcctttgcagggccctgtgggaaaacccaacacagatgcacattgcagccaaacccccaagcactgctgggagagggaaaaataaacccctcaatagtcctgaaaagaaaagggagggaatcaaagcacacaaaaaatgcaaagaccacccacctgatgagtgcctacctttcggaaacaaataactcctggcttccaaggcgcacttctaaaagaacagacggactgaacactgcctcaaagctgcatgcaccaggggatttgtgggaagctgtggccccttctaagcatcggaagcttaatttaaagtgtgttggcctctgcggtgcctattcaagggctcccttgcatccgctgtcctccctgggaacctgggagacaagaatcctcatttagaaaaggacaggatcctgtgtggactcctttatcgtggttctctcagacaggacagccatatctgccagggaacattctagggggcatctttcaggctagatccagggtgatgtgggcccctgcgagggcatcttggaaggctgtgttggttctgcctggactggtccctctgggacagcctcagcctaccctgcctggcctcacccctcctccctctgacctgaagctcctttggaggactgacacttcatggagcctgcagtttgatcttttctgaagtggagacaacaaagcaaagccacttccactgtgtgctctctcaaaagaataggaaagctcttctctcctccttgggaatggatttggagggagggtggagggcgtaatgatggggaggccttggaggtattttggtggaggagggtgtgtgtggaggaaatgagccgcccaggagcatgggagaaattgacatgagaacatttcagaagcactggtttaaccggctgacattctttccaaaatggatggacaagcctttaggagtagacagagggcctcagggaggagaaacagctgaggaggaggcatctcccttccccctcctccagaggctgatgctacagagaaggcggcaaggcctcactgagcgcctacccaccactcactagatttctatctttttattaccttaccctgggagatgaatggggttatctccattttccaggtgacaaacagagattcagagaggtgacgagaggctctccaaggacccatatggaagtgtcagctggaattcaaccctcaggcagcctggctccaaagttcacaacctttcctacttgtttcagccctgccctgcctttcagggctaagaagatgttagtagatgttccataaatatttattaaattgaactgaactcagcagctgaacacacgcaggcctcttccaccctgaccaagaggaatcctttgagggtctgcagtatggaaagaaattctctgaggcgctaaataaaatcctgctctgaggtgcaaggaggacttttttgaaattaatagctaacaaagtttatgcagaccccaaaaggaaaaacagaaaggaattggaatcattttaaaaacagagtcggtagataataaaacttcacggtggtggtgttgtctttcatcaagaagcacgaagtgctcacaggctttaattacatcttcatccctacggccccttctgaagtcggtagatgcacgttaatagtacctttcgttttaggcatggacacattccggtaccagaagctttagcaattctccccaaggcaagcagagtacagagctggatcggggcgcaatgactctccaggccagcatcccatgctacctccagttgtatttcctgactccgcagctgaaaccaaggacttcattgacatatttaggggtagggggatctgaaggtctaggaaagaaggtgggcaaaaccaaggaatcaggcctccactttggcctgcacaccatataaatcccctctttgttcacccatatgcacattctttaatttaggcatggtttccatttgtgtacatcaatgagtttgctcagtcacaagggtgccgaagcctgagctggaccactcactttaggtaatgccacagcagacaatcagtgcctctgatcatgaagactggagaaatgtgtctgggctgggcccatgcatgatgcttgggagggaaactctcccagtggactctgcgactgggatgtggaagctcagacagctagagatgggaaaggaaacttaaattgcaaaggagtaatcctttttttttctttctttttttttttttttttttttttttgctagttcattttcaatcattcatttcctggcttaaaaaataattaatagtaataatcgcatatggctttttaatggctctccattgccaaatactatttaagcacaaatttcttcactagacactggagcccaatctacacacttgatggtgtggctccatctgggaccccagtctcatttcttgttcttaatttctgtacagttattcctaatttgtgaactgcagacctgcaagaggccagggcgtttcagcaaggggtccataactcttagtgccacaccaaacatgggcagcagctgaaatccatagtatgtaaaactcaggcgaatttgaaaggccgttaaattcctagcagctctttgtcattacgtgttttcttgggtacgaagtttgacaattgttacaagaaggggcctgcattgtgataacagttttcaacctgggatccaaggaaccccacggagattccctgaagtatagatggagggagcacgaggatggagcaggagcagatggggacaccccatgcccgcacacacacagctaattcatccctgtaaccagagagactgttttgatcagttttgtacactgggctttctagtaagattttatttgaagaaaggactctgccacagaggtgagtggggtagtttgcaagcaatggctgcagacaaagtacatgtatttctagccagtcccttgccacagttcagtggggcacagtgagaaatctgtcagctgcccgctctgtccagatccacacagtaagaactctgggtttgttagtgtcttagatgcattaagtcccatctggctcttagaaataacaaatgaacttgtagattagccaatcttttttttttttttttttttttgagacggagtctcgctccgttgcccaggctggagggcagtggcatgatctcggctcactgcaacctctacctctctggttcaagcaattcccctgcctcagcctcccgagtagctgggattacaggcatgcaccaccatgcctggccaacttttttgtatttttaatagagatggggtttcaccatgttggccagactggtctcgaactcccaacctcaggaaatccgcccgcctcggcctcccaaagtgttgggattacaggcgtgagcgaccgcgcccagccagattagccaatcttattgtcagtgcaaagacagtatccactttgcatatgtactgctgagggaatcattagaacattcactgctgctgagggtcaggtggggaattctttatataccagcttttcttgtgggccaaaatccctagagggatagtggccacttggggtccatttttatctccttcagtttctacccaaatgtgtctttgcttatgtggctggggcctgccactcaggctttcaggacacagtgtgcccccaggcagcctgggcctagaacagttgtagtaataagaggtgacaaagcaggaccttgagacagaacttccagaaattctttagctgagcctccgtcctcccagccaggtttcagacaggatgacacataaagaaatctctgaacaatccagagcagtgcacattagcgagtgaagctcaggcaggaaatgggaaggaatgcctttgtctctgctttccaccctgccacccatagctcattctcaaaagccacctccccaacactcaggctcggggtaaatgctacaaaacgtggtggaaacctctcacgacctcctctctgttgcatgaacgcctgttagaggcgaaggaaaacaatggcaaacagacccaggcctgtcacagctgtactggggccagctggaatgtggctgtgcgtgcgcgtgcatgtgtgcgtgcacgccggtgcacacgtgggaatataaacatccttggctccccagctcctgtgtgctggatcgtgctgagtgggcgcaaagttctgcatgtgtccgaggcagggaggggcagcaccagcacacctaggcgctctcatttatacattgaaaggcgggtgggggggacaaaggagaaggtttgggaatggctggctgtgtgcccgtgtatgtatgggcacatctcattgttgatatgtcttgggggaaattgagggaaattttgtgcttgggtatgtgtgcacacatggtaggcgcccacactcaagtgtgcagagggggaagctgaaagaaagtttcgagattctgtgaacattctcagttagaaaaaaatctggcaactccccataccacaggtgggtacacattcaatgcttgtgaagttcatttcctgtactagttaccagcccttgtttatacaggacacaagatgtgcttggtagcaaaagctctaggtctccggggtgagttgagggagagtgtgtatgtggagggggtggggagggagtgtgggcatcaccgcacaggtgctcttgaagtacacatgaaatcaattttcaatattaatccataattccactcatatatgttcagaggggagagaaagtagagctctaattttagaatgaccccctccttcattgctccagtgctgttttagcacccaatctgctcgggccagtggcagctcgggtgtcctcgtgtgtgtttatgggtttgaaacgcatctggcttgttcttctttgagctttactttgtgagcccagccccaggaagtgtttatgagctttttcactttgctttattctggctcagctttgtttggtagcacagaagggtagagtttgacataaatactctgttctttgtgtgagggcttcagattgcagagggtcctaggactggcattccataggaaagttgaggagtttgacccaaccccatgatcacacacctgtaagcgaacattctgcacacctcaatatgagaagaaactgcactctctaaacaaactcctgggcacgtgacctcctcagagtctacttgccagtttgttcatccagatggtgaccagctcacaatagacactcagtgactgctaattaaccatggaatattccattccactgcattaccaaagtgccagcatcactcctcagcatagctcaggaccttgtccaatcagctgtcttgaacacccactttgatccacggttcacgttcatgttatagtcatgagcccctgctcctccgccagtctagactcaaggaagcagtggcacaaatctcctggctgttgggttccatggagcagagagcctgaacccacccggaaaccaagtctagacaaaacagagctttgaggtttacacccacaacctttgtaccgtcggaagcagagggtgccaggggatccactacacgctccctgggaagcagaagccagaggtgtcgtgctatttctccatctggccaagggtttaaccctgctgaagactatttctgaggggagtctccatgatgaggggacccaaagatgctgatggggtcatttcccaggctctgttctggtccagtgcagggctccagttgttgatggtgatggaagtttgctttatacttggtccctgcttggttggagtcctctgccaccctctggcaattcacaacatctagtcacttggagacctctgaacaatagcaggactctaaagactgggacccatggctcctcagtgaattctgaaactgctttgaggtgctgcctaaagttcaaggagaagcttaccaaggaacggggacctggggacagcaatggaaatagagacagtgaggtacaggccactcgctatcctttgtaggaactttcagctcctgttagctagagaccgttgcagagtcaacattctacgcaagccagcgtggcaccctgcttgtctatgattctattcaaggcccagacataaccagccttcatgggcttccagaccactgagattgcagcctggggtgacctcctaccctgtctggaagggtctccaccccaggcctggtcctgcaggaaatggttcccgtggggagaactcctactgctccaaggcagcagcttccttggtgtcatcagtttacctgccagtctcatctctgagagggtaccagtttctttggcttccccgcctgtccccagaatgattccaacacttttttagcccctgaaagccttggaagggtgcccacttgcatttctagtgaatagcatttccactggaggcccttcacccagggttccctacaaaggggtttgcttttagggaagggcaaggtgaccctgctttgtcctcctgaagcaccacttgtggctctccatcactgtgcctgccatgcaatcataatcctcccctttctgtctctgccccgctagcctagaagtgcctgaaggcaagagctgtcttagaggcacactgggaaaatagggggccctgggtcctgattgagtgagggcccagctagggccagagggcctgggctcaccagccactgggcctggataaaggtggttttcaaggggtgagtgtagtctggcctgtctgattctcatccccactctctgatagtgctatgtttttcaccttgaaaatgaagacatactaccctgagcccttcactgggttgtcaagtggtcgtgtggcacacgtaagggagcattgccatgttaaagctccccagctcccttcattatggccatcccatggacagaggaccatgctgtgactcagaggcccagctcttcctagctgtgctgttccctgagtgaacttcagtgagttgctttatctcagtgactctgtttcatctgtgaaatgggactgtcgggttgtcagggcaagtacttggaaccttcactgagtggtatggttgtgggcattccttcttattgtcattgcttaaataagcatgaagatactttcctgaagaatgatgtttggaaggaaggaacctagactttggtatggggtgggaatggagtaaatcctaaatccatcccttgttaacaggcttgtaagtggaattcttgcctagcgagatctaggatagttctctagctcaggagtcagcaaatgtttactgtaaaggggcagatagtgactatttttggccttgcaggccacagggtctctaccacaactgcaaggcagccatggacaatacataaacaaatggacatggccttgttccaggaggactttatttacatcgggctgcaggccggatttgaccagtcggccatggtttgcttacccctgctttagcttatggggggtgccccgcaagcacttgggaaattaatttgttgaagataggtgagtagaggcctctgatagtccagatcctcggttttagctctgtttacacaggaccaggttctgtgttcttgccactgagtcacagctgcaagaccctcacctccccctagccccactcccccagctttgagtgatcccaggctccttcaagcccactgctgagtggggagcagtttctgtgccttccaggatctgtctcccctactgccactccccatccagggctttttccctccatcctgagtttgtgggacacacaatttgtaatctccttaaaactgaagaagtgaggtctctgattcatgcagattaaaatcagctgcaacctattaatggcccagggcccaagacagattttaggaaacaaaaacactggaccaaattagactgagccggcctctgtctccagggaagggaggtagagtaggaggctgggggcgggggagtggccatgtggttttcattactttggattctcttcctgaagcgaagtcacccaacacaaagtgtatggagcgccaaggcagcggccagcctctggagcccggctctccctggtagaagccctgggtcctgttggggggctctggctggttgtgtgtctgtaattaacaggtttcaaagtggttattttggaaaagagaatttcagtggcgcgtcaaaatcctttcatcagccatcagctgccgtcccgaggccttcagcaaggcctgagccacttaaggcttctgagagctttaaattcccagggtcctgtttgagaatgtggaggcttttgccatgggttttattgggctgatggttgccatgattttcattatgttatttggttcctgggatcataaaaatgtttgcctcttcctatagtacctaggatcattgaaaagaaaagggataaaaaagcccctgcatttgtagctgctacatagcatacaaaccatggcttccttgagggaaaagggccagctctggctctgggctagggaaaatcatcaaactggaagggacaggacaagcagccacacccagtctccacctccctcccatccaaggacactgaggcccagagagatgctcatctaaagctggtctggaatcctggtcccactctcggtcaggtgctctttctctccctggtgacttgaggctgtgagtagagttgggaaaggtaaaggagtctgaattctgctgaactagtgctttgggacacctctaggagtggaagaaatggtcagatttacaggcagcataaagtgaaatgctgaagtggacagaggaatgatccgggccagcctgggcattctcatggcctacaggacagagcgcttctctgaggctggaagggttactgcagccttcacttggcacccacagccctgagacatggaaagaagggaaacaggtaccaaatcccacaagcctcagagatgatttctcactgctttgaatatgaaacctctgaaatctggtcaagctcccagaatcaccctagggggtgacaggaattttggttaagcccgtattatctgataagtggaacactaacctggctttacttcctattttgatgatggctaccttccagaaccttctttcatggaaaacatgaaaaatattctgggagaattgctattaaataacctctgctgtttaaaaacaaggccagaccagcagaccttgctctcagcaggacacatgtaagaactagtctacaataaagaagctattaaggcgtgttcagagaattagagagtgttggagctgagagggaaattggagttcagctaggccaggctttcattttacagatagggaaactgaggcctcagggcatatccaaagtgatctagggggcatagggagtccaggatttgcttgactatctcattcttcacaaggccactgttccccttttgggttgatattgtaattcattcattcattcattcattcattcagtttttactacctcctatgtgtcagatgcttctaggcactgctaattttgtttctttgaagtttctagaggtggaataaaacagacacatttctgtggactacattaaagaaggaaaggacttttccccccaaaatctaggtttggggaaagtctggtgacttttgtgagcctggggcatctttgggaaacgcctgccctcttgagtgtgcctttcagatgagtgcgaaatatcattgtcagataaaggggtgacttgcctaggctgcccccacttgcagtgacccccactcccaacagccacctggcagtgtggcccaaaggaatctggaagtgaacatcagcagagattctctggatccaaatttgagtgagggctggcgggaacccagactagctggaggctgcagattgcatgggtctctccgtctgtttctcatcattctcctcctacggtttgcttgtcagtcctttgctcttgtttacctctatgtggataattcctcgattataaatcagagaacttggcactgagttctggattatctgtgatctttaactttcccagggcaaaagaaattaaaccagcaaatctctttgtttctcatggttcagcatccaaatcatggaagtgcgggtctgtgtagagtgagacagcctaagcccacctctgccctggcccccacactctaggtgagcagtcatgcatgcatgcattcatttattcactcaacaaatattcagtgagcacccatgtggcagcctctcttctagaaactggagatacagggttaaaaaaaggacactgttccttcttaccctgtttgcatcttagtatggatgacagtaagcaaacaaaccaacaaacatacatactagtgataaatgccttgagaaaggaagcaggttaagagatggcagtgaggggtgcactattttacacacagtggggtcaggaagacctctctgaagaggtgacatttgagcagagattggatgaagagagagtaagcaatgttcaatccagaaagaacatttcaagcagaaggaatagcaagtgcaaaggcctggaataggaacaagtgtgatgtgtttggggaacagtaaggaagccagagactggagtagagtgaaaaaaggggacaactgtgatacattaggtcagagcagtgggcaggggccagccatggaagtggtgactttgggttttgttctgagcttcacaggatgtccttggaggttttggaggagagtgatgcagcaaagatgaacattcagaggctatagagaggctcatggaacaacaatgggccagcttgggttaaacactggcattcagacacatggcaatggtagctgcacctcatgggtggtgcttccagtgggaactgttgagagctacatgtttcgacagggtgaggctgggcctgggagctcactacctctaccaattagtgttaagcccagaaaaaggaaatgctgcagtttaaattgtagggttggaacctgtgagtcatataagccccagccaaatgggccatggtgggctctgggaagttactggtgcagggtctgaagcccccagctgggctgtttggccacccatgggggcttccagacacattcggaagaagcagactcaaatacagaccccacctttggggtctggctttatttttggctgactgtatactgtctggtcagtttccttcccagtgtcttttactttggaaaaggcaggccacctcacaggggagcagagagaaagggggaaacacatggatttggggctcaatcagccccacaacacaaccctcacctcatcacttcgctggcttttggaaaagctactgaacctcccagagctgccagccacatgtggctgttcacatttaaatcaatttaagtgaaataaaattttaaaattttgttcctcagtttcacttaccacatttcaagggctgaatagcaacatggggcttgtggctatctattggacgtgagatgtagaagatttcccttatggcaggaagctctgttgaacagtttcatttctttaaaaaggaagcaatccacgagaactgaacaagttaacacacacaaagcacaaggtgtttgcctgtctcactacaggtgctcagcaaacggtggtcactgtgattgatcatgtgaatctccatcctcgctctgctactgactagctatgtggcaagtcattcaacgtctctgagcctctgttttctgatatgtaaaatgggaataaaaattaccgcggagcacatttccacagcataacatgatcctttttttcttagttctctctggacccatgagaacttccttaccaaccctcagctgacctatctagaccagagcttggaaactccagtcttgcagcacttagcaggaagcaggacctactgtggcccaataatgcagtctggagattttggccattttgaagggtttgaccatggctagtggtatggagttccaatgaaacaagtggacaaatctgatcaagaaaaataatcatttgactcaaatcagatatttaccctgctctgacgctctgaaagacatcatgccttgggttccccagctccaggccccggcttccctggctaaaagttcctcctgtgggcgcggctctcagagaggggctcccaggcagcccttctagtatctcagcctcgaatcagtcttccattttccacttggggtttttgttgttgcttaaacgtttattaactgcaggcatttggcgggtggaagttgggatttgcctggggctggaaggaagttatttgccaggccaggataaggtgtggtttcagagttgaaactggaatccccttcacctgcttaatgcatttcaggggagatttgttttcaactcccaaattacctgctaggaattctagacctgagatcctatctcactggctgttttctttcatttccgataagaaatacaaagaaaaaagagtgaaaggctcaaacacgacattcttgcactctcttaaataaaattacatacagtgagtgattttcttccctgtcttctacaaagcaggtaatgggagggcctgacctagcccagaaaacctctgctcctggggaggtgtgcctgggagctgcagagagcaggtgatactaaagatatttcttatgtgcttgttggccatttgtgtatcttattggaatataatttattttcaaatattaattttatgtccagcaatcttactaacctttcctttagtttaataatttatttttaattttgggggtattttctatgtacaaatcatacaaaggttatggggagtgttaaaactcataagggagtctccagtaatctcaagttcagaagaaacagagctagaaggacctgtgtccaagcttgtggagggtaagtgagcaagaagttgcctaaatgatggtctaactatgagcaacgggacaaagatagacagcaaagacatttcagacatatggaccaataatttcttttcttcctttcttcttcttcttcttttttttttttttttttttagagagatagggtctccctctgtcatccaggctggagtgcagtggtgcaatcacaattcactgtagcctcaacctcctgggattaagtgatctttcagcctcagtctctcaagttgctaggactacaggtgtgcaccaccattcctggcttttttttttttcttttagagatggggtctcgctatgttgcccaggcttgttttaaactcctggcctcaaatgatcatctcacctcagcctcccaaagtgatgggattacaggtatgagccacccaggtgaaccaatttctttctttctttctttcttttcttttctttttttttttttttttgagacagagtctcactctgtcgcccaggctggagtgctggagtgcagtggcatgatctcggctcactgcaagctctgcctcccaggttcatgccattctcctgcctcagcctcccgagtagctgggaccacaggcacccaccaccatgcccgggtaattttttgtatttttagtagagacggggtttcaccatgttagccaggatggtctcgatctcctgaccttgtggtccgcccacctcggcctcccaaagtgctaggattacgggcgtgagccaccacgccctgcccggaagctggacccatttctttaggctggcaactcaagtgattattgttgttttaagccactaggttttaggatactttgctatacagcaatagataattaaataatttaccatattaaaaactaaaaccaaaaataatatttgttcatttaatatttattcattgttaatgaataaattaacatttagtaatttattaaaatgcatatattcattaatccatttaaacgttaaaaataacattttattataaaaataacttttttaaaaaatccaagtgagaagagtgacagtgttttacatttttgcaaatctcttgactgtccggcttaatagaagacagctggattctcatatcggcttctgcattcaatcagctgtgataatgttgttttggataaagtatgcgaaggaaacccagcctcacgtagttattttgttggaaaagggaggaatattttaatagtcttttcagataattgtgaatattcttctttgacattataccaaaactcaaccaatagtagattactaaggttagttgcaatgtggaatctgaaactatatcaatgaactttttgtgctcagttatgttaaaattcagttatctggcttgtactctgaatagatcttttgctcatgcatgattttgaaataatatgcatgggtcatttggaaaatattgcttcactaagtcatgcagatttttcaaatttgatatatttcttgatgaaaactaaaagttcttatttgttaatatcactgatctcatcaaaaacctctgtaagtgttgggaaggtgttaagttcactatggcagatacaggtttctaaaaattctaatttttgctttatacttctattttggcagaaaatactgttaattattgtctttcttgaagtgatgagctcagtttgttcatttttgagaaaatgcctgtcaaataaccaaatctgaataactatggttatttggtccttttgagtaaacattgtgttccatgaaagtgactagtgcagatcacaactcaggacactcacacaagtgcttttcctccagatgaccatcatacttcaggatgcaccagaaatgcttgatactttgtttccaagtcatcacacaaagaaaagaaagggaagggaagggaaggaaaggaaagggaaggggaaggggaagggaggcagagaggggagaggaggggaggagagaaaaagtaccttttgggcaaggttttataaaattaataatttttactgtctaatttaggacattctttggtgaaactggcatttattccccctgtaagtttgtagcagtgaagaatgccgtgactgccagcatagtctagcaccagcaattttacccagatgtcaacacagtgaagaaggcaaataacatcttggtattattatgaaatattatcaaaattatgaaaataattttgagcttgcagacaccctgatagggtctcagggatcccaggggactgcagacctcacttggagaatcagtgctttagggagatggctgtcattctgctacttgtagcatttacaggtaaatgtgctacatgctaagacgtatatgtaccaggtctttgtgcaaaattgtaatcaccaccatttattgcataaactagaaaacatatcattaggtatcagcttattcttgtagatggactagatatgagaaaggcgttttatttaagggagatatttttatgcttttatttgtcccacttgtcaaaggtatatggatattggtgaggaagctaggctctaagccatttctgaaactatcagtgttgaataaataaggtacataaggaagctaacacttgcaccccttcctttgtaactcttctaccgccttgatctagtgagccctgaaagctcagtgggctgaggaaaacatcctttttagagtagcagggtgccctcaactccagtctagaagtgggcaaagttctcacgttggcagtacctgcagtgtgggacaagagaagcagctggcccagaaggcagcgtttgttcaaatggtcatggcacctgtgagcattgtattgccgtggaagagctcaagtcattgcctctgctaaagtgcctctgaattcctacacagtgaacttagagcacaacagggcgggaacatggttgttttccattcttgttcagctaggcttacacatcctctcactcccaaaaggcagagtaggcttgcaccccacacctgactgggctcagctctttggcaagtgattgcgtagctgttctgcctgtgactgcaggccccggtctgcaggcgggaaacaacaggcagttgtgtcctgagccctgggaactggagatctttccacatctgttcgcctagtcggggggcgggaggaaatcaccagaaccttcaaacatggggccagagcagggagacaaaggggaagccttaagccgatggtgaccccaggtcatatgagccccccccccaggcctcccccatccactttcatcccctcaggtccccgacactcagccttttcatccttctccaggtcagcaggatcaggttaatgtgacttgaccagaaagcttatcaaatgaaggcagagacaggtgtttgaaaccccttccctgctgaaagctgggttgaacaaggttagcagcgtagctgaggccaacatcctacactaattgcattttctttcttggagctccttctcttccccttctttgttctctggcttggaacccctcaaggtctccgagagccagtaaccaaaacaaaccattcaaaaaacgaaggatttagggaaaaaaaattaggggatgtgacattctggaccaaacagtggcccttctatgccagagcctaggaaccagcatttggaggcatccggccacttccacccagtgggcatgctgaaatcagttactatgggcttatcagaactgattgcacaaaccttttcccaacttcacaatcatgatgtcatatttgtagcttgagttgaccaaggtgggaatatttataccacagaaatcagcaagctacaaaccaggcttttccacctccagagccagttgttaaacatttaccggcacaccagtgcctccactgtggctattgtcactcaaagtatgattctcagaccaattacataggaatttcctagagatcagaaatgaggtggggcaggagggttgttatttaacatgcagatttcctggccaacctgaattaactgaatcagattctctggaggtagagcctggggaaatgctttttagcaagtccctgaggttattaataaattcaataaagtttgagacttcagccttagggaataggagaaaagagtgggcgtgcatctgactcttggcatctggaaggaacagctggcttcagtcccagttggcctaagaatggacagctgttttctctcgagatagaaacttcatgacaggaaaagaggtgggaattttggggtctcagctacccactgacaacacgactggttctgccttggatctcaggatgaatccattttccaacttgagactttgacccaagacagcatgagcaaatgcccagatgtatgtagaacgtggagaaagtcaccgtcatttgcaccattggtgggaccagtggagcccagggaaagcccagagtcagttttctgtattagattgcccaggacagcatttttctttcagatttgtctagacattttcaggatctttcccaatcaggcatgattttgtaaagcaaagaccttgttgacttcatcccactgagctggaagagaaggtcttctaaggcagaaagaaaaagagaaaaaaaggagaagagagaacgtttctttgcctagatgtaaaacagaaagttcataaggagcttaactctgctttcgccttgttttgcacctgcctgagggagtggtttagacggggacaagtagtgtgaaaacagagctagttagtaaatgcaagagctggggtttggaccccaatttttacagccaaaacaaaacaaacaaacaaacaaacaaagaccaatgcactttcctcctaagcacaatgcagtattttttccacatgcagttggaacccagaggaatccttaatgggcaactggggtagtgacataggacatatatgctcaaagtactgtgaattcctaaaccatcagagcccccataccctggtgcaaattccaaaacataatccaaagccacatgtaaaacttatgggattataggcaagtaaattatgaactattagattactggctattagattatccactggaatggataactgagagtcaaccatattgatacatatcatttaggcactccccatattagacagttaagcttgtagctgtttgctaagttcatgatcatgtgatcatttcctatacatttgttctaactgttcagggctttaattaaacatataacttcatcaaataggaggaggaagaaaccaaatagctcctcaggaaaacaagatatgagctcatatgtattttttgccaggtttcatggcctttctttgtgcccagaaactcttcctcaccctaggacccatcttcactttaatactatccattcaacaaatacatagtgaggacctactgtgtgccagttagggtgtggggaagaacaggagacaaaccacctggtctcattctcatgaattttacagtctattgggaaacaggtattacacaagtcaatatgaaaataagtaagtgattatacattgtcctaagggctgtgaaagaaaagtacaaggtacaaagagaaacgtcaatagtcctgaaaggttgactgcatcaagaacatgtccatggagaccaggctgatggagtttttgtttggattgttttgggtggcagggggtaggggtaagggcacatggagcgttttgtttgaggtacttgaaagggagatgtcaagtaggcaactgaatatccaaatcaagagagtctgtagtggagtggtgactcaagcccgcacctggatgaggtcatagggatggaatgtctgaggagaggcaacagctggggcctgctctctgggccacccatatgcagagctcacgaaggaggcactcccagagaggagggagtcccagaagccatttacaaagggtattttatgagtgggcaacgtgaaagtaccaacatcagaaaagcacctcaggacctccaggtcctgactccccactcctcccttctcatgagccaggcaggctgtctgcaggccagccagtgaattgaactggggctctcagagtctgaacagctggccatgtcttggacagtgcttcatgactctaagttattactttctgttcctttcctagtccctaactcagacccaagctctttgctccctggagtttctaagtgtgtaggtattaggaagagagcaaataaaccagttcacacagatgtatgaataatgtttaaccagccagttctctttgagatatattgttgtaaagaagcaaaactaaatgtctaatctgtggaatttcaggcaaccttatacgtttcaggtggtgcccttgagagggaagaccttttgagctggggctgccaccctgttcccttctagcttccctgcactgttcctgcagcagcttcttttcttcctccatttctgaatccccagagtcttgaaaacctccagaattttcagagtggttcctttggcaccagtggccatgcatctgacaattacagtagctaacatttatatgtaattgttagcccctcatattaaacctacattaaccctatgttaaatgaagttaaccataacatagggttgctgtgacttcacagcaaacttcagccctatgttaactgacttcacagcaacgctataaggttgggtcggttactcttctctgggtgaggctgtggctggatgagagatgtttgttagctgcctgtggacacacagctggcaggctgaaatttgaagcagcgtcttgctcccagtccacactcagggccgtgtgagtgggatgtgagcctgagtctgccctcccttgggtttgctgtcctgagagaacaaaagcaaatccgtgttctggttctctgagatagctcttactagacctggctcagtttgacccctttctgctgctggaaaggaggacagtgcaggtcaaagccctggttgctgattacagacaagatgggagtcatgtggggtgtcagcttctgtctcctgagagagaaaaccgaaaaatgctacctgaatttccaggatgaggttgaaggcacaatcttttcaggccaaatctcttgggcagaattgaagagactgcaaaaaaaatatggaagttaccctcaccgtttctgggatgtctgaattcctccctctctggaatggagccgctggaaggctccataatcctccctctcctggctcagaggcccagctacactttctaaaacaacccagagccatctgatttcaagcatgtaccggctcgtgtgtggaagacagtaattacctccattccagttaggaaagctgaaacctgcctttttcatgcctcaaacaattatcgaagtgccttttgaagctctggatagaagagaaaagcaaaacaaaccaaagagccaattagagcctgggatttgagggtggcttagttttgtgcagtgggacttgggaggaactgtgggagagggtcagaggtcaccccaaacctccagctgccaaccaactttgcctgtgccaaaagaacattattttgcattgaaaatcaaggctcctctccctgactcaggaacaatttgcaggaacaacctctgcatcagctgtgaagagggctccctgattaaataaggcctggaatgcatttgatgttgaacaaaacagttctctgacagcttttcttacttgccattagaatgcttccccttcagctgaaacttggtaagataaagtgaatccccggggacccttttgttttggtgtacatatttgaggaatttttgtggcctgtgttccatttggagttaaggttcttggtccctgaagttcttccaggcttggtggtagaagctggcaattcagaggcaggctgtgatgagagtagaaagcggataccaggcatgagggcagaggagagcaagtggccctgccctgggatgggaagcctgagggcttttttacagtccccaaggagagttccctgacattcaacactgccacaaggcgcagagtggaaagtggagttggggcatggtggggttgaagctggattagaatggacttggccaagatctgttcgtgatgtctggggtggccttttggattaacaggatttgattcactgtgaaggcaacgtagcactgtctgggaggttcccttttgagtttgggtgagaatcaggaagacagccagcaccaaagagccctgagagaacccactatgccttatttacatccctaacccaaactggatagaggagctttctcttggccctggcataagtgcccggctttccatctgcctatcatttaccccctcaacagtgggctttgatgtctaccctccactacaagaaaaagcatttgtaggaatgcctcttggtgtatgtgggggactgccccttagtatagggaaagttgtcctccatacacaaaggttttgtatcctgcaagtgctgtattttctatctgtgtttggttgaaaaaacaaaaacctacatataagtagacccaggcagttcaagtccatgttgttcaagggtcaaatgtattcctataaagcaaaacaaagaagcatattgcttaggaatgtgtctgtcgtgctcaaaatggagtgaatatcaatggtctggtggcatcaaaatggccagttctgtgacagtaaaagaggtttgtgtcttatttaatcttttgataataataacagctatggtgtatcacagctttaccaagtaccagacactgttctaagggctttgcatggttcactcactccttacgtcatccctcggtggcaggtgctgtaattatccttatattgcagacaaggacattgagacagaggtcaagccaccttcccaagggcacacatggcatctgcactgctcctgaccgaccgacagagagagctgctgtcacgatcctcaaatgagctatgcatgtcaaaagtttaaaaataaaaaagataaaaacatgcacaaaatttaaaaagtaaaccatttcaggctggacagactgaaactgagagatggccagagaagagtatgaaagataaatctatggacagagtaaaccctgactggcttgaaattagggcccttactcctccacactcctgacgggttggttcaagaccaagaaatagaagcacattgtgagttctacgctgctgccctgggaaacacacaggctaaacacacccacaggctcgagctggctttgaagttgtgcctaacagatccgagatgcatgatgaaggaatgttctggatgcgttcttctgagattttagaactgagttaactcacgttctcctacaaactgtcccttgtagtcgctgttcagaaggattccaggctgcctgtgtcaatgatttgaccccacaggatggttcttttttaggttctgacagggagcagaaatgagttttttgactcaagaagatggacgtagctgtagttctttaaaaaccatttatgtgatttccagtgttttctctgaggcaggtctccaacgatttctctccagcatgtggcagagaccaccagctgcttagcaggccctcaactgggccaagaatgttcgtgataggggtttccaccctttccatctgtggcctgtgataggcagagtaatggcctcccaaagacgtccaagtcctgatcctttgaacctgtgcatatgttacatggtgagggagaattaaggaagcaaaaaaggtgctaatcagttggctttgggatagaaagcttgtccttggccaagcataatcacaagggtcccagtatgtggaagagagaggcagaaaactcaatgtcagtaaagcgatgtaagaaagactcaatgggccattatcagctttggagatggaaggggccataagccgaggactgagggccacctctagaagctggaaaaggcaagcaaatggatgttcctctagagcctctagaaaggaacatcgccttccagatgtcttaattttagcccagtgagacccatgtcagacttttggcctccagaattataagataaattttccttgctttaagccattccattagtggtaacttttacaacagcaataagaaagtaattcaaagttatctgggttttcaaccctcaggtcataggacctggaggacattgtcccatgagctgggaagtgaaaatcatggtggtcaccttagcatccttcccactgaccatctgggaattctcatggttctcctggctaagccccacctgcatatgagcacttcagccatcagagtttccctgcaatggggtctcttcttgacgagtgatgttccatttcttagcagtgttgccagggcctctccttagtgtggtccagacatcctatagcattacaacaagctgcttttcacacccacactcgccccaaatgccaaacacttccagccagcacagggtctgggggatttttctccccttccagatagccagccacaacttcaatgagctccggcatatggaattagcatgatagaaccatgacatgccaagtgccgggagccaacctgagccattcttgggtttgagaagttatcaactgggaaatacttgtgatttacaattttcttctgtcctccaccattccatcacatgaacatccaagtcaaactcctgagctgggttaagaaattggaattcctgaggctctggttcaggttcttactacctctgtgacattgggaaagttggttaccatcatagcgcctcagttttcttatctgtaaaatggggaaaatacatgagttaatatatgtcaagtgcttagtgaactgtctgggtcatgttcagtgctataaaaatgttcattgttgttgttgctgttgtttctatcgttgttattattaaatgggtcccaaatcttgaggcaagtcatttggaaaaccagcttgttcgtgctttgccacatatagtcatgtgccacataacaatgttttggtcaacaactgaccacatacaggactatatagcctaggtgtgtagtagactataccatctaggttgtgtaagtatactggacgatgtttccacagcaacaaacccacctaatgatatatttctcagaacgtgtcgttaagcgacatgtgaccgtattatacgtccagcaattgagatgaattaccgttgcacacagtgctgaagctcaggtgtggacaccctcttttaaaatatttttcccatgaacatgtcctccaggaagcaggctccagtgtgtcacagccagatgagtgattgttagggaagacaaagcctgtgtttagagttatgcaagtatagtggggagagggcatcttattgctgactcacgcccactggcaacccagcctgattcatctagactgctgcagaccactctgcatggaagacctctgctcagaggatctcagcccactgcatggcccaccaagagcctctgacattcaggccgcttggttcttctggattcagttcttaggtccccgaaagtggtaaaggagagaggagaaaactagttcattttcagccaggagtggcccctggcacacgggacactgcttgctttggacagaggccactcacaacaggcttccccttctgggtgtggtggccagcctgccctgacaacagtgcggcctgaatctgtgactcttagcggctgcttgggactgctgcaagactctttggtctgtgacttgcccaagagagaagtttctgggcagaacggggagctcaggaaagaagaaagttacatccgcacaaagtttcaattataaagcccaataataacgatgaccaaaacaaaacaaaaaacgaaacaaaatgaaaaagcctacatgctctttggtattgttgggactgaaaacaatggaactgagtttcttgactttttcttaaccttatccccatgaaagaggtttgaattacagtatttttcaaagtaaaagccatctgaacagctgcctgaactaacctgggagcctagacagtttagcttcttgacctctgggatgtgggggaaggggacaaaaggaaagagagagtaggggaggagcgagctccttctgttttctgggctggccatttgaggcccatgaaccaactgagctgatgtcagactctggcactcccacttccaggagtcacaacaaagtggcagggatcaggggcacccctgggtctcagagaagtagcacattgtaggagaaagagaatatgctgtgcagacacacccagatttgtgttttgctgctcctttcactccatgtgatttagacaaattacataacctctctgcaaataggaaaacttccttgtgcctgttggtcttggaaggactgggactacataatgcaccaatagaatgtctggagcacatcagatgtacaatatatgagcagtagctatttttattattaaacacaacaaccacttgggccaaaggccacctaatttgtagaatcattgagccagaaagaactgcaacaagtcagctcataaagtatgcatagaaagaagcctggaaggaagtttactaaatattaacaatgattatttctgagcagtggaattgtaaggatatttgtgttttcttctttatactctttcaaattttccaaattttctttagtaaatgtgtatttttttatactgaaaaactttaaaacattattttttttaaaagtcttccatctcagtttgtgggctccagtcagattgcactaagccatctaaaaccacagtcgtccaacctgttgctaaagccatgagaaaaggctggcaccaaccagtaaagaattccctccagtcttccgtaccatacatcctgaatggagcataatccctgcatggtttctagcccatcataaccttgctacactgtttcatagaaaaacttcagccattgagaatgatgtcattcatcatatttcctctttctttgccttttgctgccaggaagccttaaacaaatttaatactcaattacagtaataattaactcagattttgggcataattattttcccttcttcctctatggtttaattttccctttattattcaaccaacttattgcatatgtgactttcattgtaaactacctcaagtacactttaaaagttggacataaatcataaagtataaataaattaagttttatctgatctcttgtaaaaacccatgatcagcctgttaaaattcatattactaaacatcttgaccagtaaatgtcaggagggtggcatgaagagcaagaaagagaaagctctgagtcaaggtccatatttagtgggaaaaaaaatcctggcaaatatagatttgttcagaactaattatttacctttttttttttttttttgagacggagtctcgctctgtcgcccaggccggactgcggactgcagaattatttaccttttaaaatgggttacttaatacttattctagtatgtcctgtgagcatctgttgggtgtcaggcacagttttaaatgttatttcattaattttgtgaggtaggtattatcatttctagctgaagaataagaaaactaagaatcaaacaagttagataacttgctcccagtctctcagttagtaagtgataagtctgcagaagaaaccctggtccgtccaactccaaggaattcacaaccctattctgtttcatcaaatacaggttttctttctctaggtgggttatgttgaaatggtgaaccaggctgaagccacaggttgactgagttctaaatccagaagcacagctagaggctcctgtggaatgagagggactaaaattgcttcaagtgcagtggattactggggttagactcacttctaaaaatgaaacactgaagtggggctttctttttttctttgtttttgagacaggatctcactctgtcacccaggctggagtgcagtggcacaatcttggctcactgcaacttcctcctcctaggttcaggcaattctcccacatcagcctccccagcagctgggactacaggcgcgtgccaccacgccaggctaatttttgtattttttggtacagacagggtttcgccatgttggccaggctggtcttgaactcttgacctcaggtcatctgtaaggtggagcttactaggaaagaacgttgaaaaacagctgctgatgatatatctgagactatttcttataggaaactgtaggtctatggaggcaggagaaataatcacagcccagcaaccagaagctaggatgctttcactactaagggagagatcactaacaccatagctgggaaagatcttaaatcatcacttgattctgaaccagagacctctacaaaatctctaggatagaagaaaatgaggagaaagaagaaagaagaccttactctctaaattagtatccaagcaaaaatattcaacactaagaaaaccagtcaacaaaatcaacatttgttatctaatcttgtccaaaagaaattaaaataatggaacaatctgactaaaactttaaactaaatttgcctaaatactcaaagagaaataacatctactttaaaaaggatattgtgaaataaagcaggcagaaataagaattggcaaatatgaaaaagaatgaattaaaaagataaaatacacagataggataaattctagacatgaaatagatgaagataaaattagtgaataggaagatagtatttaagaagccaccaaaacgtagtgcaagtcagagttaagggcatgaagatatactgagaagctccaatttttatacatacatatgagatagtaaacctatctacctcaaggataaaaatgatagtattaaaagttgtggctgggcacagtggctcacacttgtaacctcagcactttgggaggcagaggcaggaggatctcttgagcccaggagttcaagactagcctgggcaatgtggcgagaccccatctctacaaaaaatttaaaaaaaaaatgccagtcataatggcatgcacctatagtcccagcttcttcgagggctgatatgggaggattgctggagcccagaaggtcaaggctacagtgagccatgattgtgctactacactccagcctgggcaacagagaaagaccctgtctcaaaaaaaaaaaaaaaaaaaaaaagagataaagaaagaaaaaaacaaagttaccagggagaaaagagagttatttataaaggaatgatagctgcattgataatagacatcttactaacaatagattccagcagacagtggagtagtatcttcaaatatctgaaaggggaaaaaaatcacttgtaaagccagagttttatacctagctaaactagctttcaagagccgatttaaaagaaagacagttttaggatttttttaaaatgaagtttatatcagtcttgagtcttcactgaaagaaccattaaaatatgtattatatcaagaaaaactcagtttcaaggcaggacatagaaatcaagaaactatagtggacacagaaataaataagttaaaatagacttacttcaactgactataaaataactaaatctagagtttaaaataaaagttaaataaaaaagtaatatgttgagataatatgttagtagaaagagtatttactgggtaaagtgtgctaagagtcttgccttgttcagggaggaggataagatattgaaaatttcagactttgaaacatatataattaaatgtgtatggtaaaactttaaggtaattatgaatagaaaagaacatcaatctataggttctaaaccaacaaaggagaaagcagaatatagaaaatctcaccaacctaagagaagacaggaaagacaaaaaaaaaatgaaagaagacaggaaagaagaaaaaaacctaagagaagataagaaagaaagaaaataaatagaaaactaaataaaatggaagaagtaagtcaaatatgatggtaactacaataaatgtaagctgattaaatgtgtctattaaaaattggagaatatcagattagaatttttaaagtattcagttataagctattttcaaaagacccacttaggccaaaccacacaaataaagagatgacaaaagacataccacaaaatgctaaccaaaagaaaggtgggtggtgtcacagtaaggcaaatggaatcttgggaaatatatgttaatagggatagagagatatataatgatataagaaaagataatattcatgaacctatatgcccctaaaaacataaccttgaaattcaaaacatgtaaagcaaaaactaagaaaatgtaaaaatgtaaaattgtgttaaatttaaatttatttttacagaaatttattaaaaacataaaagatataaccacaaactgatatatcctttactcaaaatccaacaataggccaggcatggtggctcacacttataatcctagcactttgggaggccgaggcaggagaatcacttgagttcaggagtttgagaccagcctagacgagataggaagaccctgtcactacgaaaaataatttagaaattagccagatgtggtgactattctggaggctgaggagggagaattgcttgagcctgggaggttgaagctgcagtaagacaaggtgacatgccactgccctccaacctgggtgacagagagagaccctatctcaaaaacaaataaaaaccaaagtccaacaatagagaatatatgttcttttttgaaaatatgttgaacatttacataaattgacataacaggccacacaaaggaaggtctcaacaaatttgtaagaattgttaacttatagagatattttctgaccacagtggaatctgatttttaaaactcaataaaagatgtgtttaaatctagaagcaaggagaacaatagattaagcctaaaaaaagcagagcaaaataaaactatcagaaattaatggaaaagaaacaacaacaaaagaatgaacaaatccagaagttgattattcaaaattactagtaaaatagataaaaccctagcagggctgctccagaaaaaaagaaaatgcaataaataatattaagaattataaagagaacataatttataatgatagatacaattggaatgaaaaaatcataaaaaatagaatgagcaaatctatgaacaacttaatactagtagaggaagttaatgatttttttagaaaagtaaattttgaaagttgaatcaagaataattaattagaaaatccaaatcaaccaataacccatgtaggaaatgacttgctaccacaaatcagagccttctacccaaaaaacattgggcataggtggatttctgggatgtttggccaacctatcaagaacagctaacccttatgttacacaaactgtttgagagtgtagaagaaaagggaaagtgactcatcttattaggcacttgataccaaacctaagaatacaagaacagactaatccattataaacatagatgaaatttttctaaataaaatattaacaatattaacagagatgacatgtcttaatatagatgcagaaaaaaattattttctagaattcaaagtccctttattacataaactcttagcaaagtaagaataggcaggaacttccttaacttgataaagaacatataaccaatacctttatagacaacacactcaatgataaaacttcagaagaaagatgatacctactatcacccttattactcaatatcattctggaagtcctaccagtgcaatgagaaaagaaagagaaatgaggtataagaattgaaaaaaaaacagacaaacctatctttctttaaagataatatgattatttacacagaaaatccattgaatccactgtataggaaaattattataaataataagagatttcattgagtttgctgaatacaacatccatatacaaaagtcaacagcattttctaggcactaggtaaaactaattggaagggagacagagactgagattgtagctggaggggaatgtatcaaagtaggatttttaaagatgggagattcctgagcactttgtttgctgttgagaataatccagtagagtgaaagaagttgattgtgcagaaaatagaggtggatgacttaggaataagtcctggagacatcaagagaggatgggatgcaaagcacaagtagaggtgtttgcctttaagagaaacagagctacttcttccattgtaatgagaaggaagacaattcctatgccagtagttgtacagatgtcacagtggagggatgagggagtttctgtctgattatttctgttttctcagtaagacataaactgagatcatcagttgagaggggatgatcattggaggtctgaggggagaagagataaatagtgacctcagaaaagttaaaataaactttactatggaaaaaaaaatgtagcctttctgagcaatgttgagtactcatttgaggactgcagtcatagatttaaagtgtaatcagtcaactcagtggaattactttctccattaatcttaaattgcttcaggactgtttcagcctaagccagtagctgggtttaaccaaatttgaagatttttctaggagagtttggcacgaggagagaggggcaaaggcgtgtaaggcagtgtttataacagtggcccatggaattgatcatgggtaaagagaaaacaaggacatgcgaggaggtgataaatagaacaaaacaaagcaaaacaaaacaaacaataaaaacagacaagcaagtgagcttaactgagtggtcaaaaaattattggagtagaaatactacagaaggttggctggaaggatgaaaatggtggtcggcgtataacaattgaaatctagacttgaaaggtggtgatgacaaggctaggctatggccattttaatgtagctgaagaaagtggaagaatagatcactggaagtgagaaggtcaggaactcagagaccaaggatgttaaagtcaccaagaacgatgacaaaaataggggtgaaaggaaggagttgtatgctcaagtgtttaataaatgaataataggttattgatgacagcaattcagtgggagaagggttatataatgtgaaggaatgagcatccaaatagctgtggtttttaaaggataaaggaggagaaagggtttggaagtagcagtggaaagcaaggaagcccatttccctatctacaggctctgggatatgggacagtgagataaaaaacaaccacacttttgggtgctatggggaaaaaccacatcctcagggccaatcaggttttggtgaaggcgcgaagatgaacagaatgttcaaagaagaagataaagatttagaggatttccagaaagctgagtggagtgggtggatattgggtcagatattaatagcagtaccaacataccttatcatctgtcctcccgctcccaccccccctagattgtaaattccacaagggtagagatctttgcctattttgttcattgatctgtcccaagaactaaaacagtgcctggaacattgtggatgctcaatacatatttgttgattgattgattaatagtagctaatatttattgagcactaatgtgccaagggtactagtaagtgctttatatatattattattgttattattattattattactctccccattttatagatgagaacattgaggcacagaaaggttaagtagcttgcctaagttcatgggactagcaagttgtagagccaaagttcaaacacactctagctctggtttggttctggagcctctgtattcttaaattccaaattacctcaccttttcatggttggtggatgtacagaacaatctcaaagtagaagcccaggtaatggtaaaagaccaaggaggctagacctctagtggagactgaggttaaaagttaaacaataaatatgaacactgatttcaaaagttagtctaaaagctagcctagggcatttgctgcctctaatgtcctatactcttgttcatctcctattgtgattgtgatcaaggcaccttctactgtcagttcccagatctttttatttcccacccccacccctcaccccccacatattgcccttcttcattatttttagtttctgcatattcccattccgacacctggcaaacctgccactcttttccactgacttctcttaagggcagtcaggtgcattgggacctaatttctaagcatgtgaatagtgacacgtcgagcttacagcaggccttaggatcaccaggctgactcactgtcatacagattccaactacaaaaatcatctgggagcgccctccgaagtgctaggattctgctggctgttttatgaacagctcatactatgaagtggaaaagtaaaggaacattccaacatttcaggaaaaccaaggaaaaaaatgagtatgtgtaactggatggaggaagcctgggatagtaccactatttctgtgtgaagcctctcctaactctcagtgagatacatgctcactagggtcaggcacatgaaaggtctctaggagcacttggaggtttggaccagagatcaggacccacagtgcactggtattgttgtgtgtgctgaggttctttgggtgcatgcaacagaaatgcttctggctaatgtaagccagagtttaaaagaaggatatagaggtcccacaggattgagggaaggctgaagaagcagtcttagaaatgggtaagaagcaggcaaattccagaaactaggaagcaggaaacacaaggctcacaagagtcccacaggtctggtcaggacactccacttggatgggatgaaactcctgacatctccattctttttgtccctctgttcaaaattcaccttccattgaagggagcatctgattggcccaacttgggtcaaaaacctcctaattgccagcaatatccacagactgtatcctactgggaaaagataatccgccaaaaggaaattagattgttattaggaaagggagatgagtgctaggtgctctggcagccaccattcccaacccctccctggatgtttaagaatatataaaacatttcaacttgagaaagcagattgaatttttttagaaaagaatatgtaaaactgtatttcttctccagctgtactttccgagccctacattggtctaaatggaaggatacctttcagtaccagcccagtcatgcttttgcatgattacctctatcaaactctatttctttggaaggaactcttaaatttactgtcacataaatgtttcctggtagctcaggttatcctttgtaaaattctgtctacctctacagcttgaagttaattttccttaagtcttcaaaaataaaagttcagtcttgttattgatttagatccttgtggaaattttttagtatttccttactcttttaaatagtctttttccccccttttgctgcttttcctattggttttctttcattaaaaattgagacccagccagtcgcagtggctcatgcctgtaatcccagcactttgggaggccgaggcgggcggatcccttgagcccaggagtttaggaccagcctggaaacagagatgctgtctctacaaaaaaaaattgaaaaaattagctgggtgtggtggtgagcatctatagttcctgctactcgggaggctgaggtgggaggatcacttgagcatgggaggtagaagctgcagtgagccatgcagtgagccatgactgcaccactgcactccagcctgggtgacagagtgaggtcctgtctcaaaaaaaaaaaaaaaaaaggcacccaaaatttttagaatgactgtcacaataatagcacatgtccctgaatagagatcctaccttaatgttggttaaagggggttgctcttaaaaaggaaccatggccagtcgcagtggctcacgcctgtaatcccagcattttgggaggccgaggcgggcggatcacgaggccaggagattgagaccatcctggctaacacggtgaaaccccgtctctactaaaaatacaaaaaaattagctggtcgtggtggcgggcgcctgtagtcccagctactcgggaggctgaggcaggagagtggcatgaacccaggaggtggagcttgcagtgagccgagatcgcgccactgtactccagcctgggcgacagagcaagatttcgtctcaaaaaaaaaaaaggagccatgaatcactgaaacagattttatttttgtttttgttttatttacctctgcaatatccttttaagatcagtgtgataggagacccatcctaagggattgttggaaaagaggaaaaacccttaatgaaaagtactatcattttagttcttctagatttagcccatatcttgagattaaaaagacaattaatgggatattttgagtgagaccttcacatatatgctccctttgataaaatttgtgtctatggcagtttttttttcttaatcgaccttttcatttctttatttattagtttaaaatatttccatgtgtaatctcattttagttttcaaacgaattggttagaagaggtattttgtccccattttaattatgtagaaactggttcacgaaaagatgatgatttacccaaggtcatgtagctaagtggtcaaaaaactaggctgagcatcaagatgtcttcatttctgggtgtttatttaagtcagcgatctcaaactggggccagtaacacacttaggtcttgctaggaggggaccctgacttggaacccacgcttcaaagagcctaactctggctctttccagtcccatgggccaaagagccaagacacctcacattctgggtcccaggttcccagagtcctgtcaaatgtcaccaagtccatttgagtctgtcctcctaagggcattctgcacctttgatgtgagcaacattaagccagagggacagccaaggggaggctgtttgaggaatcaggggatagacagagcttgactcccacaggtgtgcaggctggagctggggtgagaaggggagggccgggggccaggagccagctcttctctgctgccctgtatctgtgtgcaactccaagatgtcccaggactctgaattctcacacctggctgccaggtctttaggaaggcatattttttcattgtaggcaaacagaatatattttgtttaacagttagtgagcttgatttatacttttaaatatttagacatatgatatggggcctccatttgtactcttgctccaggccctgcaaatgttaggggtgggcttgcagaacgccaacatagtttgtttggctagcacaccgctttttttttttttcttttttaacatcttgaattagtttctaacactaacaattgggagattttgaataagaatagagatttctgatttctcttttttaaaattacagaaaatcatgggccttcctacttgtatggcgaaaaagagctggggctgagcaggatcagcctgccctgggtggggctgggccagtgtttcctgattggccacagttcccacctgtttcccttctctcatttcggtaacctctgatctctctggccactgagggcatttgagtttgtcacccttgatttacatccttctttagatatgtcctttctgtataaagccaccatgccatcacatttaacacattgtttttgcctcttttctacaacttccctcaaagaaagtttttttctccattagctaagtgtaaatccctacattttagtatggataaatgcctataattttgccatcttattccctaacttctgaatcttgggaaatcattaaaacaacagctaggaacttcaagagagcagttgctctccacagggatcccccctttctccatgccatgcgaactggaaacccagtgcaatggattttctcactttgaccccagtgagggagggagatttttgataactgacaaagagcttttgttcaggtttgcaacaggatggatcagccagccccacctcatggccccatgcttcttccaggttcatcttccccttctgccccagaaaagcccccagccacagcctccttgcctccaagtcgccagcactccgccccctcctccgcctgcctctcagtctggaaaacagctttgcacgttaacctccaggggcattcactgggtttccagaggggtccccagccccacaggctgccaaaataggctctttacactccatagatgggagagaaaaatctgcttgttcggttgcaactgtcaagcaaaggacatgctgagctcagatagaaatagcagcagggtcagggcagggcaaggccccagcatttcattagctcggcccagctaagggtgattgaatgcacacagtggcccatgaatggggccatggagggcagccacacagtgcagcacagaaaaatcattctttggccgctgtcagctggctcaatgggacttaattattgggataatgagaactgattttcattgttttaattttggggaaggggtgagaaaggagggacttttcttcctcatctgggtgaaaggatgctaaactgtggcctctaacggtcccgtatcctccaggctgctgttggctcctgtgtttgctgttctttatcagtgctgtaagagagtgttaggatggtcatctgtgtcagtgtctcctttagggcctataaacctggcaggatgtgtcctcagaagagcatttctgtgctggcatccacggtgagcagctgtaccaaagcaatagagggacagagagaagccactggacagagctgcccatgctcagccccttccaaatgcctccaggacatgagggaatcctaccctgctcctttttttttttttttttttttttttaaatacaggatctagagaattcaaatgatctgctcgaggcaaacataggatcgtctgagttccttgcaccctgttcaaggttcaagagcctaggactctactgcagaccacaccacaacactgttggatcatcagacctcttctagctacgaatccttgacaattgagataaggtccacttacatgaaccctgaaagtcattacatatgacttattcagccctcccttattcaatttgattcacttgccaccttcccaagatcttactcttcatgtggaaatgagagacttatttattgctcagcttgttccctcatttctctaggtaacatgtactactagtgggatcatcaaacaataagtatttgcaaaactgggcttagcgtggttctaggtgctgtgcaagtatataatgacaccccccaacccaaagaaagtcacctggggagacctgaaacaattagagaaacacacaaggggaccctaattgaatgtgaatctctctagccaaccaaaagaaagagagggtgggtttaagggtagtgagggacactttgtgaagaaatgacagcttgtgaggactccaaggttgagtagaatttcaacaaagagcaaagaatggaattggatggtgtgttcgagagaaggaaacagacattattggaataaagattccatgtagggaagaaggttgagttgaagagtagggccagatgatgtgaagtttggaaagagaggcagggcatgctttcttcacccacaactataatacatctttgaccataaaaagtggttgttattgctatcatttgtttttgttttcactttgccccttcaagttcttgaaaaagatagtcataaaagaagagggtatgccctcattcatggagcacagagaaggaagccctctgtgatgtttccagatgtgtaggtttaggctctagaccagtgctggtgccttcctgggactgcccaagccaatcaccagggagaggctgcagatcctttctctgctcagctccgttcgggctcctcttttcttgaagatttgacagatattggttaagttcttcaaatctgacaactgggttctttgtggcaaagaataggtggctaaggagaactggctctaacaggctaatagcctacctggcccctttccagcaggagaaatgccatagtccttcccagaagcacatcttatatgcacagtcctcacagagtgtgtctgtgcatcagaatcaattaatcatgcctgtcaggagggggaatggcccctctggctgaaacagtggaaggagccctcgtgattgaagaccactttgccttggaaactcatgcaggtcagaggggaaagttgagtctagatggcatgcggtattccttgggtatgttttctcatccctgaaatttgcccatgtcacccaactaactgcttgtagcaaagctgtattgtcagtgcaatcctttggggccttgtttgggcctgaagaagccattcatttcttaaagaagaaaaagctggcaaagtggaatttgtagtaacagctgttagtatttaaaacttttgtttcaagatcttcaggcacttaaaaatgactttaaatggccactctgcaagagtctatcttttacaaggcagcctgtgagatctttctcaaaacaagcctcatctcatctcctcttttattgagatccccattggtcctctattttgtatagaagtggttcccaaacttttttgatttaacaccccatcagtaaacaattttgaataggtactctcaatatacatatatttctttttatattatacacatgtattactttcctaatatattatgtacattataaaacatatacaaaagtaatttttttaaaggctgagataaagatgaagtaagcaatagtttaaaatgtcttgtcaattatgatggcttcatactgtcattagctaatatgtcaaaagcacaataaatatgtcaggggagttccatttatatcatttgaatgatataaatccttatatctagtagttttcatggaaatttctaactgttttggcttgacttcttgttacatgcaaatatttggtcattgtcttcactttgtaatatggccgaagaaaacttgttctaagggcagtgtcaatgctattattcttattatttgcttgtgcttatactactaatattatctttgatccattgtttccatgcaggaatattttaatccacttgtccattttgtgtgtgttagattaaatttgataatatccataatccaatgagtcaggaatgtgcaaattgtagtgattcatatgtcattgaaagccccaggggagtgaggactgaggacaccatttgccgcctctgcaatgtgcaggtcctaatcttgccacaagatatctcatgaacaattcatgacacataacaatggctgtgaggagcccgttgtcaatatttatatcaaatgttgtaagtccatgttttttatttcctagaaaaaaataagttcaaattctagtactttctgacttctaaattctaatggatcatcttgtgtatctctggggcatgcatcctatttcgagaccagatgtctacaggatggatttcaaacccattagccttgacttacagggtccttctctgtccaaactcagcccatctttccagcctcatctcccattgttccctgtcttataccaaggagacatcccattgctttttaaacatgaaatattctttaataactccattcttttgtgcttactcttccagccaactggaatgcctttctcccattctctaacccaagttaaatcttcgtaagatgtctgattcccttagagcagaggtcagcaacctttctgtaaaaggccagtcgtaaatatttcaagctttgcaagccatattgtctctgccaactactcaattttatcattgtagtgcaaaaacagccataggcaatatgtaaacaaataagcatggttgtgttctaaaaaaaatttctttacaaaaataggtagtgggctggatttggtccttgggctgtagtttgccaacccctgccttagagaacctgtcactcttctactactgccatcctagctttttctccatgattatctgtttacaagcacattttgccaaaatactaaattctttgaagtcaacacttttattcctattccctaaaagctagaaatctggaaatagaaatgattcaataaagacatattattgaatatcaagaattatcattatgttgctggtggaaaaaagtggagaaaaattcttcggttgggtacaagattaaatggcttacttctaagatttatctaaaataaaagattatataaaaatacaaattaatgagatggaaggatttgtcttgagttggaactaggtcttctaaaagggcagtcagtgtcctgctcatctgatcacccatgttcatattcctgccacattgttttggcccacagcttcgatgagacctagagaatcacttccttttcaaccatacagccaccgctggggccaaccactccctacgtttgtataatgctgtatggttttcaaagcaagtagcacaattcctatttggtagataaggcaattgaggcatattaaatgacttgccctatgaatgatataactgggacttctgattcctaatctaggactctttttgttacaccagacagcctctcaggaaattagaacaaaaaaatgacatattgcaaaattaagtcaaagaataaattaaccccatttgaaagtccaaggagaccttcagacaaatgtgtatcagaatttcaatggtatttggcagagttggcctaatggaagtgtggacaccctgccaactttgcataagatacataaatctcaaaatcaatttaactaactttcatttatcttggaaacacaaaaatttagactagaacttggcaggaataaagagatttacaccaagcctgcatccccactactcttgtaaactgtttcatgaaccccagtgttgaagacctcactgttttgtttgactctgaaggccgcctacgcatacttgctgctggaggaaggttaatactgactcagaagcaagaggaccactgactgaatcaccaccacttactacagtcctctgctctgtattccttggaaatctcttgcctcagcttgggcttaacccaacccacttagaaggagagaacaattttacagccccgcatggagtgactccaagccaatcgtatctgtttccaagtgatctgacgcagcaagcagattgtatttcctttggaggcttggctgagaattgttgggttggcaacactgaaccagagtgaataaaataagactgtcaagaaaaatctgaaatggcccctaaagagataggactaatgaaatgctcaggtcaggggtggggtgctttctgggcagactgaaaaaagaaaggaggaccaggtgaccatgtgtgaaattcaagagtcaacaatgatctaggtaagccaggcagattggcacatgcccagtacttttctgagagcaggcatcaagcctaaaaaaatgcacaaaatctacctcttatttttattcttacctttaatcagattttttattgaagttttttcatggttggttacctatccaccttcctcccatcctgccaaagaaggcagggactccaaatgcatttgccaaaaaccaacagacccctgtgttcaattattgtgggcttagggaatagtaattaaggagttccagggatgggatgtgggagcagcaaaggagttaggtttcacttaaggtccttgggaataaataaatattctgtcactaggatgaatggggttggttcttcacagatcatgtaaagggacaggcttagccctagaaccaactcatgatctagatgagtttctgttcagatggataagggcatatctttgagcaccaggttccatgggcacatatctggttcattattctttgctttgcttgtgcaaaattattttcaaaggcaaagacacggggacaaagttgggctctttgaggctgttccttgagcaaagaggtgtatgcctctggctgcccacttggcagtggatatcttcatgcttcttttttccacccaaatattatggccactggagtatttgtaggaaacagtctaaaaaaagacaacactcacttccccttgcttcaggctcttcacagtcaactccactggcatgtttcaggcacctgctgtgtgccaggcattttttttcagaatggaacaatattgcccttgtctttaatgccttaactgtctagcaggaaagacattattatgagtacctggggcagaaacagtgtgagaaacattttggagacccaaaggaaggggccattgtaaagaagttccaccagagtagaggtaagaacggggacagggcatgcctatagacacctatccatcattcgcttgtccacacattgatttccctaaatatttattatctgcttgttatctgccaagagtgaagggcttgggattcacagatgaataggacatggaatatagagtagggggttgggcagaagaagggagtggtgggagagggagttgaaaaatagattgggccgcattagtaagacttttgcttgccaatttgggtctgaactttgttctgtaggtaatgaggagcctctgaaggtctttctacaaggggtggcacagatacctgccccaccccattatttcctaccctgcaacttagaagtattttattcatgtatctgttttttagcttgcttcttgtttgatttccctaactgggatgtgagttccacgaggacagggaccctactgtatccaccactgtattcccagttctgggcacaaagtctggcacacagtgggtcaccagcaaatattttacttactgaataatcagatctgtgtttagacagttgtctccagttgataccatggagggacatccaaggttgggagatcctggaggaaggactggtagcagcagagaggtgctgagagcctaatccggggctatggtggcatagaagggaaggggagagatttagaggactcatcagagttaacatcatcagaccttggtgagggagagggagggtccagaggtttccatgtggatgtctgagtagctggtgatatcgttgactgagagagaggagacagggtaggaaccttcaggtgaagaggggcttgttatgggaagtaagggagcatagatagtgagatcagtcttggacatgtatgatttgagacaaccatagaatgttccactagagatgtccagtagacagttggaaatatacgtgggcaattctggaagatggctggagctgaggtcacaggcttttggtgataaacgaagccaacaaagagtaaagtcactcaaggagagcagacagagttgaaagaaaaaatagaagccccaaaactggaggaataccactggagggtgggaaagaggagctggggggaggagacaggtgtgctctgagaggcgggaggagaagagaagaggacttctggctactatgggatagcatgggccctacctaggacagggcagaggtcagtgggaatgggagctgttatcttgggcgaccaactccactcagttcttaccatgttaatgttaatggcaaactcttggcaattctgggcaagtgagaagagcagaaacacctctgtgcagtttatcaggactttctccttctagcacaccctgagggtgaggccagaattagtcatgtgctgaatggtctgcctatttcatgatgttctcagcttggaaacattttttttgtgcaactccaactcaagcaccagcaaatccagcctctcctcacctcctattacaaatggctgtcatggactagaccggtgcctaacaaacagcccacacttcgggatctgagttcaggttccggcacgattagtgcaggtggcttctggctctaaatctctcagaggagacatcttcttctgggggctgattcacacgtgagtgctgatcatgaccttgtgtcgggattaacctcctttctcagcatctcctgctacattccatctgtttctaaagacacctcattctgccttccttccggccatccactgttacctttcacttcctgtcggcacgtacaggccagggactttactcaagtcactgaacattttggggaaatgaaatgaaaacataaagagaaggccagtccacaaaacagctcaaaatggagatgctctggctgaaggaaggagtgttggggtccaggagccccgctcactcctcagcacccgggagcatcacggaatctaaggtgaacctccggggcaggagacacagcactggccttagagtccacaagcccgggttccttggccctgtctctttccctctctctgttgtctgtagctccctcctagctctgaaactccaagtacaagtgagcaggtcatgagtcaccaagcctcttttcctgggcgtttttccttccggggagagaacagccaggcttggacaaaaagtgttgggacaccctgaagcagaacacactccctgtcattcctggcctcactctcctccagaacgaaagcacccagacctgcaggccttttttaggaatgaagtcactggtctgtgtaggttgacagagtgtccttggaaaaggctgcttgggaaggaaactcacaaggcatgggtatccccactggaagaatccagagcaaaacccttctggaaatcccccaccccacatatacacaaggaaactccatggaaggcatcctgtcttggaggcctcagtgggttcctcctggagagtttaaggggagggaggcagaggaggaaggagagaaacctaaagtcagcaggatattctcatgttctctctctgttaattgcctcctctctttttctaagaaggctgagataccgaggcttcctcacccaccaccccttcctctacctccccttagtgctgggtgagttcatccatcaggacccctgcctgggactgtcctcactctcccgctgtggctcacttgcccccagggcccatcccagcccagcccagccctgcccagcccagcctgctgcatgcttctaccccggctcccactcaggctcgtgcgtcactgctattcatcttgtttagtgcttggcttggctgcagatgctgtaaatatggtaattttagactccctgattggaaaggattgcagagcgggttgtgggggaggacggcagtttgatttactccgcaggagctggttccgagatggctctccaccctctgtgcacgcctcttctccaagctgtgccccatcaggccctactcttagtgttgagtcctgacttcttggggtcttgggagaaatgagagggacagagtggatgtctgtgcgttctgggcctgaagaattgctggttagcacagagcatcacatgcaaggaggccggaagtgtagtcagtgatgcgcagggtgggcgtcctgacactgctaagacaatgcccaaggctgatgacccaggattatccccccacccagggcacactggggatgaagtgggggctgcccgaggcctctgaccccttctgagctctctcccttttctgttctcctttctttcctgacctccctccatggggggccatcagtccccagggccttctgccaggcactcacagggttgtcagcaaatccctcctcccacccctttgttgaataaagacctaatttgcatttgattacaggacccctgagtgggtaggggtgtattcagatccccagggagtgactgtgaggctggcatttcaggccctgggagtcagagtgggagctgagggttttgagccccaggagtaggtcaggttcttcaaaagccaccagatagtctcccagctgtctgtcttatctcctcaggacaaccctaactccaaggctggtgactgagtcagacttggaacatccccgtttttgagccacagtctatagtcacagaatgttccagggggagggatggggggagaaaaggagggcacaactcacatttctttgagccccaaacttcatttgaccagtgaggagtggcttgcaccaaatcattggtgcagctaaccacaagaatgttagctcttatctagtgcttcatccatgccctggacacattttttttttttttttttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggccgccctggacacatttttatagaaagatccagatgaagggaaaaagaagtctgataggtatttctttttactaagtcatgtgggaagctacagcggaatcctgccactctctgctgactgatggtgagcttatgtttggtgacaggaaacttgccatctacaaggcagcctcttaaaacttcggtcagctctgaccgttgtctaataattcttcattgctgcaagttttccagctgtcccccacatctgttttagtggtggtggaggattgggggactcagaaggagggcgtagattgtcctgctacagaaaaagaactagcaggactcctctgagggagcaacatggagagactttctcacccctctgcaggcaggctctgccccctttcactcactggagtgctcacttcctgtgcacacgctgcgccgtgctccctcctggcccatgaggtgccagtcaccacacacttggatttgtttacttttcctcctggaaatgtggacatgagggcattatactcacttttcaaagcaaaggattctttcctggaggggttaatagtccttaggtgtaagtacccctccagtggttgtatagcagttgtctgttgggggaccttaagtgattattcatggaatctttcatgctaaagatgcattgcagcgaaacgtcattggtttggaccaaatccggttatggtctgaagaacctcaggtatgggacatccccagcaaagcagtcttattactctttatcctgcagagtcacagcttacagaatcttccctagaagaggtgtgcctggtgtacttttaaaaatagatgcgcctcttgtgtaaacagcattttgcctgttggaatgtaaatgaatgttgttggagtgcttggagacagtttgttcttttagtggattagcaatttcccctgcaaatgttgtttcatggtatttgctaagcacatccttccttcatatgcaatatggaattccctatcagccagcctagatgggcgaaaactctggaagttctgctgtacccagtccatcaataaccctagcagtgatctgtgttctagaaaggcaggggtgggggatgagtccaggttttctaaagacattgggaaataatagcaaattttccagagaaggagttgcttccaaaaatttaaaaaatagttaaagagaggcatttataaccatgaagagtagtcaacagagaaaacaaacatgccagtgaatgaacatcctagcagagggtggagagagcaagccagaatagtgtggagggggtacaaaagtttcaaattatcttccctatataaaattcccatgatcccccaggcagtcagttttaactgcttaccccagcactcccaaattccattcttccggaggcctggcaaagcacctcctcagcactcactacccagtcccaggcctcaggcgtgctctccccacacggctgctgtccccatcttcacttccacatcatccttggatcctagatcactgtccctacagctcacttccttgtttccactccctgtccacacattaaatatccatgctctggcctggcagtcagcagtcccatgacctggctccagggccccttcagccccaagtcgcgtccctcgcaggtttgatgcccaagcagcagatttctccccaacagaggcctcagagagtgcctggctgtgataagcatgtgttgctgtgattttgtcatctgtctccttgcttttgcttaggctgttcccctgccttcctctctgcctggcaggattccccccttcccaagaagtgcctgcttctgatctccagtaagtatctgacgtcagtcatattcttaaatctgaccagctcacagtatttacatccaggatttctctctttttctagaatgaaaacacctccaggtcaagggctttctctcacacttatttacacctcagcacctagcacagagtgctgtacacagtagatgcttattttagactgtgatatccttaataataataataatagctctgcattattaatcattttccatgtgcaggcactggggtctctccccagatgcatcttcagcacaaaccaaagagtgttaccatcagttacattttatggaacttgccaagagcgtaggtaataaatgacagagctgcgatttgaacccttatttgtcccctctaggacttgcatttgaagtcataagggtgctgttctattactctcatgaagacagggaccacgtctttacctaaggcagtgttgcaagtggagactaaagaccaaatctgccccatagatatgttttgtttggcccattctgtgcgtgtttgtttgtttctttaatcaggaaattttacatccacatctagatttctggctttgctgggaagcccaggagatacagtaaccctggatttaagcgtagtgatgctggccagtgctcgaaaccgctgtccccacttcactacagcctctgcttgcctggcctgagggtaggggagcattagagtttgcgtcttccgcactgtactgtctggttccatgtttcacctcccaggcattgggattggggtgggtccgttcttggttatataggactgccccatatattgcagggtgtgtagcaacactggccctcacccgctaaatcaacagcacctttccttcagtcatgttgacaatcaaaaactcccccaaacatttgcaaagcccctagtgagggatgctgccccattcccttttgagacacaatggcagataaccccttgtctcaccagtggtggcacacagtagggcctccattaaatagatttaaaagacctaaaatgcaacatccattaccaaatagttcccatgttaaaagttcccatgaaaggagaagcagaaaaatgcaataatcatagtatttttttaaaaataaattatctggagcaaatttagtgcattcccttaaacacctgtcccatgatggaaaaaaaaagttagtaataacacgtttctgtggaggcatttccattctccacgcctcagttcccactgtaatgttaattggttatggttttctttgcttctagtccttacatgtgcagctgtcaaccaggcaccaccccaggaaatgctgcacttaaagggataagtaagaggaactgaatcacatgcagcttttctaaggagaaatgatattgttaatatttttgcttgttgttctaattataaaaatactatgtgcttatagtagaaatttcagagtaaagtactaagaataagtaaaaatccctcatactctcatcatcagaagataatcactgtttctatttttgtatatttccttccagtctttcttcctctatcgcacatatttgtgtttgttgttgctgatttcattttgcttctaagaaaattgggattgtactattgataaagccctccttgccactgcatggctgtaccatgatcagtttaaccagtccccttttgttgaacatatggtagcttcccagtttatgctgtgatcaacaggacagcaatcaccttctttatccataaatcttttgggatcacttggattatttctatagaaagagtaatatggtaagcagtgtagaaagaaaccatcctctccacaagagagatgttattggctctggccctagaagagatgggcagagccaagggtagactgagttctggttaaggaatttccaggcaggaagaagttcatatttttgagctggcttctctagtgcagctgaagacgagccatctactgcgagcaaagagaggcgaggtggggctggggacttggggagggtggagttggtttggagctcccagtgcaggaagcaaacaagggcttaaccaaaggatgaaaattgtttggcagcattgagcacctaggtcacactgtgtgatttaggaatagaggccattagcacagatgtgcagctctctccagtgaggcagagacaaaagcagaggtggggtggaggtgggtggggggagggtggggatagtaggatcatctcaggtttgggaaatggcctgacagatccagccaaaggtcagaggggctggtgagagcctcatgaaatcttttcccacccaaaataataagattgctataacacataagtaaaaatcgtctctgcaacctagcaaacagagctaagaaatgagctttgtctactaaaatggctttacagacccaacatgagctggacatagaccctgagttacttttagggtataataataacaacaatgaaaactttctacagcagatcacagttacagagtgctttatacaatacataagtccaatctcatagggtattactaagtgggtcccccattttcaaaggagaaaactgaggcttagaaagggtgatgatatgtgtaagtgtaaataggtagttgactgtagagtcaggctccagaccagctccaaggacagatttgtgataattaatctattaatgtgaccatctcttctgtccttgcaagatgacttttgttggaaaacaaaagtctcaaaacaaaagtcacacctgtgaccttgacctcctaagcaagacaattaaccaaacgagctaacaggaaaagccagttcttcctgggtgtaaagagtggtctcagtgtcctacctaccaggctggtctccttgctgttctctgaacagacctcacacagtcctcctgccggaggtttcccttggtgagtggtttctacacctggactcctctcccccacatgccgacacagctgattctctaacctcttcaagtctttgcttcaatgtcaccttcccagtggtgccttccctggctcctctaccttaatggcaacccccgccccactgcaaactccctccaccagcacttcttgtcttcctttcctgctctttattttcttccatagcatttatcaccttctaatatactagtatttcattcattttcttgtttctttttgttttctctaccataatgtcagtgtgacagtgcagaatttttgtctgttttgttccctgctgtttccccatgcctagaagatgtccagaatatggtaggtacttaaaaagtaattgttgaatgaatagcagccgaggtattaggaaaaattaaaaagttttttttttttttttgagactctcactctgttgcccaggctggagtgcagtggcataatctcagctcactgcaacctccacctccagggttcaagtgagtctcctgcctcagctccctgagtagctagaactataggcacctgccaccacacccgactatttttatatttttagtagagacaaagtttcactatgttggccaggctagtctccaactcctgacctcgtgatccgcccgcctcagcctcccaaagtgctgggattacaggcatgagctaccgtgcccggccaaaaaaatattcttaagaagaacactagcacagtgactcactcataataggacatccgtatgtgctggttccttctctcttaccccttgttctgtgttaaatgttatgtgctcagcacatccatctttggaattaaagtatttctgggaaagataacacattaagccttaacatccagtccatgaagctgatatcacaggggaagaaacccacactggctcttaaggaagtgggtgagtcgtacatgaaacgcgccagagtgtccctgtctgtctaacggggtgggacacatgatcttggagggtatttccagtgctgcctatgattccacccagctatgaatcagggtgggcagaaactggaaacaggcatgtgggacccaggtggatcacagtctcccctcttccacctgctggcattcctgcctttggggacagcagggcgggtgaatcctgggctgtttgctcactgacagccatggggttgcaaaggatcccttctcttcagccggggcactgctgagttacttactcacccatcccaacattcatttattcagtagaaacatattagatgtccccagtgtgctcagtgctgagctgaataaaacagacaagaccctgattgacagctgggtgaaatcatagacagcactggaaataccctccgcatcccacccctcaccattagacacacagggagaccctggcttgtcctgtgtacaactcactcacttccttgagagccagtatgggttttttccctgtgatacctgcttcatggactggatgttaaggctcaatatgtgctatcttttctgaaaagaattctaaaggtggatgtgctgagcacaaaacatttgacatagaagggaagagaagaagggaatcggcacagtgagttcctattatgagccaagtcactgtactagtgttcttcttaagaatactttttatttcttctaatacctcagctgctattcactcaatggttacttttttaagtacctactatattctggacatcttctaggcatggggaaacagcagggaacaacacatggccccacagtcaggcaacggggacagacctcaaacgtgaaaacccacccagaccagagccatccttgggcaccctgatgcctgttggactttcctatcctactttgggactcttccttcccagggccttgctcaggcccctacctggaaccaacagcctccagctgctctccttgtctgaagcgtcctcagcatgcccttcctccctgcagatcgctcccagatggctcctaaagccatcaggtggagttcagcccaggctacccagaggacaagtgaggggacccctgggggatggggagagagcggcctgagaagaggaggtggctagaaagaggaagggaggaagaacaagactgaggagtcttttaagagcgtgaaacctgaggagcaaatgtcccagaaggtttgaggaaaggttcactgggaaatgcactgcaggaaacccctgcatggcctctcaggaaaccctaccatggagatcacattaggcctgaaaatatttgcagttacatatgtttctttgaatgcaagaccaagtggaggccatcttccagggagggctggtcacaccaactgcaagcacaattttaatctgtcatccacaaagcatcctagaggatggcgcctgcatacccttcctgccttgtttcctaccaccccaccccaccttctccacacaccctgagtttctcagtgttccctgaataagcttcctcacacctcattccatggcatcctcaggagtccccggcattggggcactgccatttctccttcctgtgttccccagccctacctagccttcaagcctcagctcagagccttcacctcttccaagaagctttggctggccacctggaagcatcttcggctcctttctacactttcaggagaacactttttataaactcccttgtatggggtcattattttatgtacatgggttagctgttgcaccaactacagatgaatctccactcataataagtttaagttccaataaacccatcgaaagttgaaaatattgtgagttgaaaatgcatttaattcacccaacttaccaaacctctgtagcttagcctcgcctaccgtacacatgctcagagcacttacattaacctacaatgggcaaaatcatctaacacaaagcctactttataataaagtagggaatatctcatgtttattgaatactgtacattgtgttaaaattggaagtttcacaccatcataaagtcaaggaatcatttagttgaatcattataagtctaggactgtctgtagatgtaaatttgttaagaattaggactcaagagtagaattcctttaatccacatagacttacaatggtgctgtgcacatggagcccctaaatcattgctgactgagtagatttcccagggtaagcccaagaagttactcctagaaggggctggtaggggaaagagccaacatcccacatgcctgcccactttgggtctggtcccaagaaacaaactccagtggcctcgaaaatttaatattgctgtcagaagggcctccccttcaaaggaacaggtcctgatagctcttgttatatgcaaagtggaaaggtaacgtgactgttctctgcatttcctgcctttcaattgagtgaagacagacagatgatttattgggcatttcctagcctccccttcaccataggaaaccagactgaaaaaaaggtgcaaattttaaaaagatgtgtgagtatcttgagggggctgggggagaattcctgtgtaccactaaagcaaaaaaagaaaactctctaacagcaggacctctgatctggaggcatattgaccataaatttacgccaccccatgagagctcaaaggctgtgctgttctcgtcctctctcagtccccatttccaggtgatcaagcttgggcttagggtagtggcagtgtggctttagctgtcagccatcaccatggaagagcaggaggtttaggggccttcataacctttcaagtgttggtttccgttggaagtagttgaatatctccaccccacccatgcccctgagagaaagccgggaagaggggccaccatcgggggctcagcacctgcaagcccaatgctgacatgaaggcttcgcttcattccattcggccacgagagctatactcgcttcctagggctcccctagccacgcgggtactttactgagtgtctgaaaacaacagaaattgattgcatcgttgttctggaggctagaggtgtgatatcaaggtttcggcagggccatgttcctcctaaaggctgtggggaagggtccttccttgcctcttctcagcttctggtggtggccggcactcctccacattccttggcttgtagctgccccactcccgtcactgctgtcatcttcacgtggcccttccctatgcatctgtgtcttcacatggtggtctccttgtggatgacagtgtctgtctctgttcctctcccctcttcttataaggacaccagccgtattggattgagggcccaccctactccagaataatctcatctccacctacatcataattacatctgcaaatatatttttatttcaaaaataaggtcatattcacaggtaccagggttaggacttcagtgtatcttttgagggtgacacaattcagtccaccatgggagacacatgctttttgtccatggccttatagggaatccttgggtgactccgtatctgtgtgtaagtatatgcctgtgatttgtattcatatagtgtcatatacacacaaatacctatatatttacatgtatatatatataaatatgtatatgacatttactaatacatatctctaataggtatttgtaatatatataaaaatacctgtgatttgtattgatatagtgttatatatatgtgtgcatatatatatatacacacaaaaaaacctgtccatatatatgtgtctatagagacaaatacctataaaatagtaggtaattacctatctatacttataatagatatttttaataaatatacaaatatctgtacaaacacctgtaatttgtactcatgtagtgtcatacatgtaatataaatacatctaaatataatctgtcatacatatgacacgatatgaatttgtaagtcattaacctgtgattaatacacatcccaggggcattttttttttttttgagatggagtcttgctctgtcacctaggctggagtgcagtggcgtgatcttggctcactgcaacctctgcctcccaggttcaagtgaccctcctgcctcagcctcccaagcagctggaattacaggtgccctccaccacacccggctaatttttgcctttttggtagagaagagtgtcaccatgttggccaggctggtctcgaactcctgacctcatgtgatccacctgcctcagcctcccaaaatactgggttacatgcgtgggtcactgcgcccccaggagcaattctgagtaatgccctgatttcattaatcaaaggaagactgcagaggtgtttgtagtcctttttctgcaattttcccactaaagcaatggcaggaaaggtctgtcgtcttgaccacagacacacacgcttgccaggactgcaccccgaggaggactccagcatgtggaatgggcagaaggcagaagccctatgtctgccctggggtccccagtgctgaaggcagcagctctgctggctgcgcggctcttccctaccttgttttggatgagaagacccagacccagagtcctgaagtggcttgtccaagtccacatggacacaaacagttctagaagtcacactgccacatacccagcagagctacttctcttctctgcctcctccttgccccattttcccaactaataatcagatttttcctcggagtgacttctgacgagcatactcagatgttacaggtagtcacaaaaatagcacccttttcccatcaaatgggctgagaaacgatttttcacggaggtcttgccacattcaaaggttaaagtactttgtgttctgttgttttggagctgttggagaggcggaaaaaaaattctttttcaatttcataaaggatttttgttttcattttctcagactccagactgactcaccaaaaggttcatctcatattcggcatacagtggcccacctgggaggtcttttattaatgagtctggggacttgggggctgctgctcccctaaatctacttgaaagtgaccttcagagctgggcgcggtggctcacgcctgtaatcccagcactttgggaggctgaggtgggcggatcacctgaggtcaggagttcgagactagcctggccaacatggtgaaaccccatctctactaaaaatacaaaaattagccgggcatggtggtgagcgcctgtaatcccagctactcgggagagtgaggcaggagaatcagttgaacccgggaggcggaggttgcagtgagccgagattgcgccactgcactccaggctgggtgacaaaagtgagactccatctcaaaaacaaaaagtgaccttcagaagcactgacctggcctccccccgccccacacacacttctgccccaggatgtccccctctctccatctccaccctgctctctccacactacaaggctacttgacttcgcttctggaagccctagggcctgattctctctccctcatgctcactgggatcatccggcagggaacagaagggatactgcttccgggcagaaaatgggccagattcaggaacgcctgaaatggggctctggaagccttttgcttggaactttcttggagcatgtttttgccagggccatcacccatctaggagttccaaatggtttggcagaaatattgccctgcctcctacaccttcctctgccactcctgacttcctttcaccccagcctccccagctgagaactcccatgctggctcccaaatacacaacaagctcttcgcatggtgcccgcttccacaacgtctggtgatcaacgtatcctaattcattggaaagcctaaattgtggacctcaaatttaaggatcatttagggggcttattaaaaatatcggtttctaaccccaccactcaaagtcttattgaggtctgtggcagagcctgggaatctgcattcttagcgcaccccaggggattctgaggttgggcatctagagggcccccttggagaaatacagcttaattctacagcaggcatgctcacctggggcctctgctctgcagagcaccgctggggacacttaggcgaggtgactaggaagaagaaaagaatagcagtgtgaggattcaggctgaggtataaatataaaccaggtaggtcaaggcctgggcctgggaggagggcagaggaaggcaagttccccgtgtggcttctcagggaccagcagcgtgagggttccacgtggcaacgctgctggagagatgtttacatctgggcactggcagagccttctggacaggccatcaagccagagggagcaggccctcgagctaaatggcatcattctgagacgggagctccttcagctttgtcctcaaaggcactgcagcttggtgaatgaacataccggctttagagtcacactggtggcccgacttgtctggtctctgtagtttcctctgctggaaaaggaggacaacagtcttccatgcagagggcgagtgggaggatgaaatgaggtcatgtgtgcaaagttctcagcatggtccttgtggcagcaatgtacacgagctattgtctttgtcctcagagctgctcctgtctgcctcacagcacgtctctgaagctgtctttgcagaattagaccacatgaataatttggagagtccataactgtcctagaaagcttttggtttgtcctttttctccctgtgaaagccctcgtcaccctggaaatgccagttctgaagaggcaacgcttacaacgcatcaaattttctctccaagtgaccctgcctcaccagacatttgcagcccttccagtgatactgaaagaaccactcaacaggtgggggccagatctttgcaacggaaaatgccacttttgaacgccaaacctctgcctgacgaaggctgtgtgatctacagggtgagacagggagtttaaggtgggaaccaaaggctcttgagcaaatgcagaaaggaaatggacttatgcagaggcccatacagcccccagtcaaccctgcctttgccatgtcagctgtgggggattttgtgctggtctcagcctctgagcgctctctgcctcagtttccctctgcagggtggagccagcacccacagccatgttttggcacgtggcaaactaactccttttgtgtactgtgcagtcttaggagtaatgaggcagcaatattattgttagttctctgttctaatgatcagctgtgaggacctaagcaaatgagagttgctatagtgttatgaagaaaagaccctgacttgttagagtggccatttgtttccccacagctattcatccccctggtgccctcatcaccagggcatatctaaaagatgccatgctagatacccatccagggtatggtacagacatcacaaggtaagtattccaaggccagagaagtgaaaatgttcacagcagctctggaagagaggaactcagaaacctctgggcaccttctggatggagcccattgcctccacatccaaacatggaccatgtattgctacaaaggaagcaatagtgtgctccacggaaggcccgggctgctgccggtccctccagagttcacggctgggcatgatgagaccaacctctctcaccctggccgcttctctagccagtgggagggcagaggctggcagaaaagcctccgtctgccttgttgactctgccgggttcagagagggcttcacatttgacttggcgaaggagagaagttctttatttccctcagcctcaggtctgccaagcccaaggctgaggtgagcagttttctcctccgtctctcattgccacatcattacctgcagagttcaatgaaaagccccatccagaatgggccaagccgagcctgcaatgggcttgttctctcctcggggcgtgctccttcttcccctccagctcagcctgccaggccttcccagtgatactgcgagctgggtttttctttcttcccgccccccaagtccagagcccagttatttacccaaagaaaacagggaagtgacaaggtaacagagtacacatgttgtgaaaatatgcaggctggggctgaagaaaagaaaacattcttccataagtagctgccttgttaattcatttttttctccagattagaaccagccatttcttgtgtgccttcaagcaccttctgtggtttcctgacagctgcctgcaaggggtgagatttggcttgaaaaatgggccatcggtcatgcttcgggggaagggcagaaaccaaaattcccagattgctcaaattcactgctccttttctaaatgggaacgaaagagggagaggtggtggggagaggactgtataaactctgaggcgtaacctgattttccgtaagaaacgacagctcggtaatgagcagtccttggaacgtgcttttttacctcctcttgaagttggtttccgatccctggcaagcctgtgctctgcagccttgagtaacggccacaggccgattctcggcaattaaaaataatattggccctgatagagaactcttgggtgctcccccacacatacacacccttttcattatgtgccaaagatcactttcccaaacctgtttcggaacagctggccgcactagagggcctgcatgggctgggggaggctggggttattaatagcatttgctctgcccggtgtttggggcaggaaaggggtgatttgcgtctttttggaaggctaggccctcatcagtttgggcctgatttttctgcgctggatcctttaaacctcagggcctaccaagaatggttgagaaagcctgaagagaggctctctgcggccaatatcccttcggtacaaatcttcgtgcttctcattatttccctcgtcaacagtctccgtctcctttgcagcctgtgggtattggcctgcagcttggctggtctccttttgggagaggtcatgccgcacaggcctagccggcccctgttagcattgctgtggtgctttctgttaacgagaggccactgaagctgggcgatgcctcccagcaggggacgggcttgtgagaaggagctgcttgttgttgcccttccccagagaggaagccgagtgcaggcctgagcgggcagctggggttggagaagcttcacgatcccttacttatggccacagagttcatcagcttcccacgaccagcacccatagccttaaccccggggtgggtggaaactctgctatctcctcacagggctccccaccaccacaagggcaccttcccaagagcccaggagagggctggctttcaggcctggtgtggtgttgataatcaggtcgggttgagctgaaatggaaaaccttgagagtgaggtggatggtgggctccaggctggcatctcccactgaaagagccgggtcgcagagacacactcaacaagtgccagtggcctggctggctgaggggacctcagagcaccagtgtttgggaccggggctgggaaggccctgccatccaccctagtgacatccgtcatgtggccaccaggttcccactgggtgaacacagcctctcccctcactgagccagattccagcctccggccataggtgaaagacaatttccgattattgttttcaaacattctacatccagcgcataaaaacacaatagtgacaggaaaaatacacacacacacatacacacacacacaccccacatgcacacaacacaaaggtttaagcgctcactataagaaggtcaggggacccttttctcattccagtccttgatgtggatccaagggaagcagtgcctttgaagtcagcagcaaccgcagcaggctcagctgtgagggtgtggacagggaggcagacaggatgtgctgccttatcagggcccaatctaaggccctcctgtaaggaccaagcttcctccagcaaaaggtgacttagaggtgtttgttcaataatgcgaggagactcattacaaccctggggcacttgggatctggctctctcagagccaagcctttctgtttggagttttgcacagccctttaagaggagacttcagagtgagactctgtctcaaaaaaaaaagaagttctttcttacattgaggtggaatctgccactccatgactttgattcattgacccagttttgcaataattctcaagagctgggaagaagtatagccagatttcaataccagggagagcaggcagagaaagagagctaatctcctttaccccatccttgctgctgtctctgtctcatggttgattattaatatattgattacattttgaacagactgacacttgctttcaccctaatgtattttcatgaaatacttaacatcttcatgtcaatattatcttataaaacactgctgaaaaggtgcatgttggagaatggtgtctcactccatccagttctcccagtgcaactggggagggtatctggatcttttccctggaggtgtctggccactctcatccccgccgggctccaatgtggccacaagccactcttgctgaaggaagtgtgtctgcttttataccttgggtatgttggggtagaaagctttaggaccattcttctagaataaggtaaacttgctccctcttcttggtgccaagccacctcacttcgctgggccttgtcactcttcaccctctctcctgatttctccaggttaagcagctccaggactcatctttctctgtacctgctgagaaactaactttacatagctttttactagaatgtttgctctgtgaggtcggggagtgtgtctgttttctttactgctctgtcctcagagtctacaagtatttgctgaatgactgctgactggtttcccaggtgtagctgacaaaaccctatcttcagctcttacactctgtgaggaaactctggagaattaataagaaggtgaacctggtctatttcccatagaattgtctgattcatcccctttgttagtaattagaagaacaacgtcaaggccaaatttcaaacagcaagtcagcagcaaatccaggcaaacccctcaaacttgagcactgcttgtcttgtatgccctgttatgccagcttcattcaaatggtgaccttgatccaactgaggaagctcatactcaggaagcactataggatctcattaccactgccagattgaccactgtcttctacagctctgttcatggacagtccagggctcacagcatacacctaccaagctgggagaaacccccccggtgcctcagtgactgggggcatgcttggattgcttttctctctgaagtctcatcaaatcccactttcatgatgtcacttctcagccctagaagctacaagacttccttgtgttctccaacaccaaatcccaatttctctgcttggctttcaagattcttcattatctggccccaacttgcctatcaaaccttctttcttattactcttcaatgcattctctcttctaccagcaatggccaggccatgggtttattgctttccctgtgtattttgcttacttctttttcaatatgcttgttttgttaatatcccaaataggctcataccttcttttttaaaaattcaactttactggccggcacggtggctcacgcctataatcccagcactttggaaggccgaggcgggtggatcacgaggtcaggagttccagaccagcctggctgagatgatgaaaccctgtctctactaaaaatacaaaaaattagctgggcgcagtggcaggcgcctgtaatcctagctactcgggaggctgaggcaggagaatcgcttgaacttggacagcagaggttgcagtgagccaagatcgcggccactgcactccagcctgggtgacagagtaagactctgtctcagaaagaaaaaaaaaaattcaactttattttttagagtggttttaggttcatagcaaaatacagcagaaagcacagagagttctcatatacccctgtcccccaacatgtacagccttttcctctctcaacatcccacaccagagtggtacatttgttacaactgatgaacctacactgacatcattgtcatccaaagtccatggtttacattagggttcacacttggtattgtatattctatgggtttgttaccacatgtttatatggtaacaccatgtatccaccactacagtatcatacagagtagtttttcactgccctaaaaatcctctgtgctctgtgtatacctactttttatcatctgttttctaccccagtcatcacggacaatgcaagttctaccttcctcacgaagtctttcccagtgactgtaatctgcatagatctccctcttcccaggatccttgctgtacccacaagaagaacacccttggctgtgccattattgtctcctcctttcatattagccccatctctgtaagtagattttaagctcctggtacttggattctaccatagtgcctggcctgtggcaggagttccatatgcagggctgacatattgcatagttccaggggtcccgttcacatgatatgaatggggcccctggagttacacaagttatagccctgtccataagtccttggtgattgaataaaactcattccaggacctgaaaaagaaacaattattgtgatcatggttcagttcaaatcttcaggtgattattgaacagctactatgtactaaccaccaatgatacaaaaaatgaataaaatggctgttcctaccctctgagaaactatagtcttgcgacacagaaaggtaagcaaacagatcaccataatacaatgtgaaaagtgctaagatagaaacatgggtaaaggagatggcacttgatgtgtagcctgaaggattcataggaatttgccaggtaggtgagtgggtggagaatattccagcaaaaagggacatcattggcaaagtgaaaatacatggtacatttcagagagctgcaagtggtacagcttattttctgatgataaaaccagaagcccagtggttaaattgcctgtggtccccaagcaaacctgtaccagaccattggcatgataggattgtgtgtatcacctgcacttactgcttctggaatcaaaaagaaagaatagagccctatctttcctggccatcccttgctcttccaagggctgggtggagttaagacacagaacttccttgtatttttttcatatacactaccctgtgttgctctgtgcacaatagggtgtaccattcaagcagtggaattggatccctctagaaccctcactgggcaacctcaggaacgggcagccattttcaacaagctttccttcaaagcttgcactgtttttggcctacctcataagttcttcttcttcctcgtcctccctttcttcttcctctgccctctctttgccttctttctcatcttttttgatattttggatgcaagaagtctggttaattgataaaacccagtgtgggcaaaaatagagttgtttcttccccctgcatggcttcctctccccaacccagttgctaagtggtcattggccaccatattggaatttagatgtggctgggcttccacaatgcatggtccaatctcagagtgtgttgaagggctttggggtctggttggataaaacagctgaggcccaatgttgtggttcttggcacctctcatttcccctttctgtatttcccttcggcatcatcagcaggattttgtttaaggcttctggagcttgtctttgtttcacccgggaaagtccctgcagggagagctaagatctccccggaggaatgggccagagccctgacctctgtcacccaaattgtttaggagaagcagcccccataggggttaggagggtgatcaattggcaacttaaggagtaaaggcctctctctccctcttctccctctgcttattgtgctcagaagggcaacagggtcagcagcagcaaactgaggggccaactcaccacgccttgaaagaggctcgttttgtgtttcagtaatgagcgctctttctccccttggatgcactcaaatttcacaagttacagggaacctgtcaactgctgttttcattgtatggggctcacagggaacttggatatagggcaagcttgtttcaaagaaagcaggggaaagaaaagtcctgaatagctgcaatgtgctgtcatatgcagatcacagccccagttgctatgggacacctctgcccgcagagagggcaagatgccgaacgtcccttattgatgtgattgcctccttggagatgggaatgcccctctaaaagggccaggctaggagccgacagcaccacgggctctcgggtttgccatggaaccgggcctgaagcagcctgcatcccagcagcctctgccttcccactggctgttcagtagggagccccccaacccaggggctgagggaacaggccaagctaaccctggaaaagtgaggagaggcaggtgggaagggtccctttttgcggggcacaagcctttgctcatagaagggctactggagggcatggttgtgaaccaggcctgatgttaaagacaggtttcaccttctttgtttgtcttgccctctgagaacacttggcaataacattcctttcctgacaggctcattttgtagctgacggacattgttttctttcccctgtttacctaatgtggcccagagtaacagaacaggctgtgccagcgagagaggagagtgagcctccccagtggctcctgggtccccatacccaggtccctctgccctgagctccttgtcttgcatctgtttgccccacctgtgggaacagggactacccagagggctgtcctgcctggaatcaagcactggcaggacctgggtcaggggagcctgcgattaggagagggcccagaattatgactctctccccggggtcatttgactgcaaggttagaaggcctgagatcaaacaaggctatgagaaaccagccttgtcactttgcataggatagaccagtgggagccaagattggaggcatctgaaggtcactgtaggaccttaaaaataccaggggagggtactgtgagaaacagattcccatcaactgtttactaaacactctatgctatttaaagggacaaaggcatggccaggtcctatcatcagggagtctaaatctggggtctgcagctgagccaggaggggggtccagtgcccttggcagcctgctgtaaccttctgaccctctgtgtccagcccccatccccatttttacctccagccaagcttccccctatgggggttaacagggtaaatactgtccaggcccttccctcaaagaagctgcaaatctagtaagagaataatatgtgcgtatatgaaactataatttaagacactgtgatcaataacctaaagggaaaggctctgaggacatccaggggtcttgggctcaaaggctggagcgccacacacacacacacacacacacatgcacacacacacacatgcacacacacacacatcaaatcacatattagctcgtgtcttcatgagctttccagtttgcaaaccgctcacacatacagcatttcctttaaacttcacatcagccagtgaaggggctttgtaagcctgacatgtaagatctaacaaccctcccagaatgatagaattggcagaggggggaggcagagactgtcaagcaatggcaagttttctgattggctggaacacagggcaggtgaccccgtgagctaaggtgaaacaaccaggctgaaggccttgcatgctgcagtgctgggtacaaccatgtcagttcaaaccagattcaatttggttggttaatgtgcccatttcccattgctgccatacaaacttagtagcttcaacagtacaaatcaattacctgtataatcctggaggtcagaagtccaaaatggatctcactgagctaaaatcagtgtcgtcagggcagtgttcccttctggaggctgcagaaaagaaagtgttgtcttgttttttccagcttctagaggccgcccacattccttgactcatggccccctttctctgtcttcagagccagcaacatcacagctctccgaccaatcattcttccattgccacttctccctctgacttggattcctcttctgcctccctcttcttcttttaggacccttgtgattacgttgggccaggacaatgtgcctgttttaaggttagctaactaacagccttaattccctttttcctgtcagggaacatgtttataggcttcaggaaataggccgtggacacctttgaggggccgttattctccctaccacatatagttagttggttgattgttagttgttcagttattggttgtttggtgttggatggctgttttttgtttgtttgtttgtttgttttttgagaatctccttggctcaggtcctcacctgagagccagataatcacgtttgttaaaagaagagaaaaaatgagagtgagcagccgctaaggggaagaaggagctacaagaggcggcacagaaagtggacatcgattttatttcgttgtccatcattatcaatctataaagcacaatccccaaaactacagcacatgccattctggggaaatttgttagctcacggacccccacagaccccagtgtgtggctgtttcatacgtcatgcaaacaggcccttggactctgtctcatgtcctctggcttagaagcagggatgtttgtaatctacaaacaaaaggtcgtctggccaaccttttgagatgtaatctcgaatccagatatactagtgggttccgctaagtgtctattggtcccctagtgtctctcaaacccacggtgggcttcagtctctcccaggcatcagccctaaccctgtggcatgggccctgcccagctgcctcccagacgtcacaccttgcaggctggactgtgtcagcagctgccttgctttccttgctggaaacctaaacctgctttttaaggagcccctcaaaactcttgaaataagatgtgggcattgctcacttgccctgagctgccccttgcagctggggggctgcttggtttgctctcttggcaaagccccttgtttttactctgctggggcccaactccttccttctctgtttccttgcctggggcttctgattccagtaagccaccccaataactcctgcggtgcccccacggctcacctgccaaagccactcccacctgatcccagactatccactcatccctggcctgtgacttgtcccgacctcccagtgggtcctggcttctatcactgaccttctaggtggtgacttcaatcttgatatgctcttcccctgctgaccttgacttcccatctccaaattgccagtgtcatatcaatagcatcacagcataatggctaatgcttctgagctcttactacacctcaggtactgtacatgttttcgctcatttaatcctcatcacaaccctagacagaaccctatgaagaatgggtagtagcccatcttacgcgtgaggagacaaaagcacagagagatgaaacagcctaccaagggtgccacaggtcatatgtgatggagtcggggaatcaaacccaggccagggagtgtcatcatccctcacatctggatttctgctacagtcacctcatactactctatcttatttccagtcaactcccagcagccagggtgaactgtatgtacaatggatcatgtcctccactgctcagagccttccagcagttctcacctcactcacagccttccagcagctctcacctcactcataaaagccagaggctcatgtggcccacaggcccacgtggtcgagccctgctccttctctaccccacctcctgctgtgccccctcgcactctcctccactcggctgcactggactccttactgtttctcagagaaaccaagcacatccctgcctcggtgtccctgtacttgctattccttccacctggattgctccctgcctcctcactgcccatacttggcccattcctttcttaaggagagctttgctgatgttctgcatttaagaaacttaagacctacctttgccgacatccctacccaaagtcttcctatcccccttacctggctttatttttctccatatatttgtcaccaaataacacatgagagctacctgtgttgtttattatctgtctctcccacggggaataaagcttcaggagggcagcacccttgaccactgctacgtatccagcactgtgtagggcgcctagcaggtctttgttaaatgagtggatgaagtctcaggactcccctcaggagcctaaggttctgggaggctccagaccaccatccaacctatatctgttcctgggccaccaagggggcaggccttccattcagcccgcagatgaagactttagcttcactttggtgctcagttccctctacagagcccggcaaacaagagcatgcagcacatgagtatgggctgagcttgagcttttgttctcattgactgctgtgtgtgtgggggtgtgggtgtgggtgtcagtgtgtgtatgtgtgtgtgtgtgtgtgtgtgtgtgctcactcacatgttgaaggaactccattgctctcctctccacccccacccctactccagcaagctgagggtgagaaatagctactttttgtttgtttgtttgtttgtttttgttttgtttgagacagggtctcgctctgtcacccaggctggagtgcagtggcacaaccttggctcgctgcagcttcaaactcccagcctcaagcaatactgccgcctcagcctcctcagtagctggaactactactggcttttattggctgcacgcaccagcatctcactgtgttgcccaggctggtctcgaactcctaggctcaagcgatccacccgccttggcctcccaaagtgctaggattacaggtgtgagccactgcacccggccacagctacttccttcactatcagcaccacagaacacataggtcttaattctcagcccttaaaacccagtccagcccaccagacattatttaaaaataatccaactgagacatctttgtggatctctaccaaaaagatagctttgtcctcccacccattgctttagcagcctgtataggggcacccagagggccagcccaccacacctggggcctccactttgaatccaccaggcccactctaatgggacagggaccttgggccagcgaagcagaaatgtattactgcaacagccccgtggtttcagatccttgcagtagcaggttctgggcatgtgtccccatcacccttctccaacagaaaatagtttatttttattttttcatggctggcagcaaggcagcacctgtggtaacctcgttagtcaattccaagagctcctcagagaagggggaaagcctgccaatttagcaaggatttttggtctccagtagctatgaagtgtgggggggattggggaaataagcccaggagcaagagaggttggggatgagcagtcttctcatccaaatccactctgaggttagagaagaggaaagcacgccattgactggttttctgattgccttcatacatccaagtatgttctccacaatgactttttctctagtgggaagccatggagatggacttagataataccaagtaccatttcctgcatgccttttgcaggccaggcattgtgccaagcccttcagatggtgctcctcagtgggagcttctcagccagggttttctgtcaaagatactgactcgacaatcctagaggatatggagtttatttattcccaactggaaagtgagggactcgagtctctgaggggttaggtgactttcccaagttctcatagcttctaaatggtagggccagaaatcaaatgctgtctgatgccaaggcttacatgacaagctccctccctgctccctgctccccctgcccctcatttctctggcagtcaccagattttattttccccaggatgagaatctgtaaaggtttggggtctggctgatttggactgaaatgggctctgtggcctcttccctgggtcttaggccccatttgaaaaattgaaatggaccgttgaatcccagagccttgcggcatggtagattgtgaaataattccatctcctcccctctccctccccaacgccacacacccatggtgaatggggattctcccaatgaggaaggctcagcaactcccagggcccctgacctgttcattctagaagcttcaggagcagcagtccctgcacccaggctcatgccccagttggcagccaagttcatcctctggacaccaacatagcttcaaaagagtcagtgtcagaaagcctcatacttaccttaccgtttagggtagtttttattttgaaatacatatagaaagatatattaatcagggtcccagcaagaaacagagttcttttcaaaaggatttgactaagaagaatgtagtgaaggcacaacttatagatggacgggcagggttcagggcagcaacaggaatgttgaggcacccaggaactagcaatagtgggaagatgataccagccctcagccaaaggagcaaagaaaggaaatagtgtgactggggcctggtgagtcttggcagcatagaggtggccacctggtgagagcagtggtcccaagggccacagtccctgccatagccaagcaccagagcaaagagggagcaggggaagagacaccctcctgacctccagcctcctgcctgtacctcacatttgccggacacaaaaggaagctagaggcaaaggaagctggtgattcagctcctagcactcagccccaggggtcacagagcagggcaccaaagggaagagaatgaacatgaagggagaaggcaaatggagaaaaataagcacaggggacaccttcctccttttcgtgattaggattgttaccattgcagacctgcctgccacccccaacccagaggaccttgaggctttggggaatgagaagtaaagcccccactagaaggttgaggatgcataaagcttaaaacccttgttctagggaaagtgtctttgcagcctttccatggcacttagtgaggaatgagtcttgtttccagatggagatgctaaagcatccaggcatgccagccctggggaatgcagggaaacagtcttagggatggacccaggccttggtactttagagcttctagggtatgagtcatctttgcctcttaacaatcagatcagtggtacccttctgacctctgtcatttggctgcactggaggcaagaaatggtttggactcacgcaggggcatgatgttagtaaggaaggggtcagaggtgaacctagcttgggtgctccacctcttgactcagagtctgtgctctttgatgaactttctgttaccttgggatcttctacagcaggtcctggtgtgcaagtatttcaagatcaagataaaatatttcattgtgttttatttaggaaaaaaatggtagatgaaagcggaaccaacaggggcattccgtttgtggtttgctgagattccctggaaagcaagcttgggaggccagggtctgtcagaacacaagaccaatgtcttctccaaaacttggatgaacagaaggtgcttacaagctgacagggagttatggggaaggaagcagaatttccagtttggttccaagtcttttctggtcttgacctttagcctaaaaacagagggcccagttgttctccattattactgtaactcaaaaggagacacatgggtccgggagagagttgggaggcaatactaggtttgcacgttctgagttcatggacacccaaggaactgcccctccctaggataactagagccaagccactggacccttctcatcctgtggccttgtctacaattttaatcattttgaagatgaaggttttgaagatgaaggcccagcctcaaaaaggaataaccaagaacaaccctctctccctcctttagtttagatgcttccacagtcaaatgtaaaattattcatgtgcttttactcattattcatctgattttatgtaaaaaaaaaaaaaatggaatcctaggctggtcactgcatggtgttctcaatcacaagccatgagccagggttcaacatgctcccttcacttcagaccttcctcacaactgagcctggatcccactctggacctcatgatccgcctaccacggcctcccagcgcgcccagcccctgctttatttttctatatagcacttattgttaccagatacatttgtgtttatcacctctctcatcacacacacacacacacacagttaaaggcagggacttggtctattttctcaaagttgtgtccccggcacttagaatcctacctgccgtggtgtacatgctcaataagtacttattaagtgaatgaatggagtcagacatgtcctcaagggtaggttcaaatcagggagaatggtgggtgtccttactgctttataggatttcatgctggccccagacttgagtcatttccatcaggcaaattcctgaaatacttactggtcttcctgattctgtggtatgtgcttgtcaacagcacattgtcgaacacgttgctgcctatgcaacactatgtggcaatggctgttgaaactcgttgctaacagaagtgaaagcaaagaaaagcaaagataaagaacgtaatggctgggcgcggtggctcatgcctgtaatatcagcactttgggaggctgaggtgggcagatcacttgaggtcaggagttcgagaccaacctggctaacatggtgaaaccccttttctattggctgggcgtggtggcatgcacctgtaatcccagctactcgggaggctgaggcaagagaatcgcttgaacccgggaggtggaggttgtagtgaacggagattgcaccattgcactccagcttgggcaacaagagggaaactccatctcaaaaaaacaaaaacaaaaaaaggagaaagaaagtaatttccccgccatggatgatatgacatggcagctttcatggaggtttcagaatctgccggcccacctcacacatgacttcctatgcaattagtataaagcaaagagacaacagacaacacttcacacctgagccccaggtcctgaatgtctttggatagcctctctccttgaaggatatattgactcacaggcaaagggcccttataatgatataaaggagaccaagttggaaggaatagatcacaggaaggtgaagcccaaaatccagaagggaatttcagggaaagtggtctggactcaggtaccctgcccagatccatgtgccttccaacacgtggcagacagagaggtgacaagacaaaggaggaaagcatgctcaagggatagctaatgggtgtgtcattcgaccttcccaagacctagctctctggaaatatcaagggttcagggggctgggtcataggcttgctttccttctagctcactgtgtggacctggataagttgcttggccttacccatccacccttagtagcctcttctctggccccttccatggttctgtgcagagtaaagaggtaggacacacagtagggcccagaagggtctcctggcagtcactgatgccagattcagctctcttgactctccatgttggtgacgacaccaccaattttcctttgcacacatggcctcaccttgaaaattcaagagtctacagtcaagtcacttctgcttctaggggcctcccagaagcacctagtattctgtttcaagtcctttgtccagctgctttcaaatcaccaaactcctctctccctcccctccattactacccatggagatccagaggagggacttcttaacttctcagacagtgaattgagggagctcagagatttcttttattcctggagcacagaatgtaacgtaggtgcaccagatcaaaggcatagcagcagcctgagcttctctttgaccaagtcctgggaggcaggctgggtgtttgtgtttgaggatagagtgccagatgttgcaaataaacatagaaaacactcatttaaatttaaatttaagatgaacaatgaatactttttttagtataagtgtgttttataaaatatttgagccatatgtataccgaaaaatgattccttgcttgtctgaaatccagattgtgttgggtggtctatattttacctggcagcccatttgcatgtttcctaaacacaccggcagctcccaaatcagcctggagagagctgagcctggtgcgtggggcataccttacaaccccagtttctgttccccacccatgttctttccaaggaggctggctgccccactgtcagagtgtccaggaaagaaaatagaagagagaaaatggtcatggggttcacgggcattgtgcccccaccgtcggctgcagcagagactcagtgtggcagatgcctccacgtctccagcccaggcccagtcaagcaagggccctaagatctgcccagaaggagaaggtgtgggagggggcggtgcccgcaagtggaggtgggggacaggaaagggaagggcccgcaatgccagcatggagcttcgaaggggactttgaaaggtgctgcctatgaagcactgctttcctccagagcagccatcctacctgcctgccctgagacccccgctggctaccattatcccaggacaaaacagggcccgggctcccggttccccctcatttcctctttcagtgtattttctctcctccatgttctggaagtttctctcagtgtaagccttgtcagggaggcctgccactctgccccacctcttcgcctcctgcttgccctgcggccagctgtggtttggcctgatctcagagcttagcacacagcaggtctcccagggttggaggtccatcctacctttgagtagctgtgtgaccttggaggaggcctgtcctacctttgagtagctgtgtgaccttggactacttagtgctcggcacctctgcttcctcatctgcaaatgggcactctgggcaagatgaagtgagtcactgagtgggaagtgtttgggacagtgacccgcgtggaagagacattgttatacacgtgggctttattccacccctgctgctccactcagctgttcctcagtcacctccactgattttgttcttagctgtagcccttcttgaacccctgccgtcctaggtgcacacgcctgccccacacctcccactgtcccctccctgggtgcccatgactctcttcttccctttcagttattttcctctctcagacccatccaaccagccccatttccccaaggttctgttctaacctctctttaatcctttttcccttggagatctcaaggaacagatgggagcctcagcacagtatagccttgtatgtgcacaggccatttccacacggggcggggacgtggcagctgtgctttggcggtcatctctggagaagggcggctggggctcaggaggctgagggagctcctgcttttcactttcttccctcctgtgagattcagtttttttcataagcattaattacttttattaatatagtagaattgcaactgtaatgtaggatttttttttaggagaagggatagattacctttgaccaggctctcagggtttctttattaagtaatctgcctttaagatgggatagggggagggcattcaaagtaaagatggtcccctagttgtgatttttcgactttatgatggtgcaaaagtgataggcggtcagtagaaagtggcaccacattctcccatgatgctgggtggtggtgtgagccatgtctcccggtcagccagctggttgggagggtaaagggccaatgccgtacagtgtgctgtgctgctaggtgatgttgcccagctctgggctgtggaagcgttctgagtacactgaaggtgggctaggctcagctgtgatgctcaggaggttaggtggatccagtgcattttcactggtatttccagctcaccctgcatttatctggatgtaatctcatcataagtcaaggagcatctgtacaacaagcagtctgagggaaggcacagaggagaggctttggcacctggaaagaaatgtcgggcctcatactgcccatagtaatttgtagattcaatgctatccccatccagctaccattgactttcttcacaaaattagaaaaaaactactttaaatttcatatggaaccaaaaaagagcccgtgcagccaagacaatcctaagcaaaaagaacaaacctggaggcatcacgctacctgacttcaaactatactacaagcttacggtaaccaaaacagcatggtactagtaccaaaacagatacatagacaaatggaacagaacagaggcctcagaaataacactacgcatctacaaccatctgatctttgacaaacctgacaaaagcaggcaatggggaaaggattccctatttaataaatggtgttgggaaaactggctagccatatgcagaaaactgaaattggaccccttccttacaccttatacaaaaattaactcaagatggattaaagacttaaatgtaacatctaaaaccataaaaaccctagaagaaaacctaggcaataccattcaggacataagcatgggcaaagacttcatgactaaaacaccaaaagcaatggcaacaaaagtcaaaattgacaaatgggatctaattaagctaaagagcttctgcacagcaaaagaaactatcataagagtgaacaggcaacctacagaatgggagaacatttttacaatctatccatctgacaaagggctaatatccagaatctacaaaaaacttaaactaatttacaagaaaaaaacaaccccatcaaaaagtggtcaaaggatatgaacagacacttctcaaaagaagacatttatgcggtcaacaaacatatggaaaaaagctcatcatcactgatcactagagaaatgcaaatcaaaaccacaatgagataccatctcatgccagtaagaatggcgatcattaaaaagtcaggaaacaacagatgctgtagaggacgggagaaataggaatgcttttacactgttgatgggagtataattcgtccaaccattgtggaagacagtgtggcaattcctcaaggatctagaaccagaaataccatttgacccagcaatcccattactgggtatatacccaaaggattataaatcattctgctataaagacacatgcacacgtatgtttattgtggcactgttcacaatagcaaagacttggaatcaacccaaacgcccatcaatgatagactggataaagaaaatgtagcacatatacaccatggaatactatgcagccataaaaaaggatgagttcatgtcctttgtagggacatggatgaagctggaaaccattattctcagcaaagtgacacaagaagagaaaaccaaacaccacatgttctcactcataagcgggagttgaacaataacacatggacacagggaggggaacgtcacacaccagggcctgtaaggggctagggggctaggggagggatagcattaggagaaaaacctaatgtagataacaggttgatgggtgcagcaaacaaccatggcatgtgtataccagtgtaacaaatctgcacgttctgcacatgtatcccagaacttaaagtataataaaaaataaaaaaaatttaaaaaagaaatgtcctgcctcagctggtggtggcaggtgctgtggctcactaaggcctcaggtccattggctttacctgacaggtttgtctacagcgcctgcagacctgccaggagggggtgacactctttggagacagggtgatcccctaatagtgatgtaagtgggaggagaagctgtaaaataagtttaggaaatagagactcccccacatacttttgggggtccaggtaagggtacaatgtagaccagctttcatatgtccaaatatttgaaagttacaaatcaagctaacaaactattacatagaatatgttctctcctcttgccttgacaaacgcaccttcctgatatggtgaaggccaaccttgaatttagaacccgtggacccctcagagttccacactggaatgtggtggccttgggggagcccgcctgggctggtttcagaccctggctccatttagcactaggaagggccttgagcacacatgtgtgggcactcagctcacatgtgcaagctccgcagtgccctcaagccacccctggtcaccacccgaggcctatgggtgtgcacaccagtaatgtgatccacccacaacttggccttgggcttaggctcagggaattgaccagggaactccaggatcagaatgcacaaggcactgtccaacgtccagcagcagggcatatgtgggtccttggggccatattcctttaacctgtggacacttcacccacggctggaggtgagccagagcagactccctaatgtgtgggccacagcaccggccactccagtcaccagatgaggacctggcgggggtgagcttagccaatgaaaaccggaggaaggagctttaaaggtttcctagaagagtcctccagatgcccaggcgcccccccaccccccatgctggggctggatttctgcccaacacctcgtgcctcagggtcattcaggtgtcaccgtctcatgctcctgacacagtgaagagcttgttttcctcctcacactccctgactctaatccccaccagcctgtgccacttggctggcctccttggcagaaaggtgacaaaaggacacgtctctggagagtcagatccctcagctgccggaatctaggacctccttggggccacataagccaatggctgagggtcctgatcttgttactgatctggtttccttcgacctcttatagccagggtgttggtgggagtcactcaagcaaattcattaatcttaaggaagcaggagctattacaatcgagcaagcctctttgcttctctctaacgctcatgctcccatagcattgccctcctgccctgatcagccttccctatagaaccttacctcccaatgtttcctcacctccagccagctcacctctgccactgcgcttcttgcctgctcccaacatctgctcatctgcacctacccagctgttcttatttctatccaaatcgctttcgtccttcaaggtgacttgagatttcacctccataaaaggttcccaacacttccatcgattcttcccctgctttatcacctgtattgtttaccacctggacccaacatttggcccatgaattatgttcatgttagtactttataacatatggcatttttattcttccatgttatgtagaaatcatagaactagaagagatcttaaagactacctagtcccatcctcattttctgaacatgaggaaaccgagagagaggaaggttgttgtaacttgccaggcagagccctcagggtttggcagagctgggcgttacactcaaattacactcaacactcttagcccaatccaggacttgccacaagctcttgatgcctctctacatagaagtctgcttcacccataggatgcggcggtcaggaaggtcagtctcagaatatactcaagtgggcaaatggggccttcccattttctggcaggacacagcccagagaggtgcattcccacctctgtgtactctattatttaagttatttgcattttaataaccagcaggcaaaaaaggcagtggtcacctagattttctcagaccagccttgattccctgctgtctccccatggggaatttcaggaactcccttttcttcagagggaataagcccaattcctgcttcaccatggcagggaggccggctccttttgctgccaatccccattatccctcgcatttccattgtggaagtgcagagaggttcttagcgagtctcccctcggactttcccaggggctcctgacgaggagccccaggcgggaggctgatgggctaaacaagcaaccaaggaatagccaaacaggctccaagtcagagcctatctttaacaaaggtgggataaagggagcaacaaactagaaggcagaagggtagggaggggctggggacaggatgacctgtcccaggtaaggcccctaaatgctaagtaaattccccaagtcaaaatcagctggaacagggcagagcaaacatttttttcctccccaccccgaccccgggtgtcctgctcactgcaaggaagaaaaacagaataatgagccacgttggagagtgtcactccagcagctccggaaagacgtgggcagacgcctggctgggcggctgactttctctgtttctggtagagattttataaatattcggggagtttgatctgaggctgttggtggggaggcaaggagagctgcagaggggggagacaactcagcccacgggggttcttggacctctctaaagcctgcttttcattagcgtcgccaaggcaacggctcatctgctgcagatctcatcaaggccctgcaaagcatccacggcacgttacgctttgcgtttcacagtgaatcggctgcaatcagtcttcctgcagccctcccttacccccatcacctcctagcctatggaagagaagatcattaaaggcgggtgaaaaactgcaatcagaactctccgaggctggcacggagaggcagagctgcgatagtcctgttccgaggacagtagattcgccctgaggactattcaaagctgggcagtgatgagcctcaagtaacccgatggacctgtagcaactccccagctcagtcttcttccatggtgcacactcagccttgattcttgtctcctccctgcctgacctaacctttcccctccacacacctttattttttaccaaggcgaacatttgcggtgcgcccaagaacctcaccggcccttgtgccgatcggttccagatgcccatggaaatgcaagctcatgtgtttctctggttttaacaaaggtgtccaatgagttctaagggtgatgtcaggggaggtgggggcagaccagggagtaaagggagacccatgttggcaaagcagtgtgagagcaggtgagtgggcccaaagagtagggccaggtgtcatgctcagcacagccaggtagggaatgtgcacagaacacattaattcggcttcacagacactcccattctcagcatgtaccccatggaaatccagtcaccccctttaaaagttggctccttccatggccgggtgcggtgtttcacccctgtaatcccagcactttgggaggctgaggtgggtggatcacctgaggtcaggagtttgagaccagcctggctaacatggtgaaaccccatctccactaaaaatacaaaaattagctgggtgtggtggcgtgtgcctgtaatcccagctacttgggaggctgaggcaggagaatcacttgaacctaggaggcagaggttgcagtgagtcgagatcacgccattgcagtgagccgagatcgcgccattgtactccagccaacaagagcaaaactctgtctcaaaaaaaaaaaaaattggctccttccagctttgagatcctgaggccagcagccagggatcctgctctctgctatatgtcagtgttccagcacagtgcctgcgcataagaggccctcagcagtgtcttcaaagaaggaacccctctgtccacacaaaagagggggagagtggtcagggcactgcagaggttggggttgggttttctggttgtctttctagcttgtctttgtgctggaaagcaaacctgagctccagcctctcccagcccctcctttctgtggaatgcagatcaccccagctctcctgaaagattggtactcagagcctttgagcaagccctgggaaaatgcagaatctcaggctgtaattacgagctggagaagatccctcccccagctataaatggagcagaaccaggaacccaagacagctgggctcacacaaaggcagccccttgctttcttgcttgctcctacttttcccactgagcttggccctggagaagcaaacccctaattcctctgctggtctgagcaggaaattcccgtcagcttgtgggagaggccatctgagagagatttcagcacatccatcccccccgagatccagaaccgtatcaagtcctaccccagtcccgcagagcagcttcttcctccacagcttctgagctgcaccgaagcaggcctccgccagcctttgctacccaaggctgatgttgggtttttaacactcagccaagtcatagggaagagtaagatttacaataattgggtacatagcatagctgactgggctgcacagtgtggcttttggtcagttctggcattctggtgggaaagctgcactgaagaggcagagaaatgccagcccagatggcagacatggtgcatttaaaaaggcagtgtggtatagatcctcgctcctataaacgcgggcctggaacctgcagcaggagcatcacctgggagcttgttacagaagcagaatctcaggccctactgaatcagagaatgggttttaacaagctggccagcggacacaggcacattcaagcttgaggcagagtggagcacaggaaagaacatatgggtgcgttcatcccagccttgtggattcctaatgccagctttgtcactcagtagtatgtgactttaagttaagctccctctctgagcttcagtttcctcccctttacagcagagatgatgtaacctattataaagggctgatgtgaggctcgacctggtaccagcaggctcctaccctagtcaatgttagcagcacagagatgattgctcagggaacatcaaaatcctttatttccccaaggcaactacctaggagatgcagcttcagtccgtcctcttgctatttcacttttttattttctggggagacttgtagtcccctgaccatgaatttcagagccaacagtggtaagcttttcattctagctacccccgtgtgaaattaagatccagagtgcccccagagggaccaagctttctcatgtagaatagatcgctatgggtgaaggaactgaatgaatgcggtctggcagggtcagttctggggacaggggcattccaggaagaggagatacaacatgtaactttcataatggataaatggctccttggcggttccccacaagtgagtagtatcgagtctggatttcatttctttcaccgtctgtgagtttccttgagagagagtaggattctcttgtcatggggattggagttttaacccacttttctttgtttggtgttggtgtgttctgtcattacagtcccctactgctttcccaagctaatgtaatggaacacagggatggacaagccacgagggtctgcagggacctcaatgtctccataaatgctgggctgattttgcaaagctgctttcccaacggggcttggctaaagctgcttttcaaattagttttgtagaggaaaggagggcaggtcagctcccaggtaccagttgggtgacctggggcgagtcccttaacctctctaagcctcagtttcctcctaggatgataatgctaatacgagaatctccttgaagacagccatgcatgtctccacccattctggggataacagaattactggcggattaagtaacgtgatacttacaaggaacatggtacagagagtggaatatggtcaataaatggtagctgccatttttgtagtcattagaagaggcgagccttgaacgactagcctctgttgaaaattacaaacaagagagtggcctacatttgcaaacagtgagcatagccacccattcctgttagggtcagcaactgaccctcccttcccccgccttcacttttttttctttagctgcaggagttgagacatgtggctcaccaggctacctcagtgagttaaagctttaaataaatacacactcaaaacggctatcacatcactgcccccatgactgccacaagcccctcccgacctgggaacgtctcttcctccctctccctttctctgctgctagaggccaggccttggctgagccctggagagggtatctcctttgcacgtatgctggtcccaggggccctgcacagggcagatgagggtagtcctgatcctgtacagactctcctcttcctgggtttgttagaagcctggccaggcccctagtcttatgacttcaacagatgtttctgcttaaggagccctggcatctttatggcctgttttttccattcttgcctctcttcctctgtcccagcagccctgaatgcaatttggactttattttctttctaatggttacagggatagaaagggctttttcccccccattttcagtttttggctttttcattagctcatcaagctgggtatgtctgtgttagctcacacagacatattcacacacgaacacacacattccatatgcattcagatctgtacccatggtgtgtatttcttaatgttgcactgacatttattgccacttcagacccagcccatttcaaagccttcctccctgcctccaccccacacttcacattcatcctctgcctagcctcacacaggtcaccctgagcagccgactggggtgtcacccagatgctgattccaaaaactagtgctggcctcggcctccagcaagatgtgtagagcctcagtaactcaccagtctgcctctgtgcttccaaggagtcttgggctgactgatggagtgagagctgagactgcatttgccatgcatctcttcaagctctgcctggccagccagtctacccaggctcagggggccaagttgacagctgttaaaaaaaagaaccagttttccatgagcaggcttgaaaccagtctggccaccccttggatctacacctgtaactgcccccagcttgccagcatggcagggtgttcccagtcacctcccccgcagcgttgggggttgcctgtcccatcagtctggttcccagagcaaaggaaacctggcgatgtcaggtcttcagcttttagtctatctatggcaaaggtgcctggggctgggacctctttattacctcctaagcctgaggactggaactgaacttctcactgcaggtataaataaatctacctggaatcttaaatgttgataccacctggctgccttacctgaagttagacccattacccacaagaggccatctaacctcaaattctctgtgtctctgcagcccttcttcctaggagggcaatgatgccgaatcacctgttatggcattttcataattcagctaaccattcactactctatctgcccatgatccacccaatgctgaccatgggtggcggggcagagtggcctctctagaatgtctcctctttaacaccctcaccatggaggggcctttatagatggccccatgaagttctcactaggcgactgctcctacctgagatgggccaggcagccatggacccctcccctcccctccggttcctgccctgcccaacctcattctgatggtttggccttgtgcatctcactagtgactcttttcttccctccttcctatttaaacaaattaaaactccagtttttcttcatttatgttttggtggctgaggtggagcatcttttccccagtgggttaagagaggctggttggagaagacagcaacaggagagtgagttgggtccccagtggcatagtgacatacacagggacagtgggaaatggaagctggaagaagtcccagaagtaggagcaagaagagtgactgtcctccatgctgggttctgccagggactctggatgcgctgaacaacagccatcctagagatttgaggacacctcttctgtttgctttactcatcacagattcatgaataaagacaaacaggggagccacctcattggcttttccatctctaaataaatcccttctgaatacacacccccaatgtggatgctatggatgcttctcaagaaacaaccatatgatgctatgataatcgatatccttccaatgactcaaatcaaatcaacttgaggagcctgatgggtctgatgctcttcttccctgggcctctgcacctttccagagccaggccccctgtgtgtgtgtggccggtggcgtgggggagttgcttcttttcatttttgtgagtgaaaatgaaagggttccccacaaccagctgcaacaaggatctctcaccctgttgctaaggagtggtggggtcctgctaccatgtggtgctctggcaggcctggggagatctttagggatctggagcagccactggatgtgcagtcctgagcccctgggatgtggaagtgattggccggccacctggatgggcctcacagtcctactgtcactcctcttctctcctttcacttctggatcctgctagagaaatggagcccggggaaactgtctcaccacctaggactgtgtggagctgggcacacactcaggaggcaggtgacttccaggtagtcaaagagaagctcacactccctgtcctctgatagtcctactccctgaaggatctggtcaagccattccttccagatggccgtgatactgtgtcccctcagtattaggagggggggaattgatgctttccatgaatgaaagctcctaaaccccctcccccgcagctagggctgatggggaatggctaaaccccagatgtcttcattgcaccataaatgtgagcagggaggtacaaaggggtaggcaatgatgtgtgtgtgtgtgtgtgtgtgtgtgtgtgtgtatgtgtgtgtatcaaagagaggagtctgtcacaggaaaaatactgagtggccccaaatgttgtaagcgtatgcaccccagttttacaataataacaatcataatactaataattttgctatcatttgttgagatctttttctgggccaggtacggtactttgcacatattatctcataattctcaaaatctctgtgaggtacaagtatcactatgcaacttttcaaatgagaaagcgagcatggaaaaaaagttggttcaattgccaaagatcatagatctgagaagtggcagggccaggattagaatgctagagctcaaagttcttctgccacgtatcatagaagcgaccactacatcgataatggtaactgccaaccctcactgttcactggccacatgccagacacatagattcacttaattcattcttacaaaactctggatgtattcttattgcctcattgtatagatgaggaaactgaggcacagagcattttggcattgattcccttcggcaaatgtgatttgaacagctcctatgtgtgtgcagggcaccgtgctcttggctctgcgtgggatatgggactgagtgatacgtcattcttatggtctgagatcaggaaggtccatggccatggccatcagaatgggctcagggtgggattccagaacttgaaatgagggaccttgcatcctagggtatgctagaaagtggaacataccaggtctctagagaaggaacctaggcacagaagcaagacagagtcctgttgtcagactgaggcaccaggtcagaactgggccagcagcaagggctggcggaactggaactgatttattcccgcctgcagcatggcctcgagggcagggctccagagctaggctgctaagttcagatcttccattctttagctgtgagaccgtgggcaagttaatgaacctctctgggtttcagtagcctcgtctagaaaacaggaatcataactgcccacctcatggaattgttctaaggactaaatgagttaatatgtgagaggctcttggaacagggccaggcccatgatgggctctctggtgggctctcaagctctcgccagccgatgatcattgggccctttgatgctgagtgggcagaagctgcaggtaggggacaagttgtcccagtggcaaacagaagaaaattgtagtaggaactgattagggcctgtctctgtaggtggtttgatggggagggagagatgaaatccaatgggacaagagggaattcacatcattagtataaaaggttggcaaatgggcatgggacccttccttcttagtctccagaggccaagatgcaggtgcctggcacctgggctggctgaaagtggggaatgtatcagggctggcatttatagtgatgccactattgtctaattatgggcacaaagagaggctcccactgtctgtgcagcccctcaaatcacccagggaagaaatattggtctattcccagcattccctctgtcaactccccaacctcagtctctggcttggaagaaagacggctgggaagggggatggaaggcagccatgctctgttgcagtaaatctttcctagaagaggagacagctgagctcatcagccagtgtcggatcagctcagaaagaatcctttccaactcccagaagacccctcagcggcttgggaaaggaatggctcactggggcactttgtttgtgtatgtgggcctgtcaggctgggcaggggtgtctgatgacacattaggacagctgaaaagagaggtgggacaaaaatgtttgcccaagggcagtcttgtgattcccccaccccccgtgctccccacccccacacgcctttgagagcttgttccaggacttttcatatgcatttgagaccacaatttcctctcccagaaaccccattaagctatgagtgagtgaggcggtgggggagagagagaggaaaaggaaaagagagacagagcaagagagagagtttgtgtgtgcacacacgaatacttcttccccacccgcattcttttgcacatgtctaccgttatgtacattcctatgccataccccttgaactctccatcaggtcttcctcaaccatcctcttcaggaagcctcagggcctcagagaaaggcaaaagggcctagactttgacttccttttttttctctctctcttagagacaacattttgctctgtcacccaagctgaactgaactgggctccagaaatcctcccacctcagcctcctgagcagctaggactacagatgtgccaccatacccagctaattttttaattttttgtagaggtggggtctcattatgttgcccaagctgatctcaaactcctggcttcaagagatccacccacctcagcctcccaaagcgctaggattacaagtatgagactttgccattccaatgagaattttgtccttagcaatctcatccaatggccactggagatgtgtgtagggccacaagaatgagaaagggggcaatggagtgacaggtgacctgctcaggtgcccctccccagaccaaatgtcccaggcacacagcccatgccctccaccatggagtacattttctccctggcttgctgctgagctaaaggaccagggacgtggaaacaggaggtgaactaaggcaccccgccacccactgtggcagcttgaatttcttgaggctgagacaaactaggatccagtagcctagattttgccccagtttctccactgagtatttactcagtgctcctgagccgatgccttcccctctgcctagatgaaccacagcattttggtaaatgcctcagcatgttaggagcgctggaacgtttattctcttccctcccaattatccactctaatggagcagaacacttacatggaaaatcctaaacatggaagatgatttaaaaatgattcaccctggaatacatgcttccagttgcttctacaggtttaccttgctaaaggcatttcgcttcctttgctgttacaataagcttgcctgccttgaagaaaagaagaccagggccaaagggaaatcagtcaagggagcctgttttgtctgaaataatgcatccatgaacaaatgaattgagtataactgtctttttacatcagtgtttctgtggaattaagagaacatccaaggccactcctagcttgagtagattaaatttgtccttgtgtttggagcaagggttgtgaagtctgtctggcccatcaaatgaccaatggcttttaaggaaggactaagtgacttatgaccagaacaagggagcagcctgagtcagtctccccaatgtctacattgtgttatttatactagcaaaaaaatagacacaactaaatgttcgaccatatggtattggttaaattaacatctatacgatggaatactagatggtcattaaaattatgtgtcagaagaaggcttaatctcatgggaaagtgttcacaccatattattaaagagaaaaaacagattataaagcaatatgcatacaatgtagtagttctgtaagaaaaaagtattatgtgcattttaactggaaaaatatgtataaaaatgttaacagtgcaatctctgggcaataagattatacttgacttttatttcttttttggaattgtcttttttttttttttttcaagtttcctcccattaacatgcatgttcccaaaatcaggggaaaaatacattaagaaaaaaagattatctgagagaccagcagatgtgtttcctgtttcttatcccatgtctattctccattttatattggagattcaaattcttcagccctttccacaacagacacttctggggcaagaggcacagaatatctgatatcctaaacaacaccaccagggtgaatttctcactgacagtaacagctttggaaaggttttgtttctacctggcgctgggaattaatcgtacccaaacttttttttttctaatcagtaatgagcatctccaagggggtcctagaagggttccaggggttcatggaggacaattataaaccttgacagctgctcggtgggttttcaaccatgggggtgattcatcccttctcgtaagccttttcatagcaccctacgctcagagttttgaaaatgtgacaaaaaagaaaggggctggggagaacaatggcccttctccttttatggaaggatgatgaagggaattgggaagagcaaaactaagggactaagacaattcagcttttttttgtctggctcataggaccgtgttccccatagagtaatgcccaatgagtggacgaagggagtaataaatgagttcatagaaggaaacagctgggctgctgtaaaagctcctgcaaaacagataggcctggcacacgccatttctgtcacaggttttaaagaacctatctagctttcagctactcctcatcaccatctcctacagaagcagagtcaagatcatgtctcttcccatcgtaaggaaacagcactgcgaatgttccagctgtcctgaagtcactaatcccgtcaggggcagacattggcaacacacccagaaggtggtggggagtgcagctgtcctcctggccgactgttccagccggtcacctctgctgctccaagggtgccacgttacctaattctggttcacggtgagatggcggcttttctcggccagcttgtccttagaaaattcgttcccttgttgtattggaaaattcctcttgtgcctgtcattgcacacatcaggagaccaaggtttccattttctcagaagaaattagccagctactgtcattgacatgaagcctgttcctggaattttttactcctcctcttaaaggcatattctggaagaggcaatctgagaatggggcccgtgctctcctacagcagagaaataaactgaggctaggccaggagctgtgcaccgtctgggggaaccatacccagtggggagtggccagatcagtcccaacactgaaattgtttactgtcatccactcctggttgttaggggacattgaggatgacaggatagagagtagggaaggaaggaccagccaaggaacattttccctataaaatgagactcccaccctactcctgcccttgttaagacttcatacactatggaatactatgcagccataaaaagaacaagatcgtgtctcttgtaggaacatggttggagctggaggccattatccttaagaaactaatgcaagaacagaaaaccaaataccacatgttcttacttgtaagtgggagttaaatggtaagaacttatgaacacaaagaaggaaacatcaaacactagggtctactcatgggtggagggagaagaggagggagaggagcagaaaagataactattgggtactgggcttaatacctgggtgatgaaatactctgttcagcaaacccctgtaacacaagtttacctatgtaacaaaccttcacatgtaccctccaaacctaaaatacaagttaaaaaaaaaaaaaaggacacagatgtaaattgaccctgatggagagaactctactctatccttgccaggtcacaagaaggtgagatatttacttttcaaatgattgatgctgaaatggaaaggactgtatctcgggggcacaaacccaacagagtaaatgaagatcctactgcttcagctcctgggatttgttaaagtggggaccagcttagaaaaatagacggccgtcctagagacccatggcagtctcggtctgattttaaatctaaattctcaagtacaagtagcttcccaagaagagaaagctacttctacataaagaggtggtatcagtaggaactccttaagccttacctttttattattgatgatgatgaagtgaagcttcctgttgatatcattgtcagaccaagcacagcacaccaactcaaacctcattcattcattcattcattcatgtgtccttttaacagacgtctactagacaccttgtgtgtccatgaaccaaataccatgcttaagaccaaggattcagaaatgtgttagctgtcattccccctccaggaactctcagccaggaggagatgtactcagggaaaaggagaaatcacagtataaccattgtaaaatcctttctgataaaatcgcagagtgtctaatactcctgttccacatacataaaaagaaactaaagtgtagagaagggaggaaagtcccgaatttagtgtgtagcagatccaggagtaaaacaagcattcctcggtctggggtaaatcccaccgggactgtgttgagacccaaattcctctgagtccacgggccccttcaagtcagatgaaattccaaacaagccagagcctagctgaacagttccacggtgccgggctccagtgtgttctggaaggttctcgtgggctgtgcctccagaagacggaggcggggaggagccccacaggcccagggcagtgtcaggttcccccttttctgtcagcaggcatggaagagcctttaagaaaatggagtattattattatttgtttgtttttacagtgactcagtctgtagtaactgggttaaagtccgctttgagaaaaggagaacaaaagacctcctgttagtgctggaagtttgcctcttaagatatcactgagaggaactgggaagaaaaaaaatccccagcagggcagaggaagctgcaggccttcaggaacacagcagcactttggaaaggaaaacacggccgactttcatctcctgcgccgtatctgagctggccgctccctttgccgctgctttatggcccactgcggtgctgaccgtcggacatcggccagtaccctattcccacactctttgaacacagggggctgccaggagtggtggtagtgtgggcatatctccatagccaaccaaccccaggctgaggaggagggaaaggatgttgccatacgaaacatactacgtgctggacgttattctaacattacatatcataactcatttcgtaaacaccaaggaggctagcatcctccttctccagccacagcagaagttgcgcaaggtggaaatctggccctgccctgtttaggaaactcattgcaagtagaggaaccgtggggtgagtaggctcccaaatgggtaggaccagattgctaggtggtctcttccaggttgcagactcaggccatctgactctaagacctaagaacttaatcctactctcttcaaatgaaaacagaaagtcagaggaagacaagaaagtttttcttctcacgacctcccatcagatccgccccatctacattaaacttgtacccgtgtccttcatcaatcagctcagtggaaatgttattctcacccttggccacccagatcaggaaatcggtctggaccatgagtgacatgctggtgttggccttcttcaccataactataagaagctggaatgttcccctccaaggctatgaaagaaggatggagacaagaaggaaaagacagaaattctgtgaaagtctcaggtccttcctcctttcggaaccacttcacataatcctcttcctccccaggggctcccgaaagattaggcttcacttgcaggtcccaggccctggtcctgcagagtggttgggcctttggggtctctcagagagcctaatcattctgttttctgaacaagtcatagttttgctgacttctgaccaaacccccatcgaaacccaagagtggaagtgtgattgtggtcatctataccctgtccccctacaggactccctgtcccacgggatgcagcaggcaggtgtgggaaagcctacctgatggccgagatcattaagcagcggccctctgattttctgtacagctactcagtgacttggaagggattctttgcactaacaagcagtgcctccacaaacaatgagttgaggggaaagactcaaaagaggccgatacaatgctgtttgggatgtttctccctttggctggcctcaggggactgggcccgtcatgtaatcactggagatttagggcctaattaaactctggcattgggccagcatgctggtggccccttgagtttcccatgtccacccatgtctagggtattaaactctagactgggagtgtgtactgcttaactgatcccacaggagccagccctcattatccaacaggctgggtattggcagcccacagggctcggcattggcaggtgcagtcctggggaggactgcatgcctttaggttaacggtccctacatcagcacccgctggggccacagtagagggctttgtggatcacctctgccattgggacccctggcatttccttcctttcatggcctgataaaacccaagctctgagagttagcaaactgataccctttaatcatgccttatatttataaaggcctttgtccagagaactccaagtgctcaaaaatgtcaattaattcactctcccagcctcctttagggaaaagctggtggcaggtgtcatcatcatcaccagaggtggccaaatcatcttcttagtgggctgtcctggatattctttgtgtttaaagagcattttgcttctgagcacatggttgggttttgcacagcctgaagcataagaattgaggtatttccttactttacagctctagagaattcttgtgtgtgggtacccgtgaaacacaaactgagtgcatgctttcttgagtttggaaattttgttattgtttggtctcagcatttgctggtagtaaataagtaagcagaagtaagctgcttaagttcccatgtagtccaagacagagcagacaaaagacctgatccccaagccccacacctggccccaagatccctctgggattatcttgcggccactctctgaagccttggaccctgtagttgatctcatagccacgtctcaccagtaactttttttttggtgggggggtgggtcctggcaagagatgggtgatgtaggaatggcctagctgcagaaggaggacagccaggtaggacatctgcctggctcacctccttcctggccacagactagctttgtgaccttggttggcagcgtcattttcatgtcggctatagtttccatgcctataaacagaatgatgatacctgccaccaacttttccctaaagggggctgggagagtgcattaattaatgtttttgagcacttggagttctttggagaaaggcctttataaatataaggcatgattaaaggatatcagtttgctaactctcagaggaagtacttaatgggatcaggcctgcatatgttgatgactgagtttcattcttcattcagatctgcacagggctcccatcactcagctctgccgccattcatgtagtattcttctgttctttcatttctatatactcatagtagggggcccacaaatgctgccctccacatgcaggcccactacctcccctccctcttgtcaaacccaatggcttttcctcactctgcattttccttgtcctttctggaacatgacactggtcactacccctcctcacccttgaaagtcttattctgtcattcccacaagcccaacaggtctaaactgaagtcatcattgaccccaaaccaattcccatcattactgccctatttctcttcaccattctcatgggcctggattccaggtcttcctctccactgccaccccctctgtgcaagccttattgtcccaacctgcttggtcctttgaaaagcccatccctgggcagaaatgggatgtgtatgtccctaaactgcccccaaagacctctctgcactgtatttgacctctggccctcctgttccctaactggccttggtctcctgctcccttccgtgggccgctccagctcttcccaccatgtgacctgccttcctgcttgtccaccttcctgtctggtccccagactcagtttctactctccctcccagcaagctgggacacacaaacatagacatatgttatgttcacacaaacatagacatatgttcacatacccctcccagcatcctgactggcccagctgacctccctcacccactctgaataaccagctctccctcctcctgcctttgtccagtcccatctctattactcagggctctccagagaaacagaaccaacagggttggatgcggatagatgggtgggtgggtggatggatgatggatggatggatagctagatagatagctagctagatagatagatagatagatagataatacatgataggttgatattagatgatagaaaagcaaatagagtttaagaaattggtttatgcaattgtggaggctggcaaatctgaaatctgacctcagtctcttctcttaaggcctttgactgattggacaaggcccacccacgttgcggaaggtaatttgattactcaaagtctactgatggaaatgttaatgtcatctaaagaataccttcacagcaacacctagcctaatatttgacgagatatccgggtactatgacctaggcaagtcaacacataacattacccatcatgcttttcatctggtcagcagtgctcgtataaatctcctgaaacattgctctcaccacaatgcttccctgctccaaaacctaaacacccatatgcctgacatgcaatagggacaggtacatatttgttgagtgaataaataatgaggagcctttgggatgggctacactctgctcaatgcagcaaaccattttgagggcctaatgtctggagctgaggatatgactatcaaagctgcccttacgtgttcctctcctctccctctagtgtctcaaggccagagtccgaacctcagacatctctaatcccccatagtacccaatggagtgccttatatggattaggccctcaatcacttgtgggttaattttattctctttattgatccctatatcaaatttacctgaaatattataggtttttagggcgtcacttatgaaatcataaactgtagtgccaaatctgcttccacttttgtttttaaggcacacatgcaaagagctatttccacaatcaggaagggtggaaatagctcagaacactgacagtggtctgtagggatgggtggcttctatgggattttttatacttttctgtgtcttccaaattgtcctctgtgaccacgtgttgcttttacaaccataaaacatgttatctgtttttttcatttatcttttcgatttgggggtctgttctcagctcttttttggggtccccatcatgcctcctggcttccttttgaaaataaggcaacccgagacttccttgtaaaagtctgtgaggtcataaaaggccaagttaactgcaaatggttgttctgttttaattctgttgaagtgtcaggtaacatggacttataataaaagcacttggggagttaatgattactgctgttgtcaagctgtcccaaagacagagagggagcctgcacacgccgcgtctcgccttgggccgctccttcagtgtatccagccctgcggccgcgctggccccctgtccgcatgctgtcaggctacctccgtgccagacgaccaacacccagccacagtggaaatgactgttccttcaactttcttcagcccctgcctgctggggtctccggagggaagcgttcactctagcccaaatgaaacagagctccagaaaaaccacagtggaggccacagcggcctcaggccctgaactttgtatttcttagcccgccaggattgctggctgctgggtgtcatgtaactcccaaaaatgtgaagggaaaaccaaagagcctgagaagcgcagacgtctcctggctggggagtccgtctagaaagtcgcctttcatggtgaggccaggtgcacgcgagagtggctggagaaggtggggtgagcccagaacagggaggcccggcccactcccaggctgaaactccgagaaactccccctgcacaaggccacgccaatgaagtccccttccttctggaaagggtcctacacaaattgctagggtttccagtgtgatatttgacaagtgcaaagggctggaaatattctagagatttttcagcttcgtacaattatcggtggccactgagcccatctcacctcctgtggtgtcccgccagtggctgcaccagccaggcggggctgccttttgtccctgatcctgtcagccctccagtaaagtgtgcttaaccaggtgccccaggagagcagggggccagctccatgtcctcatgggtgtgcagcccctcagcccttcctcggccctgcccattaacagctgtgaccgcagaaaatgccccagcggcagcgccatggtccccagggctgccctcctgcctccctctaagtcatcgaaggtcaaggttggagaaatcttagtgcccatgggccctcctcctcactgaggagcagagcactggctcaggctcactgaggacagggccacgctgctctggtctcatgtacttttgtattctgggagcctagcactcagggctccctgagtgagtgaatgaatgagtgagtgaactagctcctgtgttctcgtcttttcttcggagagtgacactttggacaggtcatgtttactccatcccctcagcttttcagtaaaacgagcccaccagtgttcatttccttcatataactgctggcatcaagccagcaaccttgtggctcctcagacgcccaccggtgtggcccaggcggtgctgcagcctccctcgctccagccctcaagggaggcctcactgacatcagcctctgcattagtttcttataaggctgacttggtcaagttttacttaaaataacagaaatgcactctttcacatttctggatccgagaagtccaaaatcaaggtgtcacagcagggcgggttccttctcgatgcactgagggagagcctgtgttatatgtaaaatatttgtttagaaacagaatgctcgttccctggtgctgcaaagaaatagcactcaaacataaatttaattctctcagcaaggccatttttactttctgcagaaagggtgctcatcgcagatggaacaatggtgagagtacactcgaacaaaggagggaatcaatttttattccttacacagtttgtccctgctactgtgtcttgtctccattggctggagccagacatgacaatctaaactaaaacccgactggctaacagtttaacaagaagggaaactttggagaggaacttttactttctacagcctgtcccaggcctcctctagcccctggtgtgcttgggcgtgcacctccatctgcacatgtgctctctctctcttctcataaggacagtagtcagattggacgaagggcctaccccactcctgtgtcttaactaattacatctacagcgaccctatttccaaataaggtcacgttctgaggctctggaaaggacatgaatttggggggacactatccaacacagtacagccttcctgcccccctgcaaagtttcgtcttgctctccacccgcccctaacctctgcaccctttctttagctgggggtgggcttctggaatgcagtctcattcgcccactagtctaagtgtggttggtaggtagagggtaggggacacgctgtctgtgccaccgtttcccgccagggacatagacactctcaggatccctgaactctgaagtctaaactgtcagtcagcgtccccagcggaagctgcacttgagaatcacccgggagcttttaaaacacagtgtgccctaaccacactcccaggaactctggtgcacttgggccgggtgggactctggcatgagtattgtttgaaagttcatcaggtgattctaaggtgcagcctaggaccggaacaactgtgtaagatgctgtgaaaacagctccatctcaccttcaccaggaatatgagcagctcactgcctagtgaggctcgaatacccattaggaagagccaagccaggcttcttagggtgggttccctggcaacacttcccaaactctcccaccaagctcccaggaggcaggagggagcaaacacatactctgcagaaccggaaacagatggcagcaagcaccacgtgtccttgaagttttctggttttgcttttaaaattggaatttttgcatcttcttctacaatatcaccatcttgttttacaacctaaaaaaagatttcattatgttgactttttttcctccaaaaatatctgagtgtagaaatgaggctctggaaaggtatgccatgtttaaactgtggttttgtatggtccttgacacaccattgggttccctggggttcctgactttgaaaaacccagccacaaagagttaaagagggtgggagccaatctgtttaacctttggaaggaatcgcatcttagacgaaaacctaggcacagagaagttaagcagctcattcaagatgacacagtttgttattaactgagtcggaactgtacctcaggacccacctttcccactgcattgatctggggcaactgctaatttgctgtgtgaccttgtctagttctctttacttctctgtgtcagttttcctacgcataagatgatgataacatctgatccacccaacttcttcagtagttgaggaggctcaggtgtgtagaggcatgttgaaattagggagtgtcacatgtaaactgtggcatgtcatgtgtaaattatggagtgtcatatgtaaattataaagtgtcacatgtaaaaacaaggcgccgtaatttaagtccagcctcacacttctaggtgaggcacagtgattgcagcaagagtgacttttccagggtcatgcgggcgggccactgagggaaacacagtgtagtgcacccagcccctctgagcccgtgcagaggcttaagggagctccagtgttccagttccagggaaggctgaggctgggagctcatgccagcacttctgtttgctctccattggtcccagcttttatctgcccagtaccagtttgaaaacaaccttcttgtcccaatcctgagagtatcctttcgaaagagtaagtcatggaaaaatgcgtggcaaacaacaacaatgccagcaccttctttctcctttcacaaggccacagagaccctcccccacagcccatctcttccagaggaagtctgcggccagccctgctccagacccctcccttgccagcccaggcccgtgaggctcctcagcccacgtccgcccttttctgtttacactgggagatgagcttctgccgagcttaagtgcagttctggcccttttgtttgtttttaagtcaagttacaactttgctcctggatttattgcaaattccatttatcttcttcttcccggggtctctgcacaaagcctttgtgtcttcctcttctgctgtggacagataccatggggcaccaggaaaggacggggagcacacagccccggggaggcgcactctaaggagggccaaagccattctgcggggtgctggggaggaagacaggggctggcaatgtaggaggaggggctgtcgattacccgggaggacaggcccggccctacatcgtgccccttctcacacaggcctccagaggaaagaagagccaggccgaaaggcaaagaaatcccagacctcaggggaaggaatcaagaaaagaaggttctggtttgagtggaaggagcccgtggcactttctagccaggggtggtatgaggccaaaggttctgagaggcctgagaaaggacacctaggtctgctgagggcggtaggcctgagggttgggcacagcgcgtgccatgagagaccaccccaggtgcagctgggcaccagcacagtctctcagcttccctgcccttctcttaggcctccccaaccctctccaaacaccacatttccagaaactgctgatgaagagcaaacaactccaaactgaagctcaccagggagagaaagagaatcaaactgagctgaacaaattgcgagtggggcgtccagctgtgctgttggcttgtctctctaagaggggaagtgctgagggcctgtcccccaccaccaccccgagtccttccctagtgagagttccctggcttgggagcacgcaggagatgctcggcttcagaggggccttgcttgagcgtggtgaggaagtcccggggctgtgaaagaggaaatgctggactctccctgcctaagggcctgacctagaatggggctttaacctccctggaggaggagagcagctgcaggtagctggcggctgcagagtactcctgggcaggctgtagggccatgggtcagtagctgaaggagccacctttcatgccctcccctcaccatcacagttcccgggcatgaaactcaggcatcagcacctcagcccaggccctcaaggagtggggttaagtgagcatgaacagagcaggccccctttgcctctgggagcctcctggcttcccaacaggtgctatcgctgaatgaagaggagggctgtccacagcagtttccccagccaaggctctgggctccagccctgctggtccctcttcctctgtcacccatcagctctgcagccggcccagatactcccttctccatgctgtggcccctcctccggggcccccacttctcaacctctgcactggtctatctgtcacttacctgcctggctccctcagacacctccagccatctaccctgagaccttggctgctgatgtccactctctggccgcagcttcctcccttcacctgttccttctcctgctgtcaccctggctcttgtgcccccgcctctccctctagaagcttccctgggctcccttgcccgcctgatctcaggcattcagcaccctcactctcaactttactcaggcctgccccgagggcccctcatggccatccactgcattcactccaaaccttcggctgccaggccccagaggaggtgcggctgcaggcccagcacaggctgagtctggctctcccctgaggccactgtcagtggccactgtcactctcctcagatgccccagatccccacctctaccttctacctgcagaatctctcagcacgccccttactgagcaggtccaggccttcccacagggcccctggagtctcctctcacccccctcagagctcactcactcacaccaccacccttccttccctcgagagcagaggatgtccccacctcctttgcaaaactaacttccatacctgggtgcaaatgcaacagctcctgtgtcttccacaccaagtggccgccgtcctcagcctggaccggaagctgtgtggcagcaggatctccagtgcttccagtgcacagccacaagcatggcgtcctcttccttgtcctaaaagggcttcccttagatggctttctctcagcacaccatctctgctcttgtcccccgtatcacacacttctcactgggtcctttcaccttcctcttctccagccctggccatcggctgctactgaaggccattctcagtggcccaggagccaaccccctagctgcctcctcagagtttctgggcttcccacccaccctttgcctcccctccatgggttctcctggtgacttcctgccaggcttccattttctctccatccccgtgctttttacctgctcctctgctggccgggcctcctctcccagcacatcgcttctgtctctctcctccgcgtccacatcttcagccagtgcttccatgagcccccgatttccagctccccagatccccacatttctaccggcctactctgctggccgtctctgcttagacaccctgcagaacttctcacgaaattgaactgatcttctcctccccaaacctctccttgaggctgtttgtctctttctgtatttctaccctccccactgcccaggctcaaaacccagcattctcttcatctctttcttctctgtctccctgcatgtctggtcagcctccggatgcctgaaggagcttctgctctatttttcagatccctcccactccggtgttgctatctgaattcaaaccctttccttctcctccctggaccttacctctcagcctttgggcctcgcttcccgtggtctccctgtccttggacacagagcccatcagagtggcctgtctccctttcagaaacccatatgagctccacatgcatgtggctcccctgccaggaacaggcctccctgtcctcccgtacaacctcactgccgccacttgtcactcagcagatgttgcctgagtccctgccatgtgatatgtacctgtgctcacaccatagccacctgctgctcactcccagaactgaccctctgcacctacccagtcttctggtccctctttttgttcgcctgttttatcttccagagacacctcctgttctttacatccatttccacccatcagcaccttattcaatcgtactcaaggcctacctcctccaaaggtgaaaccaatttctctcctgcctcattttcccttaaaatactgttcattccctattataaccacatctgaatgtatatgtgtgtgtgtgtgtgtgtgtgtgtgtgtgtgtgtgtgtgtgtcatctccctagttgtgtaaccctgcaggccatgaacagttattattcaatgttgtttcctacacatctttaataaaagtttgttgcatttaaatctgatcttattctctcatttcacagttgttagaactgtggccagagtcagccccaggtcagaatgctggtcagcagcagactcacatcccagccctaccttcctgatacctgatgtggtgctcagaaaaacaaggaatcccaggctgttacccagtgtctccatgtgccctccacagatgcactcaactgtcctctcttctgctcttcctcctacaaactgggcaactggaatcagaacagagactttggatgagcatccagtgtaacccagcctagtttttcaccacgacttccagatctacatttaacatccgacagcaactataattctactttctgaacctccagggaagttgcttccttgtccctttcagcaaaggatgtcatggttttacaatgtctccagtgaaaaagttcttcttctctacatcttcctcccactcctacaacccttgatccccacgtgagatctcatttcctccagctgggtcttctgcagagtgattagagcttctgccctccttgcagcatctctattgtaaaaggattgctgaagcttattaagccttgcagctcctaggaggaaaggtaccatatagaaataaaacaaatcaacaaattagtgtgttttgtagaagttgaataggactccacctatctgcatgagtgtgcacactgtgcagtcgcacaggcagtctcaaatgggaatttggaaaaagctaagctttttcacttgagaaaggtttacatattctttgcacctgggcacacacagcacaggctgttctcaggactcccaccagattaggcctgggacatgacagagcctgtcaggtccacgtttgctttccagtctccttgcttccagtctagctgtggcctgactccaagtccagtgtaagatttttttttttcagcaataaggaatcggttcattcacctgtacgaaaaccagtgggaggatcatgcataaggctcatatccttgctgtgaatttcaaaggactggctaagtaaataaaattatcatgccaacctgagctggtatagattgcattgattgctgctaatagccaaaatggacattttaaaagtgctctacactgcattctacacaacttgggacagaaaaatagctgttgctcttaaggagctgatggtctccttcaagggtaagctggaacaggctgacccaggaaaaggcactcccagttgaatgctttcacttgcgtgggaagtccagctgtctcaatggggcccaggagacagactgacgagggacgaattcctgtgtttgggactgggcttgaaaagtctcctgtttgtaacactcaacttgtagaagagcagaaagaatttccagctgtcgacaggatgaggggagccctcctgattctgtctggggatgtgtttgcactccagaatctgctatccttcctcttgctatccttcccggctaccacatgaaacacctggtcctatgggccagctctggaacaagatgactctttgccatcaaggaatacaagtggccaaaggacaaatattgtgtgattccacttacatgaggtacctagaggagtcaaattcacagagacagaaagtagagtggtgattaccagaggttggggtggagagaggggaacggggagttaatgttttatggatacaaagtttctgtttttcaagatgaagaagttgtggagatagataatggtgatggctggacatcagtgagaatgtacttaacacccctaaacagtacagttaaaaatggttacagtgataaattttatgttacgtatatttgaccataaaaaggaaggaaaaaaggaaagaaggaaggaagggagggaaggaaggagggagaggggaagggaggaagggggagggagagagggaggaaggaaatgcaagtgggaactcagccctggtcagagcactgctgggaaaagataggtgactctttatcttgctgtaaagagaggtgtgtttgtgtgtgtgtgtccctgcaggagtgaaaatggacccacaaaccacatggttaatgaggtgagcatactggaccaagctatttaacatctgggcctgccccatgactaatagtccaggtcattctgcataatgcagaccaatataagattgttagtggaggccaggcgtggtggctcacgcctgtaatcccagcactttgggaggccaaggtgggcagatcacctgaggtcaggagttcaagaccagcctgcccaacatggtgaaaccctgtctatactaataatacaaaacaattagccaggcatggtgactcacgcctgtaatcccagctacttgggaggctgagacaggagaattgcttgaacccaggaggtggaggttgcagtgagccaagatcacaccattgcactccagcctgggcaacaatagcaaaactctgtctcaaaaaaaaaaagattgttagtggaagttgttctttttttctttttttttttttgagatggagtctcactctgtcacccaggctggagtgcagtggcacgatctcagctcactgcaagttctgcctcccaggttcatgccattctcctgcctcagcttcctgagtagctgggactacaggagcccaccaccacacccggctagtttttttgtatttttagtagagatggggtttcaccgtgttagccaggatggtctcgatctcctgactttgtgatccacccgccttgacctcccaaagtgctgggattacaggcgtgagccaccctgcctggccagaagttgttccttaaatggctaagagccttcataatattcttgggagggcgagtggcagcccatttctccataacttgctcagaagcacattttagttgttttaagaatgactcgatttttggagtcagagaggttggggctagagtttagggcctgctgttgtgtggccattcagaacgcccaatttaaatctaaatgcgtaaaatcaaaagagtggtgaatgtgaacatgcttttttataaactgtaaagtgcctcactgtgatcctttattctttcaattcagcctatgagtgcaagttagcaatagactttaaagaactcatactgcaggaaagtaagcatagatactaaaatacaaaattcaacctctactgcctatgacacgatttttcaggcctcagaggcagcctggtagcaaccacagctaagaacaaaggtcctaagagctggactttttgaaaaaatagattctgtagcctttgtagggaggagttggtctgagttgaaccatattgctgagaagagtctctcattaagcctttatccattatcaacactggggcataaaatcatttataccaaatacttatttttttaattgagatataattgacataccataaaattcaccctcttaaagtgtacaattccatgatttttagtatattcacaaaattgtgcaattatcaccattatctagttccgaatattttcatcacccccaaaagagtctccatatgcattggcagtcactccccattcctccttcccctttcctctggcaaccactattctactatccatctctatggatttgcttattctggacatttcatataaatggaattatacaatatgtgaccttttgtgtttggcttctttcagtgagcatagtgttttcaaggttcatccatgttgtagcatgtattggaatgtcatttgttttcatagctgaataatattccatggtatggataaaccacattttgtttatctgttcatcagttgatgcacatttgagttgtttccactttctggctaaaatgaataatgctgctatgaacattcatatacagtgtgtgtggacatggattttcaatactcttgggtacatacctaggagtagaaatgctagtcatatgagcaattgacctagctttcttggagtgcactggcatgatctcagctcactgcaacctccgcctcctgggttcaagcgattctcctgcctcagcctcccaagtagctgggactacagctgcatgccaccaggcccagctaatttttgtatttttggtagagatgggatttcaccatgttggccaagatggtctcgatctcttgaccttgtgatccacccgccttggcctcccaaagtgctgggatcatctgtatccttactggtttactgatttttctgactatttgttttattaattcttgagagaggaatgatgaaatgtatatattcaaactatgactgtggttttgtctatttcctctttaacttttgtcagtttttgattcatatattatgaagttctgttagcaggtacagaaacatttagaattgttaaatcttcttaaatttttcttttttttttttgagacggagtctcgctctgtcgcccaggctggagtgcagtggcgtgatatctgctcactgcaagctctgcctcccgggttcacaccattctcctgcttcagcctcccgagtagctgggactacaggcgtccaccacaacgcccagctaattttttgtatttttattagagatggggtttcactgtgttagccaggatggtctcgatgtcctgacctcatgatctgcctgcctcagcctcccaaagtgctgggattacaggcgtgagccactgcacctggcttaaattttcctttttgtcactatgaaattgtctctctttatctctggtgctattccttgtcctaaagtcttctttttttattattaatatagctactccagctctcttgtgataagcattgcacagcatatcttttttcattcttttacttttaaactatttgtgtttttatatttaaaatgaatttcttgctttttaaatccagtctgatagtgcctgacctttaattggggtatttggaccatttgcatttaattacaagtacatgtaacatacatgtttggtttaggtatgtcatcttactatttgttttctactcattccatctgttctttgttaccttttgcatctttccttgccttcttttgaagtgagggttcttttttgttatttcattttatctagaccattgacttttagctacatgctcttgtcctttgtgctattgctgctataaattttatttctgcatatgttatgaactctacagtactttattatttttgctttaatattttaaagaaatttttaatgaaaaattttaatatttatcctcatgtttcccatttctggtgctcttcattcttttgtgtagatccaagtattattttccttctttgtaaaaaacttatgttaacatttctttagggtagatctgctgatggtgaattgtctaagctttcatttatctcaaaaagtcttcattatatcgctggatacagaatttgatttgtgtatcattcagtatatcaaagaaagtattccattgtcttctggcttgcattgttttgatcagaagtctgcagtatttcctatactctctatgacactataaaatacagcttttttcagactacttttaagattttctctttattactaattttagtaatttattatgatgtactttggtatgatggtgtgatttcccttgcttattttgattggggttcattgtgattcctggatctgtggtatttatagtttttaacaaatttggaaaattttcagccttgatttttgtcaaaaatttgttctccctcttttttctttttcaattatacatatgttagaccacttgatattgctcaaggattgatgggactttgttcatttctgggttttttgttttgttttgttttgtttttgaagtcttcttcctcttggtgcttcattttggatagttcctattgctgttttcagttttacttttctccttgtagcatctagtttgctttgaatttcagccactgacctttcatttcagatattgtcttttccaccacaagaagtgcattctttcctcattttatgtatgtttttcttaaaatcctggagtatattttgcctacttaaacagctgttttaacgtgcctgtctgttcattctgtcttttcaactctgtcattttcaggcatgtttctattaattgccttttttcctgatatgggtcacatttttctgctacctggtgagtctagtaatttttgcttagatgttggatattttaaaggttacattgttgaatgtttgtatatttttaaatcctcctttaaggagtattgagtttttatccagcaggcagttacttatggataagattattcctttagaggcttgtttttagctttgttagaatgaacctaacgtttcttttattctagggatagttcagtcttactatctgcatatgaacctcattggatctctactaaatgccccagctgatcaagctggttgatatttttacatctcagaatcccatgtgaactctgaaattttcagcttatagcttctggtcattctttgcccagacttacaaagcttcactctgggtatgaacatcttagtattaagcactcaacagggcacttgtgcagatttctggagctttttttacatggtcccctcttttctagaattctgccccacagtttccaactacagtctccttgaccttcatttctgtattttaacttaacaagactaccatactgtgcttgggatattgtttcccctgctgtaaagtccagaatgtgcctccaatcagaaactgtcatgatcatttaccacatgtattttctttatctcatgggtcatagttctgcactgtgtgttgtacaatatctgaagccgtcagtacatttattttgttgttttctagttttggtagagacagggtttcaccatgttggccaggccaacctctatatttttcatccaggcctgcggggtcatcctctttggcttcaaatcccaagggatacagggggagggtaaatctggatcctgttgctttgtcatggccagaagcaaaaatcttaagaacaggttttgataaagaaatgatgaatgatagcaggcaggcccagaaactagacctgataacctggctgggggttccaagatataaggaagcagcagaaaaactctagcatctgcaagccatgcaggaacaggtatggcaatggagacagaggcaaaaaattttggaaattactacaaacaaatctcatctgtgttcccaggtggctggctatcttacatttgctctccagattcactcgccaccctttggcctgtcaacctgtctagattgcatcaatggggcaccattgacctctagtttctagttgtgctcaggcaaaaagagacacaaacaggaaactacaagacagaaaggatgtttattcccctagatcctttcctgtcaaatcactgtgaattagttttgcccctctaccaaaagttgcactgtcaccatcctattgggaggccctctccttacaggtactctctgtggattctcctaactattccttcctcttgaccctttggatttagggagggtaatgcctcttcaatgtgattaagcttaaagtattgcaccttcctttgttagttcccctaaatcctgtccatagcttgataaataatcccttcattaaattctcctctttttccccaccagaattctaactgatactacagggttgttgatgctgcctctaaatgtaaaccatctactgcccagtaattgtaagaccataggcagatcactttactgactctagcctcagtttgcccttagcctagccctgacaacttgagcctagccctgactacttgagaaactcaaattcaggaggctgtaccataacagcagacctgaggaaagaagtgccccctccaccttccctacctttttttttcttttgtcccccattcttagaattcctagctcagctgctctgcttcacaggctaacccaagtcttttcctctaggtcttagccacagatatagcctggtcagtgctaagagaggaggaggccagataaagaccactcacgtagagacaactatcatttggggatcatgctcaaggtcaagttcacacaagcaactcagcttttaaccctagccagtagggcttaacacacaagggactcttttccctcctgacacatgctccctggagaagatttatttttttattttttaactagaaagacaaatcaatagaatgagtaaattaaaaagttaaaaggctgggcgtggtggctcacgcctgtaatcccagcactttgggaggctgaggtgggtggatcacgaggtccagagatcgagaccatcctcgctaacacggtgaaaccccatctctactaaaaatacaaaaaaattatccaggcgcctgtagtcccagctactcaggaggctgaggcaggagaatggcgtgaacctgggaggtggagcttgcagtgagtgagatcgcaccactgcattccagcctgggtgacagagtgagactccatctcaaaaaaaaaaagaaaaaaaaaagttaaaagatagagattttaaataaagaaggaaaagtcatgagttttaaaaggttagtcctaaggtcaaggaagcaagttagacagagtcatttactgcagcctcccccaggctgaagcacatttagaaatggaaaccaaaggtatggtggaaggaatccatgagcaggaggagtcaaagagttggtgacagtctactctgaaagacattaggccacaacgaacatataacctctcaggcaaacatccccagatccctgtcctaagaaagggaaaatgaaatggtctcccacctttctgtgaaaacccattaaacgtacttgccttcctgaggaggttattttctgcatagtgcaccttttctgtcttctccttaatcaaagggacacttaagtccccttttgaggcttctaatgtggcaagcctattcagtctccaaggttgatgtttttcctagactttcacttgatccttgccccaaatataatgtacctttcccctacccatgttgtgactcagtaccaaagcctccagggccactaccccggggttagcctctctctctctccctttccttccaggagtctttccaagatctgaggtaagattgatgcttctctgggaatcagacctccttacccttcctcttgcataggcttaaacatgatattgcatctttcttttagagaaaaagtctatattttcttgttatttattatcattaaaggcaatacaggcttacccaagaactaggcaggttattggactggatctacccaggagtccagagattcccaagtgagtcagcagacgcctgagatagtaggggcctaagaatagcaaccttccctacagcctctgcgtgaccccttctgacctgtccccaccatgggtagctgttgtaatctgactcactgtgtccctccagacagctctggtttctgataagaaccttccatgaaagaagagccttgctcacttctgcactagctgctcacattattggttcaaggcttagagagtatagtcctttgacccctaacccttgatcctggccccagtgaactattcctactgggcataggaagaaatgcctatacctgacattttttactgaagggagagcagagacaatctacccaatgatttgctattgttaattaataccccaaatccctaagtaggagtgactgaaaggcttaaggccctttaactcttcctattctcaagtgaatctaaagtttattttccctatatcctttaatcatgtttcaggtcctcacctgtctgtccacagcctgaatacaattggtctgggatgggatttggaaaaagcagacacaatgccttgtagttgatgagtggcagctcgggagtttctgtaaaggagaacctatggatggaatattggctgatacaggagccagggggttttcatcaggctgttttgtatagtaaacactctatttttccacttagattgcatgtttatttacttagaaagactttaggggaagccaatggagactggaggggacggggcaaggccctcccaaaccactccttggcaatccctgcctaagatggcttaacccctcattggattctctcacttctcacttatttttccttcctttatcattcattcaatcctgggaataccacgcttattgtttcattcatccatccacccacctgtccatgcatccatccatccattcatgatggcagctccttctcaatggaaagcaaaagccccttgccagagagaacctctatatttttcatccaggcctgtggggtcatcctctttggcttcaaatgccaagtgatgcccaagggtgctgatggtgtcactgcacttctccacagccacctttcttctcttgccattctctcccactcctttctcctctactcttaagttccttttttctctccttttcctttctccactgtctatgctttaggcctacccaagccactgtggatattttgtagccattcaaaactaaaaagggcagctgagcccaattccagaagagttgatagctcctggctcctggatcctccatgacttcagctacccgctgtttccctggggcagagctaagctggacttctccttactggcccccagggtctgggctaaggccacattggggccccaaggacatcaagtcttcaggctggagctttctcctacgggagaaaaaaataagctcccaaagcagaaaaagttgtcttttctcctgttgctattggaaacataacaacaaagccaagatgtagtggcttagcaagaataaaacaagctgtcagcagccagggcccagctgatctcctcagtggtgacgtgggttctgtgcacagtgacaatgagtgtaattgaacccagagctttggggtgcaggaggcaggccaagcagccccaacgccactcccctttcccatgtcactcatgcctctggttgggggtggcagatgggtcagcacaggcccacagagggttcctcttcatgtctttacttctctcctaaagagggataagcctggaacctgggcacctggaatgactgggcaagcatgcctctaacctggcctccattcctgagctccagttaccctgttaccatccagccccatctgttctagagtcactgcctttaggctggagggaccttggcaatcgtctggtcctggctgtctcaggagcagaatcctcacttgggattagacccttcacagacgccagatgctctaagtacaggggcatcatggaggaggagccattctgacttccagtatacttgatgaggaacaactgattcagtcaacccatatcatcttgggtcaggattggtgctgattcattttgattcctgcaggcatggtctctctcctcctgaagctgagtctagtggggaagacaaatatggatcaagtaattaaagcgggaggctgtttaccaaaagggagttcttaggaggtcacaagtctaggaagagggtggtcacggaaggcctttctgaggtgatggcatttaaattaaaggcaagagtgcatttctgtcactcacttcctcacccccagagcctaacacagggctggcacatggtagatactcagttgtttcatgaatgaatgaatgaatgggcaatgaacaaatatctctacatttcctgatagcccttggtgacttacaggatttgatgctgggtctattaatgtatccatttacaaaaaaaaaaaaaaaaaaaactggatgtcacgattcctcctgagggctatttgtgttatggacgtgctatgtgctgttcattcaattttagaggtgtttatgctgggtcacagctggggaaaacgatacccctgagatcccgcagggagtcttctagactcgccccctcctgacaccctcagactgcaccatggagaactctgtaaattaattcatcaaagtgaggaaggcaggccccttgacaggtgactggattcagatctgaaagcggagacaggttaatacttcctgtgcccagatgtcctaaccacagacccaagctcacgggaggcaaggggagaatagcaccacggacctaccttctttttctcataagagggtgaagggttcttggaaattcccctaaagcattcaaatgagcaaatccagggctgtttgctgtcaggtttctgggcaggattatgggcagactgaccagctgttccctcccccaggactgccttaatttccaagccctacttctcagtcccagggaaagttggcccagctataaaatgccctgaaactctcccagaactcaaaacatacccacagtacggtgtcactcttggggaacctgtccgtaatgaacagcaacaagcatcttctttcccttccctctccaacacgcacctttccaagaagagaaatgagagctagtgacattgagtataggcaaggccaccacatatagtttcacaggctgttcactgcaaaaggccaacatgcatagaaggcagatgggggctgaaattcagcctgcactcatcctgccaagctgtgccctggcatggctgtatccacaaagaggaaggggtgccttttctaacttgtacataggtgccatatgggctagtagtgaccctgggtggagagcccaaagagtgacatctggggaggaaaataagccaatcattcccttgctaccacctaaacattctagccaggtgttcctcaagtgatcagatatgctaataaggcagacttcttagaaggtaatagaatatgatggataaaccagtagggccggtaaggctttgtgttttatttttctatgtcttgaattcacatgacagtgaaaatcaaactactgagatgtactagggaaagatcaaatgtcttctttctgttaaactgcttttagggagagtaaagatttgcagtgagtataacccctctgggttggaaacaccaggagtctggaatgtagcccaaacactgggctctagctttgcttaccttgagccttttggtcaggaagggggcctctgaaagacgaggggaagtcggcattttctcaagagaacaacctcccctgtggaggtccaggcatctcaccagagaacacatctcatactcaggatgattagctcttggtttcgtctgaatggtggcataatatggatgtgttgcttagaaaagaatctgatttcagcacatgtttgatgggtgtagaaccaagggctgtggtcccctttgccgatcactttacattgtggggatatttggaaaaggcaactcatacttaggggcaagggcagtcaccccctctcagaaatacgtccccagcatgatatcctttgttatctgcccatatgcccagtctaaagggggctatggttctggggaagctaagagggaaggtgggcagggagtgaggcctgccaatcacagctctcctagcacttccgggccctcgatatgccagagcatgaagtggggtcaagggatggaactgaaatgcttcctgagactctgggatccccctaaccgcagttccctaccctcataattccaaatcctctgtggctcttggaccaggcaattacctgggaaccacctctggactggccagagggaagcccaagcttctcctaagtttcaggaagagaagcctaggttctcggtgctgttgaaactcagcgcatgcgtgggcagttcaggaaagtcagaccaatgtcatatgactcctgcgcgatcctctcaggaaacagggccccaggcaatttcgttcctaagtgagacttcttccctcatcatcccttttgttttttctaagcaaaagttacttggaccttgcagataatttcatatccagagccctcccatgcctcgtgggagtacataggataggagccggtggttccgaagcgcctgcaggtgccacacatggagctaaggggtcactttgccaggaggatcttatgaaatcctcagacaaccctgagatgaagaactgttactgttcttatttttactgataagatgctaaaggttcagagagtttaagtagcttgcacgaggtcacacagccaataagtggtggagctgggacctggactagtcccagccctagtgcccacactcataccaccttatagcatgggaattccaggtctttcacaaagttggaagactgggatataatgaggagggaaggccatagctcccctacacccatggtcagccaagctctgcccatgtcgtgagatgtgtatcggagctacaactcctccaggcattttacctgagagcagggactctgtctcccttgaacttttctgcatacgctgtgcctcaagccaggcctgattcacaaaataatgtttattggcagaatgaaggaccgcctcccaagctgccctcatcctgcttttctcctccctctctcctaagctctgagtagacactgggctcgccaggctttctatttttatttattttttatgaaacagggtctcactctgttgcccaggctgtagtgcagtggtgcaaacatagctcactgcagcctcgacctcccagacccaagccatcctccctctttggcctcccgagtagctgggcccacagaaggcagggttcctgcacaggcaccaggttctactcaagctgacctatgttcccacttctgaccctagcatgttaaacatccatgtccctagatgggcagatgggggaggtcttgaacatgtgtccttcctacaatgggttctcagctgctcctggtatctctatgaatgggttctgaaggttttctctcatccacacagttttagctcttctttgggtttccagggctgccccgcaagaagcaaatctaagcaggaggttagcaactgcgttcttggccctggtctccttcccctgagtggccacagtgtgggtgaggttcagactcccccatggtgtggctggctcctgggtgggcccaaatagcatgttcatcagttatcaaatgtcaaagatcagaagccaagccatataaacacctcaagatgctgttccagcagttatcccccgtatttatccactggaacagcttgacaaatctgtcagtgctaaggagggtaggaatcaaatcatataggtccctatcttcaaggtgtccaccatcgggctgaggaggcttatatacatggcacagttagtgagcagtgcaaggtttgtgtggtgcagtgtgccaggcacagctcagaaagcagggatggtgttggtgggatgcaggggcaaaaaatcctgataaataaagcctttcaaagtagctgagctatcaggaggtcctctcctatcttccataccccatctagcatttcattcctcttgaactacctactgctacacaacagacactctaaaacttagtgtctcaaaacaatgcatttttatctctcacatctctgttgactgggctcagctcactcaggatgtcttgcagttggaacggctagggctgaaatcatctgaaggttctactgagctggacatccaaggtcaccatcactcactcacatggctggcagtgatgctgaatgttggctgagagctcagctggggctcttgactgcagcaactatttctggcctcactctgtggcttggacttctcacaggatggtggctgatttctagagcaagtgtcccatattgaaggttctaagagatccaggcagatattgcaaagcttcttacaaccaagccttggaagttccagaatgttgctcctagcatattctgttggtcaagcaagtcactataggtagaccagatttaagaggtgagaagcagctcatgaatctgaggagggaaagaactaaaggctgccatcttggagactgtctattacagcttcctttatataaagataacatgcctttgttgaaccgagacagaaaatgaactctcaactgggaaaggaaaaagaatctgtccctgtgtctagaagaaggtacttcttcaagtcccaccccagcctgttttcttacctcataccccaaggtacattctttgactatgtcctaggcccagaattctggagtcagaatgcggaagagagtggaaaaaaccacttacatcatcctaactaaccagcccacatttaagaatgagattgctacgtgactgttgccatgaaattgtttatctgcccttgctgcagtgtggcctttaagggacacaatctggtgccaatgatgtcccagcagcagttgccatggagacctggaggtcaaggttggtaagggagcttcttgccaagatgatgtcacataaaaatccctttgctttcttgtgaccaccaggttattcagctatgaaggaaaaagaaagccataaattcctcagatgtgtgtccacagttggagcagggtgggctactgcagactcctagcatacaagtcacgagacctcctttgagtccttgcactccccctgacttgtctgatgggggagatccatctaacctcactggacatgctccaggagccgcgtttggaaggctgtgaaatcatctggttgggactgcctttctcacccatctgaataattcaagcacaataactcacttctaagcctgccgttggcttcccacagcctctgtctgccagtccccattacctatggggtgcaatcactgtccatataaagcagaactggggtactttgcacatgccacctccccccaactcactcctagtctaccctacttcagaaaccttatctccttccccaacaacacaatgtatttaaatagctactaatttcctcttctttctttcttctgcataaaatttcattaattatacatttcttggttcatgacacaatgtcatctttgtaccatgcacacttcacttgtatttagctattcagttatttttttttaaataaacaccatccagtcagcccacaacccaaaacaaaagccaggcccttgacgacaaccagtatgtcttccaaattccaagtgacagtgaacagaaaaatgaaagagccgttcacccagcataaacaaggcggaagaagcccacgcctatcaaaagtttccatcttctagcatccgaagatggcgcatcttccaaatgtcttggtttttacatgacccaagtgtcccagtctttccagtcattgaaaatttgggttctcaagtggtgtatcattttatcttgagctgtgtgtcctatagaaacatggaagatgactatttcttttttcggctaaacatgcagcagccagcagactagagccagcttctgcctcgggccgccccggggcgcgggatgggaaggggttaacgcagcgccccgcttacctggggtaaaagccggcacagaacccgagcgcacaggtcgccgcgcgcatgcgcactctcctggcccagcacagtgcttgggggccggcggctcccagctcccgggccgccctgctgcacaaaggcctgctttgttctctcggctctgttttaaatatctgacgaatattccccccatccctgctccaaatccccggcctgacggcaggcgcggcacaacggcgcattgtggggccaagcgaggggcgaagggggctgggggtggccggcgcgatggggacgctccggttgcgccaagttgactctgccgtttgggtcacctgggctgagtcgcgggcgtggaggcagagggtagggggtgaggaggtgtttcttgtcttcttcttccaatctcagaagtaaacattggaaagtggggcccccagcagtgtacagcccgtttccaaaccaggcctgtaaggaggagctgaggtttcggctgagcccccagcctcccccgaccgcacagcctcgggcatgaacccgcgaagccagacgcttagttgcttatcaggccatcgctgtacatatttagaaagtacctatcactcagacactttgaaaagcgtggcgttccagcgcaaaccaacccgaacgggttggaagggggcagtcctttcttcccgcaagttcggggctcgagagacggctgcaggaaggccatcacccctggcttcctgcagccacagcttccagccccacacgatgcccaacttcattttagcagtggcccccaggggaaatcacaccattcttggttttgtccctccctcctgaggttgggacattgttcaaacaaaagtaagccttcagctgacagagaagctgccccgcctcttccctgcccttgtcttgctggcattcattgggactaccaggtagctttccttcccagctcaggtgtttacctgctgctgcagaggaggagtttttgcattgtctccagggggtttgcaaaataagaaccccaaaacccacctctctttcccattttcttctttaaaggtagagaaagcactgcatttcacattgggtcttggaaacccaaagctagacacaaaatgtgggcgttagcagctctgaaaagtgtgtgcttggtcttaacgtttattcttaaaaaggaggtgttcataccccagcttgcgaacaaagctttcataccctcagcatcttgaagggaaattgctgcccttccatccagggcaggtgaaggaggaactggcttgggagggttggattcagaagcaaatagctttatcgttttgtgatgcctgtttgaggcctgactgggagcccaggagtcctccttctgtggtagtttgttataaatcccagggtcggacttacattccccagctgcaaaaagcatacatacgtcctaagatatttatttttaatcatactttataattttcacatttcacatattgttacatttcaccaatactctaatacttgagtattaaagctaatccaccatagaccaacagtctaactttgcaaatgaaggaacttgtccagagccattcagaaagacagggcagaggcgagcctggaggccaagcctcctgtccctatgaccaggtttggtcccttctaacatgctagtcatgaactaaaagaccaggtttcctaccacttctcacaaaattcttatcacgtcagggaggattctgactccacagtaagaagctttggaaaaaggtttttggtattcaggtagctttgaggagagggagtctcttctcagtacagcccctaggaatgccgagtttgccaggactgtgctcacaagcttagagacgtaagtcacgttccattgcctgggttgctaagtggcagagaaatcctgggtgtttgtttccaggcactcttgagcctccggaggaatttcttcaagcaacactaactgtcctttcaccactctgttggccagtgaaccccctatctctgtagatgacagcagcccgctctttctcccccactagtccccctgcagcaggtcagcctggagccacatctgggaaggtgtgacctagaacttgacctccttccctgatgagtatgcagaatctccccagctataaaatagcatggccgtccctaccccaccccccatgcacctccggacttggagacattggaaggtttacttcagcacatttgtgatgcgatactagctgcttggagagaaaccttcaccagcagcctcatcctatagcagtgcctgcccatctgggcaggaggtgccagggtttatactcccctgagcttcagagggtgggatcgttccagacaaccttcggccggtaacttctacgggcacatcctttttttcgtatgttctacattgacccataccaccaccaccattccaaccccttgaaccaacccctggtttcaagctctcccaggctggcagatgaaggaacatttcaaagccatcacgtggtaatactgcctgctggccaacaactccatttcaacagcgtcacctttggactgttcagcagtgtttgtgcaagtatttgaatattttctggcattttggccctattattttataataataagtggaaatggaaaaatgaagtgctgattctcatgataagaagggcaggtctcacagagctcatataattgaggcaaagatggaaatcattaggcacgctgaaagtgggattatgtagcctcaatcaaatgctcactggagttaagcctgtcaactatgtgtccaattgttaaaaaaaaatgaatacaattagggagcatatatgaaattctggacgtatatggtcaaagactgtgtctaaaaggcgggtgtagttgggatatactggattccctcaattctaaagctgcattgatttaatagcagttttccaggactgggttgggaagacactgtgagaccagaaatcaggaaaatacagtgataatattgtttcacttcctgggaacagaaccgtccctcataacatgcaagtgtactgcttgcccctggcatggtggaccagagggttttcaggacagtattagggtatgggaggagggagtggcctggagattgatcccttggggagtcactacagctcggaagccggggacaggcctttagttaatgtgctagaatggatggaacttgactcaagagaggccctcatgccacaaggttttgaatctcccatgtgcccggcatatagaaaatttagggagttaaaagcaaagagtataaggtgcaccttttcctctttgggcactcgtccctttaccactgtcccagctctccctgggggccatgctgtcactggcagcctttgcacggtctgttccctctgctgggagtgtctgtcctacctccttggctgcctggccagctctggctcacccttgaagacgccgctcaggctcctgcctccccaggctccagtgtctgtgtgtgcgctgcgtgctggccatccacctcatattcttgctctgtccacactgtataaccatcactggctggcctgggagagtttgaagatgagatttcttgttcatctttcgatcctctgcatcccaggagccctcagtgagggtttactgagtgaagcaggccaggaaggaatgctgcgttctcaggaagacctcttcagcaaaacactgttgacctttgcctttgcatcatgcgccaggcatgacctagcacagccattttaaacctctgagacaccaagaaactctttctttcttctccagaagccaaaccatttgtttctaaattccgctttctttgcctccgaggccccctcatctggagccttcttgcccatctagtgtctggagcttcacatcctccgggaggttctttactgatactttcagtaagtaaagccactgacttttccttcagctgtggggtgctcgctgaattcttaccacttcttcagggaaaaacaacctagaagcactctctgatccaaagtgtttctcagggagagcggccaagtgagcacaggagccgctcggccgtctgggactgtgatgtgatgtctgaacagcctctttagaaacactgcagccttttccagggatgccatccagacggggacatccctcacaagttgtctagggtcctggggatggaggccgggagctccggatcgagggatttagccttatggggcctggttggccccgccaggccagctgtgaatgaggagggtgtctgagctctgttttgcacccgtccactcaccaacttattcttgacctaacacaccatgcccctgctgcccttggctgtgacgatgggaagcaactgtccaaaaagcctgaggggagccagctccaacaaacccaccgttggcccaccatgcccaccctactcagcgcaatgaccagtgggtctttatgttttacagtcagggccttgctctgttgcccaggctggagtgcagtggtacgatcacagctcactgcagccttgaccacccaggctcaagtgatcctcccaccccagcctcctgagtagctggtactgtaagcacacaccaccatgcccagctaattttttcttttttctttttctttttctttttttttttttttttttttttttttttttggagagaggggttctcaccatcttgcccaggctggtcttgaacacatgggctcaagtgatcctcctgtcttggcctcccaaagtgctgaagtgctgggattataggcatgagccaccacacccagccctgggcctctttttgaggacaccaatgccattgcctcctggctaaactgctctccacacaagttagttccacagactctccaggtccttgggaccccatgaaactctctggggctgtgcccagagtccacttgacagaaacctgattcttttcctgtgaggcaaacagctgtgatcgggacatgtctgtcaggggatgacttggcagagctacaacgccaaggctcggatgcatattttttatgtgatttcttaaaattcaagcaggagaatacgccttcccccaaacggctggctcccccactgcattcgcattccccccacgatgtataacaggagtccgcagcccacccctggagaggacaaggctgtaattcagcaaggctccagtgacatcctgaccgtgagagtgcagctggggcagtttatgaacagtgctctagtccctgggggaagttagctctgttctccagcccacaagagtctattgttcgctttcttgtttttctccaaatgtttagatgtgctcagagcacagaaaagcccgaaacccaggccaccagccagggcgatcctgaagcagggaagcctgtgggctggagctcgtggggctacccccacccacacacacccattgttgttcctacctcgccctaagatgtgaccgtcctggaggacagaggtaagggagtggcctctttttggccagggctgtttggacaacagtgggcttggattgttccagcaagtgaggtatgagaccacagctcaggctcacttgggtggtagccagaagcaactgcccaagttaccttgggcccatccaaaatgtgcacagagagagtttggcaactgtcttccagttgcttgtcactgaccaagactgctgaagtttgacaggaataagcaagttctggcctcctgtctgcatcaagaatctgggctccaaggtacagcctcttgagttggactcctgccatcagctcttcctaactgtgcaaacttgggcaagttacttagcctctctgagcctcagtttcctcctgggtaaaatggcacctacctcgtagagttactgaggattcaacaaggtaatcaaggtaagcactcgcacagaatgagccctcaatacatactggttattctttgtattattactgttatcaatgattactagtacaccatcccaaagtcacctcctctgcttagagcatccatttttgtacctaaaccgaatgccttcaacagtctccagttgtgggtcagagaacagctgtgcaagaacggcaatgccagaggaatgaaggatgaagtgccttgtgatgtggggaggagagaacgtgctcaaaagcccgtcgcctttgcctcccactccccttagccccagatccctttctccagggctcatattacctgccctcccccagtggctgggattctcagcctgccactggctccacagtccctacagagccaccgaaaccctcccacccctgcctggaaaatgcctctcccccgtataccaccttggcggccaccactagtcagccagtaatggggtgggggtgagacggaggtggagcctctggaaatggtgctagatcaagggagaaggagatccaggaccccaactccgtaggcctgggatgctgagtacagtttagagattggggattcatttacaccagcttggggggctttggtgtgaagggagatggacagagtatgagggaggaggaaaaggtagagggtagaggaatgcatcctgaatcctagtcctttctgactgggacagttcacatccataaacgaggctctggggcctgcctcaagaaatggaactatgatgatccccctttggatgcattaatcctttcaaaaataagactctgggagcctccggtgacagggccatatggtttccttatcttccttatcttccagcactcaccttccatttggaatgtttatcccaagataatgatcagattccacttagggtgattgaatgggggcctctgagtatccccccctcaatttcaaatgaatgggtgatccgatccaataatagatgagcctaacagtctcctgctaatggatggggctcctcagccccatgccatgcacccccaacttccttttcctgcaaatatccacccccttcaacctgggcaactccacttttacctgctttatatagtggagggtgctctgtgtaaaatttctagtgagccaaatggaactgctttaaactatgtttaaaaaccagagatgtgatgctaactcagcgattttcaatagaaatgtaatgcaagccacaaatgcaagctacacgtgtcattttaaattttctgatagccacacatctgtaaaaataaacagatgaaattaattttaaggatatattttatttgaaatctaatttatatcatagttatttaatataattaatatatactatattttattaaaccccaaaatattttaacttgttaccaatataaaaattatttgtgaggtatttcaccttcacttctttgtacttagtcttcaatatccagagtatatattgattctgactagccacatttcaaatgctcagttgcccctgggctagtggctattgtattagatagggcagatctagacagaccacactaagaacctagggcaaggacaaactctgatgggcatagttgagctggctgctagagagagaccctttgagaagaagagcaatttacaactttgctctgagtctaagtggagatctagccatcatcttgctacctctccttgcctttcccctcccagggaggaaaacacataggacacagcatttttttttttaagtgatagcagttttaattgctactaatttaatggcagtcatttcacctgctaataaaattgtccattgaggcctccagccgtgagtgcttttttccatggactgtttaaaagtgaagctaatgctgattgtcaccaaacatccatgtcatggatccactgtactttgtctgaagaaggggaggcccgactggggtagacagagtcagctttgggtgatcactgccagtagacaccctctgattccagagaacaggagacacaattcagcctttgacaggacattcagataagtgttcactagtcaatcggataccatatttaaggctgggcgtggtggctcacacgtgtcatctcaacacatagggaggctgaggtgggtggatcatttgaggtcaggagttcgagaccagcctggccaacatggtgaaaccacgtctctactaaaaatacaaaaattagctgggcatggtggcaggcacctgtagtcccggctactcggaaggctgaggcagaagaatcgcttgaacccaggaggcggaggttgcagtgagcggagattgtgccactgcactccagcctgggcaacagagtgagactcagtctcaaaaaaaaaaaaaaaaaaaaaaatccatatttaaatggccattcatgttctggaccaggcattggaaaagaacagagtttgtgttcggaggtttgtatatgtgcttgatgtctcccagtcctagtgagtcttgaatgagttaataatgtaacaggtctcctgctgaagcagacatgcccagcgcctccctgatcttcaaatcaagataaacacatacaagagcaggctgggaggggagtcctctggcaaagcaggaggacggcggccccaagcaagccctgcatgagggaaggtggggaagtagattccaggcctcttgggagagcccttcgttgaccaccttgtggaatagttgctctctagcccctgtctctgctttgattttcttcagagcacttataattcttgacattctattttgtttttatttgttgattgctgtcctcagctttgtttcttgctacttccccagtgcctagaaagagtgcccgtcactcttaacaaactttttttttcagacagggtcttgctccattgctcaggctagagtgcagtggtgcaatcatagctcactgcagcctcaaactcccggcttcaagtgatcctcccacctcagcctccagagtagctgggactataaccatggccatcacacctggctaattttttaattttgtgtagagatgggctcttgctatgttgtccaggctggtcttgaactcctggcctcaagcgatcctcccactttagcctctcaaatttccgggattgcaagcatgagccacctcactcggacttcgtaaacatttgctgactgaataaatagtatgaggagtttgttccagccatcctgggcaggcctgaaagatctctgagcttagaaacagccagaggatgagaacaagctggtaggagaggcagagcgagatggtggtctttgtatgtgattcccctagtaatggggagacggagaagaatttgcagaagtgagggaatgtgattgcagcacaaaggcagcaagattattttgtcagcaacatttggatcccattggtgatgagagacatgtgggcccggcaaggagacaattgtggtagtcaagacaggatgtgaataagacataaagaagcgtttcatcagtggggatggaaaagaaccagggctgtggcggccgagttcaggagtaggaagggtcggtcaggcgttcatgaggacctcttcacatacacacacacacaaacacacacacttgcacacacaggcagcctgctgggaccattcatttagaggcccccacagcacattttagcacaactgcaaacctcaccttctgcctcaggctttggtctttgtcttctctttgcttcttaccatagctgggaacattgccctgtgaagggcagggcccagaaactttggaggaggcagtttcttcagtcacagcttttctcctggctagtttgcagaggtaagaggcctcaaagtcacaatgtccctcgggagagaaaggagagaaggccagtgaaggaaggcctggaagaggagagaaatccttttttgaactgggtcaaggagggcaactgtgagctgacatcctaactcacacattcacacatgtgtaggccacgtgaagggtctgtaattgagactgggggactggaggaggcgaatgagcttcttattaggagtgggtggggaccttcttggggatccagctgaaacagaactttatttttaaagagctttagattgatgtccctgctagcctaaatataactgagcagccagcttcttgcgagccaggccaggcttccaagcaagctccaagaccctctttttaagagagggaaaaaaagagagagggagaggaatccacagatggaaaaggtcacacagttagccctctgaatgtgctgggaggagggagatggatgagctggttgtgtacactctgcagtcccctggcctcaccatcaaggaagaaagatcaagggttgctgggtgatgggggaggggagctggcatccactttgtacctgggatctgcctggcccagtcggggacaagtaagacccaggcttgtgctcagagagctgacggtccagtgggaggaaaagggtgccgagcaaacctgcgcagcactgcagtgcagcgcaactgatcagtcccacgtgacgcacaagcagagggctgtgagctttcagaggggccattccatgtggctgggggacctgaacagcccatctcagagaaggaagggtttcatatggagctggagagaaaacaacaggaagcagagacaggagtggacaggatgcacgtcgggtactcaaactcatcagatttgacagaagtgcaagaatgtgagagcaagggggttggtgcttggagcctgagatattgtccttcagtctggaggtaaaggggaggcactgaagagttgagggggaaggcagcaaccccacgtagactgaaggaaggctaacttggcaatgaggtgtagggtggagcttccttgggggaggggagagcccaagaacacaaaggtcagcaaggggtctgagttaggtaaggcgatgctagctgctgtaacagactccagaatctcagctgtgtaaaacaatagagatttgtttcttgctcacataaagctaatttggtagagggctgaggtgtagggctttgcttctggagtaattcaagaatcctgagtgaggggggctctgctgtcttcaacatgtggctccacggtcagcctggaattgacattcatgttgcccaggagaatatggaagacctggcaggaggcttttatgagccaggcattccaccggccagaactcaagtcacctggcccctcctgcatgcaagggtggctgatgggtagtccctggtgggctacacatatctggtggtcacctctgccacaggacagggacagggactgtgatctgaaggaatatgtcagcaataggaatgaaaagggaggaagcaggcagagcgtctatatttaggaattaggaggaagagaagccagagatccaaagcaaaataaggcagcttgagggaacagagagaaaaagacagcactgcagacactttgaggaggagtgtgctgagacagaaccttcggtttggctgccataaggcctgtgggagaggtgggcagagccagggttttgttttgttttttttgttgttttgttttttgttttttgtttttttgagtcagagtctcgctttgttgtccaggccggagtgcagtggcgcaatctcggctcactgctgcctccatctcctgggttcacacaattctcctgagtagctgggattacaggcctgctgagtagctgggattacaggcgtgcaccaccacacccagctaatttttgtatttttagtggagatggggtttcaccacgttggccaggctggtctggatctcctgacctcaagtgatccacccacctcagcctcccaaagtactgggattataggagtaagccaccatgcccggcccaggttttaaggctttgggaagcagccagcaatgattccctaatactttccgtaagcacatccatgcattaggcatgtgtgatgacattagctttacctccaaacacccaaagtggccccagaaggcacccctttccagggactctctgtggtgcagcaatgtgaatatgggctttagagtcagaagatctggaatccaggaataaccatgtcaacctacggcaaacaccttaatctctgggagccttggtttcctcatctattaaatgggcagactggtagctacttttccatctcattgaaagggttaggagtaatccacttcgtaaggtgcttagctcagtgccagtacatagtaattcatgtaagaaacatttattgtatatctactgagggccaggtgccttactaggtgttggggactcaaaggaaccaaaattcctgctctcaagaagcttatgctctggtagggctgaagacacagaagaagcacacccttaaaacatagcatgataaatgcaatgatagtagtatttttagaagagggagactcagccctagtttgttggaagaggtgacttacagtggagaagaagagttcaccaagggatgggctgaagtattccacaactaaggaaatatcaaagaagcagcaatgtgtagcaatgaacagcaactggacttcttgtgagttttgtcagattgcatcctttaaggaattggcccatttcatctaggtgtatgttggggtgggtgctgggaaatggctgagctgggaatctcacagtttactgtctctaaccataaagttaaagcagaagtggcaggaggtgcaatggaaaaggtagccaggatcctgaattttgaaacgttatccattgtgttaatggtctttaccctgtgggcaacgaggagcccttgaagagttttaagcaagagactgattatggtcatatttgaactcatcttttaatgagttcaccttggttgctatttgggtaattatttaaggaaagaatagaggaaaggaggcccaagacacagttcagataaaagatgatgaaggtctgcagagattgtactcatgtctgccgtgtgttgcatgtgtaccatatgccagccctgtcctacgggatttaatttcaaattccaattgttcactgttggtatataggaaagtaattgacatttttgtactaactttgtatcctgcaaccctactataattgctcgaagtcccaggagcttaagaagttaatccttttggattttctacatggatgttcatgtcatttacaacaaagttttctttcttccttctgaatctgaacactttttatttccttttcttgtcttattgcattatttaggacttccagtatgatgttgaaaaactataacaggggaaatccttgctttcttcctgatcttagtggaaaagctttgcatttctcaccattaagatgttagctgtagattttttgtagatattctttatcatgttgaggaaattcccctgtatttctagtttactgagaattttttatcatgaatgggtgttggattttgtcaaatgctttttcttgatccactcaatagaatcatatctattgatatgatcatgtgatttaaaaaaaaatacagagacagggtttcactatgttgcccaagcttgtctccaactcctgggttcaagtgatcctcctgcattggcttcctgaattgctgggattataggtgtgagccaccatgcctggctgggattttttttttttttagcccattgatgtgatggattacattaactgattttggaatgttgaaccagcattgcatacctgaggtaaatcccatttgatcatagtgtatacttctttttatacattgttggattgaatttgctaatattttgttgaggatttttacatccacgtttgtaagagataattggtatgtaattttcttttcttataatgtctttgtccatttttgttattagggtaatcctggcctcatagaatgagttaggaggtatgccctctgcttctatcttctgaaagagattatagcaaattggtataatttcttccttaaatatttaataaaactcaccaatgagcccatctgggcctggtgctttctattttgggaggctattaattattgattcaatttctttaatagatatagacctattcagattgtctatttcttcttgtatgagtttcgccagattgtatcctttaaggaatgagtccatttcatctaggttatcaaaatttgtggacatagagttgttcatagcattatttcttcattatccttttaatgtccatgggatctgtagtgatgttccctgtttcatttctgttattaataacatagatattagtcctctctcttttcttagcctgattaaaggtttattgatcttattgatgttttcaaaggaccagcttttggttttattcatttttctttattgatttcctgtttgcaatttcattgatttttcctttgatttgtattatttcttttcgtctccttccttgggatttaatttgctcttccttttttagtttcccagatggaagcttaggtgattgattttagatctttcttctaacgtatgcactcagtgctataaatttccccaagccctgcttttgctgcatcccacaaattttgttaagttatattttcattttcacttaaatccaagtatttttaaatttcgtctaagatttcttttttgacccatatgttatttataagtgtgtggcttaatctccaagtatttggggattttccagctatcagactatttctagtttaattccgttgtagtttgagagaaaacattgtatgatttctattattttaaatatgtttaggtgtgtttcatggcccatggtctgtcttggtgaatgttccatgtgtgcttgagaagaatgtgtattctgttgttgccggctggatctgtccatttctgacagaggagtattgaagtttttaactgtaatagtggattcatctgtttctccttgaagttctaccagtttttgcctcacacatttggacactctgttgttaggtgcatacaagttaagaattattatatcttattggagggctgaaccctaaatcattatgggatgcccctcttatccctgataactttccttggtctgaagcctgctctttctaaaattaatatagctactcctgttttcttttgattagtgttagcatggtatgtctttatccattcatttacttttaatctatgtgtgtttttatatttaaagtagatttcttgtagacaacatagagttgggtcttgtttcttgatccactcagtcatttaaggagaccagaggaggatgggagtggtggggggataaagatccagatccctctaaaataagcaagtgctttagctaaaccattctactccttatttcagaggggagaaaagagcagtcatagatccaagataaaattcctcctccctgctttttattactttgttttatcctactcctctgataaatggatagatatgttcagaacatataactcacttaaaataatatgaatgctaaacatgtgccaggaaatcagagcagctccttgtgttttcccctttttaggaggtctgggaggaccatccacccctcctggaaggccctgactcaaacactacaacattagatcccagcttcccctttgacagagttttgcaggttcccaggagagaggagtggtcatgaaaagggggtggggcctctctctggatgggagaaggcactggaactagtaagctatcatctctcagattccgctttgggcttcgccttccccagtagctgtcacctgcctttccctttgttgttggggcactctgctacaacctgcttcatgctccccacttactgcctccattgtttccctcccactctgtgcaataattccctctcctcccttcttcttccaggggccttgttttaggcttgaccttggcattgctggcatcctaattcctgcaacgagcatttacttgttcatctaattcatacaatgagcacctactgagctcagtagtgagttcttctaattcatacaatgagctcagacatgaagctgcccctatggcctcagggatcaaggagggctgtgtagggccatggtgtctgccccctttctggtgcccaggcagtggcccctgactcttgccataagtcctgttcctagtcacatggccacaggctctacctctttctgccactcctctgaccctctgagggaccctggaatccatcagtggctttcaagccccctgaggcacacaggacttggtaagaccatctaaggaccatctgcagcatcttttctcaaaggcctgaatgccttcctggggctctgcctagaaacagggcccagattcctgctgttgctttttgaagcccaaaaaccacactgaatgttgctctccttcctgaatctctgcctaaagatcaggaatatgtgagaagaagtggaatctctgctccgttttcaatctcccctcacagattagtctggcctctcctatgtatgtcatcaaatgtcaatagtgcaggttttgatcaggcactggtttgtcgtttgcttttttttttaattaacttcatctccacaaaagtcttatacactcatcatagggagtttagatgacacagaactatataaagaagagaataaaaataacctataatatcagtactcaggaagaaccactgttagcattttgtaagttactctcctgcacatattgttttatatacttgagattataactttgaccctactcagtttgttggtttgtttcattttttcactgtgttaaaatacacataacataaaagttaccacctaaactatttttaagtgtagtcttcagtggtactaagtacattcatattattgtgcaaccatcaccaccatccatcactagagcattttgatctttccaacctgaaattctgtacccattaaatattaattccccattctcacctctcccaagcccctggcaagcaccattctactttctgtctctgtgattttgactactgtaagtatctcgtgagtggaatcatatagcatttgtcttttagtgattggcttattttacttagcataatgtccttaaagttcaagcatgttgtagcatgtaccagaatttccttcatttttaagggtggataatattctgttgtgtgtatataccacattatgcttatccattcattcatcgacagacagttaggttgctttcacattttagctattatgaataatgttgctatgaacgtgggtttacaaaaatttcttcaagaccttgctttcagttattttgggtatgtacccagaagtggaattgctggattctaatacagtaattctatttttagtgttttggaaaactgccatactgttttccacaatggctgtaccattttaaattcccaccaatagtgtacaacagtttcaatgtctctacattcttaccaacacctgtttttctcctttttttagtgatagtcatcctaatgggtgtaagatgcttgcttggttttttaagtttacattatattgcaagcactgtcattaaaaactctccagacacatccctcctccaattcctctattgttggaaatttaggatttttttctttcaatatttttgctatcataagtaaaattgcaacagagaatttgtgcataaatttctgctgcatttttggttatttacataggcaaggattgctagataaaatacaggatgtccagttaaatttagatttcaaataaacaatgaataatttgttagtgtcagtacactcaaaatattccccgggacaaatttattctaaaacagtattcatcatatacctgaaattcaaagtttgctaggcatctttttttttttatttgccaaatctagcaatccaaccatacgtactattcccaggaatgaaattaatgagttaaagttgatgaacattttcaagattctggatgcatctggccaaagggcttttctgtaaactagtgccaggttcctctccactaacagtaagtaagaatgcctgttttctcacaaaagtggctgctttgagttatttcatttaagaataaacaaaagtttgcttctttgataggtgggaaatgatcatttacaaagttttgactatgaatgaaactgacctttcattccaaaggttggtcttttgtatttcctttcatgtaaactacgtgtctgtccttggctcatttatctttttgtgtttcttgtcaagccataagaactcttaaaggatattagctttgtggctttcacattttgttgcaaatatttctcccagcttattgtctgccttttaatttggcttatattatttgccaaagtaaaggcatttgatcgtcttatgtgttctaatctctaggtctttcatgattcttccattgcttttagtccacagccccttcttacttagattacatatatctattcacctgtatttgcttcaagaaatctgtgttgattctttttagtgttttctacatttaaccgtctaaactatatggagtgtctttggaaatggtgttcaatgagtttctaaattatttcttctcttcagatctctaatttgcttcagctatatttgatgaataaaatctcttccttcacaatgacttgtgatgatactttagccttatacataaagaaaaatctattttccttaaaagtgagcttctctgtcatttaatctgtctgggtcttgctatattaactatacaatgaggctattttataattcattcatgtattcaacaaatatttattgagcatcttctgtgggtcagatatatatgtaagatttcttagcagacttagctgagattaaaggaaaaattaaaataaaaataaagatttcttccagcattaaaattctaaatataaaagaacttcatttattcatcctcagatcactggaggaaactgacataatttgcttcacctgttgatttttttcattcttttatattaatctagtctactaattttattcagatcttctccagaacttttacctcttattgctactgcatgtcttattgcattggcaaaaacttcaaaataattgttacatcataaaactatgtaataaaagtgatagatgacacccttgttttgtctctaaggagaatgcctcccattttgtgccattaagaatttcttggcttttggtttaagatagaggtatttttgtatttaaaaagtaatagtctcttcttatttttctaagaggttttttttaagtcaggaaatacttgattaattttattaaatataattttagagcctgttaaggttattgtatcattctttatgagttttgcattttgaagtacaagtactactaacatagtgggactacatgaggcagaattaagatgaatacacacagtcctcaccacattatatggtgcttttgtgaacagcaattctaaacttgaagtacattttaaagccttgattgactgattaatttgttgttgttgttgttgcccaggctggagtgcaatggtgcaatctttgctcaccgcaacctctgcctcccaggttcaagcgattctcctgcctcagcctcccgagtagccggaattacaggcatgcaccaccattcctggctaattttgtatttttagtagagatggggtttctccatgttgatcaggctggccttgaactcccaaccttaggggatccacccgccttggcctcccaagtgctgggattacaggcatgagccactgcacccagccactctgattagttttttaaaaattgagcatatatatatatatatacgtatatatatatatacacacgtatatagatgtgtgtgtgtatatatatatacacgtatatatacgtgtgtgtatatatatatacacacacgtatatatatatacacacacgtatatatatatatacacacacgtatatatatatatacacacgtatatatatatgaaaatgagaaattcgaacccgcatgtgtgtgagtaaagagtgtgcagatgttgcacaaaactctgtacgtgctcaaagtagaatgaacccacaaatatcccactaatacttagcttttatatggctggtctccaaagtagggtgtgtgcaagttgatttattgaggtaagaggaagagattagaatgtctattttgtatctcatcctttaaacttttaatttgttatggtgaaaaagacattctaatcttttccccttaccccaataaatcaacttgcacacaccctactttggagaccagccatataaaagctaagtattagtgggatatttgtgagttcattctgcctggggcacatacagaattctgtgcaacatctgcacactcatttgaatttaaatgtacagaattcaaaatgccctctgaagcttaacgaagaatttttaaactagtgggacaaagctcaataatggtaaaagcacacaaacacacacacacacacacacacacacacacacacacacacagggaaaaacaagttattcaactttgcctgacttggggtaagttatgtagcctccttgggactcaatttcctcattactacaatgacagtgttgggccagatgctcaccaagcctcttcctgcactgacattttgtgatggcgatgaccctgtggggagtatcaggttatgggagaaacagatctacatgtcagtcagcagggcaactctgttattagaaatcaagcagagtgcagtcctaggactgatgaccaagagtccagtgtgcacaatcctggctgtctccagaggcaaccctcgcatgtcatagcaatggaacatgaagaggtggagatcttttggagtgatcagagaaaggattaaaacattttaaaatgagtcctctggggaaaagttacagaaattggattccttgggcacattaggacacattaagatggattgagctcccagctccaagctccgagctctgagcatctcgtggttgagcagcttgctttatactgattgtgacagtcttgggcaaagctctttttgtttcaaggaacagaaacccacccaagctagctcacagaaattcacagctaggaacacaggggtaactgggactcacaggaatagacacactatcaggaccttgggcatctcctgggggctttatgttctaagcattctctctctgagcctctgctccattctctactccccactttgtactctctgtttccacttctctgcaagatcagcgcacagatggacatcatggccccactccataccttgcatgacttttcagcctaagtgtccattggccattagcccagtctttccattttcaagtctaggttcccctgaaatgatgtatttatcttacttaaccttagctttttgtgccaagccacatcaataattggtcatcgttggttagccaatagatgggtcacccttgggtcaagtgcccacccttggtccagtcatgtgtgaagaggggaggtgagtcgcgtgctctcagacagggctgtatggggcagatttcctccaatcactgggggagcagattggccatgatgaacaccttccgcaaagagaccaactgtcttttaacctgatactgatatgagcacaaaatcagtctgaccctgagcctttatacaggagtaagatgtaataacacttctcaggacaccctttgaaataaggtgagactccttctgccttaagacaggctgaccaagggctgcctcgctatggtggtggcctgggctgcagggctcctgagagccacctcttggcccattggtctgggagactctaaagtcactccccccgcagagcctaatttctccatcagaaatgtctgatctttgctgatgggtggttagctatttgagggatttacaaagcactaattctgtttgaccaccgaaagattttccctgcttaagaagatgctaaaaactacccaaggacctctgcaccctcttggactggcttgaccaattttcatccattttgaatattcaatttctagctacttctctgaaccaactcacaacccagtgactgacttttcattccttaatcctacatgtgactcttctgctcagcatcctgcttagaatccccaggatcttatagaacacagaaaatgggacattaatgaacaagcaggcagggtgattgtctgtggtcttttacctgtgctgggtttaatcacagtaccagcctgacacataggtgggcagaaaactcagtttcctcaaatgcaagggctttgagagcttagacttcaaattagagtgagatctatctaccccaaacaaagctactcagacacctcactatctaaaatcagaccagaacctggggatgagccaagaaatgtctaagcagccaacattatctacagaggcccatactgttgtgtttaaagtagcatctaattcaaaacaactagtttctcagagggctggatggcctatcaccctttaagaaagcctggatgaatcctctcaaaataggaaaagctaggttccttacaacctatttactttttgtttacacagaattttggcacatttgcatatctggtttctcaatccagaacagactaaaagaaaatgagtcctgagattgctacaggtatgaacaaaatagcattctccctcacaacagggaaaagtaaccactaccacaggaagagatcagaaaatgatataaagtagacccaagaacctcaaaagcatagcaatatgaagagatacaaatggccacacatatctcaaaggtttgggcactactgggttaacagtacagtaactgaagtttctaaatatgaccctaagtagaacagaaatgtgaaattaagatcagtatattctattttaaaacctggtaagcatatgacttttttaagaaaaacttccatccaaaatgatgaaatgtttacatgtgatgtttattttattttattttgagataaggtctcactctgtcacccatgctggagtgcaatggagcaatcatggctcactgcaacctccactcccccaggctcaggtggtcctcacacctcaacctcccaagtagctgggactacaggcgtctgcctccatgcctgctaatttttgtatttttatgtaaagataaggttttgccgtgttgcccagggtggtctcaaactcaagtaatctgcccgccttggcctcctaaagtgctgggattacaggtgtgagccagcatgcccggccacatgtgatgtttaaaaggacaaaccttaagctagctggaaagctccactatccagaaggatgggttttgttctggataactgaggttttgctatatagctgaagtcgaaccctctagaccacttcttaaaggacatcagggaagcttgtcagccagggaaatgccgttgctgtgacttatatgctatttggacgaagcaaacgggctgaagaaggtttgactgtatttggttgtaggcttcgcttggcaccgtctctttaaaaggctgcctgcctttgaactaatcctctatttataatccagctggagagaggcctcggcaatgtatacaaattcctagaatttgcagagtgctgctcacgtaagccctgaaccccactccagagcttctgcctgggccctcacttctccagcaaggaccctgaatcatcccggaaccgtcttggtgctgtggtagacaggccacctggcacgcccagcgccccacattcttggtgggaagcacagggcgcatctgggaatgggggcatgagttggattaggctcagtaaacaccatcactcactcctgatggcctgcactgctcaatggctctttcctagagaccaagggttgaggcctcaggcacagctcacctctatagggctgttcctttcttataattcattccctcccaacacgacgccaacttcacattttcctttcttccccccttgcacaaattattgcaagtcatggcgatctaaatatagcccgcagtctgcgctccagatgccgaggccacgcagccccgatattctcctggtgtctttccagccgcctcttgctcttgctgtcctttctccttgctcgcccttgttttctccctgatactcctactctctgcctcccagtctccccaggtctttcctgtttttccagttcaaaggaaagttctaaaagcaaggcctgaagcctggacggccccctccccagccctccaacagcactagctgtgggaaagggatcccgtctagagaagaggcagaggtgcagcatcctctaggaccctcggccatgcgtgctgtgcgttcttgcccaaccttcacttactcgctttgtccagaagttgtttatcctccttcctcctcatctgtttcttcttggatcctggacgccaaagagtgactggccactccttccattcaatcacctcctgtgttactggaaaatatgttaggacaccctccaagtcattactttcttgaagttaaatgatatcaattccttttgcctcccttccatgggcctaggtatccagagctttcatcatctgcatggattgtctctgtaccatctccaagttggccatatcccctgtaggaagtagggccaggccttgagtcctctgtcctgctaagggtttgacatctgctttgtgagcataggggagcaatttactgatacttcttaatcacaggcccctaatttaaaaagaagtgctacagtaatgatgtgtgttcatacctaacttgaggtccactctgataataggctggtccttttcttcactgaaagcaaagcatttgattcacacgcatgttttattctatccttgtcaatatgcttgttcactcactattagtcaactttcttaagttctaacttggtgggctcacggtgacccacatcccacaggtggagagtatataactattaagtcagtctgctcatttatttattcaaaaagcagttattgaaagctgggtgcctcggtgcatgcctgtagtttcagctactcaggaggctgagactggaggatgcctggaggccaggggttggagactgtagcgtactatgagcatgactgggaatagcgcactatgagcatggcaccccagcctgggcaacatagcaagaccctgtctttcaaaaaaacaaagccaaaaaacagttacaggatacctctttagacctagccgtggatatacaaataagaatttgcctcaagagatacacagactagtccagggtttctcaacctccgtacaactcacatctggggccacataattgtgtggatggccctgtgtattgtaggatgtctagaagcatccctggcctccacccacaagatgccagtagcaccaccccacacacaaattgtgacaaccaaaaatgtctccagccattgccaaatgtctcctggagccaaaatcaccccaatttgagaaccactggtctgatgagatagatagatatgcaaatgatcattacggctcaaagaagccctaccatggagacacgaacacaggcccatgcacagagggcactggagttgaattctgaaggatgggtgcaatttttccacgtagagactatgctggagagaggatattcttggcagagaaacagcatgtgcaaaggcacaggggtaccacagaacaagtcagttgcctgacatggcagctactgggtaggaacaaaaggagatgaggatgaatgggggctggccccagtgtctaaagggccttgtgtgactgggatgcttgcacttgatcctgaggttagggaaagcaagaaggtttgtaagctgggagcatgattgttggcatgatggcatgacgaagagaggaagctctgatgacactccaggaagagatgatgtgggcttgaatgaaggcattggtgcttgggaagggaacagaaggggcaggatttgaaagctctttctgaggcagaacgtgcaggatatctgagtggagatgaagacagggaataagcccagcgctacagagctgatggaatcctggtggttcggtcttggcattaaggcttttttctatcccagaagcattctggagtttgggctgtgcccaccttgtctgggaagatgaggctgtggggacacctttacgtcagggtgtgtttctgctcatccctccttgtttgcttttagatcaggctcatgggagatgtctggtggacagaaccccccaccccctttaggaattgcattaaggacatgagctgctaattttgtcgctgtcagtgcctggcaggcagatggccctgagcctcagtttctccatttgtgatgggaagagaactccccgccccatctcccaggatgtggtgcgtgtgaacagggctgtttctgtgggtggtttagacccccgtgggtgcttggcacttcctgcctgcagttggtgaggatcgtgagcagttgtaatcaggcctgataggaaggcccccaactctaccgcggccttgagtggctgccagctccatgaccaggcctgcttcaaaacttgcctgcaagttatttttttcagggtgtctggttcctgtaaacaggctttcccaaaccctctcaggctccaagaacccgctttggctgtgcatcccactgccgttcatgctccccagcccaatggaaaacctcaagacaatcccactccatttggcttcatgcaagccctcccctccagctccctccccccctgccttcccaggtaagttagagtgaaaggagggagtaggaggctgggatggagacaccttagagagaggctggccccaccaggcagtcatgatggtctcaggcctgctatgtaacacctttccccagcacacctacactgggtgggctaggtgagtgggttgtgccaggaggcaaatggtgagtgtgtgtgtgtgtgtgtgtgtatgtgtgtgcgccagctagctgcccccactctcaggagcccggtgctgatggtgatctctctctctctcaatgcaggaacaaggggctgcattgttagctagcctatctcttggtttctgattcaccccgggccacggcagcctgagcaggttcacagctgctcagggttatactttccagcacatttaggacttggaacagccccaggtttcaggaacacatggtgatgggggaggggaggggctcaaatagacggggtgtgggggaagcgagctacttctttctttcttcaagatgaatctccattttcatcatctgatagcaggaacagcatctgaggacggcggatgaattgcaaacctgctcaggtcgggggagagggcaggcgtgtgggggagatgggcagatttagttcatcctggctgaggtcttcttgtgcagccgtgtaccctctgacacacagctcttgctccagttacagcctctgcacagccagggcctgccagggacgcccacccgcggggcactctggcatacatctcggaagtcagcccccagagtgggcctctggcttccagcagccatggccaagagggcagggaggagctggaaaccggccctaagaggtgggacgtgaggaacaccagcttccatcttacagatcggcggggtcttttctctctgttgctagtggctggctaaggaggaaatcgagactataatttcccagcctctaccatctccctattttctctgagacaagtaactgcctcacagcagacaggaaccaggtgacactgctgtcccaagcattctgcccacattcaaccacagccattcatccatccatctgatatctgctgagggccttctaagagccaggcatggtccaggtgctggcttttagcaaggagcagaacacagtccctgtcctgcaggagccaggagaacccacaggaatggcaggcattgacagcaccatgtacaaggggctcgggctgggcaaaaccagatttgagcactgtcagtgactttgaaaagcctggaccctgctcacctggcagcaggcagcctcctcctctgctgccatctagctggacaatctggggcagggttctcttgagcctggtcatctcagcccacccacagagatgactataggtatcctgcctacctcctagggcagctgagaaactcaagtaagatttgtgcacagaatcccaaaatataaaacctttgtccagctctcagattcttctcccccttttctcaatggggtaactgaggactgaggcctaacatgcaggagcctgtatcagaacagggaggctgctgtgtgctgccagagattgccacccctcccagcctctctgggcagtactacacagagctggcctctgtgaggggtgcagagcagctccgggactcccacacagagcccctttctcctgcgctctggcccagagctcgctctcagggtcctataattgaaaaggcgaccgcaggccggcagtgtgacctttgggcctgcctgggcgggtgactgagttaggcccccaggtcccccacccctgagaggaccagccaggccccaatttttcacagacacagcaaggaaggtgcagcatggcagagaggaccgggctgagctcctggctcccagcccccatgggtcacttgtcccctctgctccacactgttcccattcactatgcgggatcaagaactaccaccctctctttgaggatagacagggagagaggacagggtgtatgtcagagactagatgagtttgcagctgaataaaagggtttaagcagcctggttaaaacaggaaagagcctcagtacaacctagtcatagtgctgcctttgactttctacatagaagtttctacaaagatggaatgttctagagttgcactgtccagtaggacagccactagccatatgtgactattgagcactgagatggagctggtgtgactgagaaacagaacctttacctaagtttaaatagccacatgtggctagtgatatccatattggacattgtaggtctcgcggtggggggaatgctgaggctttggagccacagagatctaggttcaaatcctgacgctgcagctgaaacttagcacttcatggctagggcatgctgcttgacctcttgagactcagtttccccgtcatttaacaaaatttttttgtaaagacaggatctcgctatattgcccagactggtctcgacctccaggcttcaagtaatcctcccaccttggcttcccaaagtgctgggattacaggtgtgagccactgcaccagcctccccatcattaaatgtagagctgaataatatactaagtgagcctggtggggggccaaggcccagggtccagctcataggagctgatagtccatctattaggactgctgcctcggcccctgcagagatcagtctggtggcttcaggcatctgtgtctaggagggctagattgatccaggctttttcttcctatgtgtgtactgaaggaagcctgcaggcaggaaaaggttgtttctccttagtgtgtggaggatttgacagagcaggtccagaagtgccaggacaggttgtcaggcttggaccttctgctctgtgctcatcagcttcatgcttcataaacagacatccctagattcatttggtgagcctggtggacccaggctggacaaagatgggataagaggacatctcctgccctggagctcagctgccagctgttttcctcctaagctgctgcccatgagctgactttcttcctcctacacctgaatcagaacttacctgtcccacctggtaaaaatctgctcattatttgcctgagtgacagctccttgccttggcccaggcactgaggtcttcctaagatctggccctgcccttgccaagaagcgcatcgccactgcacaactccgacaggagcaccagggaccatgaaaaagagggagctctgggctgggttggcaggtgagatggggtggggagagctccccagctgctctctgaggacagccacgtccctggccttgctctgtgggagcctctgagccagccaccctggaaaccttggtgctaccagtgccatgtcagtgggggctgcccggaccgagaatctggggctcaggacactcagccctgggcagcactgacagacctgtcctcatggtgcatggcaacaggggctcattcagatgatgagggccactggcccgtgccccctggtgacaatggccaggcaggagagctggcaagtgccagggcagccaagagtcacagaggaaaacagccgtcatagtgccaaggatagtgaagcttggtttccccatcaccccttcatctcatctgcaccaagtgtaatcactcagccctacttcacaatccctctacaaggaataggacggaatgaactacactccatccacagagggaaacatggaggttcagtcacctacagaaagtcacctagagactctgcctcagggttctccctgccttctgccccacaccccaccagatcatcatcatcctcgtcctcctgatcatcaacaccattgtcatcaccatttattaagtgcctgattttgtgtggagcatgcattgttacatcatttcatcctcactacaactctgtgaagcaggtatatttatccccagtttacaaagggagaaactgaggacccaagaagttattaacttgtctaaagccacacagctccctggagtaagagagaggctgtacagcccaggatgtcactccctgcacagcacaaccactcaggagagaggggcgggagggaggaaaggctggcgggatggtctctcctccataacatgccaccaagcccaagacaaaggtctgctgctggcaagggtgaccgtgtggcctggagggagggcagagagtggacagcgctgggggaaagccctgcagaagcatgctaatctgcacccctcctctccacccacggagccttttcctccaggccagcctgttccacaggaaaaacaatctcccctgcctggggacgtgaggccctggggccggctgggccaccttctggtctgtcttcattcagatcccatttctctcctctctggaagctgggggagggagtcacgctggggaaggcgaggatgaggctaaagtcttcatctgtccccctttaagccaagcaaagaaaaatagccctttgccaagatctttcatctcagtcatttactctcgcagatgttttctgcaatataaacaagaagcaaagaatgttggggaggagaagagggcgggaggcgggtaggagggaaaggaggagtgaattgacagctttgaaatctgggcctgcagagggcaggaaacaggaccttgggagggtcccgactgccctgagagcctgggcaacctcaggacactgcaccggggcaagccaagggtcgcttcccagggtgtctttgaaaggagattctggagaggcagcccagcccttgagtgggtggtctccccagacgccctccctctgcctgggaagcgacacatggacggcagctgctggggccctatgggcccaatctggagccatgccctgccagggaacacacctgcccaccttagcactccccaaaagttctggggcaaggacgctcagcctgctgccaatggaggcatcagtaggactgacaagagatgctgacacctgcaatgggcattagggtgcatgcgggggaaagaatcttgagctggtgggggttggcacctcctacagtgggtcaagaaataaaccaaggaaatcaggtgtctctgagttcactgttctgtgagattcctattgatgtcagtagcttttaaacgaataagccatggattacgaactcaaatgccaatgggggctggcagtaacccacaggagcaaagccaggtgagcactgccctgacttgaagaaggctggcccatctaaagggggcaccaccactcagtttcagctgggtatttaagacagcctagaaatccagagttctgtataaagtatcctgtttttaaaaatatttgcactaattaaaaacaaaaagcagaaaaataccgggctggacacgtgagacgtgctgctgagtagcttttagtttgtgaatcgtggatttgagatttttgcaaaatatgctggttgaatgaataaatgcttagtctttctgctcttcactttaaaaagggatttgtgagaagcttggataagaatccaatagcaagcttttattgggcatctactatctccccaaaatggagctaaacattctgatggattcagagaatcagaggacctggtcttgcccttgaggatttacactgtagttgggagaccgaatcagctcctggtgcagagcctgggcagacacggggttccagagcatgcggcaacagacactgctcctgccctcagggagctactgttctgatctgtctcctgttctgtaaagtgggaacacacaggaaatgagaccagtccttgacagtccttggttatgcggcacagaatgtttaggggaaggggagaaactaggcaatgctcccagagggggcggtgtttgggctgaaccttgaaagatgggtaggaagagccacttgtttccagctgataagtgaattctgaaactggccgacttctcacccagccaaaacattgagaactctgcaggatcaaaacccaggaccaccaaaatgagggagtcctgcttgctaagaaagagtggctgtcccacatctgccatcaacatgtcaccaaatcgcgtatagtgtctccaggggaaagtcccctagagccttcaggggaaagtcagtgaatgggtggcttgagcggagctgcagccacagaggaaggccagccatttaggaagcagtgacaggcaggcctgatgtcagcaacctttttgaaaggaaagagggggacagatttcacacaagggcccttgagggtttctgagtatccgtggtttcccgtgaatgactatagttttgtgctccttgcaaggaaaggaacggaaagggaaccaactctgagattcccacatattccacaaacacactgcagaacaggagaaattattcccgctttacagaacaggagacagaccagagcagtaagcctcctgagggcaggaaccatgtctgttgctgttgctgcacgcgctggaatccctggtgcctgccaggggtctgcaccaggggttgatgatgccaaatgtgacttgtttgagatcttacagccagaagtggcccgggggaaattcaatcccagatctgccagaccccaaagccctggttccttctgtgatgctggggaaatctgcatctccatagattcccaaaggtcacttaaaggagaatgctggatgctccaaagtttgaaaactatgagcggatgcactccatcatgggttggtatgcccaaggaagtgttagcatgaagggggcgtggcatgcaaacatattcatgtggccaggcattggaattcaacagagatcctttgagacaacacgccctccttttcatgcccggtagaggtctcttctccaacagccctgggtgcgaacatctctaagggaagccaactcaccacctcacgtcccactctgactgccagcaggttgtgctctaggctggcccagttagccatcacccagtggtctttgtactctctttctgtcctccaccaacaaggctcttcaacatgactaccttccagacacttgagaacctctcttttatttgccagctctcttatttatctcttctgcttttccttcacacattctcgtgtgacacactctcagtcccctcccccatccccatggctgtcagcaaatgcgatccattgcattttgcttctcctttaaaagcagtgcagtggcattccaagtgggacagaccagtaaagaggccagcaggagaaatacctccctcatcttcaacactcttcttcagttaatgtcacctaagatgacaccaattttcttggtaactgttcaggttgattcacgtcgactttacagtcaacacacacccctgagtctttcacacctgccccatcccgggcatgtataaaattccatttgtttagccccaaggttccagatgtacattaatcctattatatttcatcttgttacattcagccaccatgaatccaaactgttttgggatcttaggagattctaattctgttatccaagatgtcagctgcctctgaaagttcttcctagtctctaatagaactgttgaaacagaacggtcatgggagattctgggacacggatggaaccacccagcaggctgacatccatctgtttgttagcagctttagggccactcagcacatccccagctgtcccagtgacactgtctccagccctccttgttctcaagagagccatgagctgtctgctctgctgcctaccacaatgccatgtgctaccaacttaggaatcctgtctcctccctccaaaaaagtacagtgagtagtcatcttttttcttggtaaatccatgctgattcctaacgatcatcactttctttcctaagccttcataagccatccctttccttgtagatgagagaaattaaccctgagttcaaagcagaagccttcagacagctgtacgtgttaattcattatgctgggcatctccatttgcccctccacagccaccccatcctcctccccactgctctgtaccccaggaagctgaccttgtggaccgcattactgggcacccttgccctctggcttcagttgggttctgccagtgggaggcaccagcaagagacaggagggtggggccaggcgtggtgggtcacccctgtaatcccagcactgtgggaagccaaggtgggtggatcacctgaggtccggagtttgagaccagcctggccaacatggtgaaattctatctctactaaaaatacaaaaaattagctaggcgtggtggtgcgcacctataatcccagctactcaggaggctgaggcaggagagttgcttgaaaccagcagggttgaggttgcagtgagttgagatctagccactgtgctccagcctgggtgacagagtgagactccatctcaaaaacaaagagagagagagagagagagagagatgggtgggacaaggtcaagatatttatttatcctcctggttctactgtaatgggcccttgcttggctgtgtctctccactgcccctgtatctaaggccatagcccctgatgaatggctctctcctccagatactttctctttcacttcgccccctttacccttcaggctccccccgctgctagccctggagggcttcatctttccttgttagcttcctttagctttacgcataacttgtaagtagtgacatttctaaattctgctcaattaccccatttgagtgtgccgtctgtctcctgccagaacgctgaccaatacactcatattttgagtcattgcctaaagacttaggcctaacagtgctagacgtgggagggagtgtaggtgttggtgagaatagcataagagttaaaggcacggaatttgtggtctaactaaccaggattgaacttgatttccaccgctttccagctatagttactgaacttctctgagcctctgctttctcttctgtaaaatgggagcagtagtcccctctcacaaattctttgtcaggattttatgtgattatatttgtgaaacattaaatttagcatcaggtgcattataagcacttgataaatgtgttattctgattattattaagacagactctaaccattgagggtattgctttggtgctagaatacgctagcaataagcttcaaggttttcctgtttatgtccaccagggaatttggacctcaggtaatctgcccaaatcctgcccaaacaggagtaagaaaaaataagcattgttgttgctgttattttattagctagagaggcagtcaattctatcacttattgtcaacataattttttagcaaagactactctaggaggctgtagttacattctttctgacacctttcccctatctcttttctacataatcttagagtcccccaaccaccaaggatgattcctactgattcaaactaagaaaatgtggcaccttttaacctctgcccttacagagcttctccccaccacatccacccccgcccacaatgatattcttaccaaaataagctcagaagagagtctcttaactttgtccaaaagctaaatctgaaagaggttaaaggttctctggtcagtcgcatttcacccgactatttttagctgatatagggcaaaacaagtttccccaaagatctgggccctgtgaaagctggaatttctgccaagatggaggaatacagctctccctgctggaaaagagagcacaattccctctttcctcaccccgggatacctatttgctgccagtgaatctcccacctactctgtcatgctagcatttgatcacattgggttcatatgtgcttatttgctgctccaaccccaatccttactcctgagcctttaccactcaactatcaatgtgtccactcatcctctgggccatcttgtgccctcttatcctctatctcctgggtcagaagcttggcagttttctggatgtgactcctaatggaaatccatgacaaaaatgccctggattctcaaccagggagagaaactcctcttctcagcctcttctgccaatgtgccccactcctatttctctctcctgagagccctaagccctgccatgttccttctgtcctttcagcccctttcttcccctactcacataatgcaccaagggtaagcatcttcctgcccagatatatctgccctttcacatactcccatgtgactctttgacctctgttgttggaatctcttgacttagaaaaccagagatgtttccatgacttttaaggcttttgttggcaagacagcaaggagaatggagtgaggggccaagctcaggctttctgcctggccccggagggcaatgccatgggaaggtgacctcgtcacaggcctgggggctatcccagtgggatgacgccattgggtactctatctcaggctcctctgttgctctgcccttcaggcaggatattgagttttaagttaaaagacaaggatcgagcttcatcttatgatttatggtttaggccagggtttccaaaactgtataaaaagttattcctggccaagttccctattagtcatatgtgtgaagtggaaacatcactttatcagaaatatacttcccccaacccatcccaaactgtgtctataatcaggctctggagggaagacactggtattagagctggtgtcaggagaagaactcaagggaagacgctttactaataggactgtatggccctggcagtggtgattataccaaacacatatggaaagggatcatggggcagccaaaagaatgatgaaaacttcacattggtactgcccctagaggtgcttttccacgaatggctagattatgaatgtttaagctttcttatttaagtgaccttactccatcagcacccgtccactctcttctggtacccatgcccctgtttcttggggaatcccacaccatgccctgctctcagtccatgagatttcagtgcagccaactttacccccaactcagggtgaagcacaggacccaggcctaagccaatcagagcattagattctcttgggcatagtgattggtttaggaatggacatctgatcaatcagagccaatgagataccttaaggtcttccctaggacttctgggaaggggactcactctttcccccttgaacctgaaatctgagaggtatagagctggaattgctgtcatttttctgtcacatgaaacctgactctgaagccagcatagcagagagtagagctgagagatttttctgtcacatgaaacctgactctgaagccagcatagcagagaggagagctgagagatggagagtacccaagtcctgataacacattattttatccctgaatcaatttatatctgatgctggccctaattctggatctttttgttgcatgggccattggatttcccctttgctaaagcagtttgagatgactttctgtccctggcaaccaaagagccgtagtttacagctattgtttaaaaatacattcctaagtgtaaatggaactaagagaaaggagacagggccagcaatagatctgtactttgcaagcacaatctattgctcaggggcacagacagaggcatatcacatacttaaatgtgaggagagcagtactgggaggtcctcagacaggaagagggtgaaccccaggcaggaagttccatcagcaagcatcatgtctttggaaatgaaattattaaacaaccagaccatttctattgagtttcgtttttgttacacccctcttggtatgcttaacatagtaataagtattactgctatagtgaaactcccttatttatatcatcacaatttctatttccctattatttactcccttttcctatgaaataataaaaatatttactcatcatgaaattactttctctaatttaatctgcttttcccccagtgtattataaaggttctccagagaaacagaaccaacaggatctccctctatatatagagatagattagatatggatatacatatgtagatgtggacagaagtgatgtctgcctctttcagggttggccttttaaagcaactcagcaaccctccagctctctcttccctgatgacagcaatcctgaagtcacgtgtttcaggtgacataaccactgagatgcaggggtttatttgccacagcagcataacctttcacattctgactaatgtagatgtatctagagagatgtagctatagacgagatggagagagatggatttaagggaattgacgtatgtgacggcggtggagggaggtggcaaatctgaaattttgcaggaagttaggtggactggagagcaagtaagagttgatgcttcagccttgagtccaaaggctggaaactcagacagaatttctgaaactcaggcagaatttctgttgcagtctggaggcagaattccttcttcttcaggaaacctcagcctttgctcttcaggccttcaactgattaatgaagtccacacctattttggcagtttctctgctttgcttaaagtcagctggttgtaaatgttgactttattgtaaatcaaatataaaaactaccttcacagaaacatctagacaagtatttgaccaaatagctgggcaccatagcctagccaagttgacacataaaattaaccattacatccagctggagccaatattcccccatgctcctccatatattagtgagggttcagctttggattcccaggccaacactaaggtagacactgcaaataatgaacccttgacaaagctctgttagttcccagatggaagaaaattaatgatgattgctcaattcagtctggacagaatgctttactatttctgttgtggttaaagtatgtaagtcagctcttatttattatatctccattggtttacttttcactgtttgaggaattctcctcccagctaccatgccagaaaaacacttacaccctgccccgtggatccccaaaaactaaggatgtatccacagacctaactgaaggcagatcagccttcagtaaggtaactccagcaggagaaagcattttccccgttgtgaggcctgtgggagatcctcatctgaggcagatgtaaagaagcacttccctggcctgggtctgctgggaaacaagtgattaccaatccttgtgctgtccatgaaagggcctcacccctggctgctgagggtctgggaaatatctgcttcaatgaatacccaggtgctcatttttcttctccccagttacctgctaaaggctccatcttgacatcaaccctggggtcaccctccaggatacttcctcgaagcagccacattcctgggggcatctgtgccagcaggggatggtgggatggcaaatcagcaagttctgtcagtcctcagcaccactctgtccacagcctcatgagagttttgtctgaggaccttcattaggcttcagggcctgtggctgatgactccaggtcaaagccccagatgatacctgctcatcgaaaaccacgcattccactccacttcccggcctcccctgccgttaggtggaggccatatgactagatcctggccaaacggatgtggacagagtcatgtcagccactttcaaggcttgtctttaaaagcatcacagcagccctccagctctgtctgtgatggcagcaatcttgaagccacatttcaggtggcataaccattgagacatggggatctatttgtcactacagcagtagccattcccattctgactaaggtagagcataaaggaattatgatccatggctcccctctgccgcccgagtcatctcacagatggcgggctgttctcctgcacccccaggcacgctgatccgtgacatctctcccaatcgctggttaaatgacctcagacacctgctgtgctgaaggtgacaagtcaggggcagcatctgcatgtctgaagcagctcaggatcttctctgtgcccaaatccccaagaaaagtctaaaactggtaaagtaattgaaccaagatgggttttcccgaaagaccttttacagctttgagctcattaaggaaagaaagaggatttcaagacctaaacagtgctggattctttctattttagttgaagttgaaaagacgatatctttgctagagtccagaaagagtcttacctgttgaaaactcatgcaacttaaagttccttcatcacggagagcctaccaggcctgccacgtggcatgacccatggatgtgggtgggactgcttggtattttcagactgttggaaacagtggcctcttgatctcagagagagccaaattaagctgatttcactatttataatccctccggaaataagcaaagaagagaagtctaattgcaaacagactgaactttacataggaaatatgtaggccccctgaggcacctagaaagtgtctaaagccctaactgcctccctgcctcccctgcttccctctccagagcacgtaggccacatctagagaggcctgaggctgcagaatggccctggactggccaaaccagcccagccagccccttgggcctaggggcagggacttttggatgagaaacaggaagacatttgcccacagcttgaaccatggctttgggaagactctttgttctttcttccccattattttgggttttctggtctttattccgtgcttgtcaaattccaggcatgcaaggctttcaaacacactatcaaacccgccacttacacacacacacacacacacacacacacacacactccccacccccattgcattcccatcacaatcacatttgtagcagagccctgggatttgtaaccaagtggggcccagtaagagctttgtgaaatttcacatggcccctggccttctgtaacaactccagagctaaagccccagccagaaccctgggccttgctggcagctgtgctgccgggtcactgtgggagatgagacaaggacctgcgacctgctgtgcctcagtttccctgcctgtcagtttggacaaccatgactgcagctaattctgaattgtctgcctgctggtgggaccaggccctggtggggggctcagattaatggcacggaagtcccagaatgagtcaaagaagagagagaccaaaatagatcaggagccaagcgcccagaatggcagccagagaagattagacacgctgccgagagaaccgtcccgatgactttattgagggctcttgctcataaacagccactatgttattgtaacttccacagaccaggccgacccttccttgtgacgggaagtttgggattggaaccgtccgtgggccctgctgttgctgaggtcaccctgggagctggggctcttccaaaaggaaatcagcatggggctccggggcttggtggaacagtggacagatggatggtttttgagtgagaaagtcatggttaggagtcagggaagagtggcaagtgccccccggcccacccctctgcagttcagctggtgggactaagtctttctttatgggcatttctgctgaaaagtccttcctcccttacatttgcttcttggtctcatgaatccaaggagagggcactaggccagggtgacagatgtggaaaaagcccagaactgctgccatagttcccatccctgggagcctccagtccccagccatgcccagcaatggcttttcctctcacatcctgacccctcacatcctctgtctcattgcacagcccttgccctcctggccacttgctacttttaatcctcctctcatgtggagagcagccctggcaggtccatccactctcatcttccactggagtgcttcaggcaacaatggaaaaacttaagtttgccagcaaagtggtcgaaggccagaacttgtccatttgaagatagagacacaaatatctcatttcagtaccaaagaccctttctttcttatcactgccagctctccaccacccatccatctcctgctcatctctgctggaaatgctactagccaaggcgagccaagccaaacagctgtttgtgggctcacagaccctccaaggataagggtctcttctgtgatgaccagattgcaccctgatgccagccagctcctggcgtctgctgctggcccccccaagatggtagcctggggagatacagcccaaacgcctgatccagtctcttcccagtctagctctgttggcaaaatgaaactccctgccaagggaaagccagtttggactgtccaaggggcacccatgataactgggcaaaccatccatcctgggttggtccgtgtgctttgagacttacactaggtgggccagttgaggaaggagataggaggaagaagtccaaggcaaatgtcagatttttagacaagccactgctggcaacatgtttttatttggaaaatattgcacaggaacttacagtgaaaaagaagctttcaaagccctacataatgtaaccctatcctaccacatctccagtttgctgtaccatgccctcccctatgtggattcaccttggccagacatacaaacccaccccctatcctcctccatccctgctctttgtccttgctcattccattccctttgcttgaaatatctgtctagactgtgcccatcttctaagtggtccagcttcaactctgctctctcccccaacaccccgcctccgacaacctctggggagcatggagttaacattgcccctcctgtgctcactgcattttttgcctaccatagacagtttaattattgaaaaccgccttgtatgttctgtttcagatatgttggctttaatgaatctgtgtgtcccctaaccttgtctcagaattccttatatgccccaaggatgcctccacagtgctctgaacactgtagggccttaggaaatactgatggctttgactggttatcaaaaaaaaaaaatgtaagtgatcaaaaagatgcataaccaggaagaactataatgttcagcaaaaactgcgagagtggttccaggtgctgccttcttggggtcagtggtataatgggttttcctttccagacagtcccttgatagtcctagaatcccacaggacagttgggtggacagtgtccagcaggcaaacaagaccataaacgcaaagccagagaagctaaacaatgttcactttacaactccaggtgatgataatggtatttatagactcagtgacatgtttgaagctgtgagtcccagaggctaatattttaagctggatatcctgagacccagacgttctgtttttgttctcctccccatccttccctcctgtaacccctggaactttccatgcaatctggacaaaagcatgaaacctctattgtttctcaatccttactagtgctagggaaggatttaagaactgcttcatggaagggtgacttgtgatgagtggaaaacattctgaggccttaaaatgacatttgccattacaccaaaacttccatcagagaatttcaaaattctaggcagagacaagggcctttctgccgtcagagaactccaatggtaaaggagctggggtttggaagagtgaggccttatttatagatgaactcatcttggccagaggttctggagagtctaggtccacctatttaagaactttctttctctcaggtccatttttatattggataatcattcctgaggcaaatctataaacaaagggtgggaacctaaaacttggctagttatatagcccagaataaaatggggaaatcagtgttttccttcaaagcaatctagaaagcactagccaaagaacaaattgcaaacagctacacaagcatcagggaaatcccatcgatcataagagatggaaaataaccatgagatcattgcactcatctcccctggggcctggacatccaggatgcagcttcatggtgtcccttcagagggtgttacaggcattacctttctcttgctttgcactgtgaatcgtgctcctgattagtctgcaatacatccccctgaagacaggcagcaaccacagaacacagtacctcatgcataggaattaagtccagaacattctctactaggtgggttttttgctgtttgtaaacaactctagatgttcatccacagttcactcaactgtgctgactggtttcatgcactagccagaattggtcaaacttaaacatgcacaaaatcctgtagtcactttaggcccaagtccaacatttagaagctatcaacacaggaaaaaagttgtacctgttttcacgctgagaaaagcagatagctaatctgtaccaggaaaacaaacaagaaaaatgatctgaaaataacttggaaggttttgttttcaccaaaggaagcataaatagtgaaacacatacacataagacatgcatgtacacacatatatatacatgcacacacatacacacattgtatgcacacatatacataaacacacatacataaacacactgtacacacaaatatatacatgcacacacatacacacacatactgtatgcaaacatgtatacatgcacacacgtacacatactgtatgcacacatatatacatgtacacacatgcacatactgtacacacatgtatgtacacacatatgtacgcgcacacacatacacatacatatgtacacacatatgtatgcacacacatacacatactgtacatacacatatgtacatgcacacacacacgtacacatactgtgcacacacatatgtatacatgcacacacatacacatactgtgcacacacatatgtatatgtgcacacacatacacatactgtacacacatctatacatgcacacgcatacacatactgtacacacatatatatacatccacacacgtacacatacacatactatatgcacacatatatacatgtacacacatacacatactgtacatacacatatgtacatgcacactcatacatgtacacatactgtgcacacacatgtatacatgcacacacatactgtacacacacatatgtatatgtgcacacacacacatactgtacacacacatctatacatgcacacacatacacatactgtacacacatatatatacatccacacatgtacacatacacatactgtatgcacacatatatacatccacacacatatacacataaacacacatactgtacacaggtatacgcacacttgcatatatatacatgcatacacacatacacacacatatacaatactgtacacacatatatacacacatactgtatacacatatacatcacatacacacatatacatacatatatacgtgtacacacatatgtatacacacgtacacactatatacacatatatgcacacatttacgtatatacttacatatacacacgtgttttcctcctaattacaaaaataaatacagaaaaacactactagaaaacaacatgttattgtgttccttccagaatttttctatgagtagtcacctgtattctaatgtatcatacatattatatgttacattatgtatcgtataatatataaatgaggaggtatatagaagtctttttagatatatttaatgaatatatattttaattaaaattttatataacatataatgttaccaattttatttttttatttctatcctaaggtaacatactggttgtagaaagtcagaaaatgtgtatgagtaaaagaaaaagtgaaaatcatgcatattctcagcattcagaaaagagtactttcatttgttgtatgcccccctcacttatttaaatatacacccctaagtataaaatgggaagtcccattacacaggggtatgtgtgtaatggggcatatgttccataagtagaccaggggtatcaccaatgagcgtcttaaaccactgttccctctttcccttgtaaggcatgccatgctatggtttcccagccacagacccacttctccctgtggaaggggacgccacctggacgatgggccgctgctcagccttgggggtccatgctaaccctcttgagttgctagaggctttgtggaaagacttctaaattttaaaatcttcctttaaagtgccaagtcagatggtctgataatgggactttaccataagccatagttcagaaaagacagtcgacagcctaataaaacttcccctcagatagcaagggaaagtagacagctctgcccagcctggaggagaagcaaaggagagagaggacaaaggtagcaggtagacaagcaaggcctctcctgcctccctttcttgggatgattatctcagggactagggtgtcagtaacaaacacagggagttggggaggggtctaaaacaatctgggttagggctctgcttttctgagacatagtttgaggagaatccaagtctcctgaacttatctggcacagatccaacatggtgccacaggatggtttaggaatgacagagggaagtgactcagtgtccaggcaaatgggcatgagacggccctcctattctcacagcttgcttaggcatctaggatatgcctgattcctttttggcccccaacacagtaacacaaagtgctaagagaaggcctggggttgaacaggccacagttcttctcaaccttccattctaagtcaaaggagaagaaatacagctaatacactcactttccaatgctgttcaattccatttgatggagttcccacctgccttgaggaataaactgtccttcaagtttaattcattctattccattgtggtacacacatcagattaaggtagatactgggggactccagagatggggacaattccacagacactgtgccattgccttgggccttcagagctccgagagggttagcccaggcattgttctctcatcctatttctaatggtctttatcttctccctgctcctccagcccagccacatcctcttctcaatcctccatctccacctgcttcattcaacctctcttccatcccctgcttctgtgagccttggagtgcttatggcagtagtcaacctagggcagatagggccaggccttgaggctatggtgagaaagtcagaaaaatggaactagaatgataattggggtggaacatgaataataatacctactatcattattactattatttcacttataatgattcttactatgtgccaggcactggtttaagcattttacatgtatagtatgagctcatacacttgtgttaactcatataattaactcaactcaaacgcatgagttcatactgcatatgttacagcctatggggtaagtgcaactatgatcccactttagagacgaggaaacctaggcacagagaggttaaagtgccttgccctgggtcattcagctggtacatggaagctagaaccccaccacagcaagctggctgtagaccctcatagtaagccacatttggggacaccaagcaagctagaccaaggcaagtggctgcatttggtttgggaatgcaagctgacccacggaggtcccagaggatcagaaacaatccataataacttttaggagatttgctagaaggcagggagtttagagtgtctgtggctcctgctttgtagttctggaaactaaagccggggagttagggctacgtgacatgcctgcagttgcaagaagtagctgcaagagagtggaatttgcatctgcactgcacactaggtggggcagagccaacgttcaggaaggtgtacatgtctacacctgcacaggcgcttctggaggaggcaggtgtggcaagccccctgctgaggaatccagccagggaaggcatcctttgtcttgctctggtggctttcaagcaaagagcccagtgtgttttgcaggcgtccattcatgagcttagctcctgagctgcactgactggatgacgggcgtccccgcccaggagccagagactgtgtctccacatgcaggcagggccagcgtgaggtcaggattaaccagagaagctgtgctcttcttgcagcgccacactaggctgggcggggggcctgctgaagtgactggtccttggaagcacaaagcgtggagctcccacagccaaaggccccagaggttcatcatgaggggcttgtgaggggagccagctatgctcccccctgtcatagatgaggaaactgaggctcaaaattaaagctggaaaatgatttctggaacctcaaatcaagtctactgtcccctattccaggtctatcttcccatataccatgctgttttgggtacctatgccatttaaaatatcaagcagaatggggacttcttgagcctaaatcaggctcaccctggggaacaagttcagaggaccccatcagtatccagggcagaatattcatttgcccagtgatggatgcatttgggccccgcttggaggcgggagagattccttgcgcaccctgctattgcactgctgctccggcccgggcctcttcacattggacataacattttcatacgtgctccctccagtatgtagtgtctcttctcttccaagcccctctcctttagatgcccactgaaaacccatctcctgtaatgaaaccacaactatcttcctggaagtaaaattacatcacctcacccgtttgcccttttgctcctccttggttctaaaccctgtagttctcaactcagggtatcttgtgaaaccttgtgtcctttattcttgggcatggcttcagcgtgggtgtcctcccccgtatatactgtcttacgtgttgaggcatgtttgtggttattttgcccaagggaagacaccatccgtgtagtaaggcattggcgtcattccagtggcttctggatctagctagggccatgatggtgtcagtccccatgctacagccaggtcctcttgggtaggtgttactgctgtaggcctctttgcagggccccattgcaggctgataagatgccatccgagtacacagaggtcttctgcaggctggcctttttcccagctcttccagctgtgtttttccccctacccaaatgctccagctccacctccacctccatagtgccatgaatactggctccctttcccgtgccaggctccgtgctaagcattcgccatgctttatctcgttaacctgcactacaactttaagaggtggatatttttatccacattttacagataaggaatatgagactcagagataaaataacttgcccaaggttacatagctaataaatggcggggcctggatttgaaccaccacgttcttaaccgctgagctccaccacctcgttcagtccatgtcggctggtccatggcccatcctcagagacgcctgtttttgcagtgaacaccccctcaagtctttgacaacacccttacctcctcggtttacccttgtgtgccctgagccaaatctgaacctgttgagcttgatcaaagaatgaattgttatttgaaagagaaaacaaaaggtgaggatgactcactttacgctcttctttgagccactatttattgagagctttctgtgtctctagcactgttctaggtctcacattaaataaaaacccctgccctcacagagattacagtctagtgaattaatagcatgcctagtgctgacaagctgtaagaagaaaggcccatccagaaggaggagtgagggccctgggaagtaggggggtggctgcctccctgccctggcagctgagggatgacctgaggcctcagcttttcatggggatgggtcttgttccaaggcagagagtgctggtgaggccgtgagggtttcaggggcacagaggtctccaagccttctcatttctgctggtggtgatatggagccctaggtctaggcagaggcagtccatctggaactctagcttctgtggcatgaaatggccttgttgaacatgatagtgtatacagattatctccaattatcagtgagtgaaggagccctttacgaaattttaattcttcccctgcccagatgctccagctccacctccaccttcacaggaatcataaccagatttcctcttctgacccacctcttcccttctcccttctccctcctccctgcccctgcccccaccccctcaaattggtctggcctaaggccatgcagagtaattaacctaaacccaacaaatataattagaaaagtaaatatgttagccaaagcagtcttatactatatttcaaaatcaaatgtaagtaatgtaagtacacggtgggaggtgcaaaggcttcccgagcaccaggtcctttgcacctatcatctccttaaactaaccctcactgcaaacttatgatctaggctttatcctccccattttgtaagtttaaacaaacaaacaaacaaacaaacaaacaaaaaaccccaggcttaaaaaggtaaagtaacattaccaacattacataaatgtcaaggttgagtttttaaccaaagtatgtctgacccacaagtctgtggtagttctgttcccatctagtcccagggcagccatttatgcagaaacagtaaccttgggcaaactactttaccttccactgcctcagtttcccatctgtaaaatgggcccaatgctgatagctaactttcccctcaacctcagttctgttctggtgatcacatgaactggtgtctaggaaaggccacagaactttcaggtactgtgaaaatacagtattaatcctacccttgaatttagaagtgattatggcttttccaccatttaaccttgttggtatccagttcagcatatctggtttatttttcacattcctgttctgagggtagtctctggctgctgactgtaaaatctgtgttgctctctctccaggaattagcatctcctcttccacagctgtacttcagctgtacctcaggcccctgattgccaagttgtaggtgttctataacgttctttcttctggaatcccaagcgagtagtccatatgcacttctttccagtagtgtgctggtaaatgtttaacagctgggtttccaattgtgaatctgatgtgaatgttggttaataattacatctacaataataagtaagataaaagtgaaacaacaaagacgcattttggaacttcactggttttttttccatatgagccacttttttgctgaatcaggtaatcgttttcaaaaactagaaaaatattacctcaatatattatgtgattcacaatgtcactgctacagacacggcacacttttacgtctaatcttactgtattaacattttctctagcacttccataagtctagataatcaacacaacaataaatcaagccctgagtatagagtgtgccaatttctgtggtgtaaatattctcaccacggccaatttcaagctaccaatgtgatgttactgactgtggaattgggaagagagtcagtagtatactacgctacagtcttcccaccatatgtgtaataaacataactcaagcacatagatgatagtaaactgtagtttaaaaaaattaggatctgatctgttgttagtatttattacctttttaaaatataattaattatatgtttatatcatttaatttttaacaatggctgtgttccacagccagcttgcaaaattcctgaaaatttaccaatcagctttcacaagccaatgcaagcttcagcacaccaccgtcccgttcctcttcccgttagcccagatgggtcccatgctatctgatggccacaccctttgttaaatagctccagttagtcctgatccacgcaaatcaagagaacattagtcaatgcccagtttctccaaataaacaacgtcaacagcttcagtccagtggagtgacttaatgatctgtttccttcaataaactgtgatttctgaactcaattcagatacctgagcgtcgcagtaagctgagagtgaggcccagaggcgttcataatgtaatatactaagtttaaacttggcaagcagatgacattgtgagaaatggctttttttaggccgattttgggagtttggggtgtttttttaagagttaagccaaggcaaaaaaataacccttgcaacacatcacttcacagctggtcagcccaggagaggctattctgggatattcaagctaaagaacctctttttaaactccaggcaaactggaatcaggatgcagggtttttatttttgtctgtcatggatttactctgtccagtaatcctgtacagtaatctctgtccagtttgttccctgggtgggcctcagtttaccttctggagaagtcaagtcagctgcctttacctagggcattattcgatttttgaattgtggagactgaaaaaagatagttgctagggtttatcagagggtttggagtgtctactcgaggtgttccaaatcagcggagagtcagagaggggtgaagttgaagtaggatcttataagaaatgacaaatgaacaagatgtaagagagaggaggaggaagaggaataggaaggtgaaggaggaacaagggcctccaagcaacgtaccatgaaaacatcgggcaagtggctaaactgtgcgtccagtgttcactttgctaagacggagagtgagggcataagatgatttagttacagaagaaaaggcaggcaagatggagcaggcaggtgccttttgtctgggtttgacaagagagtttcctgggtagggaaggaatgtgatcaaagttatgattctaagacctgcctggaagatgaccagggagtgggcaaacttggaagcaaaaccagcctcccaaacacctgtgtaatatcgtgtcctgggccactgtataaataacctccctcctgttcatcagtaggctttgtagttctcagcctctctcctctgttgaaagtgtgagccagccctttgcatgaagaagcattagaagggatcactgcatacttctttaattgtcaagaatgcatacatgccatgcatatgaaagatatagtggactttggggactggggagtggagcaggttgggagtggggtgagggataaaagattacaccttgggcaccgtgtacactgcttgggtgatgggagcatcaaaatcgcagaaatcaccactgaagaacttatccatgtaaccaaaaaccactcgtacccccaaaaatattaacattaaaaaaaagaattcccaccgtgccttaaacttatgtcatctcactttttttttgtcagcagcctagagggaaggggacacaatcccaattttaacaccaaagcaactgagacctacagatattaaattacttgctccagattacaactgagactcaaacccatcgcctggccacaagtctggtgccctatctacaccaatctgtctccggtaaacctaactagctagtcaacttttcccatccataggccagacaccttttgaaataacaaaccatctgatctctagaaaaactgaaaggccagttccagttgtcagacacaccaagctcgagagagtctctcccaaaagttctctggaaagcccagggattccgaattccaaagccagccaaatttgaatttcctctataaagagatagtccctcctggtttagaacataaccttcctcattaggctggttccatgttttgtaataacttttgcttacaccacaaaattgtcatagattacgaaaacacaaaggccttggaaaaaaggcccagagccccctggaagtcattatttcttcctttagcaattgctgagttaagcaccataaatatggttcccatcctgctccccttcccccgccctccccgccccccacgatcagctggacatatgttaggaagaaagcagggacgtgggggtggaagaagattcgcatgtcgtgaatcttgagcactgaaaagaaaaagtggggagagggcggggagtttgcagccctggaaatggaatctctgaaggatttattgcctttgagtatctcacaaggcttttttttttttaataaaaatctgtagcttatggcttttttttttttttttttttgtatagggcagtaaacaagagctctgaaaggggaaggaagccaggagaaagccagctccattagtcacgcagcagcatatcctgtcacaaaggaccccagttgagtaatcgcccaaaatatgcctgttatttttttctgtcagaaaaaaaatggggcctgccaaaacgtactgtaaaaaaaaaaaaaatctggtgtcttaggcccagagagggaaaagaaaataaagaagaaagagtcataatttcacagtgctcttcaaaccctctccccagcttacctggaaaagaaaaagccttcagactcttcaccacgacagagcctgccaggcttgaagaaagctacagccttgggatggtccagttctcagagtcttcatagttacttggtgccaagagcttaaaaagaggaggggtggtcggggaaagttgaaggaggacagcacggggggagagaaaaaatgaacagaaagggacccaggatattgaacaagtcctttgacgagctttaaatgggtgaggcattgctcatagggaacccgcaggagcccacaccagttccatgagtattgcatgagcccagcaggggctagtgacttccagccaatggccgagcctgcttcgtaagcttttctgatggccccagcaaaaccagcactgtctcaggcctccaccatgccctgtgggtgtttgggccacagactggacaacaaggacttgtgcagaaggacatcggactctggagaggtctgaaacaaggggtggggagagacaggctggtcagagctgcctgcaacctcccgtattctcctggattggccttccaaaacccgggctgacaggctcttggtaggaaaacaggcccagcaaacaaaggtgttctcaagcccagttcagtcactgcctctgtcccatgctcttagtctcatggctctcaggagcaggacacaagagacggttatgcccaagcacagaacactcttggaaagccatcctttcccttctgctgacattctgaccccctcaagggttgtccatggggaacaggctttctgcacccaattgaccaaaaaataacagaagccttctccttaagaaagagagcaggccagacacagtggctcacgcctataatcccagtgctttgggaggctgaggtgggagaattgcttgagcccaggagttcaagaccagcctgggcaacacaatgagacctcgtctctacaaaaaaacttaaaaattagccaggcatggtctcagctactcaggaagctgaggtgggaggattgcttgagcccaggaggctgaggctgcagtgagccgtgatcatgccactgcactccaacctggacaataaagcaaaagatcctgcctcaaaaaagaagaaagagaacagagccctacagagaaggaagaaggcaggcacattgtcacttttgctctcaagctccctggatctctcctagaggagagacccccaaacctgcctgcactccgcaggagctgactgggggaggaccctttccagggacacctccctggaggtgctctaatatttggctgcttggccattctgggccaagaagactccttccctagcccaggaccattagtctccctgatgattgctgcagaaaggcccaattttcagggccctacctagcccttcaatacctttgagccacccatcttgtctgagccagagtcctaaagccagtcctgagcttcaagacccatgcttgccctggccactgcttcccctgggagagctgcctggcttcctgcagagagctggcctgcaagttggaagggcatattctcctcccggctccctggctaaattgctatagaatttcaggtcactcaagtgaactttctgtgactattttttcctcccttcaagatttatcaactattaattggagcctctagatgcctgcaatgtggaggtcctgagaattcaatacagaataatacaaatgcagttcttcctgtgaagcctggacaacctttcccttccttccttccttctttccttccttccttccttccttccttccttccttccttctttcttgagtttcctgatgccagctcctcagatggtgagccagcggtgggaaggtagtggtgggggtgattataaatacaataagaaataaacccacacactgcaaaactccatgttaatactattaatagtatttccaaattgcatacaggtagaagacagttccttagcaacatgatcgtaatgagaattccacaagggcatctggaatttactctgtcagacattccagcttatcaggaaatgaaaaggaccaagactatcatataatgtgcaaactatgctaatgcctatcactagtgtatatcagaccccagttacaggactgacccatgggactccccttgtctcagctttaatcacatgaagtacctgaggcctgttgtcctcctcggggctcaatgccttcttgcggccaggtccttcgtataattcaagagttgaaatcactgtcaacacagccctttgactaatgttccggggtgacaggcctggcacgtgaacacatgagtgatgctattatcccccaaatcacaggtgagtgaggtctctggagatgtccacccccacatgaatttccctttgtggtagcagtaacatctgagtcactaagcatggggccacaatttaggctcactccctccccttcctgtgccccaaaagggggctgaaggcgggtcctcacagcagaaaaagctccacttcctccgagctccagacagcacatctcagctgtgttgggccttacaaggctgcggtcaacaggcacccaggtgatgaggtctttctcagcctgttgttctcttgttagccctttgatgtttcaaagctgacgaggtcagcatcttccaggctgcaggaaacatgcctgccaggtatacctttcaagcagctgattaatatgtcatgtggtctctggtcagaggagagtgtaagggctgttgaaatgactcaccagctcagctcccgtgtctttgggaaacgctaccctgtcagcaagaggcctccagctgaaaagtaaagacacagatctgaaagggtacagttctagcgtccaacaaactattatacatcctaaatgaagtgagaaatggtaggctcttcacctgccagggcctggcggggcctgtgtcccaggactgcttaggaatccaagcctcgcactgtttatccattatactgatgagaagcctgtgagacagggaggcttgctgggcctccaaagtccacttgctggcttgttacttggcaccatcagatctacgctagggatggtgtaactagagcctttgagtgcatgaaaagtctgtggcctgacaaagcacttactgaccaaggaaaatcaacttcaggtgcagcaggaaaggtctggtacccagaatgtctggggttttgagacactggaaaagattgcctaataatgtcatgggctcccttccctggaaataatctgaaaataggataagttccctccaatcttggatgggtcaacctcgtcttgaggtaaggagacggttacatcaacccatggagagggcctgtcagcaactctgagtctattagagggtatattttcaaacacaaaaaactttttatcctggtaaaatatacctaacgtaaaagctaccattttacccatgtttaagtgtacaattcagtggcattaagtacattcacatcgttgtataagcttccccgtcatctctctccagaactttttcatctttccaaactgaaactctgtgcccattaaacactgactcctctttcccctcctcacagcccctggcaactaccattctccttttcatctttatgattttgactactctaagtaccttgcatacgtggagtcacgcagggttcttgtgtgacgggcttgtttcacttagcacaatgtcctcaagtttcatccatgttgtagcatgtgtcaaaatttcattcctcttgaaggctgaatactattccattgtgtgtgcatgtgcaggtgcatgtgtgtgtgtgcgtgtgcaggtgcatgcgtgcgtgtgtgtgtgtgtgtgtgcatgtagcacgttttgttcatccattcatctgtgatggacacttggttgtttccgccttttggctattgtggataatgctgccgtggacttgggggtacaaatatctgtccctcctttcaatactatatccagaagtggaactgcacaaagaaaactttaaagacaaaagcattgtgcccccagaagaaggcatgtcgatgtcctcacatcatgatttcatatggagaagaaacacctaaaaaaagttgggcgggaggccgagatgggtggatcacaaggtcaggagatcgagaccatcccggctaacgcagtgaaaccccgtctctattaaaaatacaaaaaaattagccgggcgtggtggcgggcgcctgtagtcccagctactcgggaggctgaggcaggagaatggcgtgaacctgggaggcggagcttgcagtgagccgagatctcgccactgcactccagcctgggcgacagagcgagactccatctcaacaacaacaaaaaagaacgttgggctacagtaagacttggtaagagggaccaaggaagcatggaagaaggagctggttggttcccagagcaaccagagaaggcttcacagagatgaaattggagctggattctgatgggtaagtaggagtttgcctggtagaaaaaaaaatagagaagggcaggaaaagaaacagcccttttcaaaaaagaggagaccaaacattgcatgcacatatcctttgactcggcaattgcactggcaggaattctgctgttatcctcacacacatacggctccaggcatatgtctaaggatcctcatagcagcaatgtctgcaagacttagtcactgggagtggcctgtggtccctcactaggacactgctgaaataaactatggtacagccataccgtgaattcccacacaaccattaaaaagaatgaaggagggccaggtgcggtggctcatgcctgtaatcccagcactctgggaggccgagcgggtgaatcacctgaggtcaggcgtttgagacgagcctggccaacatgatgaaaccccgtttttactaaaaatacaaaaaattagccgggtatggtggcaggcgcctgtagtcccagctactggggaggctgaggcaggagaatcacttgaaccctggagacggaggttgccatgagcagagagagcgccattgacctccagcctgggtgacaagagtgagactctgtctcaagaaaaaaaaaaaaaaaaagcaaagaatagaggcgatctccatgtgctgatatgacaagaattccagacttatttttaattaaaaaaagaagatgtcactgtatgcccaagttatttccctggaaggaaagaacacacaagaaactcttaatagtcattacctttgacaggagcaactgtaacttgaggggagagaaattaaattttcgtgttatgctttctaatgtgtatgtattgcgtttaaaaacaaagttaacaaagctgccaggttgatgagattacggtccacttttacattctttgtgctttttctaatttaaaatatttttttaaagaaaagcagctatttttctggaattgtttagtcccaatggctcctaaaggcagagagatgagatgtttacagggccatcctttcggagtttctcttacagcttcgcaaggattcctttcaagacagaatggtatcctcatctcctcgagagaaaagttttggggccaaacaagaattcggccaaaagctcggggccaggcatgtgtggtgccagggcagtgcgggggttcccacaatgtctgtccaactgtcctggggacaggacccctcttctgcacttttctgtacccctcgtggggactacgtctctgggacaaaaacccagctacacagggttaacccctgcgttttgcttcgctgagcatggctgaggaggagggggtgcggtgagagcagagggggctccatcccgccccagctccaggcagcattaataaaatgcaggtgttttgtgtatgtatagctgcttgagggaggagggagaaagagccttgactgcagcagcgcatagaaacaagagccgagtgcagtagaggaaaatgtgcctgcaagtaatgagaaagcattttgcaaagacagccttggctttagggttgagaagaatgcagcagtttctggcacaggcctaccctgtagctccccctgggtgtgtgtgtatgtgtgcgtgtgtgtgtgtgtgtgtatctggacacaggatcctatgcatgcatgtgcacatacacacaccccaccaccaccacagatttttttcccagcaacatctcacacaacctaagtttgaccctcacttgctttgaccaggagttggttctgacactcccttccctccctgccaaccgccctccatcttttctctcctgtcttcctctctgtggaccccacaccctgcaattcctcctttcccccatcacttccttctctctggggccttgggttgacggtatctccccttggccagcccctttttcgtaatgccacttggctctgctttcaagcaggcaccttgtgaacccgactcccaccctcctttccaaagcccacctcccttgcagtcgggaatggagctcaggaggttggccagcccctgctgctttagcttgatgacgtgctccagcactgtggaggttcaaagtgaggggggagtaaagcacagagcaagccccctcctcctggccaccccaagggcaggagagcaaggaggaggcatcagagatgactgcaaagtgggcagcagatctgagggccactgggccctgctgagggtcctctgtccccacctccccacatcccccagggaggtgggaagtgacagccccccaacttctagagggtcgccctccattacgccaagttaaagaagcctaaaagcaagtgatttctgtgatttctttagtttgcctccttgcctgagacctgctgaggagtgcagttgtaggtgagttgttctgacaccggaaaggcttcaggagaccagggtggacccctgaggccctgctcggtcccaggcaggccagggtctgagtggaagtcacaagtggaggagctcctccagaggacatgggctcctgattccatgaggagggggtagggagaggtgctggggggctcaggaagcacccctgtcccaggctaccaagctgatcctgagtgtttgtgtctgaaaccactgagccagaacccatgccaggcaaaggccagcccaacagcatagtaaatatgttccccggaatttagcactcctgagtcagaggggagcaggggctggcaaggaccctctcctctggcctgtctgaaatgggaggaccaagctctagagaatcaagtttttactttctcaactcctatcctctactccctacctgcctccccattcctctgcaaataaaagacagagcaggggtggacaggcagcagcccaaccatcccgccactcatccgctcatccctgcccgcagctcacaggctggctggcagcagctgtgtcaggaggcaggacccacattcggaaactctgaggaatctccttggagagtagttactggggccgcttgtcccagaccccgaattggaacaccgtctctgacaactccaagactgggacttgtcacttgcgggaataacagtgggaaccaccctggaaaatccaggatgcagggtccccttactagcacaaagcagccttggggcccctgtgcccccacacccagcccttcctcccttctgggagcggaacgcgggagaaagccttgcatcctcagtggccccccaccctctgaaaggcatgtagtggcctcaaggccttattcccccctccactctgttatatggagcctatgaggagcagatgtttctaatgaagggcccaggccagggctctggaggtaacaggcccgccatagagcgctggctcccatggaggggccgcagcccccagacctctgaaagcacaagccgcccagtgaatgggacacacactctcttgaattctcagctcctttcaggaaattgccaagttagcccttggctttctcctttccagtgcccgccccgtttccatggcaaccgcctccccatcttccagagcctctctccggtcctgcccgccccctcctctccaccaccctccgcgtctcatctgtctgggtgggaaccgggattagagttcatcgggccgggatgcttttcccagggccgctttgccttcgtgatccctttgcggcagcccggcccctgccccgggcttttcaagtcccccagacttaatgaccagccctgggtttcctcctcttctctttctctgcctccaataaagccggagaattaacccaggttttaagtgccccggttccaagctgaatatcaaagggggcttccccaagctgcttctgcatttcaaaggggctgatttatcactttcacttaaaccggcacattttggggaaagagttttacccagaggtcaaactctggaaaaacaaatggatccccgttcaccccctcctggggtgctgtgggctattagtgtataaactgctggcgggtaggtgggaaacaggctacccgcactcctcatcagcctgggcccaaactgttcctgtgcccccggggcgattgtgaggaagagggggaaatgcatggaaccatggctgagaagctcccacactgctcctcctggtctctgtgcctggcaccgggcaagtcgtcagctctgtttctgcttcctgggcctcttgtggaggccctaacctgaacctgcattaacacttccaagctaagggtgctccctgccccagggactctgccccttcaatacagccagggcctgtgagtccagattctgccttttcttccattctgcctgcgaagcttttgcaggcacttactattcaggggctgcagagctgggcccctgagccaccctcactccccagctctctcctgccctcacagtcaggccttgtccatacccttctttcccacattccctccccacaaaacatgcacacacacattcacccaccctctcccagacccctgccgccgcccccagtctccctctcatccaacctcaacccaataaattatctctattattgccccttcctcaaggacttcctcatacccccacaaagaatgctggaaccccggaccctggaaacttttctccctctctgtgaagcatctgtctagctgcccccaagcagactccagcctcactgcagagcgtgaggtccttcgtctgatttagcccagatctgattgattcccaggctttctcaggcattaacccccaaggagagatgtgcacatctctccttgaagtgaccagaaaagccaggagccagcagccaatgaagcaatccttggaagaggccaggcagacagcacagcgttatcgaggaacttcttacttagcacgaaggggcaaaagcgggcgaggcagcaccccaaagccagcttccagagaggacatcctgaatgaggtcttgagaggcaccaatcacaaggcaggttttcccttaatggacacatctgtttccttttcttaccctgccaccagctcattcattctttcacacattcattcactcctaggaccatttactgagtgcctatctcgtgtcaggggcattagagagtaaggctactgttgattacagtgcaatgagataaaccctctctcccgtaaagtggccggcaacattcatggtctttgcctaaccctctccatggggatccgggaaatactctagacagggggatttgattccagcttgaaaagatgggcaggagtttagctgagagaaatatattccaggcagagtgagcagcaggtccagaggcacccaagcccaccataggtggtgacgataggcagatatgtctggcacataggaatgtggagggaggtgctaggagatgagcctggaagggcatgtgaatgacgttgtgaatggcaggccaggaaacccaccacctctgccatgtcacccaagttcaaccccaacaagatcaaagtcgtatacctgaggtgcacgagtggggaagtcagtactacatctgctctggttcctaagatcagccccctgggtctgtctccaaaaaaggccaatgaggacatcaccaagacaagtgactggaagggccagaggatcccagtgaaactgacggtgcagaacacacaggccagattcaagtggcatcttctgcctctgcagtgatcatgaaagcccttgaggaaccaccaagagacagaaacaagcagaaaaacattaagtacagtggaaatatcatttgtggtgagatcatcaacattgcccaacagatgcagcactgatctttagccagagaactctctggaatcattaaagagatcgtgaggactgcctagtctgtgggctgtagtgttgatggcgccaccctcacgacatcacagatggctttgatagtggtgcgggtggagtggccagctagttaagggctacatatagaaatatttcaataaaggatcatttgacgaccaaaaaaaatttaaagagagaactgtactgaagaaggtggggaatgacagagggagccagtcagggcccgggaacaagagcaagtcaaagactgtgttctagcactcgtccgcctgctgaacctcatcacgagcttctttgctgcatgtgctcagattctgtctctgtttaccctttccacctggggaagcacggagctcattgactcttccgcaggagcccttgctgaagaaatcatttgtcattctatctatccgcttagattagctgggaggttcagtagaacctgcaagcttctctctccctggagggaggcaagggacacaggggaactttgggacaactacacagggcctggcaatatttgcagacaaggggatgggagggagcaggggtggcaagagtgccagcaatgctcccagggccccacaccagccacaatgcagcctttggaattttagagaaggagctcccaggggagagttggactagagtttcagagtctctctcagtgcccacattttgtgatgccactgctgatgctccaaagcagagatgcccatccagttgcatttttaagctgctgcaatgcagtaaacttccctggccaagccttggcaaaccgtctgtagcaggactcccatttcttccaggctgtccgcagagcagattttcctaggcatgggactttgaaagccacagaaggaaatggaagacaaaagaaagagcagagcaggggagccaatggtcccctgagtcttcatgtttatgaggctacttgggacctaggagttcaataacctgccatccacacatttcacacaatacaattgactccgtgcaatagatgtgttcccagaagctgtctgggaacagctaaaatttgagtaataattttatgtggtgttttcatacaatttggataatctggataattgttacatatcgtggtttggcttaaagccagggttacccctaacaataacagaagtgttgactgcttggggcctggcacctcccacttggacctgcggtttgtgaaaggctcctcctaggtcttggccccctacttgtcttccctggagtcttctgtcctggtaactgctccagagtcatcctcacagcgtcttcctccacaccctctgttgagcacccaaagctcaggatgtgccacaggaagcagggagagaagacgccaccctgccttcaaggagctcccctgggagctgggtctccccagatgcatttctggggatgtctgtgaagcccatagctgggcagcccagaccgccccacacaggaggcgctgggctcaccagctaagggtgggagctccacctggtcagatcttgctccaggtcacttttaagattgcagtgcaggcactgggcactggcctgcccgaagcctgccttatccagggactcatttcctggctttgcttctcctctacccagcttatgagaggagtgctaggagagggagggaaaacagaaatctaaacttgctcaggggtcctattttgtatcttccctctgagcttttttggtttcaaccaaagcatattccccctcttttctgtggactcaaaacccatgcccctcacttggaccgggccttcctcttcccgctttgtccaccagcctcaagtcccatgatagaatctcctggatagtgtttctttaactgggctcgagccccacagtaaagtcttggtcctccgccggccagagcccacatctctgattcagcaacaggggcaggtgttcagggcaatctgggttaggtccactgaaaaccaaaggaaataacattggtctgattcaaggccttcagaaatgagtcagcccccgagcccatcaaccatcactgttactcaacatcacacccacgttattcatgaagtattgtcttcagcttactagacaacagagccccaccagactctgggaggctgaggatgacttattggtctgctgtgggctcaacatcaagtacataccttacctctgtccaaaaactggagtggaagagcgctgagtcaggaaggctcatgccccgaggcgtcttcccacaagcctctggtcaccctgaacagtctgttctggatttcacaccttggaaaaaagtcctctatgagtacaatgagtggaaagagtcttagaggaagagttggggccaggtggccaggtatgtgcagcacctctgcccagccctccttggcccacagtcttaggctggtagcctgcatcctatgcaatagccaatgttactcttgtttttcattccttctaaatgatccaactgaggacctgccaagttgaagttggatgtgactttccttcctatggggtagagggggacttttctgggtgtagtgggaaaacactgtggccaaacacatgactctggagtcccagaggcttggactcaaagttccaaccctgccatgtaccagctcagcaagtgacttatcctctctcagcctgtttcctctttgataaaatggggataataacactgtccatctgtaagactgttgtgagttttcaatgtcatagtgcacataaatgcctggcacctcgtgagtgctccctcaacggccctgccagtgttgttgccactgttattattattttagttagtaccactctcactaccattctccctaggccggagtcttctttcacatgagacccttgtcttcctgattctggtatcctcagcacacaggcacagtcgggtgcagtgagtggtagtccaacataacttctgaaggggaggagccccagagagagggaatggcatgttcaaaggtcctgcggtgggaaggtgcatggaaaatttgaagaaaatggtatagaaaaaagtccaatcattagctacaggcccccagcagctgctttagccaatcctccaacctcctcattggcatggcaagaccacagaagcctggagccctgatacctactccagccctctgctcctctcactgaccaggaaacttcccttaagacagaagccctaaggtcatctgaaccccagaagacccaaggaagcagaaatataccaaatgaagatcctgaggcctttgtgtttagttaccataaaaaaataagtccccaaacctggctatttgtacttggcattggataattcgaaggtgattgaggaaggtactggggaaggaagcccaggcaggggctgtggttgccaggtggggagggaagactttgcaaactaacccaaaagcaagcatggggtgcgtgcctgtcttccatgtagttcctaaccccctgcccccaacacgcccatgatgcatgggagcagcccagtgccaccaaccacactgaaggcttatcctccactccatcccgctcttctccaacctcctagaaaactgtctctgttcccatccttcctctgcaagagcctccctcaacttaagctattagccctcccaggagcacttgcatttaataaaaacgaggaccttaacacttcacaggaggggcttattaatggttccctttctggcttttggaaactgcagggagcaaggtttctgtagcagttggctgagccctcagggatgggaagacagggtctgatgaggcagaatgccagttagggaccaggcccaaggtgggtctccccaactctgtcttatgccctataacctagctaccctctgttggtggtggtggcggtgttggtggtggtggtcaggtttgttgaaattaagtgtacatacaatgaaattcatccattttaaaatacagttctttgagttttagcaaatgcatgcagttgtgtaaccatcaccacaatcaagatacagaacagttccatcaccccctaaaattctgcagggcttcattatagtcaaccccttcccccagccctagccattgaaaactgctcatcaggtattttgacccattagttttgccttttccaaaaggccatataaatggaatcataaggggcatagcacggaatctgccttctttcatttagcctaatgcacttgagattcgtccatgctacctgtatcagaagttcgttttcattaaccccgttaaatagtgggcaaaggacatgaacagacacttctcaagagaagacatgcatgtggccaacaagcatatgaaaaaaagctcaacatcactggtcattagagaaatgcaaatcaaaaccacagtgagataccatctcatgcccatcagaacagcaattattaaaaagtcaaaaacaacagattctggcaaggttgtgaagaaaaaggaacgcttttacactgttggtgggagtgtaaattagttcaaccattgtggaagacagtgtggcaatttttcaaagacctagaggcaggaatatcatttgacccaggaatgccattactgggtatatacccaaaaagaatataaatcattctattgtaaagacacatgcacatgtatgttcattgcagcactattcacaatagcaaggacaaggaattaacctaaatgcccatcgatgatagataaagaaaatgtgatacatatacaccgtggaattctatgcagtcattaaaaaggaacaagatcacatcctttgcagttacatgaatgaagctggaagccattttcctcagcaaactaacacaggaacagaaaaccaaacactgcatgttctcacttataagtgggaacagaacagtgagaacacatggacacatcagggggaacaacatacactggggtctgtcagaggtggagttgggggagggagagcatcaggaagaatagctaatagatgctgggcttcatacctaggtgatgggatgatctgtgcagcaaaccaccatggcacatggtttgttgttgttgttgtcattgttgttttgagacggagtctcactctattgcttaggctggagtgcagtggcgtgatctcagctcactgcaacctctgccacctgggttcaagtgattctcctgcttcaacctcccgagtagctgggattacacgtgcctgccactgtgcctggctaatttttgtatttttagtagagacgggtttcaccatcttggccaggctggtcttgaactcctgacctcatgatccacccgcctcagcctcccaaagggctgggattacaggcgtgagccaccgcgcccagcccatggcacacgtttacctgtgtaacaaacctgcacatcctacacatgtactcctgaacttgaaataaaagttgaagaaaaaaagaagttcgtttttggccaggcacggtggctcatgcttgtaatcccagcacttcgggaggctgaagcgggcagattgcctgaggtcaatggttcaagaccagtctggccaacatggtgaaaccccatctctactaaaaatacaaaaatattagccggatgcggtggcgtgtgcctgtaatcacagctacttggaagactaaggcaggggaattgcttgaaccagggaggtggaggttgcagtgagcagagatcgcgccactgcactgcagcctgggcgacagagtgagactctgtctcagataaaaagaagaagttcgtttccattgataagtagtgttacagtacatagatgtgtaacagtttattcattcagtaatagaaggacatttgagttgttcccagttctgggccaccatgaataaagccactataaatatttgtccacaggtttttttgtggacagaagtttgtatttctccagttaaataccttaaagttatattcctcacttatataataagtatatgcttaacttcatatcaaactgccaaattgttttccaaagtggctgttctgttttgcattctcaccagcatgtctgagagttccagttgctccacatcccccgccccagtacttaatattgtcagttttgtgttttgaatgtttttttttattttatccattccaaaataataatagtggtttctcattatgatttaaatttagtgattaattatgttaaacaccttttatgtgtttatttgctattcatatttcttttctggtgaagtatatgttcaagtattctgccattttttaaaaaatggattgtttgttttcttcttactgagttttgagaatttttaatatattctagacacaagtcctctgtcagatacagattttgcaatattcctcccagtctgcatagaagatttgtcttcttactttgttatcagtgccattctaaaaacagaaggttttaattttgatgaaatccaatttataaatttttcttttctggattgtgttttcaatgtcatatccaagaaatctttgcctaatccaaatcagaaagattttctcctgttttcttctttcatgcttttaggctttttcttttgtactttcacttatgtttctgtatttcacattttaacattttacatttaggtctatgatccattttgagttataggtcaacattcaatcttttttcctctctctcctcttttctttcttttctttttttctttttttgcatggatgtgtagatgctctagcatcattttttaaagagactatctgccatgctctgaatgtatccccacaaaattcatatgttgaaacttcattgccagtgtgatagtattaagacttatggcctaggccaggcacagtggctcatgcctataatcccagcactttgggaggccaaggcaagtggatcatttgagaccagcctggccaacatggtgaaacccctatctctaacaaaaaatacaaaaattagccgggcatagtagtacacacctgtaatcccagcaacttgggaggctgaggcgggagaatcacttgaacccaggaagtggaggttgcagtgagctgagatcgtgccactgcactccagcctgggcaacagagtgacactctatctcaaataaataaataaataaataaataaataaataaataaataaataaaagagttagggcctttaggaggtgattaactcatgagaacagagccctcacagatgggattagcacccttacaacagaggtgtgagggagctgttggtccctgttgccatgtgaggatgcatcaagaggcaccatcttggaagcagacaacagcccttaccagacaccgaatccaccagtgccttgatcttggacttcccagcctccagaaccatgagaaaataaatcactgtttttataaatgacccagtctcaggtattttgttacagcagcaggaacaaactaagaccccatctgtctccagtgaattccctctgtactttgtcagaaatcaactgactatgcatgtgtatttctgcggtctccattcggttcttctgttacaaatgtgtatcctttcaccaattccactgccttgttcactctagctttatggtaactcttgaaaccaggtagtgcgtgtccacctggtctcactgttgtcagcccctgctctatgaggctctcctctttcctgtggtctttcaggccgggcggcagaggctggacaaagctcagggccctagcatggccttgcaggcccttatgatgcaaacctcaccagctcatcttctgtcacacctgcctcctaggaatactgatgtgctgatagttctctgcttttgtctagcaccatcaggcctccaagcttttgcctgccctgtcacctctgcctggaaggccccgtctttgggccccgcaccacccctttttctcttcctggttagcttggatcattcttcaaggttctaaaaaatagatgcctcatgagagacatccaggggaacccatatgaccttctcaaaagtgtccttacccaggcaatatagtacagtggccagagagcagacctggaaaccagctgcccaggcctgaactcagaatgtcagaacccactactatcactactactagggcaagttacttcccttctctgagcctcagtttcgcatctataaaacagacatcatcaaagtatctcttttttggggtgtggtagggattaaatgagtcaatatatgtataaataaatacatgtacttaaacataaacttactataaatgaatataatagagacccaataaacttgggttgttatcattttttttttttaagacaaagtctcactctatcgcccaggctggagtgcagtggcgcgaacttggctctgcctcccgggttcacgcaattctcctgcctcagcctcctgagtagctgggactacaggcacctgccaccacgcctggctaattttttgtatttttagtagagacggggtttcactgtgttagccaggatggtctccatctcctgacctcatgatctgtccgccttggcctcccaaagtgctgggattacaagggtgagccactgcgcccagccgggttgttatcattatttaaggattgagaccccttttgatgtttgctgctgtcaagaaaatatgtgagcacagcttcttcccccactttgttaccgccccacacacactcaggcaggggtcaaggccacctgagcagctagatgcagccactgaggccccagcccccattgtagagctgctgcttctaggagccacatgccagggagcaagcagcagtcagcactggaaacaggctaccccagcctcagtctccgtgggtaccactcaggtgcccagcactgcgggaatccctgcctgaggcagcctgggctgggagttcacaccttgatgccccagggtccttggatagtgatgtgtcagtaacacttcaagcaaccagacgagctgctctgcagggaagaagcccacttgcaagggagctggacattcccccagccctgggaaacacagtcctgcttgctcttgaggttgggtccccatgagaagggggtcaagaaaggaccaagagcatcacgggttttttctagagcagaggagagcccttaaagcaaagagactatctgtacacgagagccactgaagtgcagaaggaaggccaggggaggggcatggaggcagagacaggggttcaagccccagctccccttcactgtgtgagttatttaatttcctgagctttaggctcctcctctctcctaagaggatagcgccacctcccttaaggggtacctgtggctgtatggagcaatgggagagcaaagaggaaaccctggtgcatccagccttccttcagagacggaagccacaggcccagccaggagatctacccagggtggaccagcacatttctgggagtccaagtcaatgcagacagagggctctctagggaacaaagaactgagaagaggaaaaccacctctggctcttggtgagcctgccaacctcctgcagcccctcatagcccaggacccctggaggtgagcctgactctcagccctggcactggagaaactcactcttccttgccctattggtccccatttcctttttccttgggcccctcttcttctagcctgggcagagctgaggaggacagtgggggttcaggccgccgccaggctggggagctccctgcagggctgggagaataggatggacagcgttttgccagagcctcatgggaagcttcctttcaggcagctgaacccatttcaggggtagggagcactgatcaggggttgggacattgccccgggaggaggatgaggatgtttccaggcctcggctgactcatggtagtgagtattagtcactccctcacaagaatcagcccacatcctctagtagcctcttgtctcccagaggcccctgccccatgtttacctgcctgaagctcctctcccggccgcccccacccacatccgcacagtttgggcagacacaagagccccgcatcacttttcactcgaggctcctctgagacatcagcttcctgcaggagaaatcttcagggggtttctcttacagatttgggggtcaaagactgggttccaatcgcagcactgctgccttgtatctctgcttcctgggcaaattatgtcaccaatccggactgttggggatattttccccgaagagtaataataatattatctagtaggattgttgtgacaatgaaatcatataaagtgtgaaagttcctggcacaaaataagtgatcgatgcatggtaatgaacactattattatacatcaataaaagaaaaaaggtcccttatatatagcattttaaaaataaggtaacaaaacccttggccccttggccctgtgaaactgtgggctgacatggaacaaaataaaagcaagtagagggccaggtgtgctgcctcacacctgtaatcccagcattttgggaggctgaggtgggaggatcattggagttgaggagttggagaccagcccaggcaacatagcaagactctgtctctgcaaacaattaaaaactgagcttggtgtggtggtgcacacctgcgtctgtggtcccagctgctcggggctctgaggtaggaggatcacttgagcccaggagttcgaggctacggtaagccctgatcgcgccattgcactccagcttgggtgacagagcaaaactccatctctatttataaaaaaattaggagatggggggagcaggtaaaagatttcctctattttcatccaatatcccctggctgtagaaactgccccgcagcccccactggggaggtcaggacagcagtgagcagtgagaccccggacactccagggaactgtggctccgcaggaggagcccggaaggggcggagaggccacagatgtggcttgaggataaccatccactcaggtgagggaagcccacttgagcccacctctcaaacataaggcccccatccctgctggccccatcccttctcaccgaagcacggtttctctgcctcagcactgctgacactttggacaagttattttttgttaaggggctgtcctggccattgtaggatggcgagcagcgtcctcagcctctacacactagatatctgtagcactccttccccctgccagttgtgacaaccaaagatttctctggaccttgccaaatgtctcgccctacacccccaccatgaagaaccactgctgtggacggtaggctggtcccttggtctccccaccttcatcccccacctctcctgggccttctccccacctcacccgagcctcaggcctggctgaggtgtctcccccaacacacactagaggaggcagtgccaaccagccactgcatctcaggaaggccgcctggcccagttgctgggaatcagaacggagaggctggctctgcaagccaggacagtgctgagtcagggagcgatcagtggaggagtctggagggtgaaggaggaatcagtgcctcagagaggagccaggaaaggcggagtaaggctgagacaaggccacaggtggtggtgtgtgaatcctgacctgggcactttctgcttggtcagacagtgacctggggatgccaccgggagctgaaaggttgctcagagccctagtggcatggcgctgcctcccagcaaccctgaaaagttcaggcccaggctcagccccaagaattcaggagccccaggctggatcaggaaggtgacagggactgagttcagagtctcgtgtggatctggggcctcgggcatcaagctctcagtgcagtgggttacataagtgctctctctccagcaaagaaagagaagagagccctgagaaggaggcatcaaaggaggaaactggcaagcttcacaggggaggaggctttggagccagttttgtcagatgacaaggagttcaccagacagagaggcaggtggaggaagggcattcctgggaaagggcgctcacagtccacgtacaggcaaaaggtgcccaaagaacaaggaaaggtcagcaggtccacttggctgcttcagaaaccctggttcagcccttgagtgacggggagtgagggtgaagtgggtctgtttcccatgggaaagtggctggctggcagcgtgagaataaatggccagttcacgtaatgtctcccttccccattctccccatcaatgaagttcaggtcaccttgatgcaaggtcagcgtgtgccggggtgagctagctagccatagttcctgcaggaaacctaagcccaagtatgccttggccttggtcagtttctcagggaagacaccgaagctcccctgcctgcacagtgtcacttggtagcagtcgcttggcccaagacctgcggtcaggaggcctgcagtcatgtgtttgaaatagggtctgactgcacttgctcgccctgagtacccatcatcctgccggggggttaacattctcccttcccacaatgcactggtccactgggcccacacctttcctccaggtcaccctggaaagtcaccattgctgtaagcccagccctaattaaccctagggcagggagaagatcagatcaagcaagagtacccagagccaggccctggctggaggagactccgcccccctgccctgcccctgtgggtctgtcccgtcccacccagtcccaggaaagggctgggactgtttccatttccaacctgtctgggccgctcctttcttgcccaggtggctctgctgggaaagcctataacagctgagcgggcttttcaggattggcttgatgccagggccagggcgagggatgacctggccacatagcagtcatcgcctgtgctgctgaagtgcttttcttcagaggatctcaaaacgttttaccagaaacaggagttgtcccagctatgaaaggacacagaaaagaagggtcactcactaagctgctaacagctttggcagtagaagtcttcaaaagactggctccaagggaagtaaacaacagaatccaaggctaaaattgtatccttaataaatactatctgaagttaaaacaggagttcactatttatggaaatctacataaacctaataagcacagagtggtgaatgtgcgtgcgtgtgtgcgtgtgtgcgtgtgtgtgtgcattcagggagggagtggaatagaacaagatgtggcactcactctcttcctccctgtcccttcctgtggtcacacttctcagggtgcacctcacatgagagtattgcctctgggattctgtacccattgttgccttctcctcctctaggcccagcagggcccaggtctcccacttgtgaggagacagccactgtaagccatctgtcctcttgcaagatgagaccattcctttggaatgtccttctggtcaccttcctctcccactgccacagaccctcaccacctcatgctcagttcctcacacctactcattcgtgcactcttcctgccagtcttacgtgccatcaccagattcatcttcccaaaatcctgccaaaattagcccctcatccttgtccaaaggacattgtccagattcctgagcagaaccttcaagactcttccccagactgatcttccacctccggtcctccccagcatgaagtctcctcaagatatttcattgtctgcttgctagtcccacatgtgcctggagtcttccgccctttctgcccttccagatccttcccaccatccttaggaaccagccctgccaggaagccttcctatcacaaggccccttccaaagactgttactcaggagatcgtgttacctccttgggttcaaatccagaacttctccttctcgaaaggcctcattatcttacttcttatggacacactgcctgggttatgagctgtcttcccagataaattaggttgccagatttagcaaatagaaacaccagacttccagttaaacttgaatttcaaataaagaacaacaaaaaaatagtgttagtatatgccatgtaatatttggaacctacttatattaagaattgtttatctgaaacttgaatttaactggggatcctatatactctctggcaaccttacaaagaaagcataagcatggagctttccatctccctcaggctctgacactcagaggagttctcaggacctgtatcgttgattaattatttttttgatttagcaaagactccttggctttcatctgctcttggttccaagacccagagcctacttaaatccctttggtccacttgaatcatctgcaacaaacccataacaggccatctaagagaatatcttcctttagtacttcatgttctccttaaacattcatcctcgagacacgctagcagcagatgggtttcaggcaataaaacctcgagtgtttcttgctaaccaaaggaggaaggagttctggagccaggatgcttgatttcaaatcccaagtcaaccacatgtggtcctgaggcctcaagcaagagatttacatctctaggtctcaatttccccatctataaaccggcaatcatagcaggacctacctgacagattgctgtgataattaaatgagatagtacttggaaattggtgaatacatgactcttacatggaaagcactcaataaatggcacctgacattgtcagtgatttcctaagactgccagtggctgctggcatgggcacagtctccttttgggatctctttcgctagctgctcaccaaaatagtggtcatgtgtgaatctccataagcaacagagttatggcagagtcacagaggagggtcccctggtgaaggttctccgtggggaacccccatctctaggtgaggtaaagcaagacatacagggacttcctcaagagtatggtctgtccctaattctccaattaaactacaaatcattgtcctcccttttcaagttcacatctttaaaagactggtaagagctgctctccttgatgaagcgggtggccggtttcagacccaactggatgtggacagaggaaaagctaccactggccttcttgggactctctgggtgaacctcggggattcagtggagagagatcccttgcccagatcctcctgcatcctaccaaccgatcctcagcctctgaggccaccaggcggctcctgaacctcagcatgggtggggtgccttgggcttttcaaggagactcttggtcaattcaacaaaagttcaattgccaaaggaccaatttgctaaatggcaattctttgagttcatgaaattcacaaatttcataagaattatttgaatattctccataaatatctgtttcttaacagcaatttaaagaatattcaatttgtcaaaagctcagaggcctagaatggtttagttaccttataaatatgttctttttgaatatattttaatgtgtcattttaatgaaaatattttctttttcttatgaatatatttgtaagaaatatattcatgaaaatatatttaatcaaataagaatacattcctaatgcatagttactaacacattcaggcagaacacaatcagatgttcatggagaacatagtcattgaatatgtttcaaaaaatcattgtttcaaaacaaggttttgacctattggcaaattcaaagaactggtgaaatgactcctaagtaagttgactttcagagaattggctgcttctcatgagggaaaatcaatttctgcttcttgttgtcatctgtttacaatttgattctgagaacttctagaacagtggttctcaaacatgaacgtgcattaaaatcactgcaaagcttggctgaactgccaattcttggatgatgccccaaaggattctggttctaggtggggcagagcccaggaatcagcttgttgagtacaattccaaggtcactcagacaccaccagttcccacacctcactttgggagcaagttgagcgtaatgaagaaaatggttaatcatgagatgttgctataatattctaaggtaggatttttttccttctcttagtgtgcttgaaaattacatccagccttaacactaatattgtaagataatcaaattacctacatctcaccattctttttgtgtgtttgagacaggacctgtctgtatcacccaggctctgtatcacaagtatagctcactgcagcctcaaactcctggactcaagtgatcctcccacctcagcctccagagtagctacgactacaagctcacaccaccaatcccacctattttttgtagagacagatcttgctatatggcccaggccagtctcgagcttctggcctcaagtgatcctcttgccttggcttcccaatgtgctagattataggtgtgagccaccgtgcttggcacctatacctcattatcctaacataattatcttttgcaaacagccttcaacatgcatgccaactgattgccaaaggtacatactgatttatattctaccttttctgtttactatgatataagagacatcttccactatgtggcaaaggcattgtcattatcatttctaatgtttaaataatataccacacacagatttcctataacttgcacaattagtcctctaatattttatatcttctatgtgctgtatcatttccaatttttaagcacagtgaacatcttcaaacatgtaggttttttttgcttctgttgaataatttttatagaattcatttccagaactggaattagtggtgtggtaggaatctacagtggttccctacagtgagaacgcagtagaataaggaccaaagaccattcctgggatgacatgaaacatgaatattgtaatcccctattaagccactttcttgaagctctaggataaaggtcacagttggttttacagatcaatttaaggtcagatcattgaagaagttagacaagcaggggttatgagcttcttatagaatcatgattttaatgtagcatgtggggaagacctgagacactacaggtacttaatgtgttccagtatttgatgcataataaagatactgcacttagctcattaacagcctggcataattgaattgcatcattaaatcattaacactccttgccacaccacccaacatgtctgggaactatccagaggcgtcccattgagtcctaagaccttgggaagagtagagccaactcccccaattctcatcctgcccttccccagctgctccaccagtagaagagggaagtggaggtctggatgtaaggaagaccattagccaagtctcacctcctacctagggctgcagttgtgacagtgtgccgaggaaccacggaaaaccgggaggaaaaaaactggttgctctccagatgtgtaatgtgaggaagttattctgatctcgcttcctcgaagatgggatctttgtcttattgacacctcagtaggtgttccacaaatggttgtccacagagtgaatgaatggatggcctttgcctaggctcatactgataccccaggctgcctctccctgatgtattctgtagggggcactctcacttctgccttcgccgcagccaccactggagaagtaggcacctgtgtctccatcctgggcagcgctggtcttggctttacttatctcctggatctggtgttttgaacctgacaaaaggcaggcatgtgggtacattaaagcacaaacaatgtgcagtacgtttatttgctggatgaccattccagccattccaaagtcccacttgagtggggcattacaggaacatcctccgtctagaaatctgagccctggttcttcttcttcaactgtcttctctatctcattccaccctgcttgagttctcccgcctgactgtgcaagcagcctctcccttcagacctctacctcctcttctgagatccaactaccgcagctaggaagtccattgtaaacccagaaccaaggatgttttccttttccctgtttcctgcttttcaacaatgcacaaaacctctttgagcctcagactggactgcccaagacccacctcctacagcacctaaatcttcagctcttattctccagcaataagaaatcagttccatacacgttaagagctttggtcccgggcctcagaccagatcattggtcccatcaacctcagaccatatgttcacgtgaggacagcaggtgggaggccacctgccttcccccatctgcttgccctgcctgggatactgaaacacaggtaaaaagtggagaggcatcttcctgtcccagcccagctgctgagaggtgaactagagagggcggcctcgatccagtcggcccagattgaggcccagactcagacacctccgggttcccacgctcaggcagcaggcctgaagcagaactggtttcataatctcacctctgcccagtgctttttgcaaaatgatctgccatttggttcccacatcacaatcatactatttatctatgcaaaacagcacctcattaaaaaaggatgaaacacatcaccattggcccaacccctcattaaggtataacgcacaggccctaggcacacccagggtggaaccagcacccagactggccagggtgttaggcccatgtcactagctctgtccccaccctcaccccattcctcctaagtgagctgtgctgctcctcaaatctgtgtggtgagagatgacagagaaggagtcctttggaactgagagatgggttcacggggggagcccctcctccaagaggccttctcccctgaactattatctctacttaaacctcttcctcttgccttcagcccagcttctacaatgatatttgctgactactgacatatttttacctttgtttctcactagaacggaagggccctgagcagatgaaccgtattatgtttttcagggcctaaaccagtgtttggcacaccgtaggtgttcaggaaatacttgcaaaatgctcaatttaatttttgacttcatgataaggaattccatgattgtttttctgccagatggttcccctcccattctcactggagatacaccacccctttggttgtgttaagcaatgctttctacccttgacacccagggtctcaggaataaaagttgaaatgcttgcattttgaagaataatctcatgctttttgtattatctcaatgactttaatttactgtgcaacatttaggacatacagaaaagaaataagaaaaatatcacagccatgtactcaccacccaacttgaaaacacccaaagcatgatcactacaacagaagatcccaggcaattctgatgccaggcacctatccccctttctctccttcagaggaacctatatctcaaacgtgatgaccatctgaattttttacagttaattttttaatgtaatagatatgaggtttgccatcggtgtgtccttcaggctgaagtcagactgtgttctcaacccggcccggcccgcacaccgcacctgctctgtgccccagtttctctatctgtaaagtggtgataataatacccgtctcttccccacttctctgagtgtgcagatgagtgagataaatgtaaagtgcttggagcgtcaggagagagaggctttagacaaccccaagcaggtaagtagtgcaggaagcgccagcaggcctccaccatgggtttctcatggccgagaagggtgtgctgatctgctcacctgcctgcgccccgaccccggacaccagctcattcacaccagccagccagctccaccttccctctatgggtagcccttctttggtgcttctgggatcctggagctgagacagccagcagccccctctgaccgtagaggacccatttcagccacagaattggcaacctctcactgtgctgccttacggtccttcctctctcctttcctgtcattctgtgtgccagagttgtgctgtctacacagcaagctcctaagcaatggtggtgatcaggctatgtatactcccgaagaaatggggaagaaagggtcagcagccatgtctgaggctggtgtgaacgtgctgagtaaacaggccagcgagatctacaaagtttaagactccctgctcccaggaccaaaagagacaaacaaggttgaaaagcacaaactcaacatttttaaaaaccataaaatgagacaattcccacctaaggccatctctcatatattcacaccagagggcttcaagtgtgggaattgtgtcgggagaagcagagcaaaagctggctagccggtccacaaggctcgagatgggggatacgaaggtaggatggtcaatggacagaggccagaggcagaggctcatccaagacatcacttgactaaaccagtagagacctctgaagcagtacaacagtgtggtcaaagaaaatggcaagcttggtaggtaaaagagtttgctgacacagatgttatctacagtggagaagtcactgtcattagaaaatattcccccatttgctaaatgctttcagcactccagccggagaggcgattcagaacgctgatgttgcagataagtgcaaggatgggaggagctgcggctcccgtccttcaatctcaagaatcctgccaattccaagcacccacgctgtgtctacggttcaggacagccctggaggaagatggtgctcccagaaaaatcccaaagaggtggtccagaaagctggccaccaacaaggggcactgacaggagaactggaggcttggatctctgacctaggatgtcaggagctgccacagataagaactgagagagtcagggctggaaagcagggccattactgggaaacttccagtggaagagaaagaatcttgagagatggctgagggaattgagttctagacctagatctgtgtgaccttgagtcagtcatttcatctctctgggcctcagtttcctcatttgtaacatcgggggttgggttggattacgtctaaggttctatcacattaacatcctatggacagcatcagagaacagggaggggaccaacactggaatgtccctaaatgtaatgcattgggccaccaaagcagaacggagtgtagagttaaaactcatatttggagcccggtgcagtggctcacacctgtaatccctgtcccttgggaggtcaaggcaggaggatcacttgaggccaggagttcaagaccagcctgggcaacatagtgagaccctacctctagaaaaataaaaaaattatccgggtgtggtggtgcacacctgtaatcctagctacccagggagctgaggagggaggatcacttgagcccaggagtttgagtctgcagtgagctatgatttcatcactgcactttcagccgggcaacagagcaagaccttacctcaaaaatatattttaaaaataataataacttataaaggaacttgtatttgtcaagcatcagaacaagctgtaaagctttcctaaccctgcttcccacagccacacacagcatcctgacctccttgtcccatgatcagagtatgagccagtgggctccaagttggtcaacccaattctcagtccactacttgtgctagctgtgtgacttcaggcaaggcagttatctttttgccttgcctgtttcctcatctctaagaatcttcgcctcctccctgccccacgaggagggtgagagaattcactgagtaatgtccacttagcacttagcttgcaaggggggaagagtcccacataaatagaagatgacgagggttgttgtgacagctgtttgattccctgagctcttccccagcccttcctttgctgctgatggaaactaacctgttgtgagtcactattgtcttgttctcaaagttcagttcagagaattccccttgagcctgaggttcctatctagcctcactgccaaatgaggagacatcagagaacaaggctaagaaaatatgatgccaccacttccctaacacttgattccactttgctttttagccactatactgtacgcttcctaagggcggggacatctgggcaaccatgttgcacaactgcagggggcaccctctgccagcatttagttgacacccaataagcatttgttgaatgaatgacataaactgcctagctaatatttgggtgggaggaagaaaactaatatttttgaatatccaccatatgccaaaagcattttctattttattcattcctcttagcagtcttatggaatcaaaactattctcccaatttatggttgggtaaactgagactcaagaattaagtgatcaccaaggtctcatgcaatgtaagcggtagacaaagactttgaactcatgcctgtttcactggattccagtcacagtcccatgaatgtgggtaggggaaggaggcaaataccttaaaccaagataagctgagacactgttttcaacaagggtttttgctggaccaacagggtaatagtgccggaagggtatggcctgttagtaacagaaaggccccctcaaaccaggcctttaaatggtaagtgctggctgagaaaaagcccaagtttcaataggttctcaaacccttcaggagagccaagagaatctgggctgtcccttctcccttcctttatgcctattcttacctccactacctcaccatcgtcacacacatgcacacacaatccctgctacaaggtctcccaacaaatataaaaacagagacacacaatgtctattcccctctccctgcaaaacccctctgttcctagaagactggtgagagctgacaagcaggaacgcggacaacacgaatcacagaaagaacaagaaaagaccgggcacagtggctcatgcctgtaatcccaacactttgggaggccaaggtgagtggatcacttgaggtgaggagttcaagaccagcctggccaacatggtgaaaccttgtctttactaaaaatacaaaaattagccaggcatggtggtgcatgcctgtaatcctagctactcgggaggctgaggcgggagaatctcttgaacccgggaggcagaggttgcagtgagctgagatcacgccactgcactccagccttgcgacagagtgagcctccatctaaaaaaaaaaacaaaaaccaaaaaccaaaaacaaaaacaaacaacccccccaaaaaaaaacccacaaaaacaaagaacaagaggacttctttgcctcaacactgctaaaattcaagagtataggaagtagcccttgtcctccagtctctgcctgggacattttcctagcatgaacagtatgggcaaggctcccccagcaccacagatgaacccaggttcaactcctccattcctgagctttgttgaccttcatgagttctttgatatgggaacaatcatctctggtctaatatcagaaggaactgtgctttcaaacaccacaatgggccttgtttaaggagcagtccctaggagagcccgcagggagcagtacatatttactcaggcctatggcacttgtaaaggaattattggcagttgagaggcgcttccagctgaatgtatatcccaaggcatgctagctcccctcacctggggcctgataaatgccgggtactctgtcaattggctgacatctcatggcttccccagctgctgcccagagtaaagcaatgggattgagcgagttcatggtatccctcttattctttccatagatccaccttgctcagctcttttttgtttttattttttaataaaatagagacagggaccttgctatttttcccaggctggtcttgaactcctggcctcaagagatcctcctgccttgatctcccaaagtgctggaattaaaggtgtcaccccccgcatgcccggcccttactcggctctttcaacccccaaagatgagagtgtctaacaggaaagtgaccacagcttcacttgctagaagataacatcactaaacagggaacccaggactgaaggctgattgttgcacctgtgagcctaaatcccagctctgccaatacctgctgtatttgtgtactagggctaccgtaacaaaatcccacagatggggtggcttaaacaatgtatctgtttcagaaacttattatctacctcagaaacatattttctcacagttctggaggcctgaggtccaagacccgtgtattatgaatgtcaaggacagagtagcaagtagtaaagaagaaccacaggccattcttggaaagctagctgcattgacaggagatgcttgggcagtgcacagctggagaccttcctgtctttgcagttctctctgcttacttccaaacaagttgtatatatagattttgatttagacactttcaggtgcacacaggcctctgtcagtaaaataaagaaaacagggccgggcctggtgggtcacgcctgtaatcccagcactttgggaggccgaggcgggtggatcacctgaggccaggagaccagcctgaccaatatggtgaaaccctgtctctactaaaaatacaaaaattagctgggcgtgatggtgggcacccgtagtctcagctacccgggaggctgagacaggagaattacttgaacctgggaggtagaggttgcagtgagccgagattgcgtcactgcactccagcctgggccacagagcgagactccgtctcaaaaaaaaaaaaagaaaagaaaaaaaccagattcctgtctccataaaatatctgatgctgctatttttttattcatttttttctgggcctcaggggtaaagaattgagttaatcatcctatttgattcatggcagcatcacactcactgcattcccctcgctccagtagttgctatactcatgtgtttcaagggatcctttgataatgatatattcttgtgagatacatggtattattctgtaggaggattgtatttttaattcataaatggtatgctgtaaatagcatttggtttcctgctcttttttccagttctaaggtatcaccatgtgacagtatgtgcatatcattccctgcttctaagatccatgggtattccatagtgtgtgcctaccagttaacctatccacacacgtggtgatgcacaactcagctgccacatacaaggcagctgcaagtgccctggtggctggcacaagaactgctctgagaaacccaaaagggtttctgtgccccaggtggacacatcctcactgcactgaacccttccagactgctttgtgaccaagcagatctatgtaataaggtgcttggtatagtgctttttaccttatcagctattaaccaaagaatcctacactggggcatcagggtttaatccagttctgccacggggtggctgtgggatgttacataagtcacatcatgtgtctgggtctcaggatcctcttccaccaagtgagtatgccggacaaggtcaacccaaggccaaccctaaccccactgggagtgcatctgaggggcagcacaagacaatgaagcagagacaccttcagaccccaagtcctggctttggcggcctttgagaattgcggaaggagcccactgggaatatatgtgttataggagtcctttgacaattaaatgaaataatggacataaagtacctggcactttgagaagctgttcaaactgatatctactctctttattcccaacccatgccctttccctgttttgtcattttccattgaagaattctgaaatttttcggattctaaattctgacaatttaccgttcattctctgtcttcttaatgaggtgtaaatacatacagtaaggtctaataatcttcttttaataacagctttattgaagtattcacataccataaaattcaccctttaaaagtatacaattcacaggtttttataatactatattcacagagaaatctcatcactacttaatttaagaacattttcctcgccccccaccaaaaaaaaaaaaaaaaaaaaaccctcactctccatttcaccctctccagcccctggcaaccattaatctactttctgtcactattctgagcatctcatacaaatggaatcatttaccatatggccttttgtgactggcttctttcacttagcgtaacatgttcaaggttcattgtcaaataatattccactctatggacacagcacattttgtgtattcatttgtcagttgatgaacacttgggttgctaccactttttggctattatgaataaagcttctatgaacattcatgtacagattttcgtgtggtcatgttttcaattttcttgggtatatacctaggaatggaattgccaactatatggcatcttaatgcttaacttttaaggaggtaccaaaatgttttctgaaacactgcttttcagtcccacagccatatacgagggctccaatttctctacattctcatcagctcttattattgtcttgtctcttttgttttagccacgctagtgggtgtgaaatgatatcactttgtggttttgaagtgcactaatcttacattagcagcttggtttttgcaaatgtgtgcacctaagatacatatacacagatttaaatatagaacatttccctcctcctgcctctgagtcactaacttcctacccaaggtaaccactgttctgcagcaacattgcctgattttcgtgctctttaactttatgtaaataacaacataaaatatatactcttatgtctagctttttttcactcaaaaaatgttgtggtatcagtggtttcaggtgcttgttctttttacttctatgtagtatttcattatatgagtatactgcaatctgtttattcattcttttatgagtggacatttgtgttggttccaacttggggttattatgaataaaattgcaaaacactcttgtacctttcttttggaagaaatatgaactcatttctcttaggtctgtacgtaggaatggaattgctggatcacagagtagctttaactttagcagaggttaccaaacagttttccagagtggttgtaccaatttacatgcccatcagtagtgtatgagcatttcaagttgttctatatcttctttggcacttgaataaatcagtctttttgtttttgttttttaattgagacacgatctcattctgtcatccaggctggagtgctgtggcacgaacatggctcactatagcctcaacctccctgggctcaagtgaccctaccatctcagtctccagagtagctgggattacaggcgtgcaccacaatgcctggctaattttttaattttttagaaatggggtctcactatcttgcccaggttagtgtcaaactcctatcctcaaacgatcctcccacctcagcctcccaaaatgctgggattacagatatgagctaccatgctcagcctaagtttttaacgtttttcaagtaagttttagttttggtgtataatggtatcgcactacggttttaatttgtgtttctctagcaacgaatcatgttgagcacctttgttcattgccttcagtctgaaacttagctgaaaggatctgacaaataatgctcaactctccctggtggttaccagaagagctaaggattgaggtgctccagggggccccatcaagggtgaggtcttttatcccagatccttgatcacactctactaattgaacactaataaaaatccattgctaggagcatatttattcatttttgaattaacagtattttactttcaactcctagaactctccttgcaacatatccttaacccaataaagaaagagatggagaattagcaaagtaagtgtaaaaaaaaaatttaccagtcaatcttcaaggcaaagaattgactatactaaacataataacttttcatttaaaagttaaagtcaggtgaagttatagtctagtgtataagggatgtttaaattcatgtttctctttttgtttgtttgttttttgagacagagtctctctctgtaaccaaggctggaatgcagatctcagctcactgcaacctccacctcccaggttcaagagaatctcctgcctcagcctcctgagtagctaggactacaggtgcatgccactaagcctggctaatttttgtatttgttgtagagacaaggtttcaccatgttggccaggctggtctcgaacttctggcctcaagtaatccgcctgccttggcatcccaaagtgctgggagtacaggagtgagccaccacacacactttctctttgttttttttttaatagaaagtttatattctttatgatagcttaatggaaggagcattcgaaagagggtcagttaccttcaaagaaagtgtactctgtcctcaagttgggagagatcatgtgtgaggtaagtgtttcagaaggttccttagggtaatcacattatacagggctctgtgcggtggacacagaattgtaggggattgggaggatgctatgagaactaccaaggtgattggtgaaatgtcggtcaggctccagacacctctgctgcacccactaggcaggactggggtaaaatgcccaggtcctttgggcagaggaatttcagaaacaatgtgaggaaagatttggagttcccaacacctccatgccagtccccatgtaagcaagcaggactttcccacccaacaataaacgcctctctcccctgcccaataaatatcactgatgtgtttgtgtcttgttacgccactggggcagagtagtaagccccctgttaaagtcaacaaaagcaaaaatcatcccacagcttttatcaaatactaaaacaattttcactgtggaaaatttcttcttaatagggaaatggaaaattacagatatagaatcatccaatcttagagctggaaggaaccttggaggtcatcagctgaacctcaagcccactgctggaattcttattacaacatccctgctgtcctctgcttgaacggtcctaagcccgggccctttctcagcacctctaaggaagttttccacccattgttgggtggttgttagacagtcattcttatgttgaaccaaaatagtccttctggaaacttcacccttcaggcagagtttgaataagtctatttcctctcctctgtgagagctctttgagtattttaaggctgtaagcctcatcccctctgagtcttttgtccccagaccaagcattcccactgcctccaaatatataatgatccattctaaaacctggcgaaggacaggcatcaagtcactggtgtgtggtcttcctaatccttctttccctcgtcttgaaaaccagatccacagcagagattggagcagcctacccgctctcagggattgccccaaggtacagatgatgcttctgtgaaacctttgcaagttcagcggttgagggatgcaagccgtaaactaacggatgagaggtttgttttttttttaagtttttaacaagcttgggtatttttaggaaataaaagtgacactgttgaccccaatctggaatgagcccaagcagttttcccaggagatgggtgggttcttgctaatcctgttgcaaactcttaagtattttctaggcacccataagtatagtacagtattatgttcagaaaactgctagagcttccttagtcctggttttatccacctgggcaaagtggcccaaccagggcagtgaggatgagtgcatggatactcatacatgtacaattcatgttcaagccttacctgctatgctggtgaactagctgcttcaccgtcccactccccacagcccagaacgcagtgggtagtagtctacttgtgagcaggtgcacacacatgtatagacacacatacaaccttcccaagcacacgcacatccttgagggccttcctatcaatacccccacttgtattcagctatctatcaggggcaaaaaaaataaaccaggtctctccctggaggcgcaatgattttatggtagaggtgcttttgagcggccagcaaaacaagacaaaggtcttatttggtttatcaagcctaggttaacccattgttcagtgggccaggcagtgttaatcagtacccaagcctttgaataaaatctttgccaaatagatctgtgcagatattcttgctacataatgataaaagcaatacttctggtagggaggcaaaaccactaagattttaggcaataatttttccttgcttacaaaacagggagtaatgcctaccccaaagatgtaaacagtttttaattctttgaaggagaatctgtcacttatgctaaaaccaattgccaaaataatgctaaatggagctttctggaaagaaggtattgtaagtaaaagtcccagaagaaacccttctctccaatttcttcttacgttcctgtgcaaacccacgaaggagggaattgcatgattttaagaccaaagtcctctgtttttaaaaatcatatatcaaaacttgagaatgcaaaagagttctaattacaacacccaggggaatggttatgaaataccaataatggttgataaatgctcaacctattcaatgaaacacatacacaaacctttgaccagaagcacggacttagaaggtcaccatcagcatgatgaaagccttggaacacgcctctgacaagcaagaagggcattagagacccaggtgtttcccctttgattaatgcactctctgagaagcccagattgagagggagctatacatgatcaacctttgttttggaaacggctttccttgatcttcttgggttattgtgcagcccattctacaagcctcctcccatcctccctcctggttgtcaaaacaagtctgtgggagaggcattctcaggaatgtatgatgctctgtttaatatggaaaaatgatccttccaaggcaggggaagaaataaagaagcagatttcctcctcagccttcacaatacaaaccctcaaggacactgagagaagggtggtttaacaggtgcatgaggaagatttgaaagttgtggctccttcagaaatttgcttcccagtttaattgtaggcatctaaagggttaggtcaactctaaggatgattcaagtattccctctcattttcttttcttttttttttttttgacggaatttcactcttgttgcccaggctggtgtgcaatggcatgatctcgggtcactgcaacctccgcctcctgggttcaagtgattctcctgcctcagcctcccaagtagctgggattacaggcatgggccaccacgcctggctaattttgtatttttagtagagacagggtttctccatcttggtcaggctggccttgaactcccaacctcaagagatccgcccacctcagcctcccaaagtgctgggattacaggcttgagccaccaggcccggcctaattttctccttttaagtttcttagaaagaaaggtgagaggccgggcgcggtggctcatgcctgtaattccagcactttgggaggctgaggcaggtagatagcttgaggccaagagttcaagaccaagctggacaacatggtgaaacgctgtctctaaaaaaaacaaagcaaaacaaaatacaaaaaatagccaggcacaggtggcatgtacctgtggtcccagctactcaggaggttgaggtgagaggaacacttgagcccagggggcggagattgcagtgggccgtgatggtgccactgcactccagcctgggcacagagcttgtgaccatgaccctgtctcaaaacaaacacacacaaaaaagtgagaactgtttaccccctgcttagagaaggaaggttactactctcaatggggatggttgaatttttcaaagattagcatatgataaaacaagttgtacctagttaggattttctgaatctcagcctgtaaacttactatgtgatcttaatattgctgaatctccatttcctcatctataaaatggggctgaaatcttcctcagaactgttgcaaggatcaaattaggtaaatgaagttcaaatttaattctgatacctggcccacggcatccaggaaacagtagctattattatgtaattgactgttctttgcttattcattcatagactacagggattttgtgcacaagaatcaatattatgaaaataattattatgtagataggcaatgctagatatccaagcataaacaacttagtaataaagtgctgaaatccatgtgactcttgaacagataacactttcatgaaatccgactggtagatgtctgctgtgatataatgggaagggcctgggtttcaagtctgacatatctgacttccggttccagcaatgctaccatatagcacagaaccggggaatcatgggaaagttactcagaaaatagcctataaaatttataaagcatttacatgcttttattattttacaatgcaatattttctttttgtagtcagttttaattgtgaggccttgtatttttttaaatgaaaatttaagcactctttcaaattctttatctttagagaactatattatataaagtttggaaaacaggaaagagagaataaaagtcataattccgccctcctaacacaaccaccatcttcattgtgtattctcttgcactgaaagcatccagaagaccacactgtgatccttcttacctgctgtattagtccactttcatgcagctgataaagacacacccgaaactcggaacaaaaagaagcttaattggacctacacttccacatagctggggtggcctcagaatcatggtgggagatgaaaggcacttcttatacggcagtggcaagagaaaaatgaggaagatgcaaaggtggaaacctctgataaaaccatcagatcccatgagacttattcactaccatgaggacagtatgggggaaaccgctcccatgattcaaattatctcccactgggtcccttcccacaacatgtgagaattatatcaagatgagatttgggtggggacacagagccaaaccatattacctgccttccctccaccatcctctcaattgttttactggatttttatctggctaacaaaaacaaacaggcaaaaaacaaaaaccacaacacatacacacacacacacacacacacacacacacatacacacacacacatacatcacatcacatgaaacagaaaaaggcaagatttagactccatatagcaaatggatttatgctacggcgtggcttttatccattgtgaatgtgcttcctaaacacttggttcttgactaatgtgagcgttatcaggacaggacctggaaaaccctcagtgagttttcccccacccatattgaatccccttgggccatcacatctggattggtggtctgttggatgctattcagtcatgagttcctaacaagagacctgaaaaaaggcaaccataaagaagggatggagggatgagttggccaagaaaaaattgtctgatgtgtccagcatatttctctttgggaagcccaaggctgagcatggacctccatagcattaaggagaaaacaacccagcagaaatacatcgttttctgaaatatgtgggaaggggacacttaagagaagtgaagacaaagcatgacactgcttcacaaagagaataataaaacttgaagctctttgccccaagaggtacttcatatggacagaaaataaaaacaaattcaaagagctttgggtgttgagggttggggaggtaggagtgccagataaaatataggacatctggttaacttttcatttcagatgaataataagtaatttcttttttttagtttaagtatgtcctatctattctttgtataccatatcctgtattttttaaatgtgtgaggtttaaggtatctatttttaaaaatatctttattgagatacaactcacaaatttaaaaacgtactcatttaaagtgtgattgtgccactgcacttcagcctgagttgatctattcccttcaaaagcctgtccccagcattcctttgtcatcttcattttccttacaatggaaactccatagctctctgggtgtggtagctcacacttgtagtcccagctacttgggaggctgaagtgggaggatcacttgagctcaggaatttgaggccagcctgggcaatatagtgagaccccatctctaaaaaaaaaaaaaaattcttagtttcccttttctcctctctctgccctcttccccttccccctacactttgacctgcatgacttactgatgaatgatgaatggagagggatggaaattttgtttatcagctctcccaacactgcatgctcttccagggcaaatgaccgtgctcacttgtctttaagtgctttttacctccctgtacatattctggcaacttctgtcactttgggggtgaggatttccccatggaagttctgtgtgagaaatcatgtttaatgtgtgattctgtacagatgggtgtgtaggaaatatgaccggcatacgcactgacgttgacccatacaagtctaggcatctgttaagtgtttggccctgtccaggaagtagccgggccataaaatctgatatggggaggaagcttgaccatgggaggggccccttcacaatagattctgcagggacagtggggggagacaggaatgctagctaggctgagtgtctgagcaaatgtggacagccaaagggagccttggccaaaactcttctctcctctgtctccaggaattggaagtgtcccactgaggtgtcaccgtgagtccatccaaaccttactgaattactacctccattttaaggtgtaaggtgttcagagaatgtttgtgactcaatagttcttaacattttagttcttcaattttaagtgtgccagcttatgaaataaaacacatctgttagcacattgattttggaaaatttccactgatagttgtgagggcagacacagacggtgagattataagattctttttattcacagggacttcttaaaaatctagcttgttttccgttctccttgatgccttgttcatgacaggtgcttggcaaatattagttgaatggctgaataaatatatgtatgagtgaaaggcagacatcaaagtcttcctggatgaggtcaagagcagcctgggtagtgtagcaagaccctgtctataccaaaaactttaaaaggcatatctgtggtcctagctagcctgtggaggctgaggctggagattgctgaagcctgggaggttgagaggctacagtgagctgtgattgcgccaacggacggcagcctgggcaacagagtgagaccctatctcaacaaacaaacaaacaaacaaacaaatcaaaaaaatgttcccagatatttgagaatggaatttgagatcaggaaacaggccatcgtgtgaaaagccccagagcagtcatagctttgccacatagagtcttgtgattggaacatgtcacttaaactccatgaccttcagcttctgtggctgtaaatgggaatcacctcctgccataagtggttttgagaatcaagtgaaatttcagatctgaaaatgcttttctgactataggctgctgtatagatcgaggataatctgatagcgttcaaaacccagtgctcaccacctccaacctcgtgatcttgctcgagttagttaatctacacaagcctcggttttttcatctacagaatgagaataataatcacaccaacctcactgaattgtcttgaaacttacatgaatttatatgcactcgagagcacagaggtgagctcacgtgactttctcttccctgggttgccatcctctgcgtattttcttttttttttttttgagacagagtctcagtctgtcgcccatgctgcagtgcagtggcacaatctcagctcactgcaacctccgcctcccaggttcaagtgattctcctgccttcgcctcctgagtagctgggattacaggcgtgcaccaccacacccggctaatttttctttttttttttttttttgtatttttagtagagacagcgtttcactatgttggtcacgctgatctcgaactcctgaccttgtgatccgcctgccttagcctcccaaagtgctgggattacaggcgtgagccactgcacccagcctctctgcatattttctaagtagcttgttattctgcattgcccagacttgtttctctgccaacccaccagtcagtaagtaaattaattaggtgataagtgattccttgatctttttattattactatttggttatgatgattaaagcagatggtcatctgattgggcataggtcatgcatgcaaagcagctgcagtggtatctcaggattgtttccttatcagagacctgccatccaggtgtttcctcatcttaggagccgccctctaggtttcctcaaattgtgtctttcagatgagacccacccatcggagccaggctttgaaggaactgaccgcagtgtgcatgaggaagtacttcacggtgatgaccctcgccaccctctcaggaaaacacagtgacctctcccccaacatccccttcccactcccaggtcccccggcaaaggcagaagaaccaagcaagcctttccaccaaagcagccatgaaccccattctcatcctttccaagaactctctgctataccagataggggtttggggttctgttttccattttttaaaaaaatcatttcaagactcttgaacagtgtgtcggtttacactattctatcttcttaagccaccatatcaacatattcactctgcttcctttcttttcatttggcagatgccacacttttaatggcagcaataaaaggtgtt

SEQ ID NO: 726 - DNA, 388774 bp, Homo sapiens
gaggagggaggcgcgcggcgccgcatggccgacgtggggctcgcgctctcgcggtctctcccgggcgggcgcgcaggcacgcgcactcgcgggtgcgcgcgcggacggccgggcggcggcggctcccggaggtggtggcttcactttccaggactcaggggcagccacagcgacagccgcgggcagcagcctcaggagccggagctggaacggccgggggcggcggcagcggcggcgctgagggtgagtccgggcgggcgcgagcgcggcggggacaggcgtggtcgggtgcgtggtgcgtgggtccggctttcggtgactagacggtccgcaggggacatcccgtccctggggcctccccagtctccctccccctcgcgcctgggcagctctctcccagggcttcggctcgagcctgcgacctgcacggacacccccccctcaggtattcgctcgggccgcgccggtgcctcccctcctcgggcgtcctccctctcgctgacgtcctcctcactcccccgacctcccctccgcgtcgcaggtctctgcttacaccgctcgtgccctagttccctccttcctcgctccccgtgcccggttccctacgccccctcccgcgagcctcctgcccccgtttctcgccctttctacccctcccccttcttcccatcccccccttctgcctcttctctccctgtcctccttctacccccttccgttctcagttccccatccttctcaaccctcccagcgctttccttctcctagccgcatcctggaactaagtcttttcaaaagtacaggataaatgtcacggtggaaagtgcccggcttgatcttttgctattttccctaattgcataattgctgcacatggtgtgtctcctggcgagtgccgggtttggctccttcgccgccgcaccccggtggcccgcccggagaagaccttgtggggtatatttgtgtgtgtcctggtgaggggtgtgtgttgtattggtcttttgtgatgcctggcgcttgtcacagtttggaaccgaagcccatttttctctggtctcttctctgcagcccccactggcctggtttgaaactggattccctctgtcctctcccccttcccgcccaccccacttctccccctcttttctccgatctctctcataatgttttgatctttttgccctttaccatttctaatgaagataaagcgtggcttcttgtggcttttttcccccacgaccaaccagaaatgtccaatccatcttcccttaaggaaattaaggctgctttagaaagacatcatcctgtgctcggtggctgttagacccatttgcatgttttcaagattcatcgttttgtattgtgtattcttgagagtctactaaaatatttttatttaaaagtacgaaaggaagtgctagggtttaccctcaaagtatctcgcggttctaaaggattttacgctcttcttagtttttaatccctgatttctttaaaaagtatgtttctagatatgtgataattcagtctggactttgtgaatctaaatatttgcctttactacggcaatttggatgctccttggctctttggaattctgtatgtgggctgacgctgaaatagagtgttttcatataatgccataccccattctctttcccctgcagcaccttttacccccaaatcaggtgttccactgttattttctgcataaatgtctttgcagttaaatttaaagctggatattgctgtgtgcatatactatatatttattttacattttagaaaagtttagaaacatgagtaggaagacagcaagacatatatgacagaattaaacgctttcctgttataaaagcttaaatgaacacttggttttgcagttttatactagtagatactgttataaggcttacctgggtagtaggctggatttatggaatgactatagttgcctttatgtagtcagtaatatttcaagccaaatcatttcatttttatggaacatgtgagtttcattcactgtatgttgctaatttccaggactgtaattacaacatagggtacatagctaatacaagcttagacagtttgtgttgaagaagtaacaatatgtaagcctcttaatatagttttaggaaggactacttattttatggttaaaaattaaattttactttgagttatgaagtaagcgtatttatctctctcaatatctttgaaagtatcattggagagtagctgtttgtttataaccctgggatttaagtttatcttccctgtagatgagataatcggatcagattagctatttaggaattaattttaaaatgctaatttagaagataatgtttaaaggattttaattcaggaatttttattcatttgtacttcagagagacaagacatcaagtttacacttacgactaattaaattgattcatagactactttttcttcataaaaattcgttgcacctgagtggtacaataatttttttctatactttttctgtaatcaagcattcaaaaaacaaacccaggagaaattccttttattattgatatttgaaaaagagatgtgaaaactttatttctaaaagttcctatagtggttatcaatggcctcagatggacttatcatttgtaggttaacatttggatgaaatatgtcttaactcaaaagtgggaataattcttttccttaatgtgaaaccagaaattacacctctgttggggaatttctaatagtatttttattagttctctggtgagactaatttttattttaatcttcctctaatattcggcagtagaaatttgagtttcagattatggctcagatcacatcattgagtaatctttttaagtaattatataactatggcattcgatagtatgtaaatgcacataaataagaatattgagaagaatgtgtggctttataactaatgttatacacaactgaaactctcagcatagtttattaaatcatagtttattacgctgaagctgcatcctcagtatagagaatattatttcattgaggtacccatatatttgtcatggaatggattgctcctgttttaaaatgtataaaatgatttctcactcatttcacatttcttaaggtattgctggcagcattttgctatatctgagcacctttccctgaggattgttctctttttcactctcatgcatgccgccctatctgatatgccattatgtacatacttacaagattttaaacttctgatatattttaactgaaagaaggtgaaaaaaaatattaaatccaagaatgagaatttagagtgaaataaaaatgaaaaaaagcaagaaatatgttacgacttttagagctagatgtgaaacatactgatataaaatttcagtgttctattaagtgactttagtgctcataaaagatgtcacagctgtggagactggtgctcttcatttacagaataggtagaaaagtagtcagcttttccgttagtatgtttcagagctgttggggcagatctgtttctgtttggcatggggagctgttggggttgaaggggtgctggtggtggtgtgtgtggtgtgtcagtgaaaggattcactattttctgttgactctttgtggctctgtgcttcctgatgcttccattcttttgcagtgctttttggtttgtcttacaaaaatttcagtccattaaagatcggtgttacaacattgctttggcttagagcaagctacaagttaaatctttagtgatgatgaattttcatcagtgtcaaatagctatccatttggactaagttatagtaattaaaaaattttgctttatttgaggtatctttacctgttcttattcttgatcatatcagaaacagttttatttcaagttgtaatttgattaagagtaatcaaaaggatccatttcaaaaggaatttgttcagtgtacctataatttttaaagatatattttttgctgttaatggtacttattaagtataggtattttgtttttaaaaaggtgtctgagaagatagctatacagtgctgaaagtgattattaggtgacaaaaccatggggagcacaaggccttttagagtctgggcatgagttttgttggttcagttctggatttgtcagaacactttaagctagtcagctcataagggatgtattcatagtcatcaaactcagaaattgattatgatagaatgacagttgaggagagatactccttttcacttactggaattgtttgtgtctgctgtctagattataacagctacctaaatatcaaggtattgaggaaattgagttggtaatcagaactgcttggggggcctgaactcagagcaaagggaatttgaaagccttgagggatattttagccagaatgtggggaaaaaaaaaaaaatcttcagtgtcttcatctcttgtgaaatatggttgctttagtatatagctgaatgctgtcatatggttcaatttttatttagaatcatgcagtcatgcaggcctctgtgttcttctgttatcacaaaggttacttaaaaccacttactagtttggagaattttaaccttagcccagccctgaggatgtattgattgaatagggatttgaaagtgtcgtcccatttttgtgttcccacaagtatttgtactaaccttcgtttttgtacttagcaagttggctagtcgaggtttttcacagttgtgggaccaaagggcttagcacagcgcctggtagagagtagacccttaatcatttttgtcttattttctgtaacagcattattgatatataattcacatactataaaatttaccctttaaaaatgtacaactctgtagttcttagaatatttattattagaattgtgcaagattataattatctaatttaagaacatttttatcaccgcacagggaagcatcatacccattagccgtcactcttcactactctcccctcactccctggcaaccacttacccattttatttttttattaattttttttttgagacagggtcttgctctgtcactcaggctggaatgcagtggtatcaatcatatttttattttttgtagagatcgagtcccactacgttgcccaggctggtgctccctgagcttcccaaaacattggggattacaggcgtgaggttcactactgaattttatgtttatggatttgcctgttcaggacatttcatataaatagtcaaacagtttgtggtcctttgtggctggcttctttcacttaccagaatgtttcaaggttcatccattttgtagcatgtagacacagtacttcattcttttttatggctaacagtacattatgtgaatatactactatattttgttcatccattcatttgttagtggatatttgagttgtttccagttttgattattatgaataatgttgctatgaacatttcatgtataaattttgtatgttttcattttagaatacattttgaatggatgaaggaaaagttttagcaactcccaaagctgcattgttttgtaaatgaccaatttaatccattttatattgagatttacttgttttactttgaggctcattctctgtgttctggaggtagcttactgtagtacagctaaataaatgatttttgattctttaatccaggatctaaaatgtccactgaggcacaaagagttgatgacagtccaagcactagtggaggaagttccgatggagatcaacgtgaaagtgttcagcaagaaccagaaagagaacaagttcagcccaagaaaaaggagggaaaaatatccagcaaaaccgctgctaaattgtcaactagtgctaaaaggtacttcagttattataacctttttattgttggtatcaatttatcatcttaagttctatttttctcttgcatttaatcattttttctgggatgtcggccgtgaacttcatggatttttcttttcccttcaagatgatctcgtttacatggttttaaccatagggaacttcagtatttaaagtcagttaaatggcaaggcaaattcataacatacatttccatagtgtgtttgtgtgtttatgtattatcagggaaacatatacagggtgtgtatgtaaaattgcagtagtttcatttatggttacttgaccataaatattttttttctgttcagtaacacagaatagagattaggaatctttgaagtagttactgagtgagtgacagtttattttccactactcccagttggtaaagtcagaaatgctgacattagcaacaggtgcatcttggtttcattacattagtcagtggatccatcttgatacggattttctctttctctagagaatagatggatctggaaagtaggtatttgaatgattttctgttggtactcaatctcttaaaatgattggcatgtcactggacttaaagggaatctgtttgatattgttacattatagaatatctcttggaaaataatttgaaagataaattaaatgtagtgtctttcctgatcctgtgattttatgttcttgctttgttttcatatattttacattgaccaagtcggaagtatacataaaagcgatctgtaacttgtaggcatagtggaatgcctgaatgttgtattacagctttatatgttattttatggtgtgggttaaggggaactcctttctcaaagataaaaaaccattattttgttctagtagaccttgttttcctttggcttagtcagtctacagggttggaaagaaccttctcaggacccttggtgagagatgttggagggatggtgagtggttattccaaggtactagagtattcagtttccctttcgtgggggtgtattgctgatctctgttgaaggagctgtttgaaagtcagagagccctgaactttaaactttgagacctgtatactagaccatgctagggtggggaagagggttcagtttgttttgccatcacaacacaattaccggggactcagctggctgacccttctgtttgccagaccacaacacaaatgacctgcttagaggtgacctggaaaatggggggtggggttaggatggatgagaaaggtggggaatagagaaaatatgacatttaggtgaaagaaggaagtcgatgtaggtgggaaggagatgttcaggtacagattgtagttccacgcagatgaggaagatctaattcagtcctcagtgtctgattgggtttttacagggcctcttcagtttgtcagaaaaggggaaggattggttggccaggtctgtggggaatagggttctgctgggcctgtgctttattctatgattgctagttagcaaagtcacctgttgtggtgaggctctgccttttcctctaactgggagcaccactataaaataccttaaaatcatatttcttgggtgatatgtcaaagaccaaattctgcttatgaaagatgtactgctttatgtgtgaacatgagtttttcaagtacgtgggtcatctttattttactacagtatatagagaaagtacggattattcaaacctaatgatagatttcacgagggaaaaatatagaagatatttttctgcactgtatgtaggagataaaacctagtttagagataatgtatgtgcagagcgcagcgcagtgcctgattggcagtaaatagaaagtggttgtattgcattggtgaaaataggaagtctcttttgagttgcttcctggctgaaagaatccctccattggcaaattgttgtgaatctgtgattttcaaattgtggttcatgatcttcctctagaaaggtcttcagttggttttcgggtgacagtgtatgaaatgatgtaattatgtactatttattttaaatataaaaatgcggcttcactactaattttttaatttaaaaaaccttattttcccctctctcttcctccaattcagctgatagtgaagttgttggttctttgccatttctgctgaacttaggaaaaaaattgggaattatgagcacagaggaccccacatcttttaagttcactgccatgtccacagtgcctagcagagtacagtcacagtatttatttactggctgccttggaaccctgagcttcttatagggatcggattttccatggatattaggatcttagtactagtgtgttcagaagattaaaagttagaggtagtttcaaaataaattttatttcacacttttttgttgacgatcatttttattcagatgagaagcctttcccaaatagtgtcattttatgagataaagagtagcattgaagagcttgaactctagagacagcatctacgtttgaatctaggttctagcatttagtagctatagctctgtggtctttttttttttttttttgaggcagagtcttgctctgtcacccaggctggagtgcagtggtatgatctccaactcctgggctcattcagtcctccagcctcagcctcccaagtagctgggattacagggttgtgtcaccacaccaggttaaatttttaatgtattttttgtagggatgggagtctcactatgttgctcaggctggtcttgaactcatggttgcaagcgatcctcctgccttggtctctcaaagtgttggaattacaggcatgaaccactgtgcctagcctctgtgatcttgatgtataatttaacagctcaaagcctcgatttcttctttcgtagaaggaagatgataacggtacgctgttcagaaggttcttgtgaggactaaatgtgataaagcatttatttggcacatagtaagctctcaaaactgatgccgtcactgatagactttatgtcagttaaaatctacggtcatatttttcaagtctgtttggtacaaactttggaaaaatgaggtatatgttaaccttggaggccttaatgctattgttaaactagaaatactcagatgccgtaattaaatacattttgtagtgacttaggaaaagtgcttgcacgtaggtgctcagttattatatgaaatgtactataattgtagaattaataattgtaatgcagtaattatagaattaataagctggtatagaactatgatttgaaaaatctcatttgtgatattatagaatagtggtatataatacagaaaacatttaagtgggtatttaaacagcagtagaaattaatttctgtctcagagttaggaggaaagattacagttacatcttagatgcatttttgcttttctttggcaagagtttcttaaaaaattgtcatgctcttatcacagcctgttctcttgatatgtctatatcactcttgttatatttgcaagtctgttgttggactatatctgcagtgacagatttagattattttgattaaattgactagtcagttcaataaaacgtctattttgagatcttctttgaatttattctgctgcttttacgggttgatacatctgtaaatgtgaattttatatcatatttattctaaattaactgtttagagtggacatggtgattttatttttggacattcaatatgatactgttcgaggtatggtttttggtttcagactaaatttttgttaggttgaaagattgattccactgtattccagtttgaacttttatcatatgggctcgtctaagtttgttttccacatgagaatgaaatagtacttttgtagataatcttttgtaattactgtattttcttcattctaaaagtacattttaaaactttttaatgtttctgaaattgggacacatcttaaaatttatgtgcacaattattgatggtgtgtcttaaaatcaatgatctttcagaatcatagatatatagtatataccaccatttagaatgaaactctagacttcttatttgcaatggcaatgtgttttctaaagattgctttgacatttaaaaaattttaataattagttgcatgatgcttttttgagaataagttcattttggaaggttttcgctaggtgattcaattgattagagtaggggtttttaggttgactgaggaatgtagtctgtaagggaatatagaaagttgtctagatgagatgaagggttttaaaaaaattcctgctaagaaattactttgcgaatctgcgtatccacacattcatgttctacttggctctcagtaaatttttgaattttctttaactcaagaaatgtatgtgtgtgttttaaacatgttagtacatatacactgcttcatttttctgaacccttagcccaatatattgatgttaaaatgagtgtttcgtatcttctctgttctgtataattttggtaccatattcttcatttaagtctgagtgaatcatgattgttatgattcccctcctctgctattttttttaaagcaaataacagtcccacacagcattcttattgtagtcttatcattcattcctggaacggttaaggtataaggtggagtaatatacattgaaatttaattgtgtattgctccttgacttgtctcaggaacaatgggcagttgctgacttctgtatcatactaacctaagaggtggcactgccttatgaaaattggaaatttaggtgattgttcaggtgatttttgtgtaaaataattttgtcttaaaagttctgatgagggaagtcttcttgtttgacttagcaagataatagttctccatctttcaccttaccagcgtaaaataattagccttagttttccttgccttttaaatggggactgataaaacagatacttagagaattctgtgagatttacctaatcacttttaacggtaaaagatcatcatgggaaaggtagactgtaagtgtgaattattgatacttttcatttttcctcaccctaagagacagtgcctgaaataggtacctttcttatcccacttgtcaaggctgagaaacttaatacataccataatcacaacttttgagatagaattgaattgctgtcattcaaaacagcaggacatcttacaaccgtttaaatagcaattcttagtataatcttttctgtcaagagacatacaaccattttaggtaacagtagctcaaaatataatattattgactcactgctcagacttcttgaattcatcagtaaattgctttttgtattgaataatatagacctagaattatagggatctggagttcaaattttatatagaattatatgacagaaaattatgatttatcagttttttttcccttagagacagggtcttactcttgcacaggctggagtatgtggtatgatcatagatcactgtggcctcaaattcctgggctcaagtgatcctcctgccttggcctcctgagtaactgggactataagcacacaccgctatgaccaacagtttcctgaattttttgtagaggagtctcactgtgttgtgcaggttggtctcgaatttctggcctcaagtgatcctcctgcgtctgcctcccaaagctcagggattacagccatagccaccaatactgagcctggcccaggatttatgagttttttttttgttttttttttaaacctaaagggcagtataaatataaagcaagatgtgttgtttgaaaattgcaaagaagtttttttatgttaaaaatagttttctttgacagtttaagcatgctttttagaatgcctattcttttggttctcttagtttaaaaacaatttttaaaagttgttcatgtttctgataacaaagtaaacagtacatagatttttttttaatggaaagtaacagtttttttatccaccccctgcccctagttctcccaattccattcccttgaagcagactgtttagctgtctttagtcttactccttctgttggttttctgtacaactcttaataatacacttatttctcattgaattgttaattgaagtaatatcttttgattccctgctctgaaatatgaggatttagtttgcttacctattcttcctttcttttccttcctcccagttaatgatagttaaaatttttttaaaaagattattggttgcctttatagtctaaaaatatatatttaaacttctgtttcttattcctatgaataacatgttttttattctctactttgtaaattggggataatatcttctccatccacttttagctggtttatattagctacacttaattttacatcttcaaagttaataacatttactttgtacagtgcaactaacaaccaatcttctatgctttgtctgtaagtaaaaggccaataaattatacatttattataactaaatattcaatgccagaccaaacagcatattacgattagattaactacaaggccagtgtcatgatctctgggcttctcaatgagtcatagcattgaggcacaatagatcaaatctttctctccccacctcacccccaatgtctgatacttaattaaagttattttacattttagtttgcttcatatttcatctgtgattttcttatgcagctttttttccttctgggatttctgattacttccccctatgcccctttagtagtctgttttattggtatacactctgcagccccctcttgcctgtctcaacctgtttgatttacacccatttgttttgtctcgcagaaatatattgaaatttctcactcattggtgaccaccacccttctctttgctgtttattcctttttgcattttctgtatgtcccctacccacccagtggggtcctgaatgagtgagaggtgaaagtgtgtgtgcctagttggccatctttaacctggacttagccactgagttttgaagtgtctgttgtatacttttgtgtgaaatccataaaatatcttctcctatatcaaatctttgagacttctgtcatttaaatatgggcaatatgtactttgtatgcatataaatacttcacagaatccatattagaaggaagttacagtgtgttaaaagagatcacggagtttgttctagttaacttctattttacaggacggaaaactgaggcacagggagagagagcaagcatgtgtgagcagtattcttgctcagggactcaatttaatggcctagcagaattacaatgacatttttttgactttgaatttcttagccgtgctctgattcataatgcctcgccaaccttgaatcacgtggtttagagaagtcacaattatattagtagcatgcagttccttcgggaagttgataccaattctattggagggatcccatttattctagtagtttgttgtcttgaaaaagaagtagaatgaaattgtttgagtttaaatatttttgctcaaattcttgttttggtttttaaagatactttaatcagttattattgatatactgtcacagtaattaccagacaacaggcatccagctattaataaccccatatttaagaaccaaggcaaaggagaagaaacggttttgagaattttttggtatttgatttaacaaagcctacatttaataaggtatgaatgatagttaagggattgccaagtatagtcttagaaaacagtggcgcactttcagcctttttgtatgtacataggatgttagatgctgttaaaaataaaagtagaatgtaacacatgaggatagagcaggcttaaatttttttttttgcatgaagctcatgcaatgacattaattgctcatgtaatattagggtagttctagccgatgaaatagtgttaaacttcaaagtcccaacctggtccaaattagaggctccaggaaggaataccatatgcatcttgatggcagtttcaggtgttggaatgagatcccgaatcatttgattctatcagtcatgatgcttggatttaacttaatatcagctttccatcctgtatgggaatgctctaatacaaaacagaagttaaaatgacccatgaatggtgtggcagaaatttccagctttagaaattttaattagtgctgtcagtggttcagtgaagtcgtagtgttccttccacaggttgcatgcactggtagtctcatcctttagatgcatcctcaaaaccctggcagaaattgcaactttattgtttgttggatgtgattctttatacagtattagtatttcaaactaatataccaaagggaaatgttattaaaatgtaacgttttaatgaaataaattgttaagagtgaagatatttttaacataatgttctttgtctttattttaaagaattcagaaggaacttgcagaaatcacattggaccctcctcccaactgtaggtaagtactcatggttttttatttacttgtatcttttgcagaaggtgcatttgaactgttggttttatatgcagctgttgttgtagtctgattaattagtaaaaacatcattgttgtttgaacttaagtgactgtggaagacaatggtttttgtcatctctgtgcagaaatggaatgttcagcaagtatgtttgtagtggttgaacggagttgccaaaagtagtgtaatgcaataacagtaagacaatgaaattatagggtaacaaatacactatgacattttagtggaagaggtgttagggccttaagtggtttttttaatgatagaataatagcatggctaaaatatgtgctatgttgtattgttatcttgttggaatttgatttttaaaaatgcagacacattaaacagtgtttcttcatggtttacattatttcttgtcgtcattggttgtgactaggtaagaatgggtgatttgaggcaatgatgttaaatgtaaaactctctctccctttatgatcatgacctcgaattttctggtcagtgtttacttttaggaaagaaaagtgcttacctggaaatggttaatgttataaagatacatggacaaagaggagaaaaataacctcttaccttatgctgctgctttgggtctggtgcagtagttagaagatggctgtttggttatttttaagacacttatttctgttttgagatgagatcagcattggaaccaggccaacctggagtttttctggtttaaaatgataatcttatgcattgaaggtgagagggccgattaaataaaaattttcccaacgttgaacgcaggtagaatttattgcttggtatgatttctgagtttactgatcttacttttatgtaaaaacaaagataacaattttgtgtaggaaaaattctaataggacttactttgtggtgaatctaatatggttcttcaaatgaatcatgtacagtttataaacttacagtaataatattcaaagaatgtttcactcaaatagaacaaatatttctttgttaggtaaaaccgtttaacctaagactttttgtcactcttaggactgtattacatcaaagccgtttcagatggcagatcattgtttagcttttggtggtcaatgattataagtggatggatttgtggaaaaaccccagtttgaattaaacctaacatcctttgtttcttaggataatatttgttttaatggtctgaatctttaaaaaacccatattattaatatattacatatattatttttgtaaccttttttatgaacaattgaactgataaataagtgaactttatacacttctttgcttaaattttgacaaccccaatcaccggcaaaataaacaactttgttttaataagtttgtttaaggctcatttttaataaatgaaatccacatacagtatcatgtgatgtagactgcaattttgctattagataaatggggaaaggaactatataaaggttattatttaaataaacaaataattgaaccatagttctattaaaagtaaaagaaacgtttaactatagtgtcatctgaaatttggaggtttactttgtctttgagccttagtgacatcattactagttcatatgtaagctcttcataaatagagcaaaatgtgtattacaggttttaatttttaaatgtagaagtcacacataataagcccttcaaacagtttcagggaagatatctactttagttaattttctgacttgggaatttgtaaggaaattctcacttgtgggctgaggattggatagctgataagtttgctttagaagctaggtctgcagtgcagtggctttggctccttttattgattctaaaacagttgcttggactgggtcaggcagagagaaaggttatttaccttcgtatggcactccctttggcaagcaaagggtcctctgtgctgtagctgatagaaaatgtaaaactggttaatcaacacttatcagtgtgcttgtgttacttaatatggatgtttggtgtgcttattaagtgcatcactgtggtctttggactgtttggtgtcaaatatttggttgtggtttgtagttaatctgcccatctgtatttcggtgaaaatgtggttaccatcttcagaaagagattagattgcagtgttagtttggcttatttttggtcaaagttaacagtgcttttgtggttgatttttacaagttctgcactgcctgcattggcctaatgactgtaatggattaatttatcaaaatagagcaaattaaagttatctgcctaatagaagtcagagtcctttacttaatcagttaagtcatatctcatttcagaagaaagcatccccttactctgctccctttgtggattacctctcctatcacacatgcctctcaaaaccctgccttttggttccctgggtagttgttagtctgctatcacatgtaaagattatatgtgagggaacatctgtgggttttacctgtttagtcagagagtggagaacgattttttctactggttgtctgggtaggggtgggtgtgtgtcacattccactttgagtgtggtttatcctattttcgggaaccttaacagacaacccaatactgtgtgtttgtcaggttagatggaacctctgaattttggtgcatctcttaggtgatatctagttaagcttcttttggaatcatattgaaggaactgtatgtgtttaagcgttgtgcaaatctgttatttaaagaagttgagactatcaagtcaccccgaatcacagcattcagtgtagataaagttttatgtaaggcatttttagaggaagttattctaatatagtattggttaattttttttcaggttttgaataaacaaatattattttaaagaacacctacaaatgatttaatagattgaattatttcatgtaggagatatttgcctctacatatttcagttttttctcactttattgttgtctttgaagtaaaaatgcagtaagatagttttatttttgaagttgggttaaatatgtcatcctttttaaaaacattactcacagtttaatgggtaaatattttaaaacaaaactttatagctaagaaaaaatttctgctcataaaatcgtagcgtctgtagggccataggcatagaaaattacacttcatttgagtgaaatttggtatatgcttagagtatttcctataagtagtggaatatatttttcttggccttaactgtcatgttggctaacataactgacccatgacatttgcaagggttctatcctgaggccttcacagatccactgatcaataaatgttttcatactactgctgagttagaggtgctgggcagttggttagaattgctcgttaccttggtgccttgcacaccagcttagatggatagagtgggtcaaattgatgctttatccttacagacctctaacaggtagattcactgccccttataaatgactacaggttgtaactttcacagttcttcacaaattgttaaaagcaagatcttagatctgtgcatgtcagtgtgttcatttatacttcctcggtgctagtggagaactggcagctagtgggccagcaaatctccagataaaaattaaaattaaaatcgtcatcatccaaaggataacttgctcctctgtatcacagagaagctaacttgttcaaatgctattatgatctgctactgctaaagtttgtattaggtttacgagcaggggaatgacagagaatccttattactttttggaagaaaagactaaggtaaaatgatttatttggattttgatttttggtctagtaattgaacaagtaaaaggaggaagtaaaccaaaaaagaggatgtagttatactagcagtttacacttctatttctatgtgtttcaagaatctgctcatggaacactggcgctgctttttaattttgtcttttatttgataacagctttattgagatataaagtgtaaaattcacttatacttttaggtttttagtatagtctcggagttttgtaatcatcacagtctgttttgcaatattttgatacctcccaaaaaataatccatgccttttagcagtcactccttccccattttcccccagctctttcaccaccagccctcggcagcaattagtctactttctgtttctatagatttgccttatctggacattttgtataaatgaaatcttgtgtgctttttgtgtctggcttttaaaattttttttacaaagtgtaatattttcaaggttcatccatgttgctgcatgcgttagtacttcttttttttttctgagacggagtttcgctcttgtcgcccaaactagagtgcaatggcgtgatcttggctccctgcaagctccacctcctggattcaagcgattctcctgggtcagcttcccgagtagctggaattacaggcgtgcgccaccatgcctggctaatttttgtatttttagtagagacggggtttcaccgtgttggccaggctggtcttgaacttgattacccaagtatttcttttttaaaaatatttttaattgaggtaaaatatacatacatgatttaccatctttaccatttttagtgtaaagttcagtgaatatacatttatatatttatattctttttttcctcttgatccccccactccccttcctggcctctggtaactaccagtctactctctatttttgagatctacatttttagctctcatgtaagagtgagaacatgtgacatttgtcattctctgctgggcttatttcacttaaccttgcctgtggttccatccatgttgctgcacatgacaggatttcattcttttttatggttgaattaaatattccattgtgtgtatataccacattttctttattcattcatttgttaatgggcactcaggttggttccatattttagctattgtgaatggtacttgggtaaacatggaggtgcagatatctctttgatacattaatctcctttctttttgatatatactgatatgctttggcaatgtccccacccaaatctcatcttgaattgtagctcccataattcccacgtgttgtgggagggactggcgggagataattgaatcatgggggtggtatcccccatactgttcttgtggtaatgaataagtctcacgagatctgatggttttataaggggaaaccccttttacttggctctcattcttctcttgtctgccaccatgtgatgcgtacctttcaccttcaccataattgtgaggcctctcaagccaggtggaaccatgagtccattaaacgtctttttgtaaattgcccagtctcaggtatgtctttatgggcagcgtgaaaatggactaatatataaatatatatacccagtataggaattgctggatcatatggaagttctgtttttagttttgtaagtaacctttgtactgttctccatagtggctgtactaatttacatcccaacaacagtgtacgagccttcccctttctccgcatccttgccagcatccgctattgccgtctgtttgatctaagcctttttaacctcagtgagatattgcattgtagcaatgttgagcattttttaatgtaccctttggccatttgcatgtcttcttttgagaaatgtctgtttacatcttttgccccccccccctttttttttttttttgagttgtctctctctgtcactcaggctggagtgcagtggcgtgatctctgctcactgtaacctctgcctcctgggttcaagtgattctcctgcttcagcctcctgagtagctgagactacaggtacatgccaccatgctcagctgatttttgtattttttttttttttttgagatggagactcactgtgtcacccaggctggagtgcagtggcatgatcttggctcactgcaaccactgcctcccaggttcaagtgattcttctgcctcagcctcctgaataactgggattagaggcatgcaccaccacacttggctaatttttgtattttgagtagagatggggttttaccgtgttggccgggctggtctcaaactcctgacctcaagtgatcctcctgccttggcctcccaaagtgctagtattacaggcgtgagctgcgcttggcccttttgcctgttttaaattggattatatatatatatttgctgtcaagttgtttgaactctttacatattctggttactaatcccttgtcccttgtcagatagatagtttgcaaatattttctcccattctgtgtgttgtctcttcactttgttgattgtttcctttgctgtgcagaagctttttaggttgatgtaatcccagttgtatatttttgctttggttgcctgtgcttttgagatcttacacaagaaatctttgcccagaccattgtgctgtagtgtttcaggtcttagattcaagtctttaatccattttggtttgattttttttgtgtatggtgagagataggggtttagtttcattcttcatatatagttatccagttttcccagcaccatttattgaaaagactctccttttcccattgcgtgttattgatgcctttgtcaaagataaggtggctgtaaatgcgtggatttatacctgagttctctcatctgtttcactgatccatgtgtctgtttttatgccagtaccatgctgttttgattactatagctttgtaataaattttgaagtcaggtagtgtgatgcctccagcttcattctttttgctcaggattgctttggctattcatagtcttgtggttccatgtaaattttaggttttttttttttttttttttttttactatttctgtgaagaatgttattggtattttgataaggattgtattgaatctgtaaattgctttgggtagtcttgtcatttaaaaatattgttatagttcttctaatccatgaacatagaatacctttccatttttttggtgtcctatttatttcatcagttttatagttttctttgtatgagtctttcacttcttttgttagattgattcctaggcattttataatttttgtagctattgtaaataggattgctttcttgatttttttcaggttatttgctgttgacatatataaatgccactgatttttgtgtgttgattttgcattctacaactttgctgaatttcttgacagttctaacagctttttttttttggtagagtctttaggttttaacatcacgtaatctgggaacaaggctgatttgactttttcctttacagtttggatgccctttatttcttttctcttgcctaattgctctggcctttgttcctacttgttaccaaataaacttccatttttatggatataccacattttatttttcttctcatcaattgatggatatttatattgtttccacttttttgctactatgaataatgctgttatgaacatttatgtacaggtttttgggtagacatttgttttcatttctcttagatatgtacctagcagtggaattgctgggttatatagtaagtctgtgtttcctgccagcagtgtatgagggcccagtttttctccacaactttggcagcacttgatgttgtcctttttttttttttaatgatagctatcctagtagatatgaagtggtattttgttgtggtattgatttgcattattctgatggatgatggatgagcatcttttcatgtgcttattgtccatttgtttatcttctttggagaaatgttagttcaaatcctgctccattttttaatgacttgtcgttttattgttgaattgtaagagttttttcaaaatacattttggatataagtcctgtacatcagatatataatttgcaactatcttcctccattctgtggatttttttttttttactttcttgataatgacctttgaaacatagaagtttttgctttttgtgaagtctaaatatctgttttttcttttgttgtttgtgcatttggtgtcatatcttagaaaccattgcctaatccaagaccacgaagatttacatctgtattttttcctaagaattttacagttttagcttttacattttggtttctgatcctttttcagttaatttttgtatgtggtatgagattagagtccaatttcattccttttggcttgtgtagacccagtgtcccagcaccattcgttgaaaagactattttttacactgaattgtcttgatacccttgttggaaatcagtggatcataaatgtgaagatttattgctgaattctcaatttggttccattggtctgtatgtctgttcttatgtcagtaacatactgtctttattactatagttttactgagttttaaatcagaaagtgtaagtattctaactggtttacttttttcattgtcttaactcattaggtaaggcattcccagtggaaatgggaagaggctgtgactggacataaacctaactactgtgtcattttactactcatgggagccattttatagaagaaagtgttttttttttttgtttttgtttttgagacagagtcttgctctgttgcccagactggagtgcagtggcaccataccagcccactgcaacctccgcctcccaggttcaagcaattctcttgcctgagccttctgagtagctggaactacaggcgcatgccaccatgcatggctaatgtttgtacttttagtagagacgggtttcaccatgttggccagactggtctcgaactcctgatcccaagtgatctgccctccttggcctcctaaagtgctgggtttacaggtgtgagccactgcgcctggccgaaaagtgtattttccacatcatagtaactaaaatggtatgtagggaaagtgtgtgtgggggttattttttgaaattatagaataggaaggtattgagacagaaattagaaacaatgtctgtatgcgtgatctctacaaagaacaaccaatgcaaaatctaattattgtcactaattatttttcttctctgcttattgtaatatttgtacagcagtttttaacttttgaaggatttctgtatgtgatgtcatttagtcttttcaaccactttctgaaactcctaacattaagtaacttgttcaaggttgcctgagcctcccaaagtgttggaattacaggtgtgagccactgcgcccggccaggaaaacatctttaaggagggatgtgaacttggctttgaagaatgggtgggatttggaaaggtaaaaggaaatagggatggctttacgtaagagaatgaatgagagcagaaacataaaaggggagaatttagtatagttattcttgggacagtgagtttaacaggttggccctccttcccatgtgggaggtaagatttgttaggactttctaggaagggtgttaaaattaccagttgctgtagtttgaggtttaaatactgagtaaaagagagtgaaattgaagttttgatttaaaaaaattgtgtcatagaaattaatttgtaatatggagtggagaaagatataaagagtttgggaatccagtaagaaaagtgttgcatgaatacaggttcaagttatataagacctggtgatgtgataccatgaagaccaaaaaaaaaaaaaaaaaggcagtggaaatgggagacgtttttgaactggcccaccttgttgatggtgtggttttgagagacaaaattaatgatgtcgaggatgactttaaagagtgtgatatttgtagactagaatggtgatactattggcagaagtggatttgtctctatggcctctacggatcttaaaattgataatacatccctctttatttagtttggctgcctggaaactcatagccttatttgctcctcagttttagtaattaattgcattttgtgtagaaacctcaactctctggttgtatttgatttttctacccttttccctcttttatatccatatcttcatttgtactttcatactacatatatttttgtcagccagctcagagtcttttcgagggaggcatattattggtaaacgtacaatgtgaataactgaaagtttatgtgaatgtgtattggttagcaaaatgctggcatagtttttaagaggagttattaacatgataaaatttaaatatacattgaggacctatgttatttatttagggtactgaattatttgtatccatctctttttcctttatctaaaacaggtaattgaggaatatttttaattcaatcctgtgagttcttgactcagttgctacagtgttgagtggttttggatagactttttgaagacaaaaaactttaaataacattggaaatgcgtgtactaagtgactagaacagttaacaagaatggaatagcacctgcaggtgggatagctgcagagttgggctatgtgtactgtgtgagagggagtgagggagcatggtcttgccttatgttccattggcagttcagaatttcaagagtttcaagcttgtttatattctcatttctgtacttccttttataatttttaagatgagctccttcattactgccaagagtatgttttctttttgcctttaccttgaggctgtcttttcacctgaggtacaaccaatatagggctttaaaaggctggctgcttgttatttcaaatggggaactttatgtataatagtttgctgtcatgtacctgtacttcaaaactgtattaagggaagacaactgtctcaataaaatcaccatgagaaaaattctttgctttgttatttcaaaatgttattgttttaagtctgcctttaatcatagctttaaaaatatttatttgctaataaaagaaaatgttgaatggtaaagtgagtttagtgcccattatttctggtctttgaattttttttaaattctttactgctttaaaaacgataaaataatgtgtctgaaaaatatatattaaatggtcacactgggactgtattttataatagcaacagaacattttattattgagtttgcccagctttatatctagttattatttcagatttattaactaagcactttagagataggaagtgtcatattactctccaacatgtaatattttaattcccataccccttttatcttttaagatatcctgaaactgtattctttcatgtatccaaatttctttacggtgattattatgctcgttgatttacaattaatcaactaagctttattgcaaacaaataaaattttttagtatattttaagacagtgtaaaatttgatttttgcatttttgttgtcagtttgctttttgggctatgtttctaaataaatgttcatttagaactgtctacattcttcagaatgtctacatactttagggacctaatgagatgcctttaagggtatatctcaatccgtatttgtgtagaggcagcactttcttctaaaacgtttaatagaatcaggcaaagccataagctaaaattcattttctacttcaatacacagcaggtagactctctccacacactttcgcctatttggaagatgaggcctagtaataatttgaaatgaccaaaggagaggcagaactcttacaccagagccaagatttctgcctgagtatcgaccatttttcctccaccttgaatccagcatccccctcccaacattccgctaccatcacttctcctgatgcttcagattacaactcttttacccgtttcacccagtctggcaagagctctttctttaatccctgcatttcaggtagcattcagttcagtatatctgtgaattagtaaatataattaattatagtagggagctaacagctattgaatgtttccagtatttgaagcagtgtgctaaatgctttaccagcattatctcgtgtaatctttacaactgtctttgaggtgacagtagttttattatttattttaagttttttatttccataggttttttggggaacaggtggtatttggttacatgagtaaattcttcagtggtgatttgtgagattttggtgcacccatctcctgaacagtatacactgaacccagtttgaagtcttttatccctcaccctcttcccaccctttccccctgagtccccaaagtctgttgtgtcattcttatgcttttgagttgaggtgggtagtagttttgtacagcattttatagatgggaagacaggcttggaagggttaagtaactaacttgctgaaggtcacatagcaagtaaatggcagaactaggatttcaaccttgtttctgacttcagagctcaagtgttttgaggtcttgcttttctgtttccatttgcaaaacagatttaggtgaactgctctagaacagcactgtcccagtaggactttctgttatgatagacctgttccttatctgccctgtccagtacagtggccactagccatatgtggacatcgagtatttgaaaggtgactagtgcaactaaataactgatttttaattttaatttagataccaatatgtgacttgaggctactatattggacagcatagatctagaaaaatagctttttaaggttaaacttataagtatatgcttaaacttatgtttatattgggtaagagtaaactacgaggtcattttgatggtgcttgtagttaggtatttatgttgtgtatgtgtataaatacatatatacataactacatactacgtaactacttgtagtatatatttatttatctcccctctgctatccaccattatattctaaggactcttaaatattgtgggagacaatttaagtaaaatacctttgtcagttctattaattggttagatatttattttaaatttcttatcaaaatgaaagcaatattgcaaatgattgtttttaatacagactgtgaggctactgaaactggaaagtttatggttcagcagtgtctgcagcccagagagagaaataggacttcctcaaggatgtggagtttaaaagcaaaaccaggactagtattcagtcccgatagttcaatgtgttgcttatttcactgatagaatgtggatgcattttataaacttagagaatttagaaaactcataaataaggaaaattgggagttcttatccatgatcatgaggtacattggagaagagttggctgggcgcaggggctcatgcctataatcccagcactttgggaggccgaggcgggtggatcatttgaggtcagcagtttgagaccagcctgacgaacatggtgaaaccccgtctctactaaaaatacaaaaaattagcccggcttggtggtgggtacttgtaatcccagctactcaggaggctgaggcaggagaatcacttgaacctgggaggcagaggttgcagtgagctgagattgcaccattgcaccctagcctgggcagcaagagcgaaactccttctcaaaaagaaaaaaaaaaaaaaaaagagttggatttatttttcctggagaggtgaagggtcatgacagcagtgatgaactgttttcagagccttaacattctttattaagcttattctgtgtgattttggggagtagaactagcgctgctctgttaaagttagagggaaaccactttttttgcttgataaaagccttcatcttcagccagggctttctagagaaataatgggagacatcagtacataatgagagctctacctttagaggaactgaaaatgaatttatttgcttatttcagagagattttcagttattagatgggtgatggtagtactagaattatatttcccagattctggaccctaaacaaatgaagcagatttttatcagcttttgtcctcttcacccatagattgtgactcatttttcctctctttgccctcttgaaaccagtggtaggtaatttatatacttcattggcccacttaaagcagcttgtatacttgctatcagttccacatcttagttggttagtgaggcttttatttccttctttcctcaaaacttagatttgtaggaagaggaggctataggaagaacatgaataaatgagtctggtttgaggatagggattgtgtgtggggtagaaaacaacacaaactcaggacgcttttaaaatttttcttattaaacaatagtcaacacaagacttctgtagccagatgtttgggggtttctcttcatacaccaagcaagcaatcagttcttgaaatcatcaagcaattgaatcagtgtccacaaattcaattctgacactctctacctggaggtagactcagaaactacagattgagggcttagtcccaaaagattgtatccttcttcctaccagtcacaagtccaggcctcttggaacgtctgactgacttgcttcaaattagggttcttgcaaaccccatctttgggtttgtttgattaactagagtgctcacagaactcagggaaccatgtttgccggtatattacaaaggatattttaaaaggatacaagtaaacagccagatgaaaagatatataggttgaggtctggaaggatcctgagcacaggagcttctctacccatggaagtggagtatgctaccctcctggcacctggatgagttcttgttcacctttacgtcagcctccatgtgttcagctgtctggaagccctgctgaccctgtccttattggacctcttatggagaccttattacttaggcatgattgattaaatcgttggccagtggctatgatcttaagcttcagtcccctctccaccctggaagttgaagggtaaggttaaaccctctaatcatgctttggtctttcttctggcaaccagcctctatcctgaagctgcctaagggctgccagccagccatcagtcttggcataccaaaagacatcactttgtacattccaaggattttaggagttgtatgccaggaaaacggggttgaagaacaaatactatttcaaaatatccatcactttgctaggtctcagattattgcatgttgtttcataaataccttttacctgacgtagtcaagaaataaaaatattactgttaatcaaatgttaacatacattgagttcatcatctaatggaaatcttttgattattcatttgtttagtatataccccttcaaatttatcaaactgtgtaacaaactgtttagaatcctcctgatttccccctctttcttttggtcctggaaaaaataatacttgcatcctcaaaaattgaataaatgttagtgaagaaaagttatggtttatttgggatgtgttttccttcctacatataaatgttgcatgagccgagaaatcttaggattaaaagagaagtaaaagtttttaaaagattttaaatgatagaatacactgaagaaatcatttttgctctttgcgcatacattgtttcatttataatcgattaagagacaattatttaaaaacttcgtccaatcctacgaaaagatgaccatcatgtgtataggcaaaggcactattctgtggcacagtttattagagtagaatgatttgagaccaacatgcaagtggtgaactggaagaaggtgacagattcagctgcaagtgctgaagggaaatctttgcctgaaggtagggcagtttcctaagagtggcacagcccattgctttaagcatgaacattttggtgtcaggctcaagttagcaggcgaatgtagccctgcatttgcagtctttggattctaggtggctggttagttggtgagtaagggagactgtaggggtgcagtggagtgagggagttggcaatagcctgagcctgtaggggaaaagtgagatggtttagaaaatgtgagaaagtaggactgtaagagtttgagaatcaggctcccttgactaaggtggggcaggattggacaggaatagtatcagtctttttagtttaaggtaaaatatttgcattcttatcaaagctgttgtacatcacttcagtaaatgctctgtaatagcacggttcataaatgatattaaacagtgttatggtcctactttgcaaacccctgagatctgaagtgggtggaatagaatagataaatttgcattttaagagggggtgaacaaaggaattcagtttactgttttgttgcattaatgtaaaaccctttggaaatttttagagtttatataatagacactttgttttttggatgatatcctaaacattggaacaaaaccttatgcattttactctaaatttggttataaggcacttctgggactacccacatggcttggatgatctccaagtggctttagttattaatattataataacaaaagaacctcattataagttttgcctaaaaggtaaaatggaccccaaagagaacattagaagtagcctccaatatttaagtagcagacttactcagttcttgattatctgcattaatgggaaattaatagtttactatgtagtataaggtgaaaatatgtagtatttaaaaaactacatattcatgggatatgaatcacagatggtattttgaatatattataatggacagagtgtttgaaatactaaattcagggtttaaatagcttctatcaaatgtgtaaatataagtgttataaaatgtttggtaaatatttatcaaaattatcaaatgtcaattatcctaaattgattttttttccttcttcaaattatgtattggccagatgtatcttaactttgaggtcagggggaaaagctgttaaacagatctcatgatttttgagcttacttgggtgtgggttggtgaactggttgctgacaaaatctctgtacagagaaagagtgttgcacatggtttctgtcatcattctctgtgcccttttttttttttctttctttttttattctccagtttgccatcattttgagaagtgaggtgtttggagtgggacatgaccaaactgagtgcagctttgtaatcagccagctggggactcctgactggactttagagattttggtaaattttggttgagcagatctttagttttctgtgtggaaggtagtcagagattgatgttcagttggacacatacattcaaattcactcattgaccttcagctcctccatggtcagccccatcagctgggaatccagctggagagttttgattaatttagaaaatagagcctgcattttagtaagcacactttcctaggtaagagattaggtaggcttaaatcgatatttacgtgttgacagcattgactttataagttagatacagtgggggtggttgggattgatgctccatagtcttttggaggcttgggaaggaggtagggggcagtctcttgctgtactaatctctaatggcttagaataaatgtctctttctaagtgtttattagagttaagcttgaattagggttggatacatgttatcatgttgttaagcggtaagagtttgtcacaggttaagaatagtctccatgtttgataaagcagctagtcagaaattaatagggaaatctgtggataggttcaaaatggtattgggggcctgggaaatagcagataaaattatatttttgaaagaatgtcaggcgctgatgtgttcagaaaatatctcctactaggttaagtgaaatgagataagctaagatacattttgaggttaacattcatttaacattaaatattttctaagggccaatatgtgatcagcactgtgctgtatactggggatgcaattatgaacaagatggaaggcatctccagcctttgtagagcttatgttttagctgtgaagacagactggaacttgtttaaaaacaaaacaaaacagaaaaattgcctttatgatgagctggggaagtaaacagacatcataattgctatgaagaaaaccagggatgagttttagtgtggggttctagttttattttgggttgagaaagcttttctaaggaggtgaaatcttaattgagagcaaaaagttgttaggtacataaggtgtgggggaccattagtattacaaactgcatgtgctgaagctcgaaagcagatagctctgatgttcagggagctagctggaagaagtctggtgtggctggattgagggggagtggggagtgggcaggggaatgctgttgtacaagatgaggtggcagaatgaggttgtggccaaatcaagcagagtttggcttttattaagatcagtctggttgctagattggaggtgggtaaaagagtagatgctgacagtcatcaggtgagagaggatggtgttatagattatggcagtagcagtggagatagaaagagggtcatttgaagtatgttttttgaaggcaggtggacaggatttgctgatgggtaaatggcagagttagggggactgttagaacagagaaagaaatcatggggttgggtttgagtctgttggggaaatggtggtgcctgttttgagatggggaagatttctgggagataagtggtttgatggacaggatcaagagttctgttttggatgtgttaattctgaaatgtctgagacatccaaatggagatgtcaagtaggcagttgaacatgagtttggagctcagtggagagctggaaatatcaatttgaattgtcatcaaagaaatatttaaatctgtaggaaatgatgaatttgtgtgtggaaagaatatagacagacagtaatactcaaaaccaagccctcgtaacattcagaaatgggtgaactagcagctagcagaggagtcctaaggagtttgccatctagggggtaggaggaaaaccaggagagaggtttccatgaagttgagagaaaaagagagtcccctgttcttagtgagtacatctaaaattaataattaatgaaattttcaagtgaatacgaaagtagaataaagttgtaattactttcttcaccgggaaagtaataagtaaataaagactatttagtggcattgagatttcaagagtaatttcttcagtaattttgcaagattattcatattacctactcaaccagactccataattgggctcaggagggaaggctttcccttagagaagcagagttctgttcgtctgaatgttgtccagtcaggctttgggacttaaaaatgcttttgaggattcttaggtccttttttttttttttttggcctgtggactgaacatagctgttcagtgtgtatcattatttattgcctttctcttactatagattatttctcacaggagaagaagttattgctggtagcatgtcagtttacatgtgtctagctcccatctctggaacacataattaagtgtggtcgacatatattcttcttcatttttgccgttgagaaagctgtcagaaatgttacatctggagaacaggaaagactaccctcaaagccagcgttggcctaagtgtactcttaaacatttcctgtggatgtgtggaccgcctgtctctctatctcttcatgacttctgcctgtgtcttgtgtgtgcagaggccaaatagtagtagcagagatggaaaaccttctcctacacatgtgcaccagcatggtcctttgtctctctctttcatttgctcttcaaggcttcgctcaaatactgcttccattctgtaattttctcttcccagcgcacccgtgggacctgttacattgagttagaggcagtattacacggtggtttcttttggagagactggctagactacgtatacatagcctcttggttagttacataccttctcagtgcctcagttccttcatctgtaaaaccacatggggttgtgtgaggattatatgagttaatacatgtaaagcactcagagtagtgcctggcatataagggctcaaaaattgttagttgttgatgctgttgttgctgtttataaggcttgcgtgcatttcttttcttcatttgttttgggaatggtgaaggcatataatgtattattcattatcttcttaatatgtttcatgtaatagacaaatatttttatgtagttactaaggcagataacttctgcatgtcttatttttctctaaaatggtaagcatacatataagtatcttgttacttgtgtgtgaccctagattgcttggttgtcagtatctcttaataaagattttccctttcatctgtttgtagaagcctcatcagctgggctggtattagtaaaaggaagatgactagaaaattcacttggagatcacatggactcttttattattaaattaaataattcatttttcatgtatacaacactcattaattggggttgtgtttattggtgaaaacatttttttcttaaaatgaaatctttaatttttttacattaattatacttagtatgaggcacttttgcttcattcttacaggtaggcgaattgtagaggtcttacgtctttgctgggcctgccaccatcaatagtttaggagaataatagcttttgaaatgtataaggccttacttaaaccaaaaaatatgctttacaatgcaatttctaacagggtcttaattcatttgttaatatttcttcagaacgtgggcttaaattttgttttaaagtcttatacaaactcttgaggggaaatttttttttagtgttttccgctttagtttgtcttttttgatgatgcagctcaacaaccataaatacattcaggactcacaggttgacattttaatcattccatccacaagtactcagaactgtggggacctggaataaatatgagatatggcctcttgactttagtttataatctttattgttgaaaaaagcctggttcccttgaaatagttagagaaaaatattggaaagcatatagaaggaagtgtggtatagtagtaagataattcatctagtagtcttgttcatttattcactaaaagcctgctgagcactttcatctccttagtgtcaaaacctgagttttgtcacaagatccgccactgtgaaattgagcaagtaccattcctttaccagatttactccacctgccttgtaggatcatacatgatcatgtatatgaaagcttctagaacactaaagcattgtgcaaatgtaaagagttatataatgttacattgttcgggagaggccatgcctgtggtagcagttaaaaggaacaaaactttgagagttgaactagttaggttgggtgggattttccccttaagaaaccatcatcagtaaaggctgttttttaaaagctagtatataggattaataaagtacaggttgagtatctcttacctgagatgcttgggaccaaaagccttttggatttcagaatttgaattttggaatatttgcatattcataatgagcgatcttcaggatgtggcctaagtctaaacatgaaatgcatttatgtttcttacacaccttatacacatagcctgaaggtagttttatttctcccatggggacgctgaataaactgtgtattgtgtgcctgcgatctgactgggacctgccacatggggttaggtgtggagtttcccacttgtggcatcatgtcagtgctgaaagtttttgattttggagcatttcagatttcagcttttcagattaggaatgttcaacctctagccggagaaagaagatagttttctataagatggaaaatttatccagtcatgcctttttggaacatgcgtgaatttgttgagtaactgaaatgtataccttcaggttcctaaatttaatttatgtgagataaaatttgtttctaagtagttttatatttccctcttctttgaaacagtatgagtttaacattttcttattagtttaggacctcattctcaacctcagttatgataccgtaatatagtgatcaattatggaactactaagttatcgaggtaataggactcttgtctcatgccctaagaaggacttcaggctgcccatttaaaaaaattgagatataatttaaataccatacaattcactcttttaaattatgcaattcagtagtttctagtgtactcacaacgttgtgcaactgtcactgtcattacttccaaaacattttcatcatcctagaaaggaaccccacatccattagcattctccattcccccctcccccccagcttctggcaaccacgaatcgactttctgtctctatggatttgtctattctgggcattttgtataaatggaatcatacaaggtgtggccttttatatctggtgtctttcacttaacataattaaagcatttagttttataataaaaaaggctaggcaaataattgagtggaggttgggaggtttaagagattccattaaagaagaaggtgaaataagggggagagatgagatcagatgaagttcagatttagcaaacattgagtattacataagccaggcactgtgctaagtctgttgggtgatagagcagaagaggttctaaaagatatgctgtttttccatcctttgcttgatgatttggactttgagtagaaaggacagttttatcctcttgatgtacagaattacagaatgaattctttgaaaaggagtaggaaagcagatcagtcagcttttgcttagtatgatttattcctcttttaaagtgtaatttctgtttctacctagtttcaagtaagttttgaggcatgtagggctctgccacatgatgccagccttgtcctggggtataacttttttatggatcataaaggagcctggttaaagtttggaactattatagactgggagaataggcatctcaataatatccctttataccttactgcttattatttaaggttaggataattgggtaaacattcaccattcacattttattagctggtaactacgctttctcatttattccagagaataaggacagtccttcctttcgcccaattttacttgtttttctaaattttatttctttagcttagcattgcttacagggcttaattaagttttgtttcatactgttctggagctatactagtggattacccaatgaaattttttttcctatgtggtaaattgttcaaacacttaccaaataaacagctaacttgggtaatactttatgacaatgtgtagctgcatggcagtgtgcttttactatcaatactcagttctggttttatcatattattcttaataaatagtaacaaccaagttatttggtttagggagaaaatctgccatgaggtatctttgtgtctgtggcacacagccacactgtttatgccattatgaacctgcaaagctcactgtgtctgcagtgaaagctgcagatgaaatctgataggatctcttggcattttcacttctacgattatacattgaatatagggatgaattaagccctttgtattgttgagctgtgattaagattactggatagcttaagtattttctctttttgtccacatacccagtaacttgggtcaaaattattaatccattagagtgtatgcagtaactttttttcttttgtagtgttgtgacctttaatgatggagcatttcatagatgtgctaaatgaaggttaataacggtgaaaatttattatattgattagctacttatatattaacacttaaggtttaattttatttaaattttatttttcttaggctgtctgtaaaatcttctcatttaaaatttagcttctgtggataactgtttactcattgccccatatgaatatttaataggcacttcaacaagtccaaaacaacttctgcttcccctcccaaatctgcttcacccagtctttttcatttcagttaatagcaaatctgtctttccatttaggagtcattgattcctttttctctctcactctacgttcattctgtcatcaaatcgtttttgtcctaccttcagaatacatctagagtctaatcacttcccactttctccattgttactattatggtccaagccgtcttcatatcttgcttgagttattgccacaccctcccaacaggtctcccttcttccatccttccttctatatagtctattcttaatatgacagccagaatgatcttttaaacatgaaagtgagatcatattactccttgtgttcccattacaatggcctttgagagtgatcagggccccctttgtctctctgaccttattgcttattctcttgatcactctgctgccgctacgctggcctcttccctgtccctcaaatgtgccagacatgcttccatcttagggtctctgcactggctatttcctcaaatgtcatctcggtgaggctaaccctgatcaccctacctcaatacacccaattatttttactccgctttttctttccgtaggagttaacacctcctaacatttacttctatcagtttcttatgattaactgtgttgtgtattccctcccattagaatgtgaatatctgaaagacacttacagtttgaaaagtgcctggaacgtagtaaatgttcaataaattgcacttcattgatatttattggcaacataacattattaccactcctcagaagcctgccacatcttccctatcatttatacctctccccaagcctgatgtttttgtttcttgtcttaatatagagacaaggtcttactttcacccaggctggagctcagtggcatgatcatagctcactgcaacctgtatcttttgtgctcaagctatcctgctgcctcagcctctcaagtagctgagactacaggattgggctaacacacctagctaaatttttatttttatttttttgtagagatggagtcttgctgtgttgcccaggctggtcttgaaactcatgacctcctgccttgacctcccaaatgatcctcctgctttgacctcccaaagcactgggattataggcatgaatcatcaagcctggccaagtctgatggtttttaaagttgtttttagtatgattgaatatgattctcatacaaataaaggtctgctgtatagtagtaatctgttgcatagaactttgttcttcaggtgaggtgtgagtcacatccttttatcttgtttgttttttttccccgccccccgcccccccagtatagtcatgagcagtccacaaagccaaaatatacattgaaacagaaagactatttgttaaatttatggaaatatgttttaaattgtttctacaatcttctttgcttctaagaattcaaatgtcacaggaataaaagctttcaccattttaccagaatctgtaggatttagatgatggtcattttattctgttgacagtatggagcactttgcagatggatatcaggttaattgttatattgaaaagtgaaggagtacattctactaacagtctttctgctgagaaaaatctaattattgccattaaggtggcattaagttagtaaattgggtaaataaacagttaaaatccccaaatttcttataacatgccataattgctttgcttgaaaatagttatcggccaggcgcagtggctcacacctgtaatccctgccatttgggaggctgaggcgggaggatcacctgaggtcaggagttcgagacctgcctggccaacatggtgaaaccctgtctctactaaaaacacaaaacttaggtgggtgtgttggcttatgcctgtgatcccagctacttgggaggctgaggcaggagaattgcttgaacctgggaggcggaggttgcagtgagctgagatcatgccactgcactccagcctgggcgacagagtgagacgctgtttcaaaaaaaaaaaagaaaagaaaagaaaagaaaatagttatcactgaatagaaatataagatgatcaaataactattgaagttaaaggaaactacaaagaaaatctccaaaggacgccatcctagtttgtttttttgttaagcactattcacctgctgcactagagccagcaatatggacaaacaatactactactaataccattatttgttaggcacttatgaggtagcaggtctcatgcttcatcttttatgctcccagcagttctgtaatggcagagaatagcattttgtttttctaaatacattcaatctctgagcctcagtgttcccctcagacctctcagatcctgggccctttaccctacattttatggcccgcttccctttctgcttctttctgatcattttattttgtatttgatgttctgagttttctctaaagaacaacatatattcgttttagattaatggctttaagaaaatcatttattgttaagaatagtacagttttgtggctcagcaaaaaataattctactgttcagccataatcattttggcaagtttacagcctttttctcaagcgttggttagattaactgaacttctgaatacctttgtggtattttaaaaatctgaaatcacttgtctacaaatagtatttctttttttttttttggccttaaagttttaataatgaaatttttctatgtagtcctctttaaaatatttaagtatagtaggaagcagcagagtttgttccacctaatgtcaattcagagaacattttacattttatattaaaattatgatgccttaggatcgttcttttacctgtgtatttattcattttcacactcgggagttttagttgccactccatatcagtggcacagccatgatgatttttcccttgtccaatcatgaaggtttaaaaaaacctgtacagtttttagtctcttattatgatatcaattaaggtgattttataggaagaatatcaattaagggtgattttataggaagaaaaatgtaccctgcatttcatttggaaaaaaaaaaagaatcaactattaaatgaggaaattaaaaaaaagtttaggtttaaaaagaaacatacttaggagaaacttttaagctgcatatgccttatgtgagaattttaaccaagaaagactaaatgatcttttataattatgttgtcaccatatgtttgcagattcatatttgcatacattatttatatataaagatagattagtgtctagctttatgtgcattccattttgtaatacacattcttttagcaggttatgtatgtcttcatgcagttgacttttctgtatttgtgtgctttagcctccttaatgaagatttttacagtcaaagtggaagagggccaactttttattgttagtacagcaacataattaactatacaaggtttgtttattatagctgagtactagaacaatgcttcaaagaggaaaacgtacagagaagattagtaaataacatagcaatgtgtgaggctggccaattgtaataatgcctttattgggtggttcttgaatttgtaagcacatgcttacatttttcagataataggaatgaaaatgtgtaattttaattgctatttctgttgcatttttataagaaaataatggaaactttgcttggatgaatgattgtattggagaaatgttttgtatactttggttctgaaatactttgagctcttttatacaaatgaatagtgttaggtaagactccaaggtacaaattgtattactgctgaatcagatctgaagaacagtgataaattgcaatgatttatttaattatagaataaaaatttgcagtcgggttaataccatgcagctgatttagagctttgttcatcccacattttctgggaaggtcctgatttcagatactccttattttcttcttatgtaaatacatttagaaatgagaatatcctttgggcttattacggtctagtaaatgtcattaaccaatattttaggtactgtggagatacaaaaaagatgagatagtggaaagatgttgagattgtaaccatttacataaaaatgggagggtcataggaaaaaactccatagagcacttactgtctgataaaagagggtatataattgataagttttacaatgtttgaaagaagatgcaaagaaaatattgagttctcatatgtggtaaacattatgctgaatattgtcatattctcatttatttaaatttcacatcaccctcattttatagttggggtgactgaatctcagagagtttacattgttgaaggtcatacaaagccaaaattcaaatcctaactgtaaatcttattttctttctattaaatcattataaatgaatggaaacccttaaaggatataattctttcaaattgactgaattgacacaaaatattggatatctttatttaaatactacaactaaacttaataaaatatcacaggccgtatttagatcttaaatttattcaggtagtaagggacctttgatatccatagtaatagcatgaataattgaagccatcaaagtaataagccaattttgtttagtaataatatattagagtagaattttacagttttaaagggcaccatcatatctgttatcttagcatcttaaaccttttatgaggtctaccaaataattggttttgtttcctcttgacctttgtaaaatgaagaaaaaccatgcctctttgagttcataaactgtgttttgcatatttacacacatacatcttttatcctcccaccaattatttgacctgaggttgaacacttaatggataagtaggtggataaaatgataagtaaaataacacatttaaaaaggagaagcaggagacttcaggtgaatagctacccataagttgttgaaaataatcaatatttatatttattggcatccagtcaataaatatatatgagctagtcttgttctatcacccaagctggcatgcagtggtgtgatcatggctcgccgaagcctccacatcctgggctcaagtggggctcaagtgatccttccacctcagcctcccaagtagttgggactacaggtgtatgccaccatgcgtggctaatttttttttttttttcgagatggagtctcgctctgtcgcccaggctggagtgcagtggcgcaatctcggctcactgcaagctccgcctcccaggttcacgccattgacctgcctcagcctcctgagtagctgggactacaggcgcccgccaccatgcctggctaatttttttttttttttttttttgtatttttagtagacacggggtttcagtatgttggccaggatggtcttgatctcctgacctcatgatccgcccacctcagcctcccaaagttctgggattacaggcatgagccactgtgcccggccatgcctggctaatttttttaaaattttttgtagagatgggggcctttccatgtcgaccaaactgttgttaaattcctgggctcaaacagtcctcctgcctcagcctcccagagtgctgggcttatagccactgcacctgaccagtaaagatattttgagctttgagtagtacctggttattatcggttaaaaatgaaacattttataagtcttttgttctattgaaaaaccacagtggaatatgtgtgtcttccccaagaattatgacaaagcatgtggatcattgcctggcatatagtaggtatttggttatttattaagtaaattaaaaaccacaatgtagactttctggacttaaaaagaaaaaaatagagacggagtcatgctgtgtggccaggctggtctcctgagctcaagggttcttcttgcctcagcctccctagtagcttgggctacatgtgtgtgttaatatgctcagctaatttaaaaacgttttttattgtagagacagagtcttgttatgttgcccacgttggtcttgaaatcctagacccaagcagtcctcctgcctcagctcccaaagtgcctttctgggctttttattcttttttgattttcttcagaaagccagttcctaaataataaaaaaagtaaaagaatttatttattctctttttattccaatttattaattaatactcaaatattaatgtaaaactaggttggtttcatattgttctggtactgtattgtcttattttttattatctgatatctgaatcagaaaataacctagttacatattatttagtctctgagtgtattttttttttttttttgagacggagtctcgctctgtcaccaggctggagtgcaatggcatgatctcggctcaccagaacctctgcctcccgcgtacaagcgattctcctgcctcagcctcctgagtagctgggattacaggtgcccgccaccaagcctggctaatttttgtattttcagtaggacggggtttctccatattggtcaggctggtctcaaactctcaacctcaggtgatctgtctgccttggcctcccaaagtgctgggattacaggtgtgaggtattattttttaagtaggagtatttggacctaaacaggcagaattcttcaacaaagtacaatgaaaggcatttctttgacagtagcctgaatttggaggctcatttgcaaaggcactttccactgccactctaccccagaaattgcttatgaaataattctggcatttactccttcttcctcccctcccccttttattaaagagactagcttgtacaaagtcatttgcaaattcatttgtggttctccattttgattcagatagcaactctaaagactgagttataaaagtctttagactttgcagtttaaaagaacgataatattaccatgtaaaaattctgattagcataaagctttagaaagtccgttgcgtataccaagccaagtgcatttttgtctccaattcccaattctaatcaatttcgtcctcatttttcactattgcaaaagtgtagatcatgatgcccatcttttttgtagtcgagtacattttttcttccatcaaaaaagcaattagtgtcctgatgtacttcagcttcacacatttctgtagatgatttgatcaggttgttgtcttcacgacagacatctgattgtttttgaatgtgggaacactccttagacaacatggccagaattaacccacatcctcactggtgttccacaccttctcatatgtaggagaggaatttctctgtcatttccctgagactgcaccttaattctctactataatccttgactgaaggaaaagttaggcgatcaggtggaatttttaaattgttccacaaaaaactgagttctgctagctaagtggaatgttgagaatttagaacattcagcacaataaaatataaacattaaatttgtatggcattagaaccgcctttagaatttttagtggaagcgttagatcacatgcatttcactttagttaatttctgtaaattcaactatgtatagtcttctttacgaaaaggagagaacatacttgagaaatataatttaagagtgcaagtgagagtcattcagccattccttttattctgatcagtgaatgtgtgtccctgagtgagagatggaagaagtccttttagttcttgattgcatttcatagtgtgaatagctcccttccctgacagtgatttttagtctttcctaaacttagtcagctacttcatctgttattcagccgaatgaacagtgagtgatctgttgcagtgctagaggaacattggctgttttggccttattgaagaatacttgaccgactgatttaagagctattcaaaggtaattttgagtatgcaatttttgccttttgcaactaccttaggaccttattctggccgggtgcagtggctcatgcctgtaattctagcactttgagaggctgacgtgggaggattgcttgagcccaggagtttgagaccagcctgggcaacatggcgaaaccttgtctctccaaaaaatacaaaaattagctgggcatggtggcacacacctgtagtcccagctacttgggaggttgaggtaggaggattgctttgagcctgggaggcggaagtttcagtgagccgagattgcaccaccacaccccagcctgggcaacagagcaagaccctgtctcaaaaaaaaaaaaaagaacctaattctggagtaagatatgactttaccataatttgtgaattaaggattaacaaggtcagcagagctgaagccaagtgaaagcatttgagaacaaatgactgaaaaatactggatatatggtaagatatgtgtagaaaaagaactctttaagcaattttcattaaaagcttcttagtatgttttccagatactaaaaattttggtcactggaaacaattgggaagcaaagagattgattcaggataaacgtagttaaattagccaagattagggattccagtgaccttgaaaataaatgtgtagattaaaattcaggttattttaatttgatggctaaaataaaatgtgtgtattaactcagatttttttttttttaaattttgagatggagtcttgctctttcgcgcagactggagtgcagtggcatgatctcggctcactgcaagctctgctttctgggttcatgccattctcctgcctcagcctcccaagtagctgggactacaggcacccgccaccacacctggctaatttttttgtatttttagtagagatggggtttcactgtgttagctaggatagtctcgatctcctgacctcatgatccgcctgcctctgcctcccaaagtgctgggactacaggcgtgagccaccgcatccggcctaacagaattttaagaatacatattcttgaatgattgcagagtaggtggtaagttatatgccagacactgatctaagtggtttgcctgtcttacccctttaatctaggagggtagatagatgctgttctgggagctttatggatgctagttctcagtaactctgagtaaggactgttgttaccacaaccttgcaggtgagaaactgcaatatagtcacaattagaaacttgccaaagtcacagccattaagtagataagccatgattcagatcaaaccacctggctccatttcctgtactattaacctatcttctacgctggtctttaattctcttttacattattattgtctcatctgtaaaggttcaaatgcctactccagttccttgaagtggctgctttgaggtttctgagaccaggtctatactcagtaaaatttttctgaatttgtattagaggttgttttatgaacatgagattggaaaaatggtggcatgaactcacttctaacttcatatcaaactagatcaccagaaaactatttagtcctatattttagtattgtttcctcatattctgtcaatttttgttagatgcatttgtatgaagaatatttctgcatctgcgatgaaactattgaatgcattgtctcttatgatactctgttccctttataagaattaatgtgataaattattcaagaatttagtttcagagaaaagtttctttccttatgatatggcatacttccttctatcagtcattaagaattatatattctgttgagtttttctgtttgctttggctgcaagaaagcttggagttatatgtcacttcaattatagtaactttattagcctaggcttctgatatgggtaatttcttctcagtcctctgtggcaggagtatttatttattggagacagagtcgcactctgtcgcccaggctggcatgcactagcaccattatagctcactgcaaccttgaattcctgggctcaagtgatcctcctgcctcagcctcccaggtagctgggactacaggtgcatgccatcatgcttctaattaaaaaaagattatttgtaaagacagggtcttgctatgttgcccacgctggtctcaaactcctgggctcagtcctcccacctctgtctcccaaagcactgggattactgtgcctagcctgtgacaggagcttttaattcatcgtgtgtgtatcagcttcagggagctgatgaacccttctgaaatgatcagtaaacttgcttgtgtgcaagcttgtgtgggaatctgggggagcatcgttagcttctctcagattttccatgacctcctcccaacgcccccctcaaaaagatgaagaaccgttattctctgggttgacttttcattttatgttataatggtctaattgtgtatctcttattgtaagcctctggtagtctctttggtgatagttgggctattaatcatacatttacattcgaatcatcatccaatttctcagttgtcagaaagttaaagagcagcctctctgtaattttaaaaacatgcagtcttggaaacttaagaaagttgtcgacatgttcatgcaacccatgtacctactatgtttgttttctatgaaaggagcttgtctctcttaaattaccttaaataagtaatagtaaattatttgtaaagtgattcattattaacttctgtttagaattaacatattcaaaccataaagcatgtatgcaaacagtattcccatatcctttttctttgttttttaggtaagcagaaaaagttataaaattataataatctctctcgactatttatgtattaggagatccaactcttccaaaaaacatggctagggtaaggttaccagcaatgatttgctatacccatacatttataggcaaatgctataccattagaggaaaataaagccagtgctgctaacctcatcactcagattaatttccacagctgtcattttaacagtgttattataggtcttcaaatgaaaattatgttaacaggtactccacataaatgtgctgtaatccaagggggcacatgtattatatttttgattgtagtaagctttttggcctaattgactatttctctgcaacaaaaaaattagttaaactggaaaagcataataaagctatatgctctttactaggtgatatcttggtggtttaaatttacaagttgtgtatacatacatattttcctgttgaagacttgatgactgactgaaaatgtaccagggtgtcatcaccataaaagttgttgcatctatgaactatacagcagtgtgtatgatggtgtgagttataataaactattcattagttttttgctgcatagttttaggatgctgtaacagtgatcttgaggactatgacttaaaaaaatgaataacactatcattcagcttgctactctgcagacaatgtgtatgaaaaagaatttgtgtgatttaacctcagacattaaaattggtttgccagtaaaacaaaacaagattaaaaaaaatttttttttttaattttttgagacggagtctagctctggcgcctaggctggagtgcagtagcacgatctcagctcactgcaacctctgcctcctcggttcaagcgattctcctgcctcagcctcctcagtagctgggattacaggcacgtgccgccgcatccagctgatttttgtatttttagtagagacgaggtttcaccatgttgctcagtctggtcttgaactcctgatctctggtgatccacccacctcggtctcccaaagtgctggtattacaggcgtgagccaccacacctggccaccagattttcttaaaccatattatttatgtccccgcagtagaaagaacacatcaaatctgcagcattgccttgtcattcattatggagtgtattttactttcatatctaaattgattaatcagcttgtaaagagactagtaagaatccaataatggctgctgttttctaaattttatcttttaataaagaatatgtaagaagcatttattgaatgcttagcatgtgaaagatactgaaataggttctttggaggcatgcagagatgacatattccttacctgtggtttaagggttaaatataaaagaaaataaaactaggagaaaacagatttggaggctgacttctagaaatgttagaagaaattataaagaaaataataatcgatttgactagataaaattacacactaaaatgcttttaaaaagtatgtctttggtgaagagggaggaaaagaaaatactccacaaaaagcaaacaacaaactggaaaaatgtattcacagtgagacaggcagagaatgacaaaccagtaaaaatacccatgatgactgtgataggtaaatgggcatagtacacaaactgttcacaaaggaggaaatatggttagtaaacaggcatgtgggatatgtgttcagccttgttagtaatctaggaaatgagacttaaaacaagaaattgtacatagtgctgctgaaactactaccattgctactggactgtgaaaggtataattctaaattgaaagcacattggtactgtgcttcagtagcaacaaaaatgttagttcataatctttaattcagtaatttcatataaggggctctagcttatggaaaatgataaaaaatatggactgttacctgtaacaatgaaaatgtggaagtgaacaatattatgtgaagagaaatagctgagtaaattaggattagtccattcattggatggttatatatccaataaaaataaataggcaaggtatatagtagtatgaaaagatgcatatgaaaggactagattatatgtaaattgtgattatgagtttataaagtataaatatgaaaaatccctagaaaaagataatttataatccttgtgctacagtaatgagttgcaggtgatctttcttctgacctctctcaaatagggtatattaattttaaaatttaaatttagatttgtgattttaagaaaatttagttctagctctcaaggaactgccagtctaataggatagaactacactaaaaagaaatgtgctattgacatgaaagagacataaccacatgttctgagagtaccctcaaatatagttttgtattttatggagtgcttataaagtctccaggcatatatctggtggtgggaatgaattaagatgaataactgggtccttgctccaagagacctctgctttagttgaagagactcatttttgcatctaattagaccctgataccaatcacactttattaaatatgccaactgatgcttacatcaagaatgacttgaaagcatggggaagaggtaattttgaccaagggatgctgggttaatcctgggtttagggaacatctggttgcccagtttctggaagtgtgcgtaggtatttgtggggcagtaataggagagtccagtagccggtgtttaagaagctggtccaggctagtttgtgcaagttcctagaaatacagagatgaaaaagcctgtgttctcaagggacatgttgaccagtgtgggagctaataattaactaaaaatccagtacattggcttaaatttgtatgttaaggtatatctggcttcattgaaattcctattcacaaaattctcattcaagatattgtgttgttctaatggaaattataggatactgtgggattatatggaaagggtttgggggtgtttgatcctggctggggaggagtagccaagaaggacttgctataggaggccacagtgagctgggttttcaaagataagtagaaattagaagagagaatggatgtgaggggaagaggaagctggaaaggcagggtgtggccagataattcttaaggtccttgtataatcttaaagggatttaggaactcagcttctttaaggctttttttttccccccttatgtctcatgatatgttagtaagcatatggccatgtttagaagaaagtaatgaaaaggataagccagtgctgcataagtggtttctgaaggcatataacctggccatcttaagaacagttcgttgagaaattgctgagatcagtttaaggagtaacttcctttttttttttttttttttttttttgagacagggcctcactatgttgcccaggctggagtgcagtggcgtgatcacagctcactataatctcctcccatgctcaagcgaccctcccacatcagcctcctaggtagatgggactacaggcacacaccactgtgccccgctaatttttgtagttttttttttttttggtaacgatagggttttgccatattgcgcaggctggtctcgaactcctcagctcaagcgatccgtgttcctcagcctcccaaagtgctgggattacaggcgtgagctaccatgccaggacaaggagtaatatttatttgactgttttattaacatcaggcacttaaaataacgcagtgtagaagagaagtaaaagatacaggcttactatttattaatgatttgctgtgtcaacagagagcaaacatttagggatttagtgaggcagctcaaaggggattgagaaataaagttgtagagtcaaagtagagagaaaaagggcatttccagataattgacactgatctaggtgggaagtgatcagtctaagctctctcttttttctattttacagaagtatgagcttctgaacattttgccttttatcacatatggtacctctgtcttgattttcagcagatttagcaaaaatctaaactattttactattggatacatatcacagtatctgggaataatcatactctccagcaaagcagcttctggccatgtgcagtggtgcatacctgtagttctagctaccctggaggctgaggcaggaggattgcttgaacccaggagtttgaggctgtggtaagcaatgattttgcctgtgaatagccactgcagttcagcctgggcaacacggcaagactctgcctctaaaaataaataaaagacagcttctgagagtatttattagtaaacttgctttcccaaaacagcttttgagtttagttctggagacagcactgtgctgcctatcatagaccactataaagagatcattctgttttcctgctctttagaataaagctagcatatgagttgcaaccacctaatttttctttcgttcttaatttctggttacagagttctttttgggatacacatgctttttagtgcattatgggaaagacttcactgaagttaataggattgtatttatagtctcatcatgatatttctaattaaaatgatgattgtttattttagccatttgtacatctaagtaaaatattgttactgccttgtcatatttgaatacttgggaatttatagaactgtttttattagccttttaaaggatactccgtaacaaagtatacgtgtgtgtattttcattatataaactaaaacttttgcattgtaatttttgacaaaaaaaactgtagcttcaaactatattctttgagcagtatgatttttaattaagaacattaaagttcttagttataaattttaaaaagcaatgaaagtgatttgttgaggttatggttaatttctttgaaagcaattaataaaatccctttgaaattaggatttatatattttcataattcttaagactaaggtcagtagcatgctgtattttctcttctgaattctttctacattttaacacagtgcgttacatatttgatttttaatctttcacgtgggagctttatctacttatctctaaggcctgcatgcgtccttgctctcacacacgcacatataaaatcactttgtccttattactgtccattccattttcttctccctgaggttgccagaaaggcctctggtctagcttgagtaatatgcagtctgtttcagttcttcctaacctgcctgcatgttttgatggaacaccaggcacttatgtaagaatagaagcctatttatttaggtcgtgtgaaccacgaaggaactggcaccaacatattcatttctcccctttgctacttcaggtcttgagaagagtgtgcttttatggaccatgtattcttttctctggatggatgtagcttgtgggagaagctattgtaataagttcttctgaaccacagctcttctgtgtgggtcttcatctttcaggagactccaaacctgaactgtaatggtttcatgttatcatctaaatggaatggatgtaatgacacccagagcacatggctcaggctaagatctttcttggtaatctttctctatccagctcttcatcagagcaggactagctcttcactggttccttgactccaggactgtgaaaccaggaaatgaactttccttcttatatttctgcttctgcctaagggccaatttcataagtggaggtctgcaacaaaatagatgtacttaagcaagatgaagctccattgctttatcttgcttaagacgggtttaataggaatttcttctggctgtttcccgtgccccccccccccccccacttttttttttttttttttttttttaagatattagagtctcatgaggcccagactggactctaattcctaggcacaagtgatcctcccacctcagcctccgtagtagctgggactataggcacaggccaccatggctggttttactttttttttggttcatggtacatttgaaaccaaaacatacccaatatctagtcatattaaaattacttttatctctctctctcttaatttggagaaaatagtattttgtgggaaaatttatagtatataggctggcatttgctttactctcacaatcctataggattataaaattagaattttatgaaatatcctatacttggtgtaattccttattttctgtatttttgcttttctttcatttagatctctttcgtctattcctctactatcattaaaaaattatcttcctaggagaggtgattattggaaatggattaaaaaaaggttaatgagaagagatgacaatacatatgtaactatgtgattggctctgtaaagtatgaataattatactaataatggtggttaagcctagcataggaatgggattggaatgctagcaggatggaatggcaactaaatatgcaagatgagaccatgttattgagcacaccgaaggtaagatcaagaatttacattggattagagaggcaaaacagtcgattcctcacaaggggagcaaagatggtgactagcagatattttcggtaggacaaaaagggagagcgatgtcaccagaagttgagagtagaaaaagagaaaggatgagtcatggtattggaaatagttttgatggaagtcatgttaatagtgatagtaaagagaagaaaaacaatttaaacatgttcgtatcaacggactttagtatggcctgttgaaaaaagtcacctaacctactgcttttgaatgcattgattttaagtagtttgcctttgtatatcagttttgttaataacaacgacagtaaaatgagctgtctacccaaaatttagattattatgttgattataacaaacatctttattttggtaatgagcttataaaaatgaatctaggtcgggtgtggtggctcacgcctataatcccaccacgttgggaggccgaggcgggcagatcacgagctcaggagatggagaccatcctggctaacatggtaaaaccttgtctctactaaaaatacaaaaaattagccgggcgtggtggcgggcgcctgtagtcccagctactcgggaggctgaggcaggagaatggcgtgaacccgggaggcggagcttgcattgagctgagattgttccactgcactccagcctgggtgacagagagagactctgtctcaaaaaaagaaaaaaaaaaaaaaaaaaaaaaaagattctaaccccaggaaaggagaaggtatttgtcataattgtcataatgttttgacttatacaaaataagactttttctgaaacacagaaatccttgacagtttatttctttaagataaccaattttatacaggtgaattcttttaaaattgaacattgtagtggaaaagacgtcacaagtcactttagggtatggaaaagtgtggaacaggggcataaatattaccaaccagcacttctgcgggcagtcttcccacatccagtgaggccccctaaatcactgtctacttccttgtatatgtgtgtgtgcgtttgtgcacatgcatgcatacatgtgttcatggccatgaactaggagttatcccaagtgtagctgtgctcgctaagtcttatatttaagttatcttttgggcatggtttggcaagaggttaggtttttttcccttttctgtaaatatttagtgaaagcactccattgtttgctactgaatttttttcttatttttaaaaaagtattgtttgaaaaccttacatgatggcttgcatctgtaattccagctacttaggagattgaggcaggaagatcactatggcacacatatacctgtgtaacaaacctacatgttctgcacatgtatcctggaactttaaaaaaaaaaaagtcttgactcaaatattgtaatttttcttggagtaaaatttaggggccaaaggctgtattacatgtgtgaatataacatacagaaaaattaccttacatcatatataccctgtggaaattatttggatgattcagcgtattggaagaggttgatggggccctaaccatgaaaaacttcagtgtaagattttaaggtaagaggaccctcgagagttttcccaattctgaaacaaaagtgaaattcaccagctttgcctattaacttttctctgctttatagtgtcaataagaggtgtggatggaaacacatggaattagatcagtagactgcaaaatcctgcttaagttcattaaatatagtactagtctggaattctcttttctcacaaaagtaaattttttaaattgaaatgttgttatcccttttatgtgatttaaaatagagtttaatctgacatccctggtttatctttttgattcatcacaatggtgtcctagatgtgtatacaacattgttgggttaaaaattactgatttgtgtgtctttgaaagcatctgaaaaggaaatttctaatagttcttttttgtttgatgacacattataaataagcctaatggatatattatgcaatttaaaaacagtattgtctaatccatttattatatgtttataatgctatatattttttaatttaaaaacatttgtaaattattagcctgtgccaaattgtacttgaattattttcagtctgccaagaatgtttcattctgtacttttaattaaaagactgtatatgaaaacccagaaaatatgaaatgtaggatatggaaatgatacagttctttaaaccaattatgtgtaaaaattcacttttttgaaacagcaagacagtatctcatgtgatattgtccctataatctaatttctataatttaatggaacttatggcctgtacatggtttactcctgtaatcccagcactttgggaggtcgaggtgggaggattgcttgagttcaggagttcaagaccagcctgggcaacatagtaaaaccccatctctacaaaaagaaggaagttagcgagcatggtggtgcatgcttgtagtcccagctacttcagagactgagcctgggaggtcgaggctgtggtaagctgtgtttgcaccttggcagtccacctgggcaacagagtgaaaccctgtctcaggtgggggttggagggagacagtaatggggctgggcgtgatggtggctcatgcctgtaatctgagcaatttgagaggctgaggtgggcggatcacttgccaaggagtttgagatcagcatgggcaacgtggcaaaacgctgtctctaaaaaaatacaaaaattacctgggcgtggtggcatgtgcctgtagtctcagctacctgggaagctgatgtgggaggatctcttgagcccaggaggccaaggttgcaatgagtagagattgtgccactgcactccagcctgggtgacagagcaagaacctgtctcaaaaaaattaaaaaggaaaaaaagaaaagtaatggaactcagtatttggtaagcagtgtaactgtggtagaatttttttttttttttaaagcttaggaattacatctgaaagtcttttaaaaagtataatattctacttagaaattcagggtcatttggaatgcattggtaccagaaaaagtttttgttttccttttctcatttctccctccagcttttttgaggtataattgacaataaaattgtgtatatttaaggtatatgacatggtgatttgatacatgtttatattgtgaaacttaccgtaaccaagttagctaacacgtgtatcaccttacgtagttaccaattttttttatgtttgtgtgtgtgagagagaacattaggatgtactctcttagcaaattgcaggtatacagtatagtattactagctatagttaattatgctgtacattagatttccagaaatttttcatcttatacttgaaggttggtaccctttaactgacatccccccatttccccctacctttagctctggtaaccaccattctactctctgcttttatgagttcaactgttttagatttcattcgtaagtgaaatcatacagcatttgtttttctctttctcacttcacttagcataatgcgcttcagaatcatccaatgtgtagcaaatggcaggatttccttccttttttaaatgggtgaataatattccattttattgatatatacacacactgaattttctttattcatttataggtgtatgggcacttaggtcatttctatatcttggctgttgtgaataatgctgcagttaacatggagtgcagttatctctttgatattctgatttccattcctttggatatagacccagaagtagcattgctaaaacaatgttctagttttaattttttgaggagcctccatattggtttccttagtggctctaccagtttacattccccacaagaattgcacagggcacccttttctccacatcctcaccaatacttttctcttgtccttttcataatggccatccagtatctctttatggtttggatttgcagttccctgatgatagtaatgttgaacatttttttcatgtacgtgttggccatttgtatttcttttttggaaaaatgtgtattcagggctcttaccaattttttaaattttagaaacagagtcgtggtctttttttcaggctggactgaagtggcgcgatcatagcccattgcagccaactcctgggcttaaggaatcatcttgcctcagcctcccaagtagttaggactacaggtgcatgccaccacacccagctaattaaaaaatgtttttttgtggagatgcggtctcattatgttgcctaggctggtctcaaacttctggcttcatgcagtcctccgccttggtgtcctagagcactgggattgcaggcatgagccaccatgttcagtgtaggccattttaaaatcaaattatgtggggtttttttttttgctattgagttatataagctgcttatatattttgggtattaagcccttattagatgtatggtttgtaaatgttttcttccattccatagattgtcttttcattttgttgattggttcctttgttatgcaggtttttagttttatgtagttttatttgtttatttttgcttttgttgcacatgcttttggtgtcacatccaaaaaatccttgccgagaaaaatgtcaaggagatttttccatatgttttcttctaggagttttatggtttcagggtacaatgtttaagccttactgtggtcttgaatttttgtctttagcttcagaaggcaaaaagctcttctggaattttgccagcttgtttttctgagtgtacagagggaaattacttcctactgatgaggaaaagcaggcagaagttgctgttacagaacaagagatggagagaaggaacttttaggtgagaggtggaaaaggtgtgttcttagctgagatggagagcatgaggtgatacagcaatacatattaactctgtacttaacacactgactacttgagccattctgactgctcaacggaattttgacacatacttgagttaggtaagcaaagaaccataggtttcttttatttatttaaatcttttatacagatatttgtaaaatctgatgtttatatgtgagagccatttgtgaagatactgtatttaactatttacacaaagatcttttgtgtttttgagttgaactttaaaagtaattaaatgagttaacttgaatagaatttctgaagagcttctgcctataatattgattttggctttgacataattgatacttacctattctgacagtgataggctaacagattcagtcccttattgcttgagtcactttttggaacatgataatagcatcatgtcaccttagtggaagatgctcatcttttatttatttatttttctatagtggatgagggcctttcgtttaagagctacaatgatttgatgtttaaaaaagagggtggtttgaacatagccctgcttaattttaaggagtgcatttgcttatcaaaagatcatttcagtcattttgatttttatagtattttggcaaaggcttaaaaggatcattgaaagtcctgacttcatactatttttatagagcttggttcatagatggtgtatatcttaaaaaatcttagaattcttagcatgtttattattttaaaattttggcgaaactgcataggtcagttgtatcttagaatagataaaagcctccctatttttcttaacaagttctagattagacaactcagactaagtttttttgtacttcgtttcattctacagggtatccgtggtgactaataataataacagttaacattactgagtgcttactatgagtcgggtacatgatcttacataattcttacattaatcgtatgatgtaggtactaccattacctatgttttgctgtcgagaaaatgttggaagagttaagtatcttaccaaaatttaacattctgggagacagaggtagactgcaaaccctaggaagtcttacctttgctccctaatctctacagagggaaatgcaaattagaataagtgtcccaagtggaagagaaagaacattttactgttcgtatctttaggttacacagctattatagctggaccgtgagtttgactctgaattttctatagcaaaaaaataaaaaataaaaaacaaaaaaaggaaaaggaaaaaaaaaaaaggtggggaggacaaaagagttagaatagcacacataaaacctatttcttaggaattctcaaaatccctgtgcgagccacaaaaggagtctctgggagatttgggatgatttcttcaacatcattcctatatcatgtgactttgagtttttaatgggactgcctcttttgatcccacaaagaaattttagaatataatgccaaagcatcatttggtaagaattctgtgagagatcatgatgatgtggcccaagtatgcatggtttggtatgattcatacataaaatccagataacttaggagaatgaaatggatggcctgtacatttgccagtcaatccttggttttgtatatacttcagaaatcaaatgagcagataatatatttaagatctttgctttgaaattgaaaacaagaaacattgtagtaattgtattcatattattaagcttgcaagtgaatgggtaattatttccaggttaagtgattgtcttacaagtgaagagagtcaatttttcagtcctgtgaaatgcagcatagagatgccaagttagatatagactgaaaagtgttcactacatttccagacaagtcttgtgtattttagtagtaatagcgtcagtagagtattgcagagttgtgagtgcaaggtgagaaagcggcaaacctctctgtgtagaaatgtctttgtagaagcaaattgcaaagggaagaaggaaaggaccagatgtgggaggaggatttttgtttaaggaattgaagaggcttcagactgattatatgctatgaagaaggaacgaatggagaaggaagaattgaagattagaaaagcagtaatgattgatgctgcaaggtgagtatggttgaacttgaaggggatggaattcagatcattgagggtggcaagtggatcatctctactgagaagttagggtgtctttctcacttcagttccctcaccctccccacatggtagtgtggtttagcttagaaaaagtgactgaagttaggatgtgaatgaagcatgcataaccagactggagaggtgactgggaccagcaagcagctgttctatcctgaactctaaataaggcctgctgaagggggactaggggtaaaacatggaataagctaaagaacaacagagaaaccatgaattttagtgaaaataaaatgaatccccttttgccatatctcctccagtgcataggctcactgcctcagaggttccttatccaagaatgcatgtggttgaggccacagggaaccattggtaaggatttctctctcacataggaagcttgttttaggtgggcagtacatttgaaacccacttggaggtctgtctaatgttgacagtggggtgttaaagtctcccattgttattgtgtgggagtctaagtctctttgtaggtctctaaggacttgctttatgaatctgggtgctcctgtgttgggtgcatatatatgtaggatagttagctcttcttgttgaattgatccctttaccattatgtaatggccttctttgtctcttttgatctttgttggtttaaagtctgttttatcagagactaggattgcaacccctgcgtttttttgttttccatttgcttggtagatcttcctccatccttttattttgagcctatgtgtgtgtctgcacgtgagatgggttccctgaatacagcacactgatgggtcttgactctgtatccaatttgccagtctgtgtcttttaatttgagcatttagtccatttacctttaaagttaatattgttatgtgtgaatttgatcctgtcattatgatgttagttggttattttgctcattagttgatgcagtttcttcctagcctcgatggtctttacaatttggcatgattttgcagtggctggtgccagttgttcctttccatgtttagcgcttccttcaggagctcttttagggcaggcctggtggtgacaaaatctctcagcatttgcttgtctgtaaaggattttatttctccttcacttatgaagcttagtttggctggatatgaaattctaggttgaaaattctttaagaatgttgaatattggccccccctctcttctggcttgtagagtttctgccgagagatcagctgttagtctgatgggcttccctttgtgggtaacctgacctttctctctggctgcccttaacattttttccttcatttcaactttgctgaatctgacaattatgtgtcttggagttgctcttctcgaggagtatctttcagaaagttaagaaggatacccaggaattgaactcagctccacaccaagcagacgtaatagacatctacagaactctccaccccaaatcaacagaatatacattcttttcagcagcacaccacacctactccaaaactgaccacataggtggaagtaaagttctcctcagcaaatgtaaaagaacagaaattataacaaactgtctctcagaccacagtgcaatcaaactagaactcaggattaagaaactcactcaaaaccatgcaactacatggaaactgaacaacctgctcctgaatgactactgggtacataacgaaatgaaggcagaaataaagatgttctttgaaaccactgagaacaaagacacaacataccagaatctctgggacacattcaaagcagtgtgtagagggaaatttatagcactaaatgcccacaagagaaagcaggaaagatccaaaattgacaccctaacgtcacaattaaaagaactagaaaagcaagagcaaacacattcaaaagctagcagaaggcaagaaataactaaaatcagagcagaactgaaggaaatagagacacaaaaaacccttcaaaaaataaatgaatccaggagctggttttttgaaaggatcaacaaaattgatagaccgctagcaagactaataaagaagaaaagagagaagaatcaagtagacgcaataaaaaatgataaaggggatgtcaccactgatcccacagaaatacagactaccatcagagaatactacaagcacctctacagaaataaactaaaaaatctagaagaaatggataaattcctcgacacatacaccatcccaagactaaaccaggaagaagttgaatctctgaatagaccaataacagactctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttataaggccagcatcatcctgataccaaagcctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatatgcaaatcaataaacgtaatccagcatataaacagaaccaaagacaaaaaccacatgattatctcaacagatgcagaaaaggcctttgacaaaattcaacaactcttcatgctaaaaactctcaataaattaggtattgatgggacgtatctcaaaataataagagctatctatgacaaacccacaggcaatatcatactgaatgggcaaaaactggaagcattccctttgagaactggcacaagacaggttttccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcagcttcaacaaagtctcaggatacaaaatcaatgtacaaaaatcacaagcattcttatacaccagtaacagacaaacagccaaatcatgagtgaactcccattcacaattgcttcaaagagaaaaaaatacctaggaatccaacttacaagggatgtgaaggacctcttcaaggagaaccacaaaccactgctcaatgaaataaaagaggatacaaagaaatggaagaacattccatgctcatgggtaggaagaatcaatatcgtgaaaatggccatactgcccaaggtaatttatagattcaatgccatccccatcaagctaccaatgagtttcttcacagaattggaaaaaactactttaaagttcatatggaaccaaaaaagagcccgcattgccaagtcaatcctaagccaaaagaacgaagctggaggcatcacgctacctgacttcaaactatactacaaggctacagtaaccaaaacagcatggtactggtaccgaaacagagatatagatcaatggaacagaacagagccctgagaaataacgccacatatctacaaccatctgatctttgacaaacctgacaaaaacaagcaatggggaaaggattccctatttaataaatggtgctgggaaaactggctagccatatgtagaaagctgaaactggatcccttccttacaccttatacaaaaattaattcaagatggattagagacttaaacgttagacctaaaaccataaaaaccctagaagaaaacctaggcattactgttcaggacataggcatgggcaaggacttcatgtctaaaacaccaaaagcatggcaacaaaagccaaaactgaaaaatgggatctaattaaactaaagaacttctgcacagcaaaagaaactaccatcagagtgaacaggcaacctacaaaatgggagaaaattttcacaacctactcatctgacaaagggctaatatccagaatctacaatgaactcaaaaaatttacaagagaaaaaacaaacccgcttggagttggcgtgtagcgttaaaagctaaactccaaaggcttttggggctctattgctcttggggacacattgaaataaagaaatgtagagggcactcagagactggactgtgttagctgggaaggatcacagtctgccaggaaatcagttctcaccttccaatgggacaggatttgagggtgggagttggggtaggagaaagggagcagagaggaaaaatttgtaactgtcatgcaaaaggccagttaagagaatctcaactactctgggcaccaaagagcagcttttagtagatagttgagttggagccgggagcagcagcatcaacaacagcaacagctgaaatagcttgtgcaggacattagagctcttcatgggtagagtgcaggaaggccatgacaatggaagcagtaatagaaatcatacagggaggaaaatgatgtgcagcttaatatggtgagatgcccagtagaaaaaggggaaaaatgtttattctgtttataagggaataacatgtttctcagccgtagcagccccaggggctaagaatcaagaaatagggatcaaaacaataccaggaatttgaaattccttgaaaatcttggtttagagtcccttctgtataactgtgctgaccccagaaatgccttgtcctggtgcaggccccgagtagctcatccatttcctgtctggctaccaccccagcagcaatgagctaggcaggtccctgcctctgggtccttgactgtggtcaagactctttccacccccctcctcctttttttttttttttttttttgcctctccagtggatgaatttgctccttttgtgtagtgggctctccctgtcacaagatgtccctcatctaaggtgagggtcaggaatccttatttcctgatgctactcctagtctactgttctgtggtagaattgcctttgggtgccatgcatgtgctgcgatggtgtattttgtgcacaaagggcttggctgatcttgtcttttgccgttcctgcactcttttgtatgagagccccacgggcctgggttattctgtacctcaggtaggaacctggaaccaaggcttggagttaggggaaacactcgttctggctcacagataaaccctggggccctgcagggctcgttctgttctccttctccccaagtggttctggtattctggccctgaggaagtatagagtacatacagagaagcagacagggtaggttctgatacaggtaccaactgagtgtttcggtctctgaagctttcagtcttttaacttgccaaaaaagaaggaaatggtttgactgaatgggttattactggcatctgatatttctagcttcctgtgtgagaaagtgctctgtcaggtctgatttgtgtggatttttgttactagttacaatgtttaacagtttcaggaattcatttaacacactctcttaggtgtgcaattgtttttctcagggaaatctagtgtttaattacaagtctcagattaagaacgataattgtctaacatttatgaaatcctgctgacaactaagtttatactccatttgttaacaggctgttcctgattcgatctgcttgcatctcttctaacttgtgagtgacttggaaggagcagacttcatcttacttctattcatttctcaattaactatgactaacatacactaggcacccaaaaagttaagatgatagcagtaatgaagagaaatggaccttgagtttcagaaacttgtattctaatggaccttcaaaagatggcaagtattgtgtctggaattggtgggttcttggtctcgctgacttcaagaatgaagccacggaccctcgcggtgagtgttacagttcttaaagatggtgtgtctagagtttgttccttcagatgttcagatgtttctggagtttcttccttctggtgggtttgtggtcttgctggcttcaggagtgaagctacagaccttcacggtgagtgttgcagctcataaaggtggcgcggacccaaagaatgagcagcagcaagatttattgcaaagagccaaagaacaaagcttccacagcgtggtaaggggacccgagtgggttgctgccgctggctcgggcagcctgcttttattcccttatctgaccccacccacagcctactgattggcccattttatggagagctgattggtccattttacagagagctgattggtccattttgacagggtgttgattggtgcgtttacaatccctgagctagacacagagtgctgattggtgtatttacaatcctctagctagatgtaaaagttctccaagtcctcactagattaactagacacagagcactgattggtgtgtttacaaaccttgagatagacacagggtgctaattggtgtatttacaatcctttagctagacataaaggttctccaagcccccaccagattagctagatacagagtgctcattggtgcatccacgaaccctgagctagacacagagtgctgattggtgcatatacagtcctccagctagacataaaagttctccaagtcgtcacctgactcaggagcccagctggcttcgcctagtggatcccgcgccagggccgtgggtggagctgcccaccagtcccgcacggcgcctgcacttctcagcccttgggcagtcaatgggactgggtgccgtggagcagggggtgatgcctgttggggaggctcggtccatgctggagcccaccgccagggggctcggccatggcgggctgcaggtcccgagccctgccccgcggggaggtggctgaggcctggcgagagttcgagtgtggcacgggcagtctggcactgctgggggatccggcgctccctggcctgggtgctaagtccctcactgcccggggccggccggcttctctgagtgtggggcctgccaagcccacgcccacccagaactttcactggcccaagagcaacgcacgcagcccgggttcccacccgtgcctctccttccacacctccccgcaagcagagggggctggctccatacttggccagcccagagaggggctcccacagtgcagcagcggactgatgggctcctcaagggtggccagagcagacgccaaggccgaggaggcgctgagagcgagcgagggccgccagcacgttgtcacctctcagtatgagtgtgttgtagtgtatgtgtgaaagggagttttgcaatgggagtatgggatgatgtgttagtcatagttctacagagaaatagactatctatctatctatatctcagagagagagagagagagagattgagtgtaaggaattggctcatgcaattatggagaccaagtgccaagatatggagacggcaagctggagactcaggagagctgtggcgtagtagtttctgtccaagtccagaggcctgagaaccaggagagccagtagtataagttctagtctgaaagctggcaggcccaagaccaagaagagcccaagtttcagtttgagtcccgaagcaggaaaagactgatattccatttcaagcagtcagacaagtcttatggcagggtcagccttttagttctcttcaggccatcaactgattggataagggcgactcacattagggagggcaatttgcttccaattcagctgtttatctcatcaaaaaacaccctcacagacacacttggaataatgtttgaccaaatgtctggacactttgtgccccagtcaagttgacacataaaattaatcatcacagatggtttacacttctaaaacaattttatatagtaagaagcaatatagtaaattctcacaaaagttgttgatagtttctttgaaactgcaactttaagagaaatgatggggccgggcgcagtggctcacgcctgtaatcccagcactttgggaggccgaggtgggcggatcacgaggtcaggagatcgagaccatggtgaaaccccgtctctactaaaaatacaaaaaaaaaattagccgggcgtgatggcggacgcctgtagtcccagctacttgggaggctgaggcaggagaatggtgtgaacccaggaggtggagcttgcagtgagccgagattgcgccactgcactccagcctgggcgacagagcgagactccgtctcaaaaaaaaaaaaaagagagagaaatgatgtacagcaggtccttgaatgacattgttataacactgatgagaaaaaaaaattggtttcattatatatggttttgcttaaagtcatagtttccaggaacctatcagtgacattattgtatacttttaaagcatcatgaaataactgaataagaacttgtaaattgctgaattatgaatcattctcctggtttccagtattatttttattagaagttgacatggtacatgctggttaaaatatgacccaggctggttcaagtgcagtgtggtgtttacaaccaactgatcacagccagttacagatttctttgttccttttctactcccactgcttcacttgactagccatatatgtatgcgtgtatgtatatatgtaataaagtgtgatccagatgttaacaaacttgattcttcttactgactgaatcattattgttcagaaaccctttgatacaatgggaaaaaaaatgctgttgatataagaagggagtcaaatattacaggactggactgttgattaaaaaattatttttaaagcacagtagctatgaattactgtgctgttgtatttgtctctatatgtgttgctgatttctgatcttggatcatgtttaaaaccagtggcagtctgtaaataccaacaattattatcttttgatacccttttaagttatgaaactcatattgttgaagaaatacctggattcattaagaaaatgatttttttccctctttctttcccctcttcttcttctctcttcctttcccgacccccttcctttcctggaaggtctttctgttatatgaacagagtgacgagtccctctctgttgcccactgtgttgcggcaggctgcagtgcagtggcaaggtcacggttcactgcatcctagctcagcagatcctcctatctccgtctcccaagtacctgggactgtaggcgcgcaccaccatgcctggctaatttttttttttgtattttttatagagatggagtttctccatgttgcccaggctggtcttgaactcctgggctaaagtgatcttcctgcctcagaggcacctcccaaagtgctgggattacaggtatgagccatcgcgcccagcctaagaaactgattttcagtgactgtattccttcatatgtgtgttccacaatttaatcctagaattctttggtttttaaaataatgatacactggatattatttgtaaatattctgagtagctcttattatttctttacagcaaatgctgtgtaggtaataaatggagtgatgtcaaatagtatcccttttttttgaagagttttgataaatattgcctaattgcccttatttattcactcatataaaatcaataataattacagctaacttgtttagagtgctggtcaggacctgagctgtatgtggactgttcaatgtaatcctcaaaataactttttgaggaagttgttatcaatgtccttatcaggaaatatctgagtgcctactgtgtgtaaagcgttgtgttaggcagggggactgcagtaatgagcaaccaaccattgttgatgcccacattctagaggatgtgcttaacaattactgtcagttaatttaattgcgttgtgggaaaggctgtgaaagagaaatttgggctgctttgaaagtatatcacacagggtgagagaagcggtgctaagagagaaattatctttgtataaacatctcggtagcctaggtggagtagccaaggtaaaaggacgtgttttaggcagaggcggcagcatgtgtgaaggcactgaggtgctaaacggtggacatgtcccggaagctgaaatagaccaattgtgcctggaatactgaggtgttacagtagattgactcaagataaggctgggcctagatcaaatcctgcattgtgtttctggccacctgaaggatttagtccttcctaagagcaatgggaagcctttgaagtgtttttagggaggacccgtaagatgatttatattttaaaaagaatgacttacctgctttgtggacagtgggtttgtaaagtatgaaattttctattgctctatagtttcagcagtcttattctcagttttataggtagaggtgcttaaaatttttaattaaaaagaaacaaaacttaaaaagaaatccatgatcataggctgggagggagagttgaaagaggtggcttgggaggagaaggaaagaatgattagaaacttagaagtcagagaacacccaacttttttttttgtcacagtgtttggaaaacttaagtttgtatttgaaatagaatatatgttgcccagcagatcccgattcattaaaaatttgaatttgagcttctctctatcatgataatgcttgcctccatgtcatctgatttccagagactacgtatctgagaggatgtcacttaagggctttaactgaatgataccaggggctttgcagattgataaggcatggtgtggggaagaaaagtagagacaagcctatttaaaaaaaatttctatgtctttttatctggcttgtgatgccagtgaaagtaaggtggctatctggcatgtacacagattggttgttggagagccttcatgattttccattattcatttccttcagacagctcctttagtaacttaggtacatcctaccttcccccaccaagacacaatcagtaaactgattagaattatagttttatggaaaaaatacacttcatttattctaatttttgattttaaattttagttttaagaaacaaaccttttaaagttgaatactagaaaactaaaattgtgctgctcttaagttaaacatttttgactgaaaaattctaatatataaactaaggaggggttaatttacgttagcatagaactccctttcatttaccttctttgaatccttccatgtcttcagaagggaaaaaagctagaaagtttgtaaaatattaatatgctttataatgctttctacctgctaaaatgtatgaatcttagagtgagatcctgatgcagacttgtgtgttcaaaggatcatgctattttttcctttgtacttagaattaagcttgagtgcagcaaatgtataaaatcacaagtagagtgtgggttgtgttttgaagtctttaataattattttctattttataaaaaataaaatagaaagttattcaagatatttcaggatactattttatattgtgagcatttgtactttttgtgaaattttatttttctaatgttgattgtgatttgagactattatataaacaaagattgacaaagacaaagttgcaatttttcatagtattaatattttagcagaataatttttgtacttgcttaaggaagaggaaaaactttttttatttttctctcattctttaaaaacaaaaacaaaaaaatgtgagctaatgtaagcagtttcagttttctaggaaaacaaaggctttcgtgtacatgcttctgatagtagacggtgtgaccatatcatgtatgcgttcttaataatgtctgacattatcagattgattaactcagcatagaacctaatcagatttaactatggttggcagctgtacactagaagaatagtaatatagtgggagaataaaatcagttttttaagaagctgcattaaatacaaaactaaaaaaaattaaaagtgttcattatctcacagtgacatataaagctattgtgttcacacagtggctttcttaaatccatgctgacttatattttcaaagatcggctactgccagatgctagacatgctgataataagattttcatttgataatttgatggtgtaggtttcaggcagttatgatttcctgcaggcttcaagggtcaacgtttgtatctacatactgtgtttactgtgtaaacctcatagactatctaactctaagaactagagccaaaaccactgcttactttttctgggatcaacgtaagtatttctctaagaaataggtcattgcaaagtaatcatttctcctttgttttttaaaaaacgtaatcatgaaaagttaataaatgataagaaagagtcctaaattagggggctataaattaattttaattcttccattaactgtaacctgggccttaggatttaattagattcagtcactaaatgtttagtgaatgcttactatgtgaaggctgttctgggctctaaggctatgttagtgacccaaacagtaaagatattggtgccattcaaagcacttttttgatgtgctgagaatccctattgaggataacagtcaatagttaattacataagctttgaggactgatttctagactagtgagaaatagccatgacaaaaacagtctcacttgcgtaaattatttgcacaatatttttctcttcttgggcgtgatacccattttagtcagtgttctaaagctattaaactaataaaactcaagtgaatagtcaaatatccagtcggcttttatgatttgggattaaagtaacaaaaatagctgataaatgagtggaaaaggtatgcaaatagaatggatcaattgttaccttctgggaaaagagaataactgcttttcagagagcaattttctaaatcaacactcatcaaagtatacttagatcccttgcatattaacacataattaagttatgtatgtatgaaaaacagtatttattaagtttttcctattacttaagatttctaatttaattaagtacaccgtcatctctgactagtttacttaatccagaaaattaagaaatatatttaattcaggaaaaaggaacaattgctgccattttatggtatattaaccccaacaggtcttcattgtaagacaatataatttctgaaggtttggtaagtgcttgaagttttgaaattagataactttctttaaactctagtcttgcataagagtaaaaatattacagattccagaagagttactttgaggagttttaaatgccagcaaggaggtgcttataataaacatatctatttaactatcattgtagctttattttaatgtataatatatctgggatatgttgtgggtccacagaagtatttgttgaattgaattaaatgtatgcttcctaaatgtacctttcaaaacgtattgagcaatcatgtaactacattaaattataaactaataaaatgatcagtattaatgaaatttgaaaccaatttagaataataaaaagaattgattcatggtagaattcagcaatacattttgcataagcacattatgaaaacctaagtttccaaacctcggcagtaaaaaaccagtcatagcaaattattagatgtgatttatgacttattgatagcattaggatagcagtcacatgttcattttccagttttttttaataatttgataattttaaaaggatactaaattatcccttctttactgttcttagaatttatgttcattttactgatgaggtcttgagtcatcgtgtaatgttttaaaggtaaaaagttgggtagaataatcttaccatgtaacttattttttgttgttgtaataaacatggttttaaaacagttgtcactgtttataattgtatcattcattaattttcaggtaataaatggacagatttggcttagtagttgaggcgtgatttcagggactgcttaccctgctttcttcagtatgttaaaaaatgaatgtgagatctaccggaggaaggagaaaggaaaaaaacctttattttccaagttagcaatctgcagttttgggaaacctagcttctggggaaactgaaagcacacgcttggctgaagggagggaaatagcagcatttaagccttccagggtctgtcttacatattcatcagatttggggaatgtctgtgaatgtttacagggaaagtcaaatgcatgtccagatataacattaatataacatacattctatattcactttggggtggggttttaacattaaaatgaggaggaatttggttctttgcatcaaaaggtgaactataagggacaaagatgttttatgtgccatctctgtaagccagttggaaccagcttagggtctatagctgcttatcaggagagaatatttgtaaagctggtgttttctctaatcagtgctgttggctggacccccaaggtgggggtgttcttgttagctagtgtcatgtggtctaccagagtcagttggataatgttttcctagaatgagcttctgcttaactgcaggaagaaaaccttatggcaatgaacaaaccttatagtagttaacagtgtaggcatacatgaccaaactcttttccctgctctggccacttaattttctctgagggtctcatcttagccacagagcccatcttgtctgtcatctaggggtacattgttgacagttacctttgttaccattcaccaatgcttaagatcaattaatagtagacattgtctctcattcacctattaggccatacattcaaataagcatgggagagaaaacacatttgacttattaccacggtaaggttcaaattactgatatcacattcttttttgaggaagcttttatagagaagaaacactgtgggttaggatgggagttgtagcaaaggtaggctgtgggtaccaaagataactaacctataataacctattttggggaagtgtttttattaacccttttatttgtgactcttttttggtattcagaattgcaccccttagtgtaatttttagtggtgagagtcttaagagtactagtattctttgggaaacaaatgttgcacatatggcatcatctttcttcctcctacagagaagtgttgacatggatcaggatcacactggtgccactttaactggaaagttttgagggattgtgaatggtgctagaggtggccacacaatctttttggtccttctttgttcacattttgccttcttttttcccatccgtggctggcagttgacagtgttgaggttgtcctttacttgggaagcctgttgacccaacagcaaccctgatgacccagttgtcttactcactcagaaatggtgccttcttttggtggcatttgccataattgtcctaataactgtgcttgtcacaaaacccaatgcttgggctcagtaaatatttattgactaaaggaatgagtactggagactagcctctatgtttcttactcacttctgtttttactgattctgcttttttccatgaatgttgccttctctcgtgtttcacattcagaattttcttagagaatatcttagtttgggctgctgtaacagaataagtctgggtggcttaaacagcatttatttctcacaactcaggagattgggaagtccaagatcaaagtgctggcagacctggtgtctggtgagagcactgttcctagtttgcagacagtcttctcattgtatcctcacttgctggagaaagaaagaccttgtgtctcttcttttataatagcactaatcccatcgtcagggacccaccctcatgacctaatataacctcagttacttccaaatggcctcacctccaaattctgtaacactggggacttgagttgcaatatatgaattttagggagacaaatattcagtcaatagcagaggtaacacttacgttagtgaggaagaatttttaaagatttcatgtttgttttagatataactacttaaaatacatgggaatgtttctgtaatataaaaaaatgccattgtagttccatattcataaagtgaaacactttataaagaaataacgtggctgggcactgtggcttatgcctgtaataccagcattttgagaggctgagacgaaggattgcttgaagccagaagtttgagaccagcctgggcagcaaagcaagaacttgtctctacaaaaaataaaataaaataaattagttgggcccagtggcatgtgcctgtagtcccaactattctgagaggctgaggtgggaggattgcctgagcccaggagttgtaggctgcagtgagctgtgatggcaccactgcattccagcctgggtgacatagcaagatcctgtctgtttaaaaaagaaggagaaggaggagaaacatgtttttcttaaactttctttaatttggttttatgttaatgttaagaataaataaccagtaaataatcttgtaaatagaaaatactatttctgagaatttcattcgcagtaatattagaaatctattacatctcttagaaatatgatatacaaaatagtttgaattattgttattgaagaggatgtatgccagattttcaagagtaggtttattgtttgtttatgaaataaaacatcaactgccatttattaaatactttctttgtgccacaaagagttttgaatgcaatttcagtctagtcctcaaaatcatcctaaaagattggaggattatgtaaattttgcaaatgaaacttggcttttgaaatttggtcacttactctcaaagctttataaccagcaaggggcaagggctgagacttgaactcatctccgtcttattccaaagcccagccctttcgtctcttctgtattaaattcccattcctacatatggatggccacattgcagtgaatacagttggaaaataatatcagtattggagcctctgggaaattttgttttgctacattgcatttatgagctttcatccaggtccttctgtattccctgtatagttggcgctggatgaatgtttattattaatataatgaatacatatagccattcctttaatgacacagtcttacctgctaataaaattgtgtatcagtttctatcttattatgcatgattttccttgctcttctctcagcagattatgatttttaataaaagcaaagcacacacacaaaattcttgtgtcggtagctgataaatttaataggaccttttaggagacaaatactccagcaagtttgtattcactttatctgagttgaaaataaaattgctttgtatgctttagagtaatactacatttgattgtcctgtgccttgtattctgcagtttgacatttagagcttttcgtctttcaggatacaaattctattttgatatgccaacaaaatgatttaaaaactaaattgaagtttaaaaaaatactgtcagtatattgtcaaaaccggagaatatgaagtaaacttggttcaactttttatactagatacacgttacacagaacatgtaacattcttttgtagaagccagagcaaaaatacccacagtgaattaatttggtaatgaactaggttaatttgtagagaaaaggcttaggtcagggtgagatttggaggtataggatatcatagtaacataaacctatcaaaacatgcagaacatggagagcactaaaattcattaaaaaaatcagattgagtgataatataatgataactttaggaaattgatagaaactaaacttgagccccagtgactccagagatagtctttaaactgttcaggacagctagaacaggttggttttctgattaaaattcttatctaaggagaagttgataaatgctaccttcctgcacttgctcctgtaagttcaggttagtaggtgatgtcccaaagtgccctgaaggcaaccagtaaaaaactttttttttttcatgtagaaaatttggaacttggtgactctacagatgaaattcaggctctgaaaagtgctcacttgctctcaaaatttataatgagcaaggagggaagacttgaagcgtgaacccacttacatattactctaaaactcatgctatttcctctgtattgtgtgagatcaaaacaaatgccatatcatacacgtatgcaagctttcagaaatttaggtcggtggttctctgaccaagcacagtggttcacgcctgtaatcccagcactttgggaggccgaggtgggatcgcttgagctcaggagttcgagcctgagcaacgtagtgaggccctatctctacagaaaattttaaaattagctgggcatggtggcacacacttatagtctcagcagatgtgtgccaccacactcagcgaataattttgtattagctggtggaggatcgcttgagcccgggaaatcaaggatgcagtgagccatgatcacagcactgcaatccagcctgggtgacagagcaagaccctgtctcaaaacaaaacaaaacaaagccttctcaaaagtgtgctctccagaggtcacgtgggaggttgttacaaatgcagattaccaggctccatttcacacccactgacaaagaaacttcggggtggggccaacagtgtttaaaaggccctgtccttgattctgatatgtgcacaagtttgagaaccactgctttagatacttttgcagtttgaaaaagaatatggataagagggcctctgaacaatgtagttgttttcctacatagagcaatttggccatgttaggaataaacccattttgtgagtaattaattatagcttaggtgcagtctaacttaatatttttacttcaattccaatctcctttagggatttttttttaactactaaatttggtcaaaatttgacttgtctccctataatctataatatttctattctagattagccatgttgagggaaataaaatttgggtaaatattgcataatatttatattattgaagagacaattttttaccttaaagagaaggcacagtatttaattttaataaattatatgtgatttttaaaaatgtaaagactctttttggccttatttgagctcataaaatatttggacagttatcatgagagtttgctaaaataacgtaaggtgatcttattctttcccattgttttgactaattgttggtaaagaatctttctttggggagcactccccaaggcaacttggaagtgtgtcctgggccgcagttatcattattattatgattattattttttaaaaaagaatctttgaaatgactggttacttgatggtattaaagaattaatatcatacatgtctgtgtgaggtgggggatgataccttggggatgtttaatgggggagtatttgtcttttaaagaagattctcatttcattcataaattttgttttggtgggtacatagtaggtggtgattatatatatatatttaggaatacaatgtataagatataggtacacaatgtataataatcacatcagagtaaatgtggtatccatcacttgaagcatttatcctttgtgtttcaagtaatccagttgtactccctgaggtctgttctaaatttataattattactgactgtagccaccctgttgttctatcaaatactagatcttattcatttttttttcatttttctatagcttcttgttggaaaaaaaaatatatatatatatatttatatatttacctgttaaccatctccactccccccaccccatgcctcccactactctccctagcttctggtaaccatctttctacgctctgcctctatgaactcaattgtttaatttttagctcctacaaataagtgagaacagacaaaagtttgtctttctttgcctcatttatttcacttaacataatgactttgagttccatccatgttgttgcaaatgactggatcccattcttcttttatggctgaatagtattccgttgtgtatgtgtccattttctttatccacttgtctattgatgaacagttaggttgcttccaaatctttgctatcgtgaatagtgctgcaataaacgtgggaatgcagatatctctttgataaattgattcctttcttttgggtatacttagcagtgggattgctggatcatatggtagcccaatttttaattttttgagcaacctccaaactgttctctgtagtggttgtactaatttatgttcccaccaacagtgtacaaggattttcttttctcagcatcctcctcagcatttgttattgcctgtctttggataaaagtcattttaactggggtgagatgatactttattgtcgttttgatttgaattttgctgatattcagtgatgttgagcactctttcatatggctgtttgccatttgtatgtcttcttttgagagacatctattcagatcttttatcccccaccctgcttttctttttgagacatagctttgtcatccaggcaggtgtgcagtggctctcactgcaacctctgccttttgggttcaagcgattctgtttctcagccactcgaatagctaggaggattacaggcacccaccaccacatctagctaatttatgttattttttagtcaagaggggtttcaccatgtaggcccagctggtctcaaattcttgacttcaagtgatctgcccacctcggcctcccaaagtgctgggattacagaaatgagccactgtggatggcccttttgcccattttaaaattagatgattaagcttttttttatttatagaattgttttagttccttatatattctggtaatcccttgtagagtggatagtttgcagatgtaatctcccattctgtgggttgtctcttcatttgttgactgtttcctttttggtgtagaagctttataatttgatgtgattccatttgcccatttttgctttagtttcttatgctttctgggtattactcaggaaatctttgctcagtccagtgtcctggagagtttcaccaatgttttatttttcatggtataatagtttcattttgatttgagttttgtatatggtgagagataggggtctagtttcagtcttctgcatatggacatccagttttcctagaaccatttattgaagagactgtcctttcttcagtgtatgttcttggcacctttgtcaaaaatgagttcactgtagatgtacaatttgtttctggattctctattttgtttcattggtctgtgtgtctgttttttataccagttcaatggtgttttggttaccagagctctgtagtataatttgaagtcaggtaatatgatttattcagttttgttgcttttgcttagaatagctttggctattcggggtcttttgtggttccatacacattttaggattactttttctgtttctgtggagaatgtcgttggtattttgatagagaatgcatttaatctgtagattgccttcagtagtatggacgttttaacagtattgattcttccaatcaatactgtttttttggtgtgtatgtgtccttttcagtttatttcaccagtgttttgtagtttttattgtagagagctttcacttcttagattaagctaatttgtaggtatttaattttatctgttgctattgtaaatagaattacacttttaatttctttttcagattgtttgctgttggcatatggagatgcttttatagtggtgaaagtgggtatcctttttatgttccagatcttagaggaaagtctttcagtttttccccattcagtatgatactaactgtgggtctgtcatatatagcttttattatgttgaggtgtattccttctgtactcagttttttgatggtttttatcatgaagggatgttgaattttatcaaatgctttttcagcaatgatcatatggtttttgtccttcaatctgttggtattatgtatcacactgattgatttgcatatattgaaccatccttgcatccctgggataaattccacttggccatgataaaatgatcttttaaaatgtgttgttgaatttggttcgctagtattttgttgaagatttttgcattagtgatcattaaggatactggcctgtagtttgcattttttggtgtgcctttatctggttttgacatcagggtgataatggcctcacggaatgaattgggaagtattcccttctcttctcttttttagaacagtttgagtaggattgatagtaattctttaaatgtttgataaaattcggccttgaagccatcaggttctggggttttctttgctaggagactttttattatggatttgatgtcattacttgttactggtctgttcaggttttggatttcttcatggttcaattttggtaggttgtatgtgtctaggaaatcatctgtttcttctaggttttcagatggattggcatatctttgctcatagtgcccctaatgatcctttggatttctgcagtgttggttgtaatgtctctctctttttttttttttttacatctctgattttattcatttgggtgttttctctttttttcttagttcacctggctaaagacttgtcaattttctttctcttttctaaaaacacacagttttgttgctctcgtattttctttattttgatttcatttatttctgctctgatctttataatttcttttcttctactgactttgggtttggtttgctcttgcttttctggttctttaaaatgcatcattaggttgtttatttgaagtttttcttttttgatgcaggcacttggaagtataagcatctgtcttagtactgcttttgctacatcctataggttttgctatgttgtttttccattatcatttgttccaagaaatttttcagtttccttcttaatttcttcattgacccactgagcatatggtttaatttgcatacgtttgtatagttttgaaaattcttctcgttattgagctctagttttattccattctggctagaaaagatacttgacattatttcagttttttaaaatgttttgagacttgttttgtggcctaatatatagtctatccttgggaatgattcatgtgctgaggagaaaaatgtgtattctgcagccgtgggacaaaatgttctgtaaatatctattaggtccattttgtctacagtgctgattaagtctgatttttctttgttgactttctgtctagatgatctgtccagtgctgaaactgggatgttgaagtctccagctattattgtattgggatctatctttctctttagctcaacaatatttgctgtatatatctgggtgctccagttttggctgcacatatatttatgttatatcctcttgctgaattgaccctttatcattatattatgaccttcattgtctctttatagtttttgttttgaaatctattttgtctgtatagctgctcatgctttttagctggtattctttgcacacatatcttacaatgtaaaaaaaaaaacttctctgagcaaaagcaatttgacacttcataacgtctagaaatattttttcaaatgtgatgtatgaataggaagtagcatacaaaaacaaattactgtgctatccctcccccaagaatacatattctctcttcacaccacgtggctgctgctggggcatgggggaggggtggcattggcagttcaagactgtcctaccctcttcagtgactcttttagcaatatgaagttaaaaaccaggtactgttaccactcacctgatgtttaattctcatgaagatgcttttttgtgtagatagttgtcaaatgtgatgttcctgcagggaggacaattggtggaggcttctatttggccaacttgctcctcctcatttgtaaatatttcagtgggtacctgtgatttgctttgaagtacagtaattggagaaagggtaatgagagttaacaaatacggctaaagtggaaacgtggtcagtcttgagctgattattgttgaagctgaatgagggatttataaaggtctgttatgcttttctttctaagagtttgcttgaaatcttttatactttaaagttgagaaaaccaacaatgataccagctcagtacagtactcacacagtgaaggtttgttactttagctggcattctttgcagacataccttataatgtaaagagaaaacttttctaagcaaaagcaatttgacactttgcgacttctagatacaatttttcaaatgtgatggatgaataggaagtagcaaacaaaagcagatgatgaggaaataccgtttaagatgtcactttaaaatactgtactgtgttaccataagtagagtgcatttctagatccttactacattttacacatcttttctgattatgtttcttctttttatacttttaggtatacacattagctgagtactaggaattttaaatgcatgctatttagttttgaacgttcaagtacttagttgaacttaagttatgaaattgtaaaggaatggtgtctaccagtgacattacattaaagcttttcataatcgagttgtggtaagttgttttattttaaatttctaccgtaggaacagaatggttctgtaaaagttatttttcttactgtgatataattaaaaaatatgaccatacttttgcataaagaattgatagactatttctcttacggagcatatatgcatgcaaaattgactaaagaggactcatttaaaacatttctaaggggaaatttgagttaacacaagggtgaatatattttaagccagtttatattttaaaccactcaataatgtggttttgaaaagtgactttttagaatatgtatgtatatgtctacacacacacacatacgcacacatgcaaatgatgtgtttaccctgctaagcagttagattggtaactatgaggtagcagcttctgtatcttgttaccttgttaggtcagtaaagcaagtgagggggcactttattagtttgtggaccattcttgaagctggtgacgctgcaaagggtccaaggcttgccctctctgctagtctagatcactgtttctgagactgtaatgtatgtgtaaatcacctggaggtcttgttaaaagtgtagaccttgttttagagatctgggatggggcctaagattctaacaagctccttaggtgatgccaatgtaggtttgaggacctctcttttttttaatttttatttttttgaactaggggcttgctttgttgcctaggctggtctccaactcttccgttcaagtgatcctcccacttcagcttcctgagtaactgggattataggagaacgtgcccagttaaggaccagctctttgaatagcaaaggacaagcttatcatagttgtgatttagaatttaaaacctcagataaactatggttataggtaatatatttatactaactttaaaaaatatcaaattttattattattattttttggatttaaaaaatgtttctggccaggcgtggtggctctcacctgtaatcccagcagttctggggaggccaaggtgggaggatcgcttcagtccaggagttcaacatcagcctgggcaacatagcaggactgtgtgtctaaaaaaaaaaaaaaaaaaaaaaattagccgggcatggtggcatgtacctgtagcctgtagtctcagctacttgggaggctgaggtgggaagatcgcttgagcctaggagttcaaggctgcagtcagctatgaacaatgcactgccctccagcctgggagacagagcaagaccctgtctttaaaaaaaaaaaacaaaaaacgtgagcctagggctgcttctagcctatagaatatcttttgctgactagatgcagattctccttggggtagatgcatagcttggccagataagggacttctaggtagaaccatgcacaaaaaggtggttgaatttcagaccttactcactggctgcaagcttttgtgcagtatacaaactcacaaattactggttgatcctacctttgtttaacatctgggcacaaagatttaaaagagtaggaaaaaacatttaaaactattgtagtgataacaataaactgcttaaaaggtatataaacaaaacaagaaatctttatctgtcttttcacatgttgtaataataaggcttttgttcacaattttaatgttattttaaaaattaatactgcatttgttactcagtaggtttaataaaatgcagagaccgtatacaagcaacatactgctgactatgttaacttagaaaataaccaccttcacagatttagcagtctagggcagtggttcccaaattcatggtattgggcaaaatgagaaaaataaaacaatgtaatcaggtttttgtatttattaattcattctatttaaggggctttttttttttttttttttttgacagggtcactctgttgcccaggctggagtgcagtggcacgatcttggctcactgcaacctccgtcccctgggttcaagcaattctctcacctcagccttctgagtaactggaattacagatgtgtgccaccatgcccggctaatttttttttttttttttttttttttttgagacagagtctcgctctttggcccaggccagagtgcagtggcacgatctcggctcactgcaggctccacctcctgggttcatgccattctcctgcctcagcctcccgagtagctgggactacaggcgcccgccaccgcacccggctaattttttgtatttttagtagagacggggtttcaccgtgttaaccaggatggtcttgatctcctgacctcgtgattcgctcaccttggcctcccaaagtgctgagattacaggcccagataatttttgtatttttagtagggatggggttttgccgtgttgcctaggctgctcaaactcctcggctcaagcagtcttcttgtgtcagtctcccaaagttctgggattacaggcatgagccacctcatccagcttaagggacaactctatattcattatttttggtgttaaaatgtcgtctttaaaacagtattggtggtatatgagaggtatattcgttatgtacctttctgcagacatacatgcccatgctacttttattcctgaccttatttttttttcagaggaagaagttaagaaattagtttgtgggccattcttgaagccagtgacactacatagggcccaaggcttgctctctctactagcctagatcactgtacctctcagagccccactcacttgtctcctaggtgcctcataaatagttagcaacaattctcagtacttcattaaaattcacctcctcctgggagccctccagcctttgaaataacctgctactggctagagtagcctagtggtgaagagcttgaactagacagccttggctctgccacttaatgcctgtgtggccattacatatcttttacaaggttatgtaacctgtttgtgcctctttttgttcgcagttaaaatcaggataattggctgggcacagtggctcactcctgtaatcccagcactttgggaggctgaggtgggtggatcacctggggtcaggggtttgagaccagcctgaccaacatggtgaaaccccgtctctactaaaaatacaaaattagccgtacgtggtgacacatgcctgtaatcccagctacttgagaggctgaggcaggagaatcgcttgaacctgggaggtggagattgcagtgagccaagattgcaccattgcactccagcctgggcaacaagagcgaaactccgtctcaaaaaaatcaggataattatgtatcctttttgtggtggtggttgtgattattaaatatttggcacagtgccagtcacataataagcactcagctgcttcatcaatatcatcctaacgttagtcgttgtgtggacagcaacagattaagtaaaaagttatacccctaccccaattctgtttcagtctttctgtgtttggcgaacttcccaggtgattcttacatttaatacatgtgaaaaccattaccctaaaggtcctttcatagtgaacttcatttaggacttgccaaagccactaacatgaaggagttgagatcaaattcattttgtctaacactatatctcaaatgcataatattgtgtctggcatatagtaggcattcagtaaatagttgtttaatgtgtgtagcccaacttcatagttttatgagataatacggtcttacgttaaaaaaatgagagcaaacattggttctagttatgttatggagaccttaatggggaattcactgaagtataagaattaattctctatgattattctccctatggcttattagaaaaagattgaatgagctattattaaaatcataatatgtatctttcctctagagtaagactaataactgtcatagcaggctcttctccatttatttcgtctttagaaccatcttttttaattttatttaaaagtaaggtaggagatatactttcatttttcttattctctggcataaactttgttttttaaattcagctttagccaggtgcattggtgtgcaccagtattcccagctttttgggaggctgagtcgagaggattcctcaagcccaggagtttaagtccaacctgcacagcatagcgagctctttgtctctttaaaataaatataatacattcaactttagaagtcatacagtactgtttcttttgaattgagaaatagttcttaggcaatgaggatgctcctaactataaaaaagaaacatgttttgtttaccttgaataatttactaggacactgaataaaaatgttaagaaactaattccgcaagaataattgtgtagttatctgatttctgagtgaagcattttcagctagataattctagaagaaaatatttaaataaccttggcagaactttaacgttattcataacaaagatagataaaaagcaattctcacctagccataataataaatcagtatgtgcagttaaactaggaaaaacactaatatttattatatgctttttcctaatgtatcttgtatatatggtcagttagttttataagaggaggttatttgacattagttttcttgctgggaaaacctgatttccagttggtgtgatgttttaccttccttgattacaatcttattctaccagaaatgaaaagataatcaagacgtggctcatctgtttccatttatcttgatcatctatgtagtaagtgcagcgtttagattatttgtatctttttatttttatctttagatttttatctttattagtttttttattagattattttattagatattttattagatatttttgtatctttagattattttatttattattttaaataaatataatatttatttaaatataatatttatataatatattataaaataaataatatattttaaagattttgtatctttagattattttattactttattttattagatatttttgtatctttagattatttgtatctttttattttatcattatttgctctaaagatagtctgttcagatttgttatgaccaaaaatataatgatgcaggtaattattgtcttcatccttaaaattactttctaaagccaatcattctgcctaatacagggtcttcatttatttttagctacctgaaactgagtctaaaaccacttctctctacttcctcttgtctttttcatttaaacatgtgtaaattttgcagttaaaaatgataaacctatttacatttagtgttcatctcttcttctgttgttattgctattttccatctctagtccttttcaaaaacacagtggaatggatagtatagatcagctgagattgctttttaaaaggttggcagtgacatcttcatgctaaattctagtgtccattcttgctctctgaaactatctcccttgatttttggagcattgcacttttctccactgctctctgatccttgctttttttgtttatttttttatttttgtttttggctgtctttgctggtttcttttcatgcctcaaagtattttctaaaattaaggccttaatgctatgtttctctgtgttttagggttgcagattcctctaaagagggctgcaagtgacataagggaatgaatggtccaggtgggtacacaattaataagagaacagatctctgtccaacggggacaacaccactgtttgagttcaacttactatcatgtggggaaaaaaatgtttaatgtaatcagatcttctagtgagccaagagaagtatgggaagtccagatttttatgtgaaatatctcagatttcgaatatcggtggctagtggaagtttgggaatacctacacgagagggagtttggagcagtattccggttggaacagggtttatgtagcttgtacgttgcacagcctttggatttgttgtatacattgtaatatgcaccacttgcacttctattaagagtctagggattgccttaaagctggattttcataggaagtgcacatttggtaatttgtatatatattgttgggtagtgccctgaagggaaaggttgatggagggattggagcagatgtcccccaagccaccctttcctgccacaatggttagaaactattttttaaacattgaaatctaaataaacatgaccataggcctctaatatgtggcctctgctctgaatcttgaagagcttatagctctcatagcttcaaacatttctaaatagaagatagagatctaaattctagttccctttcagtaagttttcagctggtgacctggacaaaatcacaattctttgacccttagtaggctgatatttgaattggagacagttctgtttccagttcagctcggggagctttccattctaaaactcatgatcttattgttttaaatctctattttttaactggcctcacactagtttgcatattatatttccagtcacaaaaaaatatttcactactttagtgtttcttttttcttttttttaaattttattattattgtatgttaagttttagggtacatgtgcacgacgtgcaggtttggtacatatgtatacatgtgccatgctggtatgctgcacccattaactcgtcatttaccattaggtatatctcctaatgctatccctctccccaccccacaacaggccccagtgtgtgatgttccccttcctgtgcccatgtgttctcattgttcaattcccacctataactgagaacatgcggtgtttggttttttgtccttgcgatagtttgctgagaattacggtttccagcttcatccatgtccctgcaaaggacatgaactcatccttttttatggctgcatagtattccatggtgtatatgtgccacattttcttaatccagtctgtcattgttggacatttaggttggttccaagtctttgctattgtgaatagtgccgcaataaacatacgtatgcatgtgtcttcatagcagcatgatttataatcctttgggtatatacccagtaatgggatggctgggtcaaatggtatttctagttctagatccctgaggagtcaccaaaccgacttccacaatcgttgaactagtttacagtcccaccaacagtgtaaaagtcttcctatttctccacatcctctccagcacctgttgtttcctgactttttaatgattgccattctaactggtgtgagatggtatctcattgtggttttgatttgcatttctctgatggccggtgatgacgagcactttttcatgtgtttttgggctgcataaatgtcttcttttgagaggtgtctgttcatatccttcacccactttttgatggggttgtttgtttttttcttgtaaatttgtttgagatcattgtagattctggatattagccctttgtcagatgagtaggttgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctagcttttcctctagggtttttatggttttaggtctaacgtttaagtctttaatccatcttgaattaatttttgtataaggtgtaaggaagggatgcagtttcagctttctacctatgggtagccagttttcccagcaccatttattaaatagggaatcctttccccattgcttgtttttgtcaggtttgtcaaagatcagacaatgagggctctgttctgttccattggtctatatctctgttttggtaccagtaccatgctgttttggttactgtagccttgtagtatagtttgaagtcaggtagcatgatgcctccagctttgttcttttggcttaggattgacttggtgatgggggctcttttttggttccatatgaactttaaagtagttttttccaattctgtgaaaaaagtcattggtagcttgatggggatggcattgaatctataaattaccttgggcagtatggccattttcacgatattgattcttcctacccatgagtatggaatgttcttccatttctttgtatcctcttttatttccttgagcagtggtttgtagttctccttgaagaggtccttcacatcccttgtaagttggattcctagatattttattctctttgaagcaattgtgaatgggagttcacttatgatttggctctctgtttgtctcttattgctgtataagaatgcttgtgatttttgtacattgaatttgtatcctgagactttgctgaagttgcttatcagcttgaggagattttgggctgagacagcgggattttctagatatacaatcatgtcgtctgcaaacagggacaatttgacttcctcttttcctaattgaatgccctttatttccttctcctgcctaattgccctggccagaacttccaacactatgttgaataggagtggtgagagagggcatccctgtcttgtgccagttttcaaagggaatgcttccagtttttgcccattcagtatgatattggctgtaggtttgtcatagatagctcttattattttgagatacgtcccatcaatacctaatttattgagagcttttagcatgaagagttgttgaattttgtcaaaggccttttctgcatctattgagataatcatgtggtttttgtctttggttctgtttatatgctggattacgtttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgccaggctttggtatcaggatgatgctggcctcataaaatgagttagggaggattccctctttttctattgattggaatagtttcagaaggaatggtactagctcgtctttgtacctctggtagaatttggctgtgaattcatctggtcctggactttttctggttggtaagctattaattattgcttcaatctcagagcctgttattggtctactcagagattcaacttcttcctggtttagtcttgggaggatgtatatgtcagggaattaatccatttcttccagattttctagtttatttgcatagaggtgtttatagtattctctgatggtagtttgtatttctgtgggatcagtgttgatatccccgttatcattttttattgcatctatttgattcttctctcttctttattagtcttgctggcggtctatcaattttgttgatgttttcaaaaaaccagctcctggtttcattaatcttttgaaggtttttttgtgtctctatttccttcagttctgctctgattttagttatttcttgccttctgctagcttttgaatgtgtttgctcttgcttctctagctcttttagttgtgatgttagggtgtcaattttagatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgcacggttttgagtgagtttcttaatcctgagttctagtttgattgcactgtggtctgagaggcagtttgttgtaatttctgttcttttgcatttgctgaggtgtgctttacttccacctatgtggtcagttttggagtaggtgtggtgtggtgctgaaaagaatgtatactctgttgatttggggtggagagttctgtagatgtctattaggtccacttggtgcagagctgagttcaattcctgggtatccttgttaactttctgtctcgttgatctgtctaatgttgacagtggggtgttaaagtctcccattattagtgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgctggtttaaagtctgttttatcagagactaggattgcaacccctgccttttttgtcttccatttgcttggtagatcttcctccatccctttgttttgagcctatgtgtgtctctgcacgtgagatgggtttcctgaatacagcacactggtgggtcttgactctttatccaatttgccagtctgtgtcttttaattggagcatttagtccatttacatttaaagttaatattgttatgtgtgaatttgatcctgtcattatgatgttagctggttattttgctcgatagttgatgcagtttcttcctagccttgatggtctttacaatttggcatgtttttgcagtggctggtaccggttgtccctttccatgtttagtgcttccttcaggagctcttttagggcaggcctggtggtgacaaaatctctcagcatttgcttgtctgtaaagtattttatttctccttcacttatgaagcttagtttggctggatatgaaattatgggttgaaaattcatttctttaagaatgttgaatattggtccccactgtcttctggcttgtagagtttctgccgagagatcagctgttagtctgatgggcttccctttgtgggtaacccgacctttctctctggctgcccttaacattttttccttcatttcaactttggtgaatctgacaattatgtgtcttggagttgctcttctcgagaagtatctttgtggtgttctctatatttcctgaatctgaatgttggcctgccttgctagattggggaagttctcctggataatatcctgtagagtgttttcccacttggttccattctccccgtcactttcaggtacaccaatcagacgtagatttggtcttttcacatagtcccatatttcttggaggctttgttcatatctttttattcttttttctctaaacttctcttctcgcttcatttcattcgtttagtcttccatcactgataccctttcttccaactgatcacattggctcctgagtcttctgcatttgtcacgtagctctcatgccttggttttcagctccatcaggtcctttaaggacttgtctgcattagttattctagttatccattcgtctaattttttttcaaagctttttacttctttgctattgtttcgtatttcctcctgtagctcagagtagtttgattgtctgaagccttcttctctcaactaatcaaagtcattctccgtccagctttgttctgttgctggtgaggagctgcgttcctttggaggaggagaggcactctgatttttagttttcactttttctgctctgttattttcccatgtttgtggttttatctacctttggtctttgatgatggtgatgtacagatgggtttttggtgtggatgtcctttctgtttgttagttttccttctaacagtcaggaccctcagccgcaggtctgttggagtttgctagaggtccactccagaccctgtttgcctgggtctcagcagcagtggctgcagaacagtgcatattgatgaaccacagatgctgctgtctgatcgttcctctggaagttttgtctcagaggagtacccggccgtgtgaggtgtcagtccaccccctactgagagatgcctcccaggtaggctacttgggggtcagggacccacttgaggaggcagtctgcctgttctcagatctccagctgcgtgctgggagaaccactactgtcttcaaagctcagttggaaatgcagaaatcaccagtcttctgcgtggctgacactgggagctgtagacgggagctgttcctattcggccatcttggctcctccccttccttaatgtttcttcgcttaattaatctttcttcccaatgtagttcatttcttagtttctttgtctttaatcattttcctgataattcagacttgtggaaaattgctgacacatgtccattcatcctcctggcccttttatttctccttgtcagtatagctcgtatctttgtaatttcctccattccaggagttcttgaggcttgggctctccatgattactttaggtttctctgtctcccagtctgtgatgtcccttccagccatatccagtctgttttcaacaaaattctgaccactctacttctattttcaaaagccccagtggttcttatttcctgcctgcaaagtatgtttctttttcagattttcagagactatataatatttcccttaccctatccaaccatatttcccactgtgaaatagttattactacaagttaggaaagtatcttattaccagttatgccttttgactttatttattgcaatttccccaccactaaaatagcttcatttttttattcctttggcaaaaacaccgcacattcttaacagctgagttccatgcttttcaggaatcttctctggtgacctgagcacacaccaacctctcctttctttgaacttctgttacatctaatgagtgctgaatagcttatcatctaaaatcctagatgcttctagagctggaaagtagtaggcatcagctaatcatctgtgcattgtataaatgacagaacatttgtgatttgcccttgatcatattatttaacagcagagcctaaattagatctgtcagttaatttcctatatacagcttgcctgaggtagcatgaaagcagccatagaaaatgtttaaactaatgaatgtggttgtattttaatataatgttatcaaaaacggactgcagtcctgctttggtttgtgggctatagactgctgatccctgttctagagtagtaactaacaactgcttcccctaatttttctcctttgtgttgattttaaaacaatgaaacacataaaccaggggtccccagttcccatgacacatacctgtggaacctggtggcacagcaggaggtgagccagtgaagcttcatgtgtatttacagttgtccctcattgctggcattaccgcctgagctctgcctcccgtcagatcagcgatggcattggattctcataggagcgcaaactttattgtgaactgtgcatgtgagggatctaggttgcttgctccttattagaatctaatgcatgatgatctgtcactgtctcccgtcacccccagatggggaccatctagttgcaggaagacgaactcaggtctcccactgattctacattatagtgagttgtataattatttcattatatattacaatgtaataataatagaaataaagtgcacaacaactataatgagcttgaattatccggaaaccactcccctcaacccgggtgtgtggaaaaattgtcttcccctaaaccagttgctggtgccagaaaggttggggaccgctgaaataacagaaatcctcactactgcttttatttagaagcattttcagacaaggaaggatgtacaatttatttttattgtcaggtataaattttccatgtttaattcagctttagaagtcatatgataatgtttgaattgagaaacattactcttaggtaataagaatgcatttaaatatatcctataaaatagacacgttatgcatgagtgaggggtgcattttcagtgacaagtataacacttgaaatctgaagaattgttggtcttccatacagcgtacttggaatgaaacaaaggtttacaacaagttactacaagaggtagaaatagaactagggaacaatttgtttcatctactcaagtctgttgaagtataataattaacttctgaccattcttggccttttaagttctcagggctctcctcataggaattataccgttaaccctgctctcctgggcaaatttcaaccaatgtaattatattcttagtcttacctgaattctctccatagagtgtaattatctgagctggattcttcccagggcactgggctttagcacagctactactctccctatctttagtccacgactgttgggtaatttcatttctgctcttgaacagttagctactatcctgcctgaagaattggcattttatgttgagtagtgtacatttgatttcactgtttaccttgtataagattaaaactaaccttagcaggccacttttgaccgtgggcaggtcaaagacgtaagtgtggtgaaattatagcagaaggggtaaatattttcaaataaagatcgtggaatcaaaaacatagagaccttttaagttttgatgtcaaaaaccactgtttttttccacattattaaaattagcagttaagtttttttcatctccaggctttatactcttaaaaattactggattatatctgtgaatatttgttgtgttagaacagatttagtatacttttaaaatttgtttaaaatattactaaactcatgttaatgtaaatatattatgaaaaatatattttgaaaaatcttgaaaagagtggccttgtttacagttttgccagtctcttaatgtctgacttaacagaccacagctgtttctggaatgtcttgtgatacattattttacttgaagtatgtgaagaatatcctcacacataatatgtaattggaaaaagaatgttttaatagctttttcagataattgtggatatttttcttcaataatacaccaaaagttaacaagtggtaatttctgtaggttaattgctatgtggaatctgaaatcatatcagtgaacttttcattgttttcattctttgttacattgaaatctaccagcctgccttaataccgggtatgcatacatttattcacttattcattggagtgtgtgtgtgtgtgtaacttctatttttttttccttgcactttgagtgaatcttacccatggatgattttgtaatatcaagtattggtcatttggaaattattggctctctgaaagattatgcagactttccacatgttgatacatttcattatgtgatatcaaaaagtatcatttttaagtaacaccaccgatcttagaaaaatcttcaagtctttattggtggcagatacaagttttccaaaattctggtttttgtttgaaaggtcaaattttatcattggcgacaagtactgtcattttttcccatgggaaagtcttgttcagtcattattttcagaagtatcagctgaataagcatagtttgtccatcattgtttcaattaaaaatggcattccataacagctaattcagcttgcagctttaacaggtatacaaatgctttccttcgagacagccatcgtatttaggtatgcagtagaaatgctttatgcatgctcaaaggatggtttttaatacaattaataatttttgctgctttatcaagaacaagtgaagctgaatttttatttctcttttaactgcagttagtacagtttagatacattgcggtgatttgaaataaggcaccaggagttttacctgctgttgtttttgcatcagcagtataaatgtccactcagtgaaaatggtgaatgaggtcttagttttattatgaaaatagttttgacttccttgactccctgaaaaggtctctgggatgctcagagggaggtccgtgtgccacatttgaaaatcatggttataagccttgcagaggacagtgtttaatggtccccttttcttacagttattaaaatgtagtaaccattctttttattttttattttttacagacaggctctcactctgtcacccaggttggagtatagtggtataatcacagcttaccgcagcctggagctcctgggctcaagctctcctcttgccttagcttcccaaagtgctgagattacaggtgtgagccacagtgcccaaaccctaacagctcttttgttttatttcatttactttggtattctctaagactattattatgaaactttgctcatttttctaggcctttattctcaattttattattttgttcaagggctgacatgaccatattaacaattatccttagatgaacctttacaagttaagtggtagataaaaaaggaagagactgaaaaagtgtttaagaaaacatttactagcaacctacgtggccactgaaatatttaaaagaaactaattgaagttaacttttcattttataacagtgattgaaaatcaactgctttgtctgcccaaagcattctaagtctattctgttatttgaggaagtcatttgactgtctgtgtctcagttctctgactagctgacattgctgtaaatttggtatgtatgtccaggaattgaaataggcctccgtggaaagaaatacaattatttatttaaactctctaacagtagtttagttgtggcttggatctaaagacaaatattagccaatccagtctatatccccttccccatgcattcattgtgtttgtagaaatggtatatgtctaagtatcaaacgagttgtatctatcaaagacaaaaatattctggttcaaattatagataacaataagattccaatcaaaacaaagaggtaaataaatatctggtcatgatccttttgtttatactgcaaatgtcgatattgcttagtggcactgattgatgatttatggccacacatgtacccattgtttctgcttcactcctcctggttggctttcttatagtaccattcttccatgaggaatggcaagtaaataaaccagttgatacctacggagcaagaaccaccattgaaccatggatgctgattttagaaccttgctcaactgatgggtgcatgatgtgcagaaattttatttgactattatttataacaatccagacagacctgttactcatttttagattttctttaaaccagattctattattaaacattaattcagcaagagattaagcaaatctcaactgatgacttaaggaaaattgacacattttctcaatatgttcataggaattctcttgtttaataatttaaagatattatagactttataatacaaaaaagcaacagacaagctgatatttttggtacgatattatttataattcaaagaaatgtaaagagtatgctaacttggagatgttttggttggaaatggtgcccacatttgatgactttctgcctccctttccgttttgtctttccatgtgtcttttaaaaaatatatactgttgcagtttcatagctgtcaatgtcttctctttctgaggatattaattaataaattcttcctccctctgtatagtcattcttcaagttgcttttttctgacgctttcaggtctagtaatctttggttggttgagtgtatttaattgtggaccaggttacttgaatctcctaaggcattattgcttatttatatactgtccagcttccaaagtttattgcttttacctctactccctgtacctccataatgatgtatttatgacgttttacaaattttgctctatcatttaaataggactttggaaggtagcagatgatagtgtgtattttgttctcatctttacttgaaataatttgcttatttaaatgaaagcatctagacagtaattgaaaccatgagttgagttcagcaagtactaaagtcaatatgatagcttaagaaaatgttttagcaattatatttttatattgatatagatcccattaaacagtcatatgggttcaggagtattagttatgaattatcacatgtatattttaattaaaatactatagggttttaaaattaaattatgaattatttaagaataagcctatttttatttacttaatgagttaggtagttctaattaggtaaatgtaaatagaagtgaccatcttaatgccctacaatgtaagcagtaattcacaatttgtaaagatttataggaggacaaaatcagtttgatcttgaatatgcttaaattttgcacgcttgtacatttctcccaacttaccaagtggcaccttctagggaaacaggtttcaagaattgtatccttaagtttttaccaactcccccccaaatactgtagtaataagtggctttggcttgaatagtgggatgtccacaagtgttagaatcagctatacctggctttagatcttagctccattaccttttaaccatgtctaagaagaacaaaatgcaaaatattactgatacccttactttggaattattgtcaggattaagtgagatgaaatatgtgtagtaactagagcaatgtcagacattcagatattagtttccttctcttataagcccctatgtagtttttatttctttaggatgacagacatgagttctcccattattttctcattgcctgtgctttattcatattaccatcattatccttcattgcgaagaatccattacatactatagtgaattaacaataaaattcaagatgaatttacacaaaaaggaggatattatttttacacaaataaatattaaggtaatgaaaacagttttgctattgttgacaatcattataaaattgtttaccatgtcttgtaattttaaaagtttagtttttatcatttaaagacaggtattcttattagacacttgacatctgttagtctcaaaatttgctatgttttggatcgcttacaagattagctgagtgtattagtcagggttctccagaggaatggaaccaataagatatatatacaaaagagaatttgttagggagaattgattcatgctattacataggtgaagccccgccataggccatctgcaagctggagaatgatggaagccggtagcatggctctctctaagtccggaagcctcaaaaccgggtaagctgacagtgcagctctctcagtctaaggctaaagacctgaaatcccccaagaggctgctggtacaagtcccacagtccaaaggctgaagaacctggagtctgatgtccaagcacaggtggaggaaaagatgtactgttccagaagagagagaaagtaaaaagaagagcaagcaaactgaatatcccccttctgtctgctttgttttagctgtgctcacagccagttggcatgggcaactgttctagttcctggccactttgttctagaccctgcccactttgagggcaggtcttcctctctcagtacactgactcacaggggtgccttgttatatttcccaggctggtctctaactccaggcctcaactggagttgtcatcttctctggaaacatcctcatagacacacccagaaacaatacttcagcagccatctaaacatccctcaatccagtcaagtttacacctaatattaaccataacactgagggtagtgaatatagttcacataacatagttacaatagcttaggtgctagatatttcaaatacctcattcattcattggcaactacatcatcagccgggcctggggctatgatggtgaagaaatgtatcagttatttattgcagcataacaagttactccaaagtatattgacctaaacctttattatctcatagttttgtggggtaggaattgaggcataggctgttctgtcttggggtatcatgaggttgttatcaagatgtctcctgacgtctttcacattgtatactgtatgtcagagcatcatgtgcatcttgaatatatatataatctttgtcaatattacctcaaagctggggaaaaaagatgtctgctgaatagcagcgtttagtcatttgaaggcttgactggggctggaggaactactttcaagttagctcagtcacgttcctgccaggttgatgctggtttttggcaggaggtctcatttcttccctgtatagatctctccacaggttactcgactgccctcgtgacatggtggttggcttccaccagagcaaacagtctagaggaaggtggaggaagatggagaggaagagaaaaggaaaggagaagggggagtcacagaagctatctaaaaagaatactctcaaaagtcacatagcatcagttctgtcacattctttttatgagaaggaaatcactaagacgggcccatgttcaacagaccgagattagactctgctttttgaagggagagatatcacagaattcatggatatatttaaaaatcaccacaatataacacctttcctttccagatactaagtttcacaggtgacttgagactacagttacgttggtaagtttattattgtctaacactgaattagagttaccaattaagtaccaaaatgcaatgagaaagtgatataaaagcattatgtgcaaaaggcatgccttttttttttttttacaaaaattctgctaatttggggtatttttgagttggatatcttactgtcttttcagattcagaagatttataatcagactgactaaacacatctccaaaccttctaatttcttgttcgttattgttacatgtttagactgaaatagagagggaaaagatattaccaggtttactgcagtgtggaaaagctgttggagaagaatggggaatgaaaaggaaagagacaagattctttggacaaggcagaaggaagaagttgaaggattcaagttaaaggataaccttgagccgggcattatggcttctacctgtaatctcaaggacttgggagactgaggcaggaggatcacttgagccctggagttcaagaccagcctggtcaatataacaaggcacccctgtctctataaaagtacgtacatgcatgcatactcatacacataaaagataatgtcagttgatggcatgagtgtgaaagcagagctgtgtgaaacatcactaaggataagataataaggatgtcattattcctagactgtgtagcatgatttttttttaatactttcagttctagggtacatgtgcacaacatgcaggtttgttacatatgtatacatgtgccatgttggtgtgctgcacccattaacttgtcatttacattaggtatatctcctagtgctatccctccctcctgccgccaccccacgatgggccctggtgtgtgatgttccccttcctgtgtccaggtgttctcattgttcagttcccacctatgaatgagaacatgcggtgtttggttttttgtccttgtgatagtttgctgagaatgatggtttccagcttcatctatgtccctgcaaaggacatgaactcatccttttttgtggctgcgtagtattcgatggtgtatatgtgccacattttcttaatccagtctatcattgatggacatttgggttggttccaagtctttgctattgtgaatagtgccgcaataaacatacgtgtgcatgtgtctttatagcagcatgatttataatcctttgggtatatacccagtaatatataccaggtgtatatttggctgggtcaaatggtatttccagttccagatccttgaggaaccaccacactgtcttccacaatggttgaattaggaaacagtgtagctctctactgtagatggttaataaaatatggagaaccattagtgtaatcagagagacttgggttgccagtggctgcttgtacaaccttggtcagttgcttacattctctgtgctttagtttcttaatctgggaaaaaaaatggattgaactaaatcatttccagtgctaacatgttatacctttggaaaggaacttagatatagttgaaacaatttgaatttctctagtttttagtttttatttatttaaattttttctttttaaatcgtgggtacatagtaggtatatatatttatgggatacaggagatattttgacacaggcttacacatcaaggtaaatgtggtatccatcccctcaagcatttatcctttgtgttacaaacaatacagttatactccttcatatggtttggatctgtgtctccaccaaatctcatgttgaattgtaatcgccagtgttggaggtagggcctggtgggaggcgattggatcatggggagtggtttctcatgaatggtttaataccatcaacttggtaccatcttcatgatagtgagtgagttcttgccagatctggttgtttaaaagtatgtagcacctccctcctctctttctcctactcataacatgtgagatgcctgctcgccctttgccttctgccatgattggaagcctcctgaggcctccccccaaaaaaaagctgctgtgcttcctgtacagcctgcagaaccatgagctgattaaacctcttttctttataaattacccagactcggatatttctttatagcaatgcgagaacagactaatgcatgagatattttgatgcaggtatacaatgcataataatcatatcagggtaaatgtattccttcccacaagcatttagatttgtgttacaaacaatccagttatactccttcagttatttttacatgtataattattattgactataacccaccctgatgtgctatcaaatactggattttttttttttaatccgttaaccatcccacgtttccccaatcatccccctacccttcccagcctctggtaaccatccttctgcattctctctccctgagttcagttgttttgttgattttttatattgtttcttttgttttgatttcatttatttctgctctgatctttataatttcttctactaaatttgggtttggtttgctcttgctttcctagttaagatgcatccttgggtggcttatttgagttcttttttgacgtaggcaaaaaagtactgctctttctgtatcccataggttttgctgtgttgtgttttcattatcatttgtttcaagaaagttttcaattttcttcttaatttcttcattgacccactggtcattcaggagcatattgtttaatttccatgtgtttatatagttttaaaaattcctcattattgatttctagttttactctattgtcatcagagaagatacctgatactatttcttttttggtggagaatgttttgagaattgttttgtggccttacatatgttctgttcttgagaatgattcatgtgctgaggagtacacagcgtattctgcagctgttgggtgaaatgttctataaatatctactagatccatttggcctacagtgcggattaagtctgatatttctttgttgattttctgtctggatgatctgttatatcatcttgctaattgacccttttattgttatatagtgaccttcgtttcttacagtttttgtcttgaaatctgttttgtctgattatagctactcctgctgttttttggtttccatttgcatggaatattttttttctatccttttattttcagtctctttgtgtctttataggtgaagtgtgtttcttgtaggcaatggatcattgggtctttttttttttttttttttgagggcatctcgctctgttcccaggctggagtgcagtggcgcaatctcagcttactgtaacctctgcctcctgggttcaagtgattctcctacctcagcttcctgagtagctgggattacaggcgcataccaccatacctggctaatttttgtgtttttagtagagtcggggtttcaccatgttggccaggatggtctccatctcttgaccttgtaatccacccacctcggcctcccaaagtgctgggattacaggtgtgagccccggtgcccagcctgtcttgtttttttaatccttgcatccactctgtgtctcttgattggagagtatagtccacttacattcagtgttgttactgataagtaaggatttgctcctgccgttttgttacttgttttctggttgttttgtggtcttctcttccttctttcctgccttcctgccttccttttagtgagggtgattttctctggtggtatgttttaatttcttgcttttagttttttgtgtatctttggtatgtttttagatttgaggttaccatgaggcttgtaaataatataaccattattttaaactgaagacagcttaacactgattgcataaacaagcaaacaaaaaggaaactaataactctaacttggtctctctgctttttaactttttgctgtttttacttatatcttgttgtactgtctatgtcttgaaaagttgctgtagttactctttttgttgttgttgttacagggtattactttgtcacccaggctggagtgcagtggcacaattacagctcactgtggccttgatttcccggtttcaagtgatgcccccacctcagcctcctgagtagctgggaccaaaggtgcacaccaccatgcctggctaacttttatattttttgtagataacgtgatttcatcatgttgtccaggctggtctcatactcctgggctcaagtgatcctctcgcctctacctcctaaagtgttgggattacaggtgtgagccactgtggcccgccatagttattatttttgttgggtttatgtttttatctttctactaaagatatgagtagttacatcacaattagtgttataatattctttgtttttctgtgtacttactattaccagtgagttttgtatcttcacatcatttcttcttgctcattaatacccttttctttcagattgaagaattcctttagcatttgttgtaggacaggtctggtgttgatgaaatccctcagcttttgtttgggagagtctttatttcttcttcatgtttgaaggatattttaaccagatatgcttttctgagtagaagttttttttccttcagcacttcaaatatgtcatgccactctatgctggtctgtgacgtttccactgaaaagactgctgtcagatgtattggagctccattgtatgtgacttgtttgttttctctcactctttttagtatcctttattcttgaactttgggagtttgattattacaagccttgaggtggtcttctttgggttaaatctggttggttttctataaacttcttgtacttgaatatcgacagtctttttctctaggcttgggaagttctttgttattagccctttgaataaactttctacctctacctctctctctttacctcctctttaagggcagtaactcttaggtttgcccttttaaggatattttctagatcttgtgttagaaaattttggtgcagctgagctggcatcaaaaccacaagacaaacttcttcccactcttcccctcccctttccccaggcagaggagtttgtccccattccattaccaacacaggcccacggggagtactgctaggctacctttgatgttcatgccgattttctaggtgtgcttcattttttttttttttttcatttgtctcctctgactgaaaattttcaaatagcctgtcttcaagctcaccaaatcttgcttttgcttgatgaattctattatgagactgatacattcttcagtatgtcagttgcatttttcaactacaggatttctgctggatgctttttaattatttcagtctctttgatgtatctgataggattctgaattccttctgtattatcttgagttcattcaaaacagcaattttaaattcttttgtatgaatcgttgcataactctgcctctccgagattggtctctggtgccttatttagttcatttggtgaggtcatgtttttctggatggtcttagtgcttgtggatgctcattggttttggggcattgaagagtcaagtatttattgtagtctttgcagtctttggttgtttgtaaccgtcatttatgggaaggctttccaggtatttgttggaacttgagtgctgtaatctaagtttgtagtccctgcaactgtatttccattagaggataccctaagcttagtaatgctgtgattcttgcagacctgtagaggtaccatcttggtggtctttgttaagatctggaggaattctctggattacctggcagagactcttgttttcttcctttactttatcccaaacaaatggagcacattctctctgtgctgagctaccctggagctggtggagaggtgacacaagcatccctgtggccgccacccctggaaatgcactggctcagacctaaagccagcgcagcactgagtcttatccagggtcccctgtaaccactgactggctactgcctgtgtttgcttaaggtcctagagctttgccgtcagcagttggcaaaaccaaccaggcttcagggtgatgccttcccttaggtcctgtatgggtccagaagtgccatccaagagcgagggcccggaggtggaaaccttagaaatttacctggttctctgtgctactgcacctgagctgccaccgaaaccacaagacaaagtccttcccactcttccttccccttaccccaggcagaggagtctctccctggtccattgtcaccacaggcccacagggagtactgctaggctacctccagtgctcacctaaggccaagggctcttcacttagcttgtggtgaatgctgccacacttgcaattccccccgtagggcagtggtctcccctctgccccaggacagggccagaaatgctgtccaagagccaaggcctacaactggcgaccccaagagcccacttggtgcttttctctattgtggccgggcacaagacaaagtacccttaatctttcttctacttttctcaagcagaaggagtctctcccatagccaccacagctgggaatgttctgggtcatacctaatggtggcacgcctcagagtctcgctcaaggcccacggcatgtactaccttggctactgctgctgatcatttagggcctaagcgctcttaagtcagcaggtgatgaatcctgacaggactgggtgcttctcttcaaggcagtgggctcacttctgacccaggatatgtctagaaatgtcatccagggaattagggcctggaatggggacctcaggactctctctggtgccctatcctcctgtgactgagctggtatccaagttataagtcaaagtcctctttactggtgcctttcctctcctcaagaagaaggaaagggccacttttgttgctgtgagctgtgctgcctggagttgggtaagcatggtgcatacgctcctttagcctccttggctggtgtgtcactaggtcatgtgtccccccaaatgtgctggctctgagcccagcacggcactaggacttgcctaggaattgttgtccttgtggcctagacagcctttcaagttaatttagaactgtgggggtaaagcttgtgaaagttccaggctactggtatgggcagttcccctgtggctagtgctggtctcaatgccttcttcatgggcatcacctgagttctgcccagcattgctttctgctgtgacagggcatcagtgagttccaatgcaaagcccacagttggtgtgctctccgtcccccaagtgcacagattgtctctccgcaccatgcagtctctgctggtggatggggaggtgtattagtctgttttcacactgctgataataacataccggagaccgggtgatttatacaggataaagggttaattggacttacagttccgcatggctgggaagcctcacaatcaatggtggaaggcaaggaggagtaagtcacattttaacttgaatggcagcagacagagagagcttgtgcagggaaactcctcattgtaaacccatcaggtcttatgagacttactcactatcatgagaacagcacgagaaagacctgcccccatgactcaattacctcctaccgggtctctcccacgacatgtgggaattcaaaatgagatttgggtggggacacagccaaaccgtatcaggaggggtgatgtctgcaattcaagaccctctttcttacccttttcagtgcctctttcagcaatatgaagttaaaaccaggtactgtgatcgctcacctgatttttagttcttatgaaggtgcttttttgtgtagatagttgttaaatttggtgttcctgtagggacgacaatcagtggagcttctatttggccatcttgttctgactccctcttatctaggttttaaaaaacaagtttcctccctactttttgattctaatggataattccaagcttctctagtgtgtttaatggtttttttaaaaaggtatttatttatgacagggttttaaaaaaattttttttattaatgaatgaatgacagggtcttgctctgtctcccaggctggagtgcagtggtgtgatcacagcttactgcagcctcagcctcccaggctcaagtgattcttccacctgagcctcctgagtagctgggactaccagcaacacagctaacctttcattaaatggaagccaatagcaaatcagattatacaattagcactaaagttgctatttaatcaatatatattttaagaaatatattcatcaataggttataacttgaaagtgtttattagagaaacaatgtattggtccattttcatgttgctgataaagacatacccaagactgggttatttataaagaaaaagaggtttaatggactcacagttccacgtggctggggaagcctcacaatcatggcagaaggcaaaaggcacgtctatgtggtggcaggcatgagagaaaatgagagccaagtgaaaggggaaaccccttataaaaacatcagatctggtgagacttttacttaccacttattcactaccacgagaacagtatgggggaaactgcccccatgattcaattacctcccaccaggtccctcccacaacatatgggaattatgggagttagcattcaagatgaaatttgggtggggacacagccaaaccatatcaaacacttcccaaaatttacaagcaagaaagagttaaaattggaaatatatctgtgtaaataacaatctgcctatacattgtcttataaattaatttctctttacatagttttgagtattattttaagattgcatcttttccagtgttccttttgtcaaaaaatgttttcatgaggaaggagaatgttgtgtgtttaagaagccaatgtatattaaattgagagaaactgagagtcttttacttttactttataggcagtaaagtatttacaaaccatgactgcttatttaaaaccgtaagccaaatttgtattgtagttaatccaaattgatcctgttaagtgaaattggttaaaatctggttttataaactttttaattttataaaataaacaggaaggaattgtgtttatttatttattaatttattcattactctcttgctgatgttctcttcggtctgaaatggacctggctgttcttctaaaacttaacattcttagtgagaacagttataggtgaacaaaatctcctttaatgttttagcttctacctctgtgaaaatgttgtgtgtgttagcttcagtaatacgctatgttttgttttcattttatagtttatatagtgttgattgtgtgccagatactattctgatttcttttatttgtattaacaaatttaattcttacaacaatcctgtgaccaaaagctatccttctctaccaggcatggtggctcacgcctgtaatctcagcaggcagatcatttgaggtcaggagttcaagaccagcctgaccaacattgtgaaatcccgtctctactaaaaatacaaaaaaattagctggatgtggtggcaggggcctatagtcctagctacttttgaggctgaggcaggagaattgcttgaacctgggaggcagaggttgcagtgagtggagatcgcaccactgcactccagcctgggcaacagagcaaggctctttgtcaaaaaaaagaacaacaaaaaacaaaaaacaaaaaaaaacccaaaaaaccaaaaaacaactatcctcttgttgacagatggttcttctctggcatcaaggctgatagctgtgtcatggaacatagctgagatccctaagatctggctagcattggtagtttttccccagtggtggacttagagaatagttttctttcaagaaggagacttgtcacacacccactgcagccaccatatgtgaaagtctcctgcccatgggaaagccaggctttacttgagtgattacagtgcctagtgtaaaggtacccatgtagaaagctgggggttgtcatagtcatctttctccccttagtttctcacattcagtcgcaggtactactgttctttcaacagtgtttcactttattagtcccttcttccctgtgtccattgaaggagttcaagttgttattatctccaactggatgtgcttaagcagtagcccctgttcttctttcctcttatatattactccactctaattctttgcaagttgtaggcttgaatagcctttttctttcttagtaatgactttattaagatataattcacataccatacacttcattcaaattgaataattcagttggtacatgcacagaggtgtgcaaccatcattctggaaagaaatcctgtattttttaatagcagtcaccccagccctaggcatctgctaatctactttgcctctatagatttgtctgttctgggcatttcatataaaaatagaatcgtcttttagttaacataatgttttaaaggttcactgtacagaaaggttacgtatttggcctgggttcagccaagggcttgtagcacagaacatccctctgattgttcctcggaagctgcgaccttggatttgtgtatagtctggactactagggattattgtggctttagctggactctttgattaatccaccccggcatcccccatctcctgttaagcttttgactagtctgtgtctattggtatcatactcagctgtttgtctccactaattcctaacagtattagtttcctagggctgctgtaacaaattaccataatctgggtggcttaaaacaacagaagttagtgcctcacagttctgagaactggaagtctaaaatcaagtgtctgcagggccattctccttcagaaacctttagggaagaatcttacctaactggtctggtgtttgccagcagccgttggccattccttggcttgtatctgcatcactgcaatctctgcctttgtatttacacagcattttttctcatgtgtctgtgtctttacatggtgttcgcccctatatgtgtatgcccaaattttcctcctcttacaaggatatcagtcatactggtttagggtcgactctgattaacttacagatttgggaaggggattaggacttcaacttttttgggaggggctggcacaattcagtccataaagagcttgttctttaccagctgtgccacttggatctaccctgcagagcaggacctgtgtgtatacttgtttgtgaagacgatagaaactgatgttgccatccaactcccggcatctagtagggagagtcagagtggcaaaacaggcattgcctggctgccgctactacctacttggtacaggtcttctgtagcatggagctttgggaagcagtatctgctgatgttcaccagctgctaaatctcctaggaatagctcttctactcctgggacctacaggagatgagagctgctactcaactgaccccactagaatagctcttccataacacagagttgtgggggaatgggggtagtctcttatctcgaatgccatggcttcccactattatgactgaatttcgatagattttgttgaatgaatgttttacaatttgttgtaagccctctgatcaatctccagagactgaatcattgtctttgctaatttttgctggtttaataagtgttggagagaagagatttatccaagctctttatactcccattctagaagtctagccccttgaaccgtttttaaaagcaccaccttccagtgtagagattgggatgacatataattcatcaggtaatttatgccgtaagagaatgattcacattagtgtcaatgttatttttcaacatactcaactgctgtaaagttttataatcctttgtcataaaaatagaaattattttaaagtttaatagcctgctttttgtaccataaacaaaacatagaagaaaaacttaagtggttagagaagaatgctaataacctttcattcaatgagtgaaattattcttgaaatatttagtaagttatataaccaaagtcttcctttagctggaagctggaatttttcatagtgaacttaatagtgcatctctttcatgagtatttatttgatgtaaatgtcaccatctgggctgcaaattttctcttattcagttagttgaaagggtcggtaggatacctttaaaactttaaaaaactttaaatacatttagtgcctgcacttaataatttgtatctaagctgagttcaagatgtctaaaactggaagctatgagaaatttctgtttttcctcccagtctaacatactgttttttggacagaatccccatgtgacttgattaatgataaggaataatcacaaagtattttaaaaattattttctgtaaagcttcatagtctatatcttaagatggtaactatctctgtgtatatgttcatttattttaataatgcttttattattttagagatggtttgaaccttatattttgtttagtccaccctcatcattttgatgaagtaattaagtccagagagcatgtaacttcgtaagctttacagtctaaggttacatatataactctaaaggaaagaacaaaaaccataatacttccaaaaatccctgaagcagtgcgtagtattttttcagaaagctttcataaatacagtgtattttctctataatttaatattatcattattttgtctagcattaatttggtatctataataaataattgattttagccttaacttagctgtagagtcctaaggattatatatttatatattttttctattagacaggcattttcttgtctcctttcacaacatacgtggttcagtaaaacataaaatcacttgtcaatagttagtattaatataaatatataatatcgtgtctatacatttcacttaatttttgaatccatgaattaggaattatctagatttattaggcttaaacaaataattatttgctttgttttgtgctgtactgttgataaagaagctgtctatatgttattatatttgatcctcacaaccaccttatgaaggtaggttggacagcttttattatttctgttttattgatgaagaatcaggtttggtgtttaagtaaattgcctacattttataactttaataatttgctcctatagttacccatttatttttatgttactggttagtcatggtagtacttactgtcttgtttcttctagggaatacaaaagtcttgatttttattctagacgatttaagaagaccaatttgggtcatttggcatgaccccagggctagctcaggtgtaagtaatacggggtgagcatcccaaattcgaaaattcaaaacactttgtaattcacaactttttcagcaccaacataacactgaaaggaaatgctcattcaattctcaattggatttttggattttggatgcccactaggtaggtataatgcacatatttcaaaatctgaaaaaataaaatatccaaaacacttctggggttaagcatttcagataagggctattcaacttgtgtaagttaaacttctctgaatgccaggattcctttttttcccttttagcaaactcctgtccttattttagttttagttcaatgtcaccttctctgtgaaggctgccgtttttcacaggatgcagaaatctcttattcccctgtgctttctcatagcacttttgtacttgcctcacttggtacaagtattatttgttcatgccatgattgattattgagctccttgaagacaaaagttgtgatatacctcttcacttctccatggccttgaattaaccataatggagctcagtaaatgtttttaaagtaaatgaatgaacaaatggtacatgcttgatgtgtgtctgtaaactgtataagccaaacattgtgtactccctgtttctggaataactgtgcaatgctaaacatttctttgactacttactatatgatgtctgctggtttttgctgcataaatattctgatatcttcagttggtgcttagccagtttattcctgttccactgcatcacttatgattatttgggacctggatgaagcagtttcattgtaatgttgtattagttgaatctgtgattttataaaatacgaattaaatttcttataaaatgaagtttgtcactcatatttgtctaaatttgtttaaaaataaaaatcctagctaaactcttgcctatcccagaaatgaatttaaggaccgtattccttatgaattatgaagggaatttaaaagggaagcatccaggaaggtgtaattagtgtctggtaaactggctcttgtgttttctctgcctttcctctctttcttttaccagctacctgtagaccatttccctgtttattagctgcagtaccagaaggtggaataggaaatgaagtttacatccttcagttttgttatttgttagctgatttcttaaattttaggtgtgaagaactataaaaaagttaggttgtttgtgctgcatccttattattttttgtatcctgttatcacaggcattgatgacttatgtataattgagtaaagctgcaggaaagaaaagcacttaggaaatgcctcttcagattttcaagatcttttcacacctctcttggagaaaagaatttaaaaaaaaaaaacctaaatggattctaattattttctttatctgtggtattttgttttgttaaatagtgtgttatataatgaatagtggaattgggttcagttgtgaattacaggaagtgacacatatgataaagattgtggttttatgtctgttcaacaaaccacagtggaactgaaatgaaactataaatattttaactacaccaattgctttctgccgccaagcaggactagtcctaatgaaaactagataagctgatacaaagttgttgagaagcagtacagaatataggtccttatgtaccatcaggaaactttagcagttttgaatcttctaggcacacattacttttgatcagtaagaaacaattattaggttattttactcttttaagaattgaagtagccacaataaagctattgtgtgtttttttttcctttgggacaaggatttagatttaataataaaatgtgttttgtatagtaaatattcatgaaacaattgaaaagcaaataaaaacattcaatttgtgtactcttttcacaatttacatactaatctgaggctgggctggaggagaaatatattcccacattattcacttaccaggagtataccatactttcagaagctttttcttgactagtgatgactcttaagattttactgttaggatttgaacacttgtaggtcctttagtatacagaaaacattagatatatttaatgggatagcataagtaatttccattctcattcttttcttgagttttaaagtctaaacccatagacttacacacttagtctttgtccactagtcagaatgtttacactttgctaagtagttatgaacgtcctctccggtgtatttgtttcatttttcaccatgtgaggcttgactgcttagtttgtgtgagagaatgtgctactgtgagaaatataatagtgaatatctaacccctccgtatcactgaccttcggtctagtagaggagagaccattataaaaataactagggagcccttatatcctaacttctcttatcctggcaaaattatcaatatcaccctttttcactttccagtgttgtggtttgggtgatgagtgatatagtcacactgtgagtaatgaggggaaagaacaaatatttttaacctgatactttttctgaattcatgtttaggtggtagaggataccatttgattcttggagactcccaaatataattttctgtctcattttgacttcttgtagatacatgctttgtaatcttttatttttatttatttatttttgaggtggagtcttgctttctcgcccaggctggagtgcagtggcgcgatcttggctcactgcaacctccacccctggggttcaagtgattctcttgcctcagcctcccgagtagctgggattacaggcgcctgccaccaagcctggctaattttgtatttttagtggaaacggtgtttcaccattttggccaggctgttctcgagctactgacttcaggtgatctgcctgccttggcctcccaaagtgctgggattataggcttgagccaccgtgcctggccatctgtaatcttttaaaaaggaagagaagggtaccaattatctggcttttcaagatttttcaaaacattttttgaaaaatttctgagtttttggaattaaccctttgagcagctgctgagatttttatgttcttaaattggttagattaaaagaaacatttaagatgtgtctgtcccttgcctttttctaaataatttatgattaatgtcacatatcctatacaaaaaaaagtatgaggttgtatgtagttttgacttgagattttccagaagtcttttaatggcacataaaggttttttgtttgtttgtttttgttttatactttaagttcttgggtacatgtgcacaacgtgcaggtttgttatatatgtgtacatgtcccatgttggtgcgctgcacccattaactcgtcatttacattaggtatatctcctaatgctgtccctccccactccccccaccccaccacaggccctggtgtgggatgttccccaccctgtgtccaagtgttcttattgttcaattcctacctatgagtgagaacatgcgatgtttggttttctgtccttgcgatagtttgctgagaatgatggtttccagcttcatccatgtccctgcaaaggacatgaactcatccttttttatggctgcatggtattccgtggtgtttatgtgccacattttcttaatccagtctgtcattgttggacatttgggttggttccaagtctttgctattgtgaatagtgctgcaataaacatacatgtgcatatgtctttatagcagcatgatttataatcctttggatatatacccagtaatggaatggctgggtcaaatagtacttctagttctaggtccttgaggaatcaccacactgtcttccacaatggttgaactagtttacagtcccaccaacagtgtaaaagtgttcctatttctccacatcctctccagcacctgttgtttcctgactttttaatgatcgccattctaactggtgtgagatgatatctcattgtggttttgatttgcatttctctgatggtaatggcacataaagtttaatctgcaatacggaatctgatataccacccctttcctctcaccatcatctactctattttactaacatgaaactccttaagcagccttttaactaggacaaatacttgtatcaaccaatacagaaagattatttattgttcttataggcaggtttgtttgtggctgcagttagtattagactgtcacttgggatgttattctggaattgctttttctaattctttcagtgaaggtatgtgactcgttctcttttttccttttgcaaagcaaaggctcgacaaaattttatagactggtgaaacattttgcaggtctgaaaaaagtgttgtaaacctgctcatgaggttcagacaaaacttctgtgcataaattaggagttggtgttgtctaggagtttgtgaagattaagtttttcagggttctgatttcatgaaatgtcattctagatttctgtcaatctcaattataggatgatagaagtatgctgatttctcgcttaataattatgtagtatttgcaataagtatacaataagaacttatgtacttattgtacatattatatgcagtatacaataagtatacttatgttgtcttattaccataaacagagcagtggtcatgatatataaatactgaggaaatcaaatgttttctttttttgtgatctaatatgaaaatcaatgcaacatttctggataatttgcgacaataaaaaagaaaagaaatatgaggcatgcagtaatcttgacaagcaaatttcctaatttgcaaaataaaaaattacattagataatctctaaaaagaaccttctatctctgtgtcatctttgaatctataaaatacagttggtccctgacttacaatggttagatttaaatttttttgactttatgatggtgcaaaagtgataaacattcagtagaaaatgtacttcagtgtggtattcagtgagttacaggaaatgttcaacattttatttaaaataagctttgtgttagattgtgccatattttgcccaactgtaggctaatgtaagtattcaagcatgtttaagataggctagggtaaagctatgatgttttagtaggttaggtatataaatgcatttttgactttggatattttcagtttatgatggctttattgggatgtaacaccattgtaagtttagtcacatctgtagattcatttagctaaaatgccgtaatctctctctctctttttttttttttgttttgagacggagtctcgctctgtcgcccacgctaagtgcagtggcgcgatcttgactcattgcaacctctgcctcctagattcaagcgattctcctgcctcagcctcctgagtagctgggattacaggtgcccgccaccatgcccggctgatttttatattttttgtagagacggggtttcaccatgttggccaagctggtctcgaacgcctgacctcaaatgatccgcccacctcggtctcccaaattgctgggattacaggcatgagccatcgtgcccggcctaaaatgccttaatctcgataggctttttgcacatgcactatttaaattgagtacaatactcaatacttacgcccttgcccccttctccctggatcttatttgctaaagtagacattgatttctcttgaaaatgtaacaaaatttttgttgaacattttagtgtttagtgaaaagatgagaattctcagacatgaattttttatttgataataggaaactgtagttataggggaaagtcagtattttgaaaaggcaaaccaaataggcaaatatttatggagtttctaacacaagcaaggctccctctgtcagaatggacatcaggaaatgtccactgagtgaacattcaataaattttatcagttgctgtgggggataaaattatatataattttcgctttatagtttgttttgaatgttctggaaacagttaaaagtaaatgagtgtttatattttgccgaagtatcaagacagaatagtaggcagacagttggtatttaggcaggcaaaagggcagattctctgccaaatggttgtaaatgaattgacgcaaggaatttaaatattaagctttgatgagagattgttaaattttctcaatattattgtttccattggtatgcaagctaattagatacaacaactaattggagccggtggctcagactggcttgccaccattggcacacacactggatggcggcacagttgttctgattgttggctaggaagtcttccatcaaggcttagctgtagtcttatctgcaaattcctcctggtcttctctggagaacgttgccgtacatgggtctttggaaacaaggaatttcccaggaaatccccaccatctttactgtctgtgatattaatacaatttgtactcttcccttttaaaatattttagtgatcttaaaacttgaccactctggaagaatggagaagttctgtatttggcaagaataaaaagtattacaaagcatcctgcttctgcattaagtggtagtttacaacaaagctgctgatcttaattgtgcatttaaaaaaacaggaatcttgttaaaaatttttatttctgtgatgctaccccatacattttagtacagtaggcatgggataaaagaaacactcgagaagctagcctttcctcagctttcctagaatggagactgcctcctaaaatattcagaagtcagaaattattttaaaactaaagtgttaatgagcaaatttaaataaagttggtctgtaaatatgtacttcagagctgaacttagtaccctcttttcacagctctaaatgtaatactttcaattacatgaactcattagtctctattagcatacttccaggctttagaaataaagactttgaaagagctcttctcttattttattgtatggaagtaaacattgaaaaataaagaatccttacaaaagtaaacttagtctacgttgctggcagaatacatttattctataggaggtaggtgacagctgtttttaaaactttgacacataagtacaagaaagattagaatcctgtggtccacattatatattgaatagtacacgaattacaaggaggaatgatttgggtgtcccctaattgagtcacttgaatttggataaggcagagtgctttccctggaggtgtatggagagaattcacatgaccccttcattgtccagcagctttatgcatcaagattggactagaaaaaatgtgggatgaatgaatttaggattctaaaatgctccagacttttcagttctttttgtttgcatagttgcattctaagaacagatcgaattactatcctaggctcagaaaacacatttgaggttagttttgtccaaagagcatatttagtcttccttaataaaagtatataagaaaggatttattgttattaaaaaagattagaatgaaactgttaagctacttaattttttctaattatcttttatgattctgtaatacctaggtagtttatgcatataattaatatattagttgactattcttgcttttttcttttttaaaaaaattaatgtttgcatggaatatctttttctcttcattttctttcaacctatttatgtattactttggattttaaaagtaaatcaaagcgaagttcacatcttaaatgttctcatgaagttcttttgaattttttccattagtgtcagaatacatgtttgggtaagtggcacaaacacttttaaaatgtagaaaatggaatattggtacaaagcagagtagaaacagcttgattcaataagtcagtctttaagtcattaaacagatatttgttcagtacctgataggtgccaggtttaggtgcattgtttaggtgccagagagatagtaatgaaccaaacaaagaaaacaaagtactgccaacctggagtttacattgtagtggaggaagaagaaaatgaacaaataaactatatcatatgtcaaaatgtaataaatactttggagcaaagtcaagctgggaagagagcagagagatagctgtcaatggatgggggcagggaggggggtaaggtggtgatttcagatagggtgatcagagaagacctctctgacaaagtgacacaaagaccataagatggtgaggaggggacaaggtgtgctaatttgtctggtagaagagtgtctgaggtagaaaagggcatgctgacatgttagagggaccagtgggagattagagtgactggagaggagtgagccatggaaagagtgggaggagatgagagagaggaagtaggggattgagccatgatgaatcccgtaggatatggtaaagactttggtttatgtgagatgagaaatcactaagggttttgaacagagtagtcacatgatttagcttacatttctaaaggaacatttggtcatttgtgtatacttgtctagttgcttagtaaatgacagcagaaagacaagaatttaatgcaactaattttaaaattttttttaaaagatgaagttggactggataattttgcatggcctttttacttctaaagtcctatgcttctttaccttaatacggatctgaaataattgatttaaaaaattttaaagtatgtaaaggaatattgtggaataatttgtattaatgctattgctgtatattttgtatattcagtgctttattatttatatctttccacttttttttctttttgagatggggtttcggtcgcccaggcaagagtacagagtggcatgatgtcggatcgctgcagcctcgacctcctgggcatcgatcctcctacctcatcctcctgagtagctgggactacaagtgctgtgccattatgcctggctaatttttgtatttttagtagagatggggcttcatgatgttgcccaggatggtcttgaactcctgggctcaagcagtccacctgcctcaacccccacaagcatgagccattgtacctgggcatcttgccacttctgaaaaacaaatgcatacatggcaattattaaaataaagataaatcactggggaaaaacatttaaaagcatgtgactttaaaatttaaaaactgtatgtaataagattttgaagaaagaaaagttaataggatttatgtaacgaaagaaaataattgtgacagaaaactgggctaaggaaattggtgcatttgaacacaaattttagctttgagcttcctggcagccagtggggtgtgtgtgtgtgtgtgtgtgtgtgtgtgtgtgtgtgtgtgtgtgcagctatggatatctctctaggaaatttatcaggtgatgtttttgtttgagaaaaggagtagtatttagttacctgggaaatcacttctagatgccaaccaaatgtgtgtcactaagacttgaaatcattttgataatttaaaagaaacccagcactttataagactcccttgacacttctaaaaagtgatgacaggtgtgcatggctgttagccctggaaaatacagctatacgtttcgttttacaggtgataaaagcctctattttgaagcagagatttgtgaaaattactaggaaaagtatgacattggtgatgtattactctccctcatctgcaggtcccactgatatctctatattggttctgttctttaatagatcataatttcagccttaatctgaaatacctaatgccctgcaaggctctctgagactagtggttttcaaactgtgttccaggggatcatggaggcatgtcaaatgcagagagtcctgagcttctagagctttgaagaaagggttctttttcaatttaaatgtttcttaaatttcatacccagtgttcatcaaatatgatatttatctatgtctctttcgaaggctataaaagactgagagaataagttataggacatttcagtgactagccttggttatttttttctttaagagaaacagagttattaggactaaaagacattttgatgtttcatatcagcagtagggagggagaacctcagggacaggttttcctccccaactccccctaaaccttttgtactcctaggagacagattttctgccacaaaattgcctgccatgcctatttgactcagtttttttcacctgcaagagaaaaaattaagaccctacaaagctttcctagccttcatttgtttccattacaagagaatgatgaatgacagtgttaaaataatttgacagtatttataatcttgtgtattattgttagtaatagtaggagcagtagtatctcgtagtagttcgcagtgtagaaaatatttgcttctgagtattaaaggacatgaatatatctgagagatatatctgatatatgtctgaatgtatttatgagagatatattagtcatcacctccacataacatgaataaatcaagctttgtaaaggttaggtaactagcctaagataacagactagtaaatactagaatctgatactcaagttcagatcatagaacttaagatctcatgttctttcaattgtattattgttaaattaaaagtttcagttgttgatgcattttgtcctcacagaaagatcaacattaatttgattctttgtattatttagaaaagaagcagtttctatccttactcaaaacttatcttaaattgaaatatgcactctcatatctagtaacaagacatattttattaggttggtgcaaaagtaattgtggtttttgccattaaaagtaatggcaaaacctcgtagtaataaaatagtctgtactgatttttcttttaaaaagagatttaaaggtttcctcatctactttattctagtaaaacttactagtactttggggatgatttattgtattttttttttgagattatgagaagactttcaagaaatctctttgtctttgtcttctaagccctcgagatctctttctccatcactattgatggggcacagccgttggtgtgtaaacgtcctacaactgcgtattggtggtacctactcataggaaaagattttagtgtacaaaaagaggctagtatatttatatttcaccattttttaatgaccagaaattccaaaataaaacatagtaagtgaagaaattataactataatttcgaagtttattttaaataatctagaatgacttttggataaaaaggtatgttttgaataagaatgcaaacaagaaaataatagcaaacattcagtaagctgtactagcatattttggtactgatgaaagatcaactgtattatgtttttccttttgctaaggtgatgcttttcatgcctccagggcagaccttctaatgtatttttctgggcaggagcacattcagccacaggctttggaaaaaggcagttagctatatgattcagattgatcttatattgatcagctattgatatgtgaattatccagaatagctgtctgttctgtttgaaattcagctattttttttcttggtctataaagatctttacatttatgatgcaattgaaatttccattttgtgaaaatttgagagaaaggaaacttttgagccttaaaagctctggcagatatcacattaaatatgcacataaatgagtaccattcctaaataaaatgatttattttccagttgtatagatttccaggcatcttaattcttcttttgctgtgctttcaaatgggttattttgtgggtctcaaatatatttccttaaatatttggtgaatccttggagttagaagagaaaggaatattaccatcattttattagtgctggtcaattctgatgggggtaaaaattaaagaagctgatatggtaaagacgaagaaaaaataaaaatatggggagactgaccctggctttcattggcgtagttcatttctgcccttcctttctatagatttaaataaagacaagtatttattttgactaaatcacagacatataaggcattttcgggggtagattgcggaggtagtaaaataaactatagtatttcttggatttgcttatttcttgtagcagtgtctatattaatgcatcttgaattttatgcagtgtaattactgtttagtgaaatttaaaaaaggttttttaagagacatggtcttactctgtcactcaagctgttgtgcagtggcactatcatggctcactcactgcagctggggactcctgggctcaagtgatcatcccacctcagcctcctgagtagctgggactacaggcatatgccacctcacctggctaattttaaaatttttgtagagatggggtctcactgtgttgttcaggctggtcttgaactcctgtgctcaagagattctcccactttggcctcccaaagtgctgggattacaggtgtgagccaccacgtccagccttaatgaataatttttttaaattgaaaagtcacaaaacttactacgaacaaggtaaaaggtgtacagtttgacttagctctttgctcaaaaatactgataacataataagtagggtaagcctccccagtgcctcaaaataccagataccgtgttcatcattctctcagacatgagtgattaaagtaagattatttcatttttttatgatacctgctgtgctcttgaagaagactgtcttattttcacttactagtaaaagtgaaagaggaacattgttttaacattttaaaaataaaaattattttttaattattgttgatttgaaataatcagtttcctaatatgttggttcaggtttcctgagatgcaaggaaataataattgtaccagaatggggggaaaaggagggaagaaaaaggggaagagaggagaaaccagttgcaatgaattatagtccttatcatgttactttctgagaaataaaatgggcttctgattctaaaaaatatactgtatctgcaagagtaaaagtcgtaatctttcccatatttcctataggcaaattaagttactttagtggcaaagtacatttaaaggcccatttatttcttcaatcacatgatagtaaaagttttgtcaggaggtctgctgaactgagaatacagaatcagtggcagtgacagaacatctaaaaatttccaatcaccatctcctttagacatactggtccttgcattagtccttaagccaacataaatgatctttaatgtaaaattgtaacaagtacataaagcaggctaacgtagatattgcgtatctcaaagcagttggatttaaaataagtgatagttaacgaaatccaatactgtaatgaacttttgagaaaaaaatagttgattatgctttttaattgtgtgtttggggttttggcttttattattactgttaatttggccataagctcattatgttaatcagttttaacagtgtttctccatttgctggataagaatttggctgattggccgggtgcggtgttgcatgcctgtaatcccagcactttgggagactgaggcgggtggatcagttcagctcaggagtttgagaccagtctgggcaacatgatgaaaccccatctctacaaaaaatagaaaaattagccagtgtgttggcacatgcctgttgtcccagctacttgggagtcttgaggtgagaggatcacttgagcctgggaagcagagattgcagtgagccgagatcatgctactgcactccagcctgggcaacagagtgagagcctgtctcaaaaaaaaaaaaaaaaaattcagctgattactactttatagttatattttcagcattagctaggcaatataatgcagcagaaaggatccagaagtcttcacatccataaaaattatagaaagtgtagtttctatgtattgctggtagttgtcagtcactatatctagctaattttcgataatatcttttggttcatttattcatttaggcattcattcagtactaattcggccctgtttctgtgctgtaccctgtgtcgagcactgggatgtaacagtgtgcaatacaaagtccttgtccttaaggaattgataatctagctgggaaggcctacttgatgaattacagatgagtttagcacaaattgtcattgagagatgctgtgtgctttaggacgatttcacataggagtctaacccagactgggagttcagggacaactttactgaggaataatatttaagtgaagacttgaatgatatataagagttagcaggactaaggcggggatgtagggagaaggagtacttatagtttagtgggaacagtatgtgcaagaactggagtatgaaagaagaattcaaaaaggttaatataggtggaatgtagagaatattgagtgacttgaagctataaagattggtaggagttagatcatgcagtgtattttaggctacgctgaggattttagactttatctgacatatagagaaagccatcaaaatgagtgaaagtagagtgattagtttgtctatttaaaggctaagcccctggagattggagggaagcaaaattggatgtggggagatgaccaaaggctgtggcggcaacttgactgaaagatgtggtaccttgagggagaaaagtgggcagtctgagagctacctgggaagtataataaacaagacttgcaaaccatgagaaaagattacttaagatttcttcctggtgttgctatcaccaagatgggtaaaactggaagtatttgttggtacacttccagtggttgtatttgtgtgggtgggcatgttatttgtgcattttatgatcaaaatgtgcagtctaactggctcattaaaaacttgacaaaatttaggtgagttagcaattctgaaacaactttatgtgtagtttaagattaagcaactaaatatgtggtggatattaagagttaatttttttaacatcagaaaaaaagagctagaaataaggtaaaggggaatctataatgaaccttggattagaatttgagatatcagtatgaatgaatggagataaagagaaggttgcatatatgtgtatgtgtacatgtatgccttatatatttcttacttctgttcatgagagggcctagaagcagtgacatcatagctccagtcaatacacccagtaccagatcttgggtttaagtgccaggcaccaataaaaggaaccagagttccttggaaaaactgaattggggactgggactgggactggggaagtacaggatgaaagtggcaaaatgttcaaaaaatgatgggagcatgtcaaaagaatgtatgagccaactctaaggagctctcagtggccaaattagggacactttgagcactataataatgggccataacccataaaataaaaagtggtatccagatataattaagtaaattcaaacgggagaaaggaacacactttcttgccatggaattccaattagtaaatgaagagtcattgatataggaaattaccatttgaaaagaaacactacagtaataattgttttaggtgagaacagttagtggacaatgtaagatggttataaacaggatatttacagtcacaaaaagatctcactaaaagatatttactataattataaaggaatcatagtaaccttacagtggagaaaatggacatcttcttaaccaactaatcaaagtagacatactaataatgagacatggatatcatgcattttctgatatgatgtactgagaacgacacaacattacttttgtggtattcttgacaaaatgcatatcctgaatttaatcatagaaaacatcaaacccaaattgagggccatgctacaaattattgactagatttttagaaagtgtcaagattatgaaatatgaactaagcaactgtgccagattaaaggaaaccaaagagatctgataactaaatgcagtgtggtatttggatcaaacactggactagaaggaagatattagtaggacaattaacaaaatttgaataaggtttatagatcagttaatagaataatatcagtattagtttcctgatttagataattgtactgtggttatataagatgttaatgtttggggaagctgggtgaaagggatatgggaattctttgtgtaatgctttgtaaagtctgaaattatttcaagattaagaattaaaaaattacaaaaacttagagaccctagttaaatgttttctttaatttaatgaagggaagaggagatgatatggtggggttggttttattaaatttgactttataattatgttatgtttaaattttgattcctgagtatttacttcacttgaggatttttttttaaatcttcccattctcttaaacattgtcttgggaacagatgtatttttattgtgttagcaagatgtgtctttaaaatattttcttgaaatacagtaattgcacttctagaaatggattcattttaacctgatttaaaataatcaaagtagtcagagtgattaattttatgtttgttttagtttatttttaattgtcaggaataacgggaaatactgaaatatttagagaaaaagagttaggatgaaaagagggaaaacatttaaagtctttaaatatttggataatactgtgaattttcagttgttaactcccatttaatacatggataagctgaagcctagaagcttaactgttttgccaggacctacgtagttaacctatattggaggtgacattttaacctgtgtctgtatgtcaggctccagattttcccacaatactgtaatgaataaaagatgtatatattctactgaattgtaaagagccattactctttaaaattttttctttttgcctgtttgataatcatgttttcagaatgcacagtttttaacatttatttacattaaatttttagctaaaatacagagtatttataaattggttatggaaaagtgaggaaaaataatttgcatctactatgcactatatttttttcttcttgtgaagcaagtgcctgtcatgctctggaaaatataaatatgaaatctgaacagttgatgattataaaaataattacaggttgccattatgaagcacacagtcacacctaatcctttaaataaatgtgcttaactacactaaaatacatgttttaaaatgttaaacagagacattctaaaaagacacgtgaaaaccatttaatttttttaaagaaaaagatgctgagtgggtccatagtgggaattattttaaaacaagaaaaaagaaatctttagccctggaaacccttcttggactgcattagaaataaatttcctgatgtagcctgtaagtcagtcaaaacagggaagactgaatgctgggagcaataggtgtgtttgttaactctgaaatactgaaagtcagaaacatgtgaaaaggatggtcatgttaagtaggatctttaaagtcggtatataaaccatttctttgccttctattcaagcaatatactttcatccttctgttgtgtttcctcaattcctacactttgttttcgtactccccccaccaggaatgaggcaccaacaccagtgggagagttttagattccttagaaattctgcttatataagtgagtacatcaaatgatctttgccacaaaaatgatgaatgtttcttttgaaatgcagaccatggttccaagaagtttatgctcacagaatcaggagccttgcattgaaaaggtgtaagtcttgctaatagcctaaaagtctatttttttcacccaactgcagcattaaatattggaggtaagactacagacctaaagagcagactgggaagcaacaaattatcttattggtggtgatgttccttatagtaacaatgatgaacttttatagagcacttcctgtatgccagacaggaacccattaactcatttaatctttacagttgtttaagtactcatcttatccacattgtgtggatgaagaaactgaagtataattagataaatttacccaaagccacactattgagattctacttgagggcattgtaggtctcattttggacatatgaactctggtagttataaatacagtatatgtttttctagttgtgtcttcacctagaatcttcaagaccacaagctaaaggtttgagtgtaggtaagcttaggtttagggtctgcatttgagcatcttatccagctgacagctgtgaacagaaattaaaggtagcattttaaaactgtgtctcccacagctactcttatctgcataaactgtattctaaagcataatcatttcccctcttttctttcacttccttcttctcgttcttttttttttctaaaaatactttagtaattttaatagtgtagtaattgatcaaactatttgcttgcaaaagtatctggccaattttttctttgtgaaaagtaaacagcagtcagctagctgtgtatcagtttatcttagttctgaaaaggaatcaatgagaagatgtaaacaattatgacaaaaccaagacccaaaccacaaaagacttcaaagattaagtaattatgtatacatagttccatataacaaaactaataattgatagtagggaagtaaaagagaacaaacatttgttgatttcttgcccaagcattaggtgtttacaaaatgtattgtttacagtggagactttgaaatttcaaattcatttaggttagttggaggagggaggaaagctattgacagaaacactatttatttctgtctagctaaaaagaggatttaagcattatggggggtactttgatttagtttagtttttttttttttttgagacagggtcttgttttgttgcccaggctggagtgcagtggcacaatcatggctcactgcagcctcaagcccctgggcccaagtgatcctcccacctcagcctaccaaatagctgggactctaggcacacagtaccatccatcaaatcttttgtggagatggagtttctccatgttgcccaggaccttagcttatttgattgcatagtttatttagcacaggaggggatatgataggagagctcttccttccgcagataaaaatgttctcttccgtgcttataaacatttcactttagtctctatgagattgtgtgaatttttctgtggtcgtaggctacattttcacactacataaactatgcccctggttatagaatgcacatgcattctgcagtacaccaatgtatttgtttgtagttggctttattatttattcgtatgtgtatatttaaacattcctgacttggttcctgacaccaagaatacatacatgtatattttcttggaaatactatggaatataaatgagtattagcatcaccctgcgttgatcaggtgaatttgatagaaatgggaggggaaattttcttaataagtcctaaacccaagaataaacttttatatttttttttctgcttcatagctgtggaaaattattgcaaccaaactattgaaaccattcttaaagttaaaagaattgttattttaggacaaattttgaagataatacttttttgggggtggggaacttctgctgttattgttgctgtgctggaggaatggtgcttattcttttggtagcataactagtggtctgacatgaaaaactcttaaaacttaccctatattgggtctttaactgctattttatgttaaaaccttacatattagtatgtatatatatatgtgaatgcatacatatacaaactacattttcttatttttaaaatatcttaaggtacatgaaggagttaacatgttcatgaaacattgtgacatggaaaggtacttaggacttagtctaaaatggaaaaaaaaaagcaagacgcaagactgaatatgtagtatattcaatttaaaaactttctggccaggagcagtggctcacgcgtgtaatcccagtactttgggaggctgaggcaggtggatcacctgaggtgaggagttcaacaccagcctggccaacatgatgaagccacatctctattaaaaatacaaaaattagctgggtgtcgtggcactcacctgtagtcccatctactcaggaggctgaggcaggagaatcgcttgaacctggggaacagaggttgcagtgagccgagatggcgccactacactctagccggggcgacagagactccatctaaaaaaagaaaaaaagttctgaagtgaacatgtgtattacttttaaagtaaacttttgtgaagtatgtggcatgctcctcaagtgaacacatctgtgtaatcggtgccagatttaaaaaaagaacattgccagccctcctttccaaggagacctcgtgcctccttcacttagccactgtctggacttctcacaccattgataagttttgactgttttgggactgtacataagtggaattatacagtactactttcctatgtctggtttcttctgcacaatattgtttgagattcgtacttattttatgtagttgtagtttattcttattgctgtgtaatattccattgtgtgattatatcataattcattctatgtttatgggtagttctcagtttggacttaaatcatttgttacttttatcattcaaaatggattttaaaaaccagaaatatcaactaaatctagttttcaagtgaactctctttaaatttgcagatgtactgtgctaattattctgcaaattagctactttgatttgattttttttcagtcctgatttatcaggagtttacagatttggggatgtctaatcatgttattgattatgttcaacctgtttttcttcaagcatgagtactttgatttatctggttaagaaattttcagtccttcatactgaggtctcagtcatcttacaatagagacagccagtttactccccactttctagcctccgactcttgaaagcttccaagaaacacatccagaggtcacatattgggcaaccgaaggctcatgtgaaaaagccttagagccacaaaaaccttgcgcctcagtcattaatgtaatttggggcagattttatgaagcaaactaacgcctttgaatttttttttttcagttttaacgtgagtataattacttccactcctttttccactttccagtctctccgagttgcgtccctaaaggatcctgctgcaagaaatgagtgaatgaatgaagatattaagaattaaagtactgatgttaatgagagcatgggtgatgtggtttggattgcttgaggccaggagattgaaactagcctgggcaacatagtgagacaaaccttgtttcaaaaaaaataatatatatatatacacatacacacactaagtgaggtggtgtgtgcttgtagtcctagctgcttggaaggctgagatgggaggattgtgcccaggtgacagagcgagacccagtctgtattaaaaaaaaaaaaaattaaatgttgtatacttagcacataagtgatcattaaatgtttgatgaatgaattaatgaggaaagattttttttttgaaaaagaagttttatgaggagagaaaacattgcatatgtaaggcattatcctcaattccattgtggactctcccccaggtgtgcagccttgaatgatggaaatatcctcatgagattctgaaagaggaggaaacgaattttgcccttaaataggtgtcagtacagctgcacttatttgcacatttctagttctgcctctgactagagatcaattgtgatgactttgaatttgtagaccatctgcctgtcagtgcacttaaaattgcaactgatctttataagctgagtataactattattgtagcaaacagcaaattaagtgactatacactggaaagagttaggttcatacctccttgaagactgtgagctgttctttatttggacacctggtattaaactcttattggttattaatatttgggacaggttaatgaagacaatattttacagaatatagcagttttcaatataatagattcaatacaacaactttttgtgtgtttataattttgttacttattatttaccataagtggtttaaaatatacgtggcaaaacattctttagagctttgattgcaataattatcacataaccaacacctcttaagtattacgtacttaagaaggaacttgaactttatcttaacacaatagcattgacaaattactcacaaaattagtagttgtggaagaaaataggtataggaagagtaagtcactgatattgagtaaattaaagttatagacattaaattacagacaataaaattatagaagcactaaatagataaattgatttttttaatgtcatgttaagcatttaaattgcctttacaaaatattcttcacagtccttggagaaattgctgctgtatatttgattaatatgtgaacaacatttttattgttaaaatattttcttcattcctttcaaatttgtatttaaggttagcagagcctcaagcagtgcctgagtaggaaagtgataaactgacaccacactgtagaggaggaagaaaaacatctcaccaacggcagacagcagaaactaatggttttcaactgttgctgatctaatcaatcatggtgctatgatataatcagttctgtgtgattcgtttgttgttctactggaatgcattgtattcccttcttatttttaagcccccctacttctagttttcgcctttcttaaaaggcaatttctaagattgtgtttcttttaaagccaataagtaattgtgaaagacaaactcagagcctgttgaatttcaacaaaagttaagtattttgtaggacatacaacaatagtgttctttaattaaaatactgagccatatgaaaatttgtccaacatttggtaaatgcccttagttgaatcgttaatatcctagatagtaaaagattagtaccttttatctctagtctactgggtacagattttgctttcagatactatcatcacatcatcacacacaggttgaagatgacattttctcacctgttaaggcatgactttcagtaaaatgtatttagctgtcagaggtctgcaagcagtccatcagttgagacatgatgctgttttgaccgatattggtgacattttaaaagctacacaaaaattcataattataaaagtgttcactgtttcactaaagactgtgtaatgcattgcatattaattaataagatgttctcttttaaatgctatccctaaaatgtacttaatgttactttccattaccatgcataaagttttaaccatttattcatgccattagaaaaatgtagacttttcctttcttttcggtatgttccttttacttttctactcattatagagtcatgaacaactatggaaaaacacactttgttgattctttgtgatgtttttgaaaacttcgttcatatatgaaaacttctaattcaccttgctttctgaaggagaagactaagttacatatgagccctgttttgagtaatgtattactattagtattacagtatgaaagatttataatcagaagcccctttcccttgaagtggaattattctctatggccattagtacttagggtgatatactatcttcagtgctatcctgtgcctttccatttttgtcatgctacttccctctctttacatccctgcccacctccactttctgctgttaagaatagtccatagggactgtaaactagttcaaccattgtggaagacagtgtggcgatttctcaaggatctagaactagaaatacatttgacccagccatcccattactgggtgtatacccaaaggattataaatcatgctgctacaaagacacatgcacacatatgtttattgtggcactattcgcagtagcagagacttggaaccaacccaaatgtccatcaataatagactgaattaagaaaatgtggcacatatacaccacggaatactatgcagccataaaaaaggatgagttcatgtcctttgcagggacatggatgaagctggaaaccctcattctaagcaaactatcacaaggagagaaaaccaaacaccacatgttctcacttataagtgggagttgaacaatgagaacacatggacacagggaggggaatatcacacactggggcctgttgtggggtgggggcctgggggagggatagcattaggagaaatacctcatgtaaatgatgagttgatgggtgcggcaaaccaacatggcacatgtatacctatgtaacaaacctgcacattgtgcacatgtaccctaaaacttaaagtataataataaataaattacatttcttccaacgtatttatcagctacaaaaggggacccttttaatctccctctcaccaactactacttctgtgtctcaatttgtcattaaatcaagtgaggaatgtttattcttagagccatccttaaaaaagaaaagaaaagaaaagaaaatatcttgcacttatctttggttgatgacctaatatctggaacactgtttcttattaataagtttgtggtaggctataataaactccatataaagccatgccagttgtgcacatgtaccctagaacttaaagtataataaaaaaaagaaggggttcataagcaccctgtaaacactgaagcctattcaaaaggagaggggtaggacacatctcaccatcaatcatcgcaagacgacaatggtatgaataaccaatgtttacttcatacaggggctacttaaggaggtcactatatctcaatgtgaaaactccaatgaaccagtcactatgttcaattgaaatcaacctagagaaccttatctctctgcataaatgctcctgctgcatggtttttcatggccactggtggaattctgtgatgggggaacaggaaatctggacacagaagggtgggaataaaatgagcctgtgctgctttcaaaaaaaaaaaaaaaaagaatagtccataggctaaagcttattgctagggttaccacctagaacagggaagcttaattgtgaattagaaagtagatttttttctttttcaaagttcaaagataagacaatagccagacattcaagtggttaaaggattttctgagaacttccaaagctgggtttttacctaacaaaaagcatatttggaggattattttatgtcataatcatagtaagaagagtaattctagacaccaaggactggtcagtccatcccatttaggtatgggggactgaggtacatagattcagagtgggtgaggctagggtaagaatgatacctgggccctgaggagggaataagttccctttatcttagaggtgaaacaaaatagaactttcacaaaggccaaagagtaatccctaaaactgcaggctgttgctagggtttctctgggtatggcctgcaaaacccacagacttttggaaagtcttgtttggagcaaagtgccatctctgtcatagcacagtagtaatgaataaaggatgaaggacaaagccaaagggcagtttttatagggttctgcacactccagggtaatgcagagaaagcaaccaagagttttgactatcccctgaccacccccccaccacctccccgcaggagttgatagtactgagtgggctgcaagactgaaattggcttggtttcaagagggaggaggaggcagctctatgcagatttcttgtgaacagagagattggacatctctctgcaactactggcacagcttgcctgctgaccaagtggatgaagtcaaagcaaaacctgatgctgagaagtgaagctcatgaaaagccatcctggaaggacagtaaaagaagtcatgcttcagggaggcagccaaaatggccgaataggaacagctccagtctacagctcccagcgtgagtgacgcagaagacgggtgatttctgcatttccatctgaggtactgggttcatctcactagggagtgccagacagtgggcacaggacagtgggtgcagcacactgtgcgcgacccgaagcagggcaagacattgcctcactcgggaagcgcaaggggtcagggagttccctttcccagtcaaagaaaggggtgacagacggcacctggaaaattgggtcactcccatcctaatactgcgcttttctgacgggcttaaaaaacggcgcaccaggagattatatcccacgcaaggctcggagggtcctacgcccacggaatctcgctgattgctagcacagcagtctgagatcaaactgcgaggcagcagcgaggctaggggaggggcgcccgccattgcccaggcttgcttaggtaaacaaagcagccaggaagctcaaactgggtggagcccaccacagcccaaggaggcctgcctgcctctgtaggctccacccctgggggcagggcacagataaacaaaaagacagcagtaacctctgcagacttaaatgtccctgtctgacagctttgaagagagcagtggttctcccagcaggcagctggagatctgagaacgggcagactgcctcctcaagtgggtccctgacccctgacccccgagcagcctaactgggaggcaacccccagtaggggcacactgacacctcacacggccaggtactcctctgagacaaaacttccaaaggaacgatcagacagcagcatttgccgttcacaaaaatccgctgttctgcagccaccactgctgatacccaggcaaacagggtctggagtggacctctagcaaactccaacagacctgcagctgagggtcctgtctgttagaaggaaaactaacaaacagaagggacatccacaccaaaaacccatctgtacatcaccatcatcaaagaccaaaagtagataaaaccacaaagatggggagaaaacagagcagaaaaactggaaaccctaaaaagcagagcacctctcctcctccaaaggaacgcagttcctcaccagcaatggaacgaagctggacggagaatgactttgatgagttgagagaagaaggcttcagacaatcaaactactccgagctacaggaggaaattcaaaccaaaggcaaagaagtaaaaaactttgaaaaaaatttagacgaatgtataactagaataaccaatacagagaagtgcttaaaggagctgatggagctgaaagccaaggctcgggaactacgtgaagaatacagaagcctcaggagccgatgtgatcaactggaagaaagggtatcagtgatggaagacgaaatgaatgaaatgaagcaagaagggaagtttagagaaaaaagaataaaaagatatgaacaaagcctccaagaaatatgggactatgtgaaaagaccaaatctacgtctgattggtgtacctgaaagtgacggggagaaaggaaccaagtgggaaaacactctacaggatattgtccaggagaacttccccaatctagcaaggcagaccaacattcagattcaggaaatacagagaacgcctcaaagatactcctcgagaagagcaactccaagacacataattgtcagattcaccaaagttgaaatgaaggaaaaaatgttaagggcagccagagagaaaggtcgggttacccacaaagggaagcccatcagactaacagcagatctctcggcagaaactctacaagccagaagagagtggggacaaatattcaacattcctaaagaaatgaattttcagcccataatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaaccggtaccagccactgcaaaatcatgccaaattgtaaaaaccatcaaggctaggaagaaactccatcaactaacaagcaaaataaccagctaacatcataatgacgggatcaaattcacacataacaatattaactttaaatgtaaatggactgaatgctccaattaaaagacagactggcaaattggataaagagtcaagacccatcagtgtgctgtattcaggaaacccatctcatgggcacagacacacacaggctcaaaataaaagatggaggaaggtctaccaagcaaatggaaaacgaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtccttagtgacatacaaagagacttagactcccacacaataataatgggagactttaacaccccgctgtcaacattagacagatcaacgagacagaaagttaacaaggatacccaggaattgaactcagctctgcaccaagcgacctaatagacatctacagagctctccaccccaaatcaacagaatatacatttttttcagcaccacaccacacctattgcaaaattgaccacataattggaagtaaagctctcctcagcaaatgtaaaagaacagaaattataacaaactgtctctcagacctcagtgcaatcaaactagagctcaggattaagaaactcactcaaaaccgtgcaactacatggaaactgaacatcctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagagctagaaaaacaagagcaaacacattcaaaacctagcagaaggcaagaaataactaaaatcagagcagaactgaaggaaatagagacacaaaaaacccttcaaaaaagtaatgaatccaggagctggttttttgaaaggatcaacaaaattgttagaccgctagcaagactaataaagaagaaaagagagaagaagcaaatagatgcaataaaaaatgataaaggggatatcaccaccaatcccacagaaatgcaaactaccatcagagaatactacaaacacctctacgcaaataaactagaaaatctagaagaaatggataaattcctcaacacatacaccctcccaagactaaaccaggaagaagttgaatctctgaatagaccaataacaggctctgaaattgtggcaataatcaatagcttaccaaccaaaaagagtccaggaccagatggattcacagccgaattctaccagaggtacaaggaggaactggtacgattctttctgaaactattccaatcaatacaaaaagagggaatcctccctaactcattttataaggccagcatcatcctgataccaaagccgggcagagacacaaccaaaaaggagaattttagaccaatatccttgatgaacattgatgcaaaaatcctcaataaaatactagcaaaccgaatccagcagcacatcaaaaagcttatccaccatgatcaagtgggcttcatccctgggatgcaaggctggttcaagatatgcaaatcaataaatgtactccagcatataaacagaaccaaagacaaaaaccaccatgattatctcaatatatgcagaaaaggcctttgacaaaattcaacaacacttcatgctaaaaactctcaataaattaggtattgatgggacgtatctccaaataataagagctatctatgacaaacccacagccaatatcatactgaatgggcaaaaactggaagcattccctttgaaaactggcacaagacagggatgccctctctcaccactcctattcaacatagtgttggaagttctggccagggcagttaggcaggagaaggaaataaagggtattcaattaggaaaagaggaagtcaaattgtccctgtttgcagatgacatgatagtatatctagaaaaccccatcgtgtcagcccaaaatctccttaagctgataagcaacttcagcaaagtctcaggatacaaaatcaatgtacaaaaatcacaagcattcttatacaccaatagcagacaaacagagagccaaatcatgagtgaactcccattcacagttgcttcaaagagaataaaatacctaggaatccaacttacaagggatgtgaaggaccgcttcaaggagaactacaaaccactgctcaatgaaataaaagaggatacaaagaaatggaagaacattccatgctcatgggtaggaagaatcaatatcgtgaaaatggccatactgtccaaggtaatttatagattcaatgccatccccatcaagctaccaatgagtttcttcacagaattggaaaacactactttaaagttcatatggaaccaaaaaagagcctgcatcgccaagtcagtcctaagccaaaagaacaaagctggaggcatcacgctacctgacttcaaactatactacaaggctacagtaaccaaagcagcatggtactggtaccaaaacagagatatagatcagcggaacagaacagagccctcagaaataacgccacatatctacaactatctgatctttgacaaacctgagaaaagcaagcaatggggaaaggattccctatttaataaatggtgctgggaaaactggctagccatatgtagaaagctgaaactggatcccttccttacaccttatacaaaaattaattcaagatggattaaagacttaaacattagacctaaaaccataaaaaccctagaagaaaacctaggcattaccattgaggacataggcatgggcaaggacttcatgtctaaaacaccaaaagcaatggcaacaaaagccaaaattgacaaatgggatctaattaaagagcttctgcacagcaaaagaaactaccatcagagtgaacaggcaacctgcaaaatgggtgaaaattttcgcaacctactcatctgacaaagggctaatatccagaatctacaatgaactccaacaaatttgcaagaaaaaaacaaccccatcaaaaagtgggcgaaggacatgaacagacacttctcaaaagaagacatttatgcagccaaaaaacacgtgaaaaaatgctcaccatcactggccatcaaagaaatgcaaatcaaaaccgcaatgagataccatctcacaccagttagaatggcaatcactaaaaagtcaggaagcaacaggtgctggagaggatgtggagaaacaggaacacttttacactgttggtgggaatgtaaactagttcaaccattgtggaagacagtgtggcaattcctcagggatctagaactagacataccatttgacccagccatcccattactgggtatatacccaaagaactataaatcatgctgctataaagacacatgcacacgtatgtttattgcggcactattcacaatagcaaagacttggaaccaacccaaatgtccaacaacgatagactggattaagaaaatgtggcacatatacaccatggaatactatgcagccataaaaaatgatgagttcatgtcctttgtagggacatggatgaaattggaaatcatcattctcagtaaactatcacaaggacagaaaaacaaacacctcatgttctcactcataggtgggaattgaacagtgagaacacatggacacaggaaggggaacctcacactctggggactggtggggggttgggggaggggggagggatagcattaggagatatacctaatgctacatgacgagttaatgggtgcagcacaccagcatggcaaatgtatacatacgtaacctgtacattgtgcacatgtaccctaaaacttaaagtataataataatgaaagacaaaaaagaagtcatgcttcctcttatatccaaatgccaacttggtaagaagggaggagataactgtagggaggggtagaaatttttatggattaaacagccaaagcaaagtgttttaaatcagaagatactgagatgcctttttaaatgacacggttgatttttttcctgtgatgatttgaaatagcgacttgtaactagaaacaagtttagaaaatacagttacttttttttgtttgtttgtttcatgccctggattgtggctgaccagtttatacctactgtgctggaaaagtttaaattataaattactgtcacagtctccgtagatactaaaatctctgatctataaaacctgtattgcatgagcaatactgtcattcctcctttttctataacagttattaaaggagaagaactatgctacgattcatgtgtatttactgagcatataaagcagtctatgcagttcgtacatacctctctctaaatgcattgaggaaaattatatctcttacgtaaatcatctaagactttctgaattttgttagatcctgccatttcttgttttacacaggaggctgccagctatcaactgattgaattgattacttcattaaagctagaaatacagatctgatgagttttgcaattaattgtatagaaagctgggcttggaaaaagaagaggatgcactgagtagcagagtagacctgatgctcagttaaacctaaactgctactggtacagcaagtcagacaagcagtctggaccttactcagggtcaggagaaagcggcaaatcagaacccaggaagagagtcagggaacattatggtatatacccattgaatttagatgatcaagagtttaagccagacagtaacctacagggctacagggcaataaagagtcacacgtaacaaatctttgttgtgaaatagacaaatatttcatgctatttcagaaactattcccagagttgagcagagtaaatctgcagttaggcagtgttaggtaagtgaaagaatcatgtgaggttaggactaaggcttcatcctgatgtcagcctgtggtggtacattctgacactaactgcagacaaatttctcaccttcatatgtttcctgaaaacttatcccgaatttatttttgttaattatctcatctcctcttatacccaagtgcattccttgactcaacttctcatctttcttttatgtatcccaaaaaagtttgctcctcatcagtgtcctttacactgtaaaatttttgcctgagagtattctcttttagaaaatcttctcatatcaattccaagtagttttaggtggaagcacagaaacactaaatctctgttgtcaatcaggttatgctaaattatgctgcataacaaacaacatcaaaatttcagttatttaacacaggtctccaacccctggtgccagtttatggacaaactgtcttctgaaaaactggtccctggtgccaaaaaggttgaggaccgctgatttaacccatcaaaagtttatttctcctcacacagatacactgtgtaactgggtgattctctggggtgactgacttcgtcttggtagtttagcaatccagactgctttgatcttgtggcaccatgattgctatggcagggaggggagattctgtagaaagtctcacactggcaattaaatgctttgacctggcttaagtatcattggccagaatagttgcatggtcttacttcactgcaaggagtggggaaatacaacccttgcatgggccggaaggaatgggatatcagaatggataagtacaaagtcactagtacaccttatttgggcagtgtaaggtttttgtggtgattattgatttctgagaagcaagaaattataatggtgtttgttaccgtaagtgctttttttaatctacccattgtctaataacctttaaaatatttcctaaagggcaggttatttactgaatcttgaggatgccagtgcctggagatatgtgtgtgtgtgtgtgagtgtgtatatgtatatctgcatacacataaatgagattatatccatagaaaatatttgattctttttcagttcttaatatctagcataacaggcaggtttagcatttttttaaataatcctactgtcttaaaatggtatgtggaattatgttcccaagaggatctgaagagtatgagggcatagccttcccattaaatccattaattctctatgggagctccatatcagcagcttctgtttccagaaaacagtaaatatattgaatggagagaccattaaaagaaatacagaaagcttagatgtatctctgaggggcgatttgaccccagcaacagtatctgactccttattatttataaacatacggtgtctacatttaggaaaaaattcttctgaaattggtaaatcttcgaagacggaaggaaatctatttaattttttttgacacaaggtctcacgctatcacccaggctggcatgcactggcacaatcacagctcactgcagcctcgacctcgtcaagcgtgatccttctacctcagccttccaggtagctgggactgcaggtgtgcaccaccatgcctggctaatttttttattttttatagagatggaatttcaccattttgcctgggctggtctcgagctcttgggcttgagtgatcagcctgccttggcctcccaaaatgctaggccaggcatgagccactgtgcctggcccagaaatctattttaaaaggaagaaaactgataggaggaccacttgaaaaaatatttatatgtactgtagttgccctttgtttttctgtcagggttttgaattagctatgttgaatgagagctctcagtcagcaactactgatttcatttcaacagagcaaacacaaacatactgaacttagattttagaaaaataactttgtgtatgatggttcacagaaccagtggtgatggttcacaatgatgcttaaaggttcatcaagccctgccaataaaattagtctgggaacatttaatatgtttgtcacaataaaatgttctatataacaaacctctttaaaggaagtggtggaaattagtttctaacagctgcatcaaatatcaataagtacgtttgcaaaaaactgagctgatagttgagacttttattttaggattgaaaaaaacaatctgagaattaaattcatatactggtctacaattataaattacaaataatttattatatggttaaaacaatcatgctttttattttgcttctacctcttttatttaaaaagtagctgtaagaataacagaactgaaattaagtatttaaatatctaaatatttcttgctatggaaagcaaaaaagctgatgtgctttaagttattgtgccattgtgcatgaactaacatgggttgttgagtgcttgcttatgtctaggcattgttacctatttattatgtgtagtatctcctttggtcctattattaccttgtcaaaattaacattcacatatatccagtaaattgaccaagggtacctagccacaaagtgttagaagcaaaatttgaatccacatgtatgttcttttcattatactgtttttgagatttggaatgggagtggcagagacaaggggatgatcatgaagcagccatgatctgatctcattgccgtttttgactattcaactattcaacatcatgaacattaccttttttcagattctttatttgctgcttttcatggactctggacaaatgactagttttttgtctttgcctgtgtttcttgtactctttcaggatcatttccctactctaatgatgttgctaaggggaatggcagagtgctggtcctgtcatctttattgctaacatctcctttgagaaatatggttctggcaggtttttagaatgtagatcaacaagataagagttgtactaggccttcataagcagtgaggactggagaaatcacctagattcctcaggccagatatgaatgggctagtgttagctcatagtacaaatttcttttctaaacaaaagactatctccttgttccttcttttggaattaaaagttgcttgtaaataactttttcataatctctataactggtgtctacagattttggaaacagctttaatggtagcatatttgaaatgatctttgatctattaaaaaaaatttgtagcacgtttagaaaccaacttaagatgcagaacttttctttttttgcctttctctggaaatttctaatgatatgtccttatctttgtgtaattcttagctgagcatggaggtgtttttattttttatataattaataattttattactcaggaaattatacttgcaccttgaggacaccttgaaaatttggaattccagtgtactcagacaggggagattcatgaaacatagataattgaatgaaatatgaactagctttctaattgaatgaaatatgaactagctttctaaactctgactgtaggatcacatccctgaattgttaagggtatggagaaaaatctctgagctgccaccagaaagccagtcctctctcttgatgccccaggagtgatctaggactctccccagtgttcaggttagtggttttacctgctggtctaattagttttccttggcagtcttcagttcttctttcagatcagaaatagtatccccaaatggaaaggccccataatagatgaatttttataaagggcctaagtatttgaatattactgtaagacatcattattatagcagagtgacacgatgttccaaagtattcccatagtcatccagaaaagttcagcatgtttatgctgtacagtaacaaaaagaagtgagtgctgtaacttagaaaaattcgttttaaaaaagtcagtgttaaaaaaaaagtgagtcctttctccctattaccttccttcctttgtgtaacaaagattaattttacttctgctgtgtgccagaacagtactgaatgctgtggatacaaagatgaataaaacatgttctttgtcctcaaagagcttgctatgtaattgttcaaatagacataagaaaataattagaatatgatgtagtattttgatggtagtgttcaaaatatttctggagagcatagaagaagagataataatgaaatcttcctgacatggtatgcgggggacctatcaggactagcttcaggttcatggtgaattttccagttaatacttcattttccagtggtgtcaaataaatgaggtacagctatatttttgaaagattacctgtttggcatttaacatcattcctctgggattttaccctgttttgaatggaaggtagcctttttgaaagaagatgagccacttttgtaaatttagtatgaaacattttgagctcctcaagaaatttctttataatttctaaataaatgggacctaattaaactaaaaagcttctgcacaccaaaagaaataatcagcagagtaaacagacaacccaccgagagaaaatattcacaaactatgcatttgataaaggactaaaatccagaatccacaaggaatgcaaacaaatcagcaagaaaaaaaaatcccatcaaaaagtgggcaaaggacatgaatagacatttcttaaaagaagatatacaaacagccaacaaaaatatgaagaaatgctcaacatcactgattatcgggaaaacgcaaattaaaaccacagtgagataccaccttactcctgtaagaatggccataatttaaaaataaaaaataatagatgttggtgtgaatgtggtgaaaagggagtccttttatactgcttctgggaatgtaaactagtacaaccactatggaaaacagtgtggagattccttaaagaactcaaagtagaactactatttgatccagcagttccattactgggtatctacccaaaggaaaataagtcattatgtgaaaaagacaacatgcacacacatgtttatagtagcacagtttataattgcaaagttatggaaccaagctaagtgcccgttgaccaatgagtggttaaagaaaatgtggtatatagacaccatggactactactcagccattaaaaggaatgaagtatgttctttgcagcaacttagatggagctggtggacattattctaagtgaagtaactcagaaatggaaaaccaaatattctatgttctcatttgtaagtggaagctaagctatgaggatgcaaaggcataagagtggtatggatgttggggactcaaggaaaggttgggagcagggtgagggatgagttgggtacagtgtacattactcagatggtgggtgcattgaaatctcagaaatcaccactaaggaacttatccatgtaaccaaaaactacttgcatccccaaaaactattcatataaaaataataaatacaataaaatacaaggtattattggatattctttagccatagaaccattttttagaaaatcatgtatttgaatgttgagtatagtacaagaccactatctgtataatcttatgtaatttaaaagttttaattgtatacatacttaatctcataaatagtgggtacatatctgagaataatttcataaaaaagctccttaaaacgaattcactttaaatcaaattcaggaagaaggggccaaaatggtgaactagtagcacctaatgtgcaccactctcatggagataaaacaaaagggctagttaaccctgaccctgtaggctgatgatctgagaaaccacattagggtccatcaaggcagcagggggacacagagagcagagaggaacaaagaagggcatcaatctatctgggctcagtgtggagccaggagaacctcccaaacatgggaaagaatgagtgagtgtgagcttcctgggggagcacatccccctgcgcttataggctgaagcagagagcccattttgtgtgggggcaactctcgagtccaaggagaccactttgagacttgggccctggagcagaccaacactggcaccatagcaccaatagaaccttcagtcatggggcctgggagcagtaagattacaccacttctgccctcctccctccatccctgctggatgaggcttggtgtcagcttctggcctagtggtcctgcttctgtctgaactcggacagaggtcctggcttgctattgtcccaggaaggacccagatggcagggtgggccaccctacccacccctgccacaggtagccaggcaagcaatgcctgctagagtttctggctcagtagtccagcttctgtgtgaacttaccaagagggtgcaacctccctttgtcctgggaaacacctggacaaaagggagagtgacctcaccccaaccctgtcacaggtagccaggtagcaatgcctgctagaacttctggcaaacagtcccacatctgtgagaactcaggaagaaggtgcagcctactgttgcttgtaaagtgtctagagagaaggggtaggtcacctacaaagggaaccccatcaggctaacagtgaaaacaggcttttcagcaaaagccctacaagtcagaagagattggggggtctatattcagcattcttaaagaaaagaaattccaaccaagaatttcatatttggcaaaactaagcttcataagagaaggagaaataagatccttttaagacaagcaaatgctaagagtatttgttaccaccagacttgctttacaagatgtcttgaagggagtgctagatatagaaaggaaagactgtgttaccaaccatcacaaaaacacatttaagaacgtagactagtaatgctataaagcagcaacacaatcaagtctgtgtgataaccagctaacaacatgatgatgaaatcagacctgcatataccaatattaaccttgaatgcaaacaggctgaaagccctaattaaaaggcacagaatgacagcttggataaagaagcaagatcgaactgtatcctctctacaggactcatctcacatgcaatgacactcataggctataagtaaagggatggagaaaaattgcccaagcaaatggaaaacagaaaaaaggaggggttggcattctactttctgacaaaatagacgttaaaccaccaatgatcagaaaacacaaagaaaggcattacgtaatggcaacaggccaaattcaacaagaagacttaattattctaaatatatatgtacccacccctggagcacccagactcataaacaagttcttacagacctatgaagagacttggatagccacacaatagtagtgagagagttcaacaacccactgacactattagaagatcatggggcagaaaactaacaaagatattcagaaccagagctcaacatttgaccaaacgggcctagtagacatctacagaactctctacccaaaacaacaagatatacattcttctcatctgcacatggcatgtactctaaaattgaccacacaattggccataagacgattctcagcaacttaaaaaaaaaaaaaacttaccaaacacactctcagaccaaagcacaataaaaatagaaatcaatactaagaaaattgctcaaaagcatacaattacatggaaattatataacctactcctgaatgacatttgggtaaacaatgaaattaaggcagaaaccaagtacaacataccagaatctctggggcacaactaaagcagtattaagagggaagtatatagcactaaacacccagagaaacggactaaaaagttaaaagttaaaaggatctcaagttaacctaacatcacacccagaggaaccagagaaatgagcaaaccaaccccagagctagcagaagacaacagataaccaaaatcagagctgaaatgaaggaaactgagatgtaaaaaaccatacaaaagatcaacaagtacagaaattgattctttgaaagaataaataagattgatatgccactagcgagactaatagagagagagacagaagatccaaataaacagaatcagaaatgacaaaggggacattaccaccaacccaacagaaatacaaaaaaaccccagagactactgtgaacacctctatgcatgcaaactagaaaatctgaaagaaatggataaatgcctggaaacatacgacctcccaagattgaaccaggaagaagttgaatccatgaacagacaaataatgaattataaaattgaatcagtaataaaaagcctgccaatcacaaaaatcccaggaccagacagattcacagccaaactactgaatgtgtaaggaaaagctggtactattcctactgaaactgctcctacaaattgaggtggagggaatcctctctaattcattctgtgaggctagcatcattatgataccaaaacctggcagagacacaacaaaaaagaaaatcttaggccaatattcctgatgaccatagaagcaaaagtccccaacaaaatactagcaagccaaattcagcagcacatcaaaaagttaatccactgtgatcaagtaagctttattcctgggatgcaaagttagttcagcatacacagatcaataaatgtgatttgccacaaaaacagaattataaacaaaatcacatgatcctctaaatagatgcaggaaaaaaagcttttgataaaattcaatatcccttcatgttaagaaccctcaacaaactaggcattgaagtaatgtacttcaaaataataagagccacctatgacaaacccacagcaaacatcatactgaatgggcaaaagctggaagcattccccttgagaaccggaacaaggcaaggatgccaactctcaccactcatacttaaccatagtactagaagtccgagccagagcaatcaggcaagagaagagcaatgccaagaggaagagaggaagtcaaactatttctgtttgcagatgatatggttctataactagaaaaccccatagccactgcccaaaagttcctagatctgataaacaacttcagtaaagtctcagaagacaaaatcagtgcacaaaaaccagtagcatttctatacaccaacatcatctaagctgagagccaaatcaagaacacaatcgcattcacaatagctacaaaaagaataaaatacttaggattgcagctaatctgggaggtgaaagatctctaaatgagaattacaaaacactgcccaaagacatcataggtgacacaaatggaagaacattccatgcccatagataggaagaatcaagattgtttaaaatggccataccacccaaagcagtctacagattcagtgccattcctatcaaactactgatgacattctccatagaattagaaaaattatttttaaattcgtatggaaccaaaaaagagcctgaatagccaaagcagtcctaagcaaaaagaacaaggttggaggcatcacattacccaacttcaaactatattacaaggctacgataaccaaaaaagcacaatagtggtacaaaaagagacacacagaccaatgagactgaatagagagctcagaaataatgccagacatctacaatcatctgatctttgacaaagtcgacaaaaacaagctatggggaaaggactttctatataataagtggtgctgtgataactggctagcaatttgcagtagattgaaacgaaccattagagaaatgcaaatcaaaaccacagtgagataccatctcacaccagtcagaatggccattattaaaaagtaaaaaataatagatgctgttgaggttgtggagaaaagggaacacttatacactgctggtgtgtgtaaattagtttagccattgtggaaagtagtgtggcaatttcttgaagaacttaaaacagaaataccattcaacccagcaatccctttattgggtatatacctgaaggaatataaatcattctccacaaagacgcatgtgtgtgctcatcacagcactattcacgatagcaaagtcttggaatcaacctaaatacccatcagtggtagaccagataatgcagtatggatataccatggaatactatgcagccattaaaaaagaatgagatccttcgctttgcaacaacattgatggagctgaaagccatgatgccccatgttctctcttacaggtcagaggtaaacattgagtacacatgcacacaaataagggtacaacagacaccagagcctcctagggtggagggtgggaggagggaggggattgaaaaactgcctgttgggtactatgcttattacctgggtgacaaaataatctgtataccaaacccctgtgacatgcaatttacctgtataacaaacctgcacgtgtacctctgaacctaaaagttaaaaaaaagaagaaaaaaataccctgggatcagacatttagagtaaattgtgaaaaattacactaaaacttagacatataagttgattttagttcaattaagaaaatttgtataacagaaactatgttctaattatagaagaacaatgaaaattagtgtttattggtattttttgtatgtacaatagcacataatttttacaaaaaaatagtaaattgcttctatcagtttttctaagggactctcttagtccttggcagacaagtcattctgaagaatttatcctgtcattatcctttttgattttctcatcagggcctttgaatgtgatcctgcagttctccatcatccctttaatggatttcatgaaatcttttaagtgattttcagtttcattataaaatggaattaatttgccctgtgtttgttgacaaaccaatctttatgatagaatggctgtgatatatttggtttacaatccagtttcttggtattagaaactctgaagtgatgtctttttgtttgcttatgagttgactgatggctggcagcatctaggtagcttcatgatgggggctggtcactggaaaaaccaaggcaggattagaggggtggggctgaaagtcacaccaacatctgtgctgaaagttaatttgatcaccaatggccagtggtttaatcaatcatgcttatgttatgaaacctccataataactcgaagggtttggagaactgcttgatgactgatcacgcagagggtggtatgcccaggaaaggcatggaagctctgtgccccttccccccataccttgccctatgcatgtcttcatctatatcccttgcagtatctatgtggaagtaagcttaagtatttgtgtgagttccgtgatttcgttcgggcagattaattgaacccaaagacagggttgcagaaaccctaactggaagccagtgggcagacgttctggagacccagacttgtgactgttgtgcaaaggcggaggggtgggagggcagtcttgtggactgagccctcactttgtgggatctgaaactacctccagttaggtagtgtcagaattgaattggaggacacccagctggtgtccactgcagaattgattgcttgcttgttgtgtggggaaaactcttcacacatttgctcacagaaatcttctgtgttgatttttgttgtggtgtgagagcagaggaactgtggttttccgtacacagaatggtcgatacacatatagatatttggctttggtctaattttgtaagtggtcatttaattagcattttcattttgtgatggcatttgatttcctatgtactgtgtttttttcaaactagtatacatcaatattttttaacacaacatttcatttactcttaattatttatattatgtatagttctcacttcataaaaattataatcctaatttagaaaccaggtagattgtgaaatggcaaagttgatgatgatggctcctccaatgacagtgataatagctgccatttgtaaagcttctactctatgccagctgctgtactaggtagtttaataatccttcccacaacctcaaaagattgatgttaatcacctgacttcatggataaagaaattcaggaaattcgtagaggcaatgagtgtcttacaagttaaaaacaagccattataatgatcaagtttgtgtttttttccaaaacactatgtctttctttggtttatagaagcatttacttcagggttttctctataaattaattatatttttggtacatataatataaagttgataaaaattggaatagcccacagttgtaggaatacttttctatgttattatttctatctgtattattaatgcagtgggtgttaatcttataaaaattattttttccttttgctttttttgttgagaggtatttcacaaatactccttcttcagcagatttgaatcaaaatggaatggaagatgtggaatttatgaaattggattttcacaacaaaaaagtcataaaatatactgtaatgttttaaaaatggcttgactgtacatccatttctaatagtttattttcaaagagaatggtgtaccatttcccaatgacttcttaatggaaaccagtgattgccattggaattgcagttattttacagtgtgtgtgtttatataaaccattactctaaaatatcaggttgcagctttggtatgtgaatgaattgaaatgaacgaaatttagatattttactgttttttatagctgcagaaactggaattgcagatactagtcttgatttagcctatggtgaattttcagttatttgaaagttttatttctcattcaaagagtagcttttatcatggcctttggtcagagatgctgtttgtattgttaaaataaaaatctcttcaatatcaaatagtatataaggaaggaatccagaattagcctgttaggcacacacagctttgtggtcccaggaataatggcattcttgaatagtaactcctgagatcagtaaaacttcagaagttattgctttattgtcatttttttactgtttgtcctctaacatgtgtgattaataatacatttctcatgtatagccataatgtgccattgagttttggatcttttgattacttgtattctctcctaagacaaataatgggattgcattcttaaagctaccagtttcttgcaggttattatttgacatgcatattacatttttggtacagctcatttccagggacttgctctgttgctatttctcactcagcatgtttcagaactaccaaacctgctgaggcattaagcatactctttgtatatgctcttaggaatatgggaattgcccatatcgaagccagtcatccagccatcatgtgtgattttctgctttgaacacatttttgtcttgtgttagaggtaagcattaaggtcctatgagtctcctacttcagcagtcatatacagaagatagaaacttaattttgattgcatccagtgatgtttttatataccctgaaagcatgatgttttataattctggtctagtgtgtttgcagttttgtttttatttatatgtatctctaaacctaaaacaagtttttatagaggaaattttaggtaaattttgtataattttttaaaagttgtcagaaatctttattttacatctgttccccctttagatactaatatccccatgtgggaaatggaaaatgtaagttctccatgctgttgtaagggctgtaaacatttctcaaaagctatatcaacgcagtcaccagaacatgtttctgctctgttgcatgtttgtttccccatccttttaccattgttgcattttgtttttagtggccctaagaagcctgcttctttaattttttttctttaatcctgtctacattctttgttaaacttttggtctttgtcacttctagattactttactaccatagatttccctttctgtctttaagtttgttattttgaatcactttcaactttttctgtgacacactagtgaggaactgttcagagtgaattcactaggtggctagcatcttagagtcaaaacataaaatgttgaaattgattaactagagatagtaatgtcaatttttaagtaattaaacattgtctagtttagaacaaagtaaaccccattatagaagtgggaatttaggaagagggaatgccctgttgttatatagcctttctgtataaaatattataggaaatatagaatcagatttatggtagttaagaactttctaaatgaattttagtatattttcacaggaatgatgtgaaaagaagaatggatgaatgttatctgtgaaatggtgagaaaagaaggaactgtgagaattgtgttttgttatttaaggacctgtgaaggagatggaggagatcataagttccaccagtggtggagctagatctcctggattcatttgaatagaaaaagagaggatatgttgtgttctgtagatgaaggctatcaaaggacacctcaatggaagatcccaggaggaaggtgataaacaaatggaaggtagacttgagtgtagctttcttctgaaatgggaagagagtagaagtaaaagcagaaaagaaaaatgaggctgttgcttataaaacttgaaaacgtttaaaagattgggtagtagttagagtctgagtaactaacattttaataaataatagaatctataaccaattgtgtacttttttattttaaaaaatttttttaatagaaatggggttttgctccattgcctaggcttgagtgcagtgacacaatcatggctcactgcagcctaaacctcctgggctcaagtgatcctcccatttcagcatcccaagtagctaggagtacagctgcatgccaccgcacctggctaatttttaaattttttgtagagatggtagtctcactgtgttgcccaggctggtcttgaactccagacctcaggtaatcctcccacctcagcctcccaaaatgctgagattacaggtgtgagccaccctgtccagcctgttaacatatttttaatagatgtttttgagttattaaatacccataccctgcagcattgtggatattttatgttttctcactcagtgtcactgattggttctttatagtctctgaattaaatatattttcaaagtagcatgttttctaccaagcgaggtattttattgttatttaattattgacatccttgaaataagagtggctttgtatttaagaggtatatgagggaacacagctgaaaaacaagagcatttttgttagaaatatattggggataggtgctggggtgggagggagactcactaagccagcaattttcaaaagttacagtagtatatataaaatttgaagttaattgagaataactagagaatgaaaccttctgaataataatagagatagttttgggaggcaggaagggaatgtctttggttgcgataatgtttattgctttgatctaagtgctgattacatgggtgtatttctgtcttaaaagtcattgagactgggcaccgtggcttatgtctgtaatcccagcactttgggaggccaaggcgggtggatcatttgaggtcaggagttcaagaccagcctgcccaacatggtgaaatcctgtctctactaaaaatataaaaattagccggctgtggtggtggacacctgtaatcccagctactcaggaggctgaggcaggagaatcgcttgaaccctggaaatggaggttgcagtgagccgagatcacgccactgcactccagcctgggttacgagtgagactccgcctcaaaaaaacaaaaaagaaaaaagtcattgagctgtataaaatataaataaaacttaatgtttatacattttgctgtatgtaaattatatctcaattcttaatgcaggaaaaagcacactcctaatgggtacttcagactgggatttttaaaaaatttctgttttgtttactaagtgtactggatatacgtctagtatcatctttaatgttactttaaaaatattctttaaagtgataccactggaagaaaaactagccaatttatttcacttataactgtcatgagctgaaatttcccaacactgacctctgtttcagattcctgctgttgcctctgcactattagttggtgtcagcagggggttagcagcactcaatttaaccttgctatttgtattctgttttgaatttttttcttttctcatttaacttccttacatggattctccattttaaagattgtgcatgcaccatggggtctgtacagtgaaagactgtagtacagataagcatacaatagaagcacatttaaagataatgtgaagctgcttttcttttttttcttgaatagaggcattgctgtgaaaatcattaaacaagagaaaaattaagcctactcatgctgttatttttccgttaagattatagaccagtttaaaatatataagaactatatagatatggattaattatacattttatgtccatttagaggggcatctctgtgactgttgtgcttgtagctagccatggacagagacttattggaccagaagtacttcttttgtctctcccacattaaaattttagaatctgttatgactgagaccacatccactattcttatttcaatgtgccccctctcattgatccctctactcccttcttggaccttttatcttataaatgctgggaccttcctattcaaagcagtcttctacagcaggataggaagtcatgggtaattaaagaggggcctctaaactccagacccttcctcctcaactccccatggaaactgtctcccctgaacagtgctttgtagaatcctagtgaacttaaagactcactactcttatgagtggtctttatctttctctgagtgggttctaagtaaaacaccaggttggtggaaatggaaaggaaggacggctggctcaaattctggagatactatatgaaaaggaataatgagacactcactgtcctgtggggtaagcaggaaggaaagcctagcttcccattccacagcctccaattccattcatttccagccactgctttgtacagctccagcacactcctctcctggtctgtagttcaagattccactagtttcatctccaggtgccaaagacactctgcttggtgcctaagacaccaaagtgaaaacaacagccatggaaaacacttccagttaagttgagggagaccgagatttcactatgtatagcagggagacttgcattcctgttagctcaaacagattctgaaggcatttctccagagatgccttgcttaggtgaatggggagtgtaataacccaggtattgtattttaatattataatagtctactcttatgctagggtgacatacatcctggcttgtactggatgtatgtcaccatcctggcataattgttgttagtaaattgcttccccttttattccccagaagtttggatggtaaattatatggtcactatacacataacaaaaatggacttctcagtccatgggaattgtgtaacaaaagccccaaatgtaaacatatgtcattaagtaaagttaaaatgatagtgatggtgtttaaaaatatcgtaaatgcaaatgtttattaaatgttctaaaaatcaaaacaaaaaacctcttttgtcagggattcttgttactatgatataattcctacaggatgcttaatagcactgcccacacaatggatgtgaaataaccacctaatattttaaaatattaagtcaaaatataatggtataaaatctttataatagaatacttaaacgtttcaattaggaatttcagcttaataaaattacatgtttaaatttgtcgtattcccagctcttttaaattaaagaaccaatcatgggccttcattttgaacattgttttaaaatcatgttaaatgtagaaaacaaataatgattaaaaacagagatattggttttaggagataagtgtttcacatttattatttaccttttttaaaagacagattatgtaaattattcttcaaatttaaatgtataggtataaaattgaataaataaaacaagttttagtaagaaaactattttcagacttaatactaaccaactattgctaatatactataaaatgctacttaggcaggttatagactccaattattatagttaatggcctcagtggcctcaccttgccttaatctaggacataaagcatgcagaactcgtaatttaattatcacctgttaatattggctctaaattcatgtctcccctttcgggatgaaactgcagtgatgagccaattaaaaatcattatcttcctactgaaaacaccagcctgctaactacaccacagtatacaaatctgctgagactttcaagaagaaacttactgcctcttacctttagggagtgctgaattaaattattttcggccatttataattctaatattttgttttaattatttatttttttgagatagggcctgtgttgcccatgctagtctcaaactcctgatctcatgcaatccttctgtctcaggctcccaagtaactgggattacaggtgctcacaaatctaatttttcacatctctagattatatgaagattgtattttttaattattacataccttaaaagccatgagagaagtggagagttatgttattctatagtaataaatggcagaaatgaaatctgtgcttttattcgtatttacatatcatgagatataaaaaaaaaatcagagaatgtggtgctataaaagggttgttagcttataaaatcccattgatatgtactagagaaatgtgcagttgatttacaggaatttattagaaactttgctctttgtgtactctcctgacattgtgtactcttgtactgaaatctaattttataattgacccatgggaatcaaactctggaaaattgatttgtgctaaccaaactcacaagagattgatttataaactagtaaatcactttttaacttactatgagaatgctacctgatccaaaaacctgaaaaatttatggtgtgtttttgagttttcgctactctcagttcaggcactatagtgaataaagaggtgaaaaacacttagtcctcatcctcaatgaatttataatctggcgagaagacttggacagcaatacatagagtacaagtcagactacaataaatgagtgagtgatatgttgtggttaaatgtttagtagaggttttttgtttctgctaggcatactcttgtagttgggaaaccaaattatacttcagtggatatgttttaagagatatttctttcaagccattattggataataaattaactttcccttttctctgcatgtttctatataaagaatcaggaccaacagcccataattaggacacctttgctcttgaatatgctctagacactacaaaattttttaaacccttaacaagtgcagatacatgaaaagttcactcttgttgcagttattacaccagaatctttccttctgtactgtagattaattctaaagttagtgcataaggcaaaaattaaattatatgtagccaaagtgctctaaaaatttcataaatggcttatagaatacatactggttttgtaaaactgctcagtaatatacaagtataatgtttggtaaatcatgatatataataaagcatacataatccaaacaattttaaagtattctaattgcagtattttaaaggagttgtttatacaaaggaatcttaataaattaaatgtatgtgccatgtatatcctctgtcatcatactcaagtttgtagttttcttccattgagtagatttcaggtgggccactatctaacagtatatattgggatacttacctgttaaaatacaagatagattgtgttgcttttgaggagcttttctatagccagcctgttttagactttttgcgtggatttgttttgtgtggtagaagtaaggagatgatcaaggtatgatttcatgaatcacatagtttattgccatacaaagagaattttttccttaggttcctagtgcgtaaagaaggggagaataacgtgaacagatctcacagggagtatacttgataggtaagatacgtgaaccacaaagtgagtaagttccaaaattattaaaggcgttgcccaattaggatggaagccgtcttctgtggaaaatagtctaattaaagattgaggtgtacctttttacaacctttgtaccatagaggtcaagcctatagagaaactggcttgaccaatacagtggagatctgttaccacaggtaaggtccctcaaggctgagggtggtgccagtagtggcaggcaaggcttcagagattagctggaatgatgttgccctgtggcaatgtcacagcatgtcctcttggtctttggagaacatgtagcttgccacagtctgaactctcaaagtgtctgtcaaactcttagttttatatgtattttgaagtccagtagttgaggtcagcaactcacatatgagttctgataaggtgtgatgtgacattcgcaaggggaggggtaccactgtcacattctctaggggatgagggagaaaacactccagcttcttcttatagcagaacataaatcattcacatagcaaactatgtaagtgtttggaatcatttcacagcaacataacaggattcttactagtctcaggcatccttcctagatttggatgttagtcatacttttctctaattactatattcacccaaacatacatgcagctgactggcattgggtccgtgttctgtttctgaccatggatagcttaccaacctacaaggaaatcaagcccctgacttggctgttatttgcactgtactccatcagctgagcctcagaactcatctacctgaaaaagtgataaaattgtctcatttagcaagcacactgaagcaagactagctgtgttcagcctgcatctaaaagtgtgttactctgtgacttggctcactgtaatagtaattttgaggtaattattaatgatagtgtttatggtactaactggtgcctgatcattttcacaataaggttggtattatttccatttttaggagatcaaagtttgcaggatttgcaaaagccttgatttgaaagccagtggcagagccaggccagaatgatggttttccccatctaaagtcagtcagtggtctgcttatctatgagatcatggccattataccaaatattgggaggacctggtgaaagatgcttttaggatctggcatcgaaaatgtagagctcatgctctggaatccaagagttgtaagaatttccctgttctccttaagggctgggtgactttcagcaagttactttaaacttttcaagcctcagtttatcccccttagggattttctgatagttaaatgaaataataggtaaagtgcttagcacagaacctgatatatgataagagcttagtaaatattatttgttttttaatcttgatatttagaatttcaagttttcaacagcttttatgtacatctcttatgtacatgtgtattgccaaatgaaagcctgtttttcttcctaaaaatgactagatattatataactctataggtaatgttcttatgagggcacacataatcaccaccactcacaatacctagttttggaatcttaattattccttccataatattttcttaatctgctataatgtgagatatatgactacagctgagagatattaaaagcagaacaggaaaccacagaagtttcttaaaataaaaatacaaactgagctcagaaacatgatttttatatacatatctgaaaaagaaatgtagccagtgagcagaatatactcaaagccaaccacaaataagcagtaaaaaaaaaaaaaaaaaaaaaaaatactgcagtttattttaaaattgtacacatcttgctttcattagagtatataggaatttcattataaaatacatttttaaaaatttaaaggtacatatgtgctttgactgaataattctgtgatgttgattatactctaaagtatacatgtgaagctagagttgaatatgaggtgctgccttgttcttccagactgtaatagcgtgtatgctatgtggccaaaccctgtcctctgcagagaccagcaagtcaaacccatgtttctcagagcttggttacatgagctcttggtagcacatgtacctatatgtaaaatatttatagatagctctcaatttttaaaaagtaatgtacagtaaattttatgatcaccttctaattgcaagtgaattggcttctgtttttgaattgacagcttccctttgaaattcatttacttatgcttttttaaaaagtgtgttgattttaaaaatcagcatgaaaactagtatgaggatagggagaaagtacaaatgttacactcagctgactgaagttttggggactctgaactaaacagaactgtatagttgatattttaacttaaaatattacctgtttggcctacctaatttttacttgagagaaaaataacattaatacctattttctttgtcaaatctctataacaccctttaattactacatttttagtagcagtgatttgctgacatttgtgcaacccctatgttgtgatccatatacttctcagtgactgaagtattttctttaaaattagtcctgctatatgtttatgtaaatctttgggagagggatttcttttcaaaatgctgtttgactgtcttgtgagattgaatgtctgtgatcaaagtactgaaaaatttaaaatacataattatgaagtagctcctcacatctgaagaaatgttccacagagattccaccatgtttcttcaagattatgtatttatttatttttttattttatttttttttattatactttaagttttagggtacatgtgcacattgtgcaggttagttacatatgtatacatgtgccatgctggtgcgctgcacccactaactcgtcatctagcattaggtatatcccccgatgctatccctcccccctcccccgaccccacaacagtccccagagtatgatattccccttcctgtgtccatgtgatctcattgttcaattcccacctatgagtgagaatatgcggtgtttggttttttgttcttgcgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagattatgtatttattgagttctaattttctctcggacatggtactaagacatggtgtgatgggagagagagatgttagaaagacacctctctgaggaggtgacctttacgttgaaattctgaagaaagtagggcaggtaagctctaagtagaaggaaaatatgcaaagacctagggcagaaaggagtttggtccgttagacaaactcagagtaatcctgtgcagtgggagcttagtgaatgaagggaagagaagtgagagataagtttggaaaagtgagaaggaatcagtggggcagtctttctcccagatactgtcactttatcataaattaacttagtgaaactacactagagctaaaactgttactttaccttgaatataaagggagaaaatgctaagaacatttgattactgtaaaaaaaaaaaaaaaaaaccctgaaattgcgaacttctctattggaaatttaaaaaaaatcattttgttgaaattgctatactcttgtggtagtgactaaccatcactaccatcccatttcttctttattaaaaaaaaaattatttttctagagacagggtcttgctctgtcactcaggcaggagggcagtggtgcagtcctagctcactgcagcctggagctctagggctcaagcgatttttctgagcagctaggactacaggcacatgccgtgactacaggcgtgtgccgctatgcccagctgatttttaaattttttgtagagactaggttttgctatgttgctcaggctggtcttgaactctttgcctcaagtgatcctcccgcctccacctgccagtgctgggattatagacgtgagccaccggtgcccagcctcactttcttctttagcaggcctccctgccctataccttctgctcatatttaatgcataggccctacagtcagatgaaatcttcctgggaattgatttccctgaccttaattttctatagtcctgtttttacctttcgtgttctgtgcccagctctgttggaatgcttatgcacctactatcagtgactttgatctggctggaggggttctaagtccatatgctcccccttgatttagaattggattctctagtactctgtatttcaggtacagtgtaggttaagtgatttttttttgagctgccatgagatttaagcactttatgtaaaacaatttaattaggtaagtgaattccaagctctaagcactaaggtaggtagaccaagttttgaaacataactagtttataatttgggaaccgtttgagttaaactgtattttcatcttcagtagtcttgttctgtgcctcattgttagggtccacagtattgccattgatagtgttgttaatgaatagaatcttcatgcctcctgttctcctgactggaaagggcactttatttaattcttcttttctaatgaagacttttagataatcttcttataaatctgccttttgatattttttgtttttattttcccacagtatacacaatctgaagatcatattttcatctgtcttgtataggcttagaataaagttaaggtatagattagctctggattcaaatcagatggtcaggtaagatctctttctgggaaactgtggtaagaatgtgtagaaaaatattcctggcaacaaagttagaaaaactatccaaaattccaataaatctataattttcactgtccatggagaagaaaaaaatgtcatttgatcatatggcattagtttatgaagtgtctcagaagaaggtaagttatgggtattttttcaagtatgtataggatttaatttgtttaggaaaaagcactctaaggtaatgggtgtgtgttagtcattctgtaagagctccgcattattactctgctggacctgtctgccagtaccccggctagctgaaattcaggcacatggagcatcacttatccccctgaattatgttaatattaggaagggacaaattacttaataaaagatactgtataacattttatgaatatcatttagaagtaactgctgataactttttctgtcaatgagaattactgttctttataattgtgagtctcaaattttatctatgttgacttagatgaaaataaaggagttttcttgtttgggcatggtgttgattatgttaacaatatattgttagatgctgtttcccagtgtttgaggctgctttgccccggagagtggagaaggatgtagactgagaaggtgggaggcggaatggctgcttactgtggggtctcacaaaattctgttagttggtcttcatgatctaaagattcttctccattcccccgctactttcccatccaggggattattctcgcaacccactttttaaaacagttgtttcaatttgagaagttgttaattttacttatgattgtcagtttatgattattttattaggtatattttatgaaatatcaacaaactaaggtgatttacactactcttcataattacgaatactttaatttttttttttttttttttttgagacgaagtctcgctctgtagcccaggctggagtgcagtggcgcaatctcggctcaccgcagccaccacctatcgggttcaagcgattctcctgcctcagcctccagagtagctgggattacaggtgtgtgctactgcacctggctaatttttgtatttttagtacagagggggttttaccatgttggccaggctggtcttgaactcccaacctcgggtaatccgcccacctcagcctccgaaagtgctaggattatggggataagccaccgtgcccggccttactttaaaatcttaaacactggttttactatatgagcgtattaatggcatatttgggagagaagttgatattcatattttaaaataactccaaatttttatcttgagcgaagtagtattcactatacataatttattattttacattttctattcctaaccaaattagacattttaaaaaactctgaaaaatcacagctttgcttgtggactccattttgtgtagataattaagatccatggtttgaataccatttaggcttatcaatacaaggaaatattactccttaaacaaataactgttgtaagattgtgtctttttctgtagtttcttaatacatttaaaaacatgtgcaaaggaccagacatgaagggaatgacagtttttaaaaatcaaattgtgaaaaggttagttttttttttgtaccaaggaggtaagagtcaggaggaataaacaggtgtaaactgtaaagagcattgtaatgtacgttaaggagctttaactgaagtctaagaagagtagttgaacacttttaataagagtaacattttccagttgagttttaggaagtactggcagaaattgaataatgagtttaaaggaagaaaagtaaaagtaggaagaacagttagaatgttactgtattaatgtgggtgataattgattggatgttgttgtaggggtcagggactcagggttttaacttagtccatgtgtggataacacagttttttttttcttttttgaagtatattgcagtataaattcagctgtggacatactggatttaagttgtctaagactgatgtagaaatgttcagtgagcagttgaacacatacattagcaaaccttgaggaaaatctggcttgggaatatagatttggaatctagcaaatgatgattaaatttagagaagtagacgaaatcaacaactatatagaatgaaatagaagccgattgacttttaagagatgagcattttatccccctttttttttttctgtttaactggtaagcattgcagtggcactgcatacctttttcaatgcagatgtatattattttaggcatattatggattaaattggcatctgtcggccactctgtaaacctaattattatttatttatttggaaaagatactgaggttttttttgttttgttttgttttacaagtgttggggtgtaacttgcttgtaaatttggagcctggcaatatctgaaaatatattttcttctagagccctgcttagctcagtttttccctttctctgaagcttgatgatatatacttaatgctgtagaacttttaaactaagttattctttgttattgtaccaatatgatttttttttaggctgctgaatagggaaatagtatatccatcaatgaaatgcattatttctttaaaaaaaaaaaaggaaaaatttcagtttcatgccatataaaactattaataaattaacctcacaatttatctaagcccttaacgtgctcaaagtgatggtttgtgttttgttttgttttgtatttttggagattgctctgtgtcctgggctggggtacagtgatgcaaccatagctcactgtaaccttaaactcctgggctcaagcaatccttccaccttagccaccaaagtggttagaactacaggcatgcaccaccacacccagctaagttttttgtttgtttttggagacagggtctcactgtgtcacccagactggagtatagtgtcacgagcatggctcactacagcctcgacctcctgggctcaaccagtcctcctgcctcagcctcccgagtagctgggactacaaggcatgttctgccacacccagctaatttttgtattttctgtagagttggggtttctccatgtttcccaggctggtctccaactcctggtctcaagcagtcttgccaccccagccttcaaaagtgctgggattacaggtgtgagccactgcgcctgaccttgaagtcttacactaaaaaagggagcaacatttctaccctggaaaatttgctctttggacatttgatgtaatttttattcttatttatttatttttgagatggactctcactctgtcacccaggctggagtgcagtggtgcgatcttggctcactgcaacctccacctctggggttcaagcaattctcttgcttcagcctcccgagtagctgggactacaggcacatgccagcacgcctggctaatttttgtatttttattagagacggggtttcaccatattggccaggctggtcttgaactcctgacctcgtgatccgcccacctcggcgtccaaaagtgctgggattacaggcgtgagccaccacacctggcccctggatgtaatttttaaaaccagactcatttcaaattctgtcttagtgtaatttagatttttgtgtcttgacaataatgaaaaatatttcttctttttttttctttttgagatagagtctcactttgttgcccagtctgattgcggtggcatgatctcagctcactgcaacctccatcccccaggttcaagtgattctcctgcctcagcctcccaagtagctgggaccacgggcgcacactaccacacctggccaatgaaaaatacttctaatgatggttgttaactgctttaaagaaataatttaatactttttatgatgtttgtattacattgtcctttgatttgagttgcaactgttatttacaccttctttccctgtttgcaagcgattgttttaggatcatgttcttttcagtggttttgctgtaaaggaatcacttcatttctgattattgcatttacaaaaatgattgtttcttgtcttccttgaactgtgttttatcatttgatgctgtgattcactgtgctcctaaaacatttccatctgcctgttttgtgatctttctattttagatcaccatgccacagctgcttggatagccttctgtcacctattttcaatagtgtcatatagcatcccgcatggtttcaaggatggtaaattggctagactccagggcttgctctgtaatcctgccttgtctgttaatgtcaggtgtatctcacagctgatgctgatgaaactgcttaaagaaatcagatatgatctttagcagagccaaatctcatttccatatgtgggtttaagttctgttttgatcagcttcttgagggcagagtcctcaaagtcctacatcatggaatgcaagattgtgtggtagagacaaaagtcgtagtaatttagaaaaaccatcagcttcttgtactggcttctcacagattgttgcacttgagcacattacatctgtatgctggatgaataggaagtttttcaataaaggaggacattccaaaaataggtaacagcttagcctgatacataagtggtagctgctattattgtcatcattttgtttttattattatgattgtgagaactggataaattgggaaggaaagtaaaacaaactaaattttttcaacttatttgatgcaaagctagttctaaaatcgaatagaattacaaacatttattagtgtggatcatgtctgaatgctcaggctatttatctctttaacactatttcatataagtagttgtctttaataattgtagaatgtcttagcctgtttggaatgccgtaacaaaataccataaactgggtggcttataaacaacagaaatttctttctcatttttctggaggctgggaagtccaagattgaggcactggcagatttggtgtctagtgagggtccccttccttgtttatagaacagcaccctctccgtggctcctcacagggtggaaggggcaaccaagctgcctcaagcttcttttctaagggatcctgacctcattacctcccaaaggccccacctccgaatgcaatcaggttgggggttaagatctcaacatatgaatttagcggggacacgaacattcggaccatagcagaaagtatccgtaaaggaataagaatgattacaggtagttcggttcttaaaaggcgtgagtttattctgtagatgaataataaaactgtttgtctaattggtattaccaaaccagaacaattcagctattatatttattttcatggatttatttaaatgtataatgagtttttaatatgagacaagcatattgaagtgaatttttacatattaagagccatcgtcacattattgtttgacagatactgcttttgaaagtaagctaatcagttcatttttgtcaagtattttatatactcagagtagggagtagaattttgaatttgaagtagaatgactgttttcctctgtcaatacatatggcttatattttagatttgctggccattcagttttcatacattgtgacctgttgtcagaacccatatcttcatacttggatcagaaaatacaattcctgttaatagtggtccctgctgcctgaccttctgatcagttacagtttacccaagttgctgaattagaaagcattttaaagtacctgctatttgaaaagtacctataaaggattatgaaaaagaactctatttgaggctaatatctacaaagactttctgatttcagggtaggagtagagttcaaaatgaagcaaagtttaagacgcacatatgcagatgctattagcagtacttgtttctgggaagactaaatgtagtattcctattcctgatggtttaaatagactggttatagatttctgtggttacagggcagacgttgtaatagaggctatgagattttcttcacataaagcactaagtactatttctttctttgtatttattctttagttcttttcaaaaggtgaattggattagattttgcttctatctcaggtaaatcccctactttcaacctctgcaaatttgctactcttttattgtgtctgtaaaaaccaaccttgcatgaattgtgtcccttaagtgctatgattgtgattcccttttttatctataggacacagttttctcatgtttgtcttttcttgtcatggccttttttaagtgaaatgacatatcagaaaagatcatgatgaggccccaaaatagtctggcaattttgtataaaattagtccctgttatcaatggctcatgtttctctctttctttaccatctttaattatttgtgtgtgtgtttttgctgttaggtattgttttaagcactcaaccgttgaagtgtaggtatgaagtgcctgacaggccattgaaaataaacgaagataaattacagttgtagcagaggtttcagtccttgttattcttgatatgataccctcattgtctctggcgaattcctgtagacctttaaagtggcttgtcaaattgcttaacagaattagactttttctctaatgctgctagtggggtcacatctagaattgtctttcaatgtgatctaaaaataacatactgcaaaattacagaagagacatttggatgaaaacaaccaaatgactgagaggaatagccattaaagaggacaaaaaaattcctgaaaaactgaaacttagtttcaagcaaatggaattgggccttatgctgctttttccaaaacacctgataattctcagctacctaagaaaaattaccaaacctttttcaaagaaattaaggtctgtgctgcaatactgttctttgcagtattggctcataatcacattagggagtaaatattctaagactattagtaaataaggactgcttaagcaatatttgcctgcttctataattatattgtaattacattttatcatagacagtgaaatatgtagcaccttttgcaggtggaattctcactgctggtttgccttaaaatattggcatttggggatattctctctgctaattaatattgtttgttctcttacatctctgttcataatgagacagctctctgttagacatagagaagttatctcacttgagaaccttatgatatctatttacaagtgcatttttgtggaaatataattttaaagaatgtccgagaggttttaaagcttttattagcaccttaaaatatatgtagcattttttcattttattgcaaagctacatgttaatactctaatgctaatgaaatatttcagattattttatgcattagaaaacaatttctttgacatcagcttccattccatttatttaaatagtattttttaaaaaaaatatttggtctttgttttattaaaaacataattcaggccaggcacagtggctcacgcctgtaatcccagtactttaggaggccaaggcaggcggatcatgaggtcaggagttcaagaccagcctgaccaacatggtgaaaccccgtctctactaaaaatacaaaaattagctgggtggggcacatgcctgtaatcccagctactcaggagactgaggcaggagaatcacttgaacctgggaggtggaggttgcagtgagccaagatcgtgccactgcactccagcctgggcgacagagcaagactccatttccaaaaaaaaaaaaaaaagaaaaagaaaaagaaaaaaacataattcagcaaaagaagcaatacacaagaggtaaacaatgacttgcctaccctggtcccacaggggcagtggcaggactgatatgaagacgcttacctcctctgccatccctacaataatctatgtttttttgtcataaataaaaagagtatcacttactagggagcagatgagatcacagcctcaagcaatcctgcggagcaccacctggcagaggctggcttcctgtatttgctcaagcaagctctgtgagttgtgcttccttattgtcatggatctcttttcatggtgcatccccattcctacatttaatcacacacatctcagtcagagctctagggctttattacgaatggagttgactgctagagaggcccctccaaacttttttctgtaccgtcttccctcccaagacatctctccggggaggacattagggaaaaggaaatctggagagagtgaaaggtgcagtgctttctccaaagttctccgaagcaaccactgagtctttgaaaatcttctgatggaagaggtaagaactttagctctcatcttcaagttccttcatgtctacatcctggggggcttttgtcttattttgccctttgagctgtggttcactagtcgtggctggctttgagggggatttcacttccatcgctgccttctctttctgggcaagtcagatccactagaggggttttctgtgcttcttccccgatagagtaatgttggtaggtgcactggatacccacttcttgaggtgatgtggcaaaatcaacccttggtctgtcacagtcctgaccacccagtgcctcagttgcagttcccagttcaacacctgcaggtgcctgaacagctgcttcttcgattccagctggagaaaaagatgcaaatcaaatggaggcagttcattgcaacctggaactgctgcaccaggcaaccccagttcctcattgatctcatctcaggcaagacaagagggctcctagatgcttgaggaaacaaagttgtggtccccactcagccaccattctgggctggttgatctttcttccaggagcctgaactagtattgatgtggataagaggaagggaaatactgggtagaagtgggcagttccccagcaaaggccccacccctaagcctggaaaccgaggccctgaatgagaacagttatccctgttttccctcccaaatgttacatttttggtctgccctgcctccctccccacttatcctgtacccatattaaccccaaacctcagctggtagagacgcaaagcagctgaacatcaagaggagtcgcagcactgattgtcggagactacagatagatgtggcttaagttgagacaacatggcttcagggaaggatcaccttcttcctgcaccatcccctttccagctccccttttgctgagagccacttccactgcttaataaaatcctctgcattcatcacctttcagaccttcatgtgacctgatccttcctagatgctgaacacgaacccaggtaccaagagggcagagtgtaaaaggctgtcttcctgactctccactgagctggttaacagctgtctgcagatggcagctgctaaaagagcattaattgtaacatacccttagacagtgctgtggggccagagcccaaaagcacttctgcacctgcttgcctgtgtgctccctctcccacaaggggtttgagctcagtggtggccaggtaagcgagccatacccctgttgcaagtcccacaaaggggtcaagggaactctcccatcttgttatcttgttgtatatgaacatgacaagaaacatcattatatctttgcttttggcgttcatgcttacctatatgtagaccacaattgtaatcattcaatttgaataaataagtaataatgtagatatacaagtttatatctgtatatataataatggttatataacaactaatacttcttcaatgcttattgtttgtttatgaaatgctatttgttttacatacattggaaacatttaatccttaaaataattctatgtggttaggtatattatcactattttgcagatgataaatctgaatccttggtttcaggatggttgtttacttacccaaagtcatacagccagccagtagcattttgtcacacttcatagttggagttcttatctacattataagttaatgattaggtaattcctagaagtcagcctaagttgccagttatattaactgctacttaaactatacatttttaaatctcagttctgtaataatagtaggtttgcaatagacttagaatgtatatgcaaaccatagttcaggaatgtggccacagtatgcctgtgtattagcacattcacttgtcatcaaaatttttgttgggcatctactatatgctggatacaggcatgatgcaaacatttaaaaatatggccactgtcacaggaggcttaaaatcttgttatgaacccagttaatgaagtgtttgcactattatgcatttggatttttagttgactcattaaaataaactaaataaattaataaataaattacattcaggtatttcttgccatctgattttcttttgtttcctaagcttatatactgagagatactgcattaaccgcatatttttggcttctgaaatttgaagagccagtagcagtgaaagcttgaagagccagagaaaacagcctcatctcagagagtttattcttgagtttgggtagtgtgagttcagttagggagagtttggattgtgagggatgtgtatatcatgtcttaaaatagtatatcaataataaatagaacgaaagggtgatttaagacgttattacccctccaccattgttctattatgtacccattgaatataaagatattcctcaggaatatctattcctctccaaaaataattgtcacagtaatttaataactgaattttgtatacatcttaatgttctgtttgtgctggcttacatatatgtaagtaaaatggtttatcatgttttaatacccaagtattgggtattagaagaattgaaagattatctacataacaagagtgtatagtcttgaaaaagtggagtctgttatgcattatgcttagacagatggcagaatggaaagccctcttttaaaatcagcttttatagtatggcctagcgaataatatataacattatgctagcacactcaaccaatttgtttactcattcactcaacaaattgagtgcctgatatgcatgagactgtgtaaactgtatctgcttggtgcctggcccctggagattaaaatccagttgagttttctactattcaagagatagtatttgtagtctggaaacaagtagcttgggtttgcattctggctcttctacttactagctgcttagccttgggtgaactgttgaacctctttatttctcagtttcctcttatagtttaaaaaaaaacaaaacaggaagaagaagagggagggggatgatattaagagcatctaccttatggagttttatgatgttaataaacaaatgtatggagagttttagaacagaatattgcatggtctaattagagcagaatattacctagttaattaaataaacaaatatatgaagaagttttagagcagaatattgcctagtaaaatgttagctctttttattattttaatgtggagacagatgcttagaaaaactgcacgttaagaggttctgggcttagtccagaagggtcaagaatgactttccttgagatatgatatgggtctgagaagtgaaagatgaataatattgacagattgagaagagagaggagtagagtaagaaaatcccaggctgagaacagcaagtctgaaggccaggaaggggcaagtcagagtggctgaggacaagtataggccacaagtgctaagtgaggatgcggcagaagtggcgatggaggccaaatcttacagagccttgggaagcctgtgaaggaagattatcataaaagcaagaaagtgacacaatcagattctcatcttacagagatccctctacatgcgttctgcaaaatgtatgtggggagcacaaccagatggctgttgaaggtaaaagatgatagcttggactaaggtgggaaacagatagaagtggataaatcaaattatatttaggggataaaatagacatgacttaatgatttattggataagaagtatgagggagaggaactgtctgtgaagactcccaaaagtatcagatagatgacaaatagattacagataagtcaggaaagtgagggaatgtcctaagaagatgctcaggatatatgagagtttgctgataagaagtttagagcagtgattctcaagatgtggtcgctggaccagcagcatcagtatcacctgggtgcttgttagacttgtaaattatcaggtcctgccctggatttatagagtcagaaaccctgggtgtgatgtctccctaatctgtgttttaacaagtttgcatgtgatttgaatgcacagtaaagtttgagaaccactgttttagaggcacggtggaaaagttgaggaagagggacaaatgaatgttagagtcaagccaaggacttaattttatgaaacaataatgctttcacataggggtcagcaaactgtagccagtgggccacatctggccgactacctgtttttggacagtccacaagctaaaaatggcttttacagtttttttaatggttaaaaaaatcaaatgactattatatgacacatgaaaatgatatgaaattcacattttaatattcataaagttgtatcgggacacatttgcacttactcacttacatattgcctacatctgcttttgtactacaatgcaagagttgaatagttctgacaaaaagtacacaaggctgaaaattctatctagccctttatagaaaaatattgctaacacctgccttagagcattactgtatttgttgactgatgaaaacagaaaaaagcagcatggggagtttaatactctggtctgtaggcagaggatggactgtgtgcataatggacagatgtctaagcttgcttggtttggaaagatgcgtgcaaacagcatggtccttgttttctgccgtatgtgggcctgcagtcccagaacacgcaattttgcctaagatagtaatttacctggttctttttgtaacaagttttggagagagagtttttatgaaaatggatcaatatttattttatacagtgatgttttatcaacagtgttgaaagtacgttgtgtaaaaatattgtatatttttacgaaattgtgtaaatggtctgctgaggtcctcaagcatgttcaccatgagtatgactttacagtttgctgggtaacgttcagccttatcatgggaaaaaagtgaactttggaaattcttgcttttggtaatggtggatgagcttgttatagaccgtgcttcctgccaagaacaactagaaaaactgaggaagacaaaatctgtttgatggcagtgaggacttgaggtatcaggattctagagaaggaagtacagagggagagactcaactctgtccctaccgttaatcctcagtcattcgctaattctcagcagtagctaagaatctgagcagaactctggtactgttctggagccagaggttaaaaattggaatccagagattgctaagaaggagtggtccaggtaaacagccaggttttcatttcgatccccaaaaggtagaacagcactcagaaggtgttctacctttgaatagccagctttcagtccactcaattcttgattggaataaggtgatctgccagagtattgctttgattttgctattgttacaccagcctctaaatcagcaaagctattgagcccaataattaagtcctctgtgtggaccctaggaataataatcaaaccagtggggaggaaaagccctcctcttctgaaatagcagaacaggaagagaaagatcattttctacttcttgtgtcatggaggttaaaggtgggaagcccataagaagcctgagacttggtcagaaggaggagcggctctttgtatagatgaacgtgttgagaaccacctttatccctcacagcttccatcttaaaatgtatttagaactacctttatccctcacagctttcctcttaaaaagcagccaaacaacagaaaatccatccaggtctggattctagtaaagtcatttccggataccaactaggtcgctttgaggtggagtttcagcacctaaaaatcccctgctttgcagtgaagggtaagatgagagaaacaggcaattggagtcattctgttttttcctttttgttccagggtagttacatgtacttaatttgtttgaaacatgcaagtagattatggaacattaatataagctgtctataagttatccaacctatccgagaagcattcaacagtagtcactgtgtatttgggtgaattagaatataattgacttctctagtagacttttgagctgagttcatccttctggtttgttgactcctcacctggttctctatcgaattcatattttggaagtcatacctctttttttattgttagtttttaagggtgaatccagaatcttctttaatttctaatgctaacaagggcatagtcttaagttttctgtttactttattctgaactgcaaaactaggaaggagaatcggggtataagtgctctctgttctgtcagctcacatgcttcgtagcataagcaggtgtgtgatgattatttcagagcaaaaggaaagacttagtaaaatttgtatgtatgtattcaatttgattatagcttcactaaatatacaagtgaatataatgaaatggaatttcatgcaactcaattaaattagcttctttaccaccatattaattatccaaattttattaatttgaaatattttcttacattgttactttaacaacaaatgcgtcttcaaattaatcatctcttctgtgtattgaagaatagttcttttgattgttgtgctctttaagactttttaatgcattttctatatttagttatttcacaaattagtataatggctataattataataatttcttctagtatatggcagaacttaattttgcctatgaatttgtaaacatttccagaagatagaatatcttaagaatggatttaaaatttgggatttgggccaggatcaaagttcttgacctcatagtttcaagcatttattttttatatatatatatatgtatatatatacgtatatatatatatagcattttattttatctatataaaataaaaaattatatatgtatgtatatgtgtatagtatatatacgtgtacatacactgtatacgtcgtatacatacatgtatatacacatacatacatatacatatacagacacacacatatatatataatttccaaacaggctttactaaaccccctgaggtctcatgacacagtagaaaatcatgatttagtagaaagagcatggtcgtaggaatccagtagatcagtagacctgagttagagtcccaaatctgccactttcaatctgtatggcctcaggcaagttacttaacctttctgtctctctgtttctttataaaatggagataataatagtaacttcttcataggagtaaataacataatacagggataaataacataaaatacaacaacgtttgactcatagtgagcactcaataaatgttgttattcttcttaagaacaaaaaaaatatgatttttattacttcatccctgctgtagccaagcattatgcaggacaggggggatgtggtcacaaaccaatgtgggtggacaagtgggagctagaaaggtgaacaatagagtgtgatacctgctttaagtagagacttgtgcaatgtgctggctcttgtgagaagtggctaactcccattacatcatttcctcttcctgacacttttccagtgtatgattatgcccatttacagatccagagagggttataattgaaacatcagtcctcagacccctaatcttgtcatatatgatcgatcgtgctacagttctatagtgaatgaatgccaggtaaaataaacagctttttgagcacttactaagcatttaaagcattttctcactttttgtgggagaatacagaggaattggaagacctagttgtcatcaagaagcttacagatatgggatggctaaataaaaaagtcaattcagattgtatgacaagatagtgactacagataactactaataagtaattactggtaaacttttgaacaattttgaaaattgtgaacaataacacttagaaaaatggagatgaataaatgtactgcataatgagttattataaagtgaacatccattaactgccacccaggttgtaaaataggacattgccagcttcccccctccaagaaatctcccacattccctttcccaatcataaccacttcttttctcccataggtaaccactgtttgttataatcacttcctggattttctttatagttttaccatctcaatacatgggatcatataccgtctacattttggtgtctggcttctttgttggacattaagtttttaagatttatccatgttgtagggaactgtaatttgttcattttctttgaagtagtattccatttataactatagcacatttatctatttcactgttggtgaacattttaatataatggtttttttaagctccagactccaggagatgcctgtttcttttttcattctcagacattgttactttcgttcagttgaagatgtcacacatacctattcccttgtgtagagtgaaaactaatttctccctaattctttctagaatgataaatactatcatttttctcctcggtctgttatatagccacttcttacaatgttgatttctattgttcagttgaactcaaaagaaacttggggccaggcgcggtggctcacacctgtaatcccagcactttgggaggccaaggctggtggatcacctgaggtcaggagttcgagaccagcctggccaacatggtgaaaccctgtctctactaaaaatacaaaatttagccaggtttggtggtgggcgcctgcgatcccagctactcaggagggtgaggcaagagaatcacttgaacctgggaggcagaggtttcagtgagctgagatggcaccactgcactccattctggacagcagagcaagactccatctcaaaaaaaaaaacaaaaaaaaacttggaaagtgggattccttaacacctttggatttttccaaagtaatcactatgttttggaatgtctaatctcatcatcttggtctttttgctctgcccagctttgggaatggctggcttatcatgaagagcctaagaattctgattttaagggaaatatcatagtgataacttgtggtgggaaaagttagaagacagatgttttccatgaatacttgtggagaactgagtatacattataggtatgtatattaaaggaatgtgtgtcttaagtgaacatttcatcttaactccatgttgatgtcaaaatgatactttacttaggtagtttttactttgttaccagtagtgtaagtattctgaaactgttagaaattgtttctctgcctggaaatttcaagaaattcggaagacagggttttatagcagtgccttcacatgggggatgcatcttatttctttataatgatctgggtttaaaccttgaaatcaagtcccagaaacacaaactttatgaatcaaatacttattataaatattaatgtaattgtcagaaaactggtagaataagaactttttcttagataaaaataaaaactgtgtgtgttgaatttgaaattagtcgccctttatacgtggggatatgttccaagaccccagtggatgcctgaaacctcagatagtaccaaacttcattgctgtcggttgaaacacatttctcatgtcttccactcatgtatttaatgccttttccatcttaactaataggcatttatcacgtttctttttccttctttataatttcatagatagaacatcgtttcttaccatagtaacctcagcgtaggatttttcctttcctgttcaagttaagaacgtttatcttttcacttaaagaaagcagtttatgccttctctttggcatatttaaattgccagcatcatttgcactttggggctattattaaataaaataagagttacttgaacacaacactgagatatcctgataactgagatctggtaactgagatggctgcctaagtgactaaagggcagatagtgtacacaatgtagatgcactgggcaaggggatgatttacgtcctgtatgggctggagtagggtggtaggaggtttcatcatgctactcaaaatggtgtgcagttaggttggtacaaaagtaattgtggttttgccattttaatgacaaaaatcacaattacttttgcactaaattagtatatgaactgtttatttctggaatttttcatttaatatttttgggctacagttgacctcaggcaactaaaacctcagaaagggaaattgtggataagggaaggactactataaaatgaaatttaaacatttagcatgtaaccaatttaaatatttacaaaatcgtatggacaactcagttttcttttcctgctcaacaatactttacattataatgtactgtttatcatttgcatcatgaaacatttttattcacattaatatattgctagtgtggaaatggaagaagaaaacagttgatgtcagactcttcctcacttttgctgaagggattgcatctttatttggcatttgagttgagaattgtgctccttactactacgcaggaggccacttttaactgctcccttctcttgaacattacaatactttagagcatgaaaaaagcaaactatctctatgtgaactattactactccactgataaaatgctgaaagaaatattaccgtcatatacaagtctaaaaaaaattgctgcagataaagtcttatgaaactccattaatgtagtttcacagggattcttagcttatagcttacaaaataaaaaggattgtcaaaataccaagcttggaaaatcatgttcctgttatagaaaacataaacattcctacagactagaattcttaccaatttctttgtctaattaaccacattctgtcataacggaaaacggataaaaaggaatgaagctagccttttattttattttctgttttgagttggggtctttctatgttggtcaggctgctcttgaactcctgggctcaagtgatcctcttgcctcagcctcctgagtagctgggactacaggtgcatgccactgtgcccagctctgcccatttaatgtattgatgaggaaaaatagtagtggatgagtttgtgcattctgtgaataggagcatatggtcagcagttacttctcaaagttcatcctaagatctacaggtggacagagaggagaataaatgaaacacacacacacacacacacacacacacacacacatctcaggcctttcagtactataattaagtacaggaattcatttattatccacttaaatagaaagccacattccctatcaaattacagtagcctttaaagcttcaaattcactttttaataggccagacttccttccctcccttttttcatcctctcctcctttctccttccttccctccttctttccttcttctaccagtatttattgggtacttaaggctattctgggtactagggatacagctgtgaacaagttagttttcaatgagtttatgtttgagtttgaagagacaggctgtaatcaaacaaataaataagaaaataatcagatgtgaagatgtgctctgtagataattaaaatggaattctgctaaagaatgactggtatgttcctttagaatggttgactagggaaggcctttctcagatggttatatttaagctatgggcttgagtgtcttagaaggaatcatcatgttactgtctctgggaagaacattctaggctaaggaaccagctagtgcagaaggcaggaacccactttgcccaccaggtaacaggagaaagatcaagaagctagtagagtatggtgaaaaggtaagtctagagaaatgagcaggagttagaatacaaaacactttggaggctaagaattatggatgaaaagaaaacaagaataatgtagcagctactggttattgactcactttatgccaaatactataagcacattaccttacaatctttaattctcacatttgcttaggttagtgttgtcacccccacgattcaggtgagaaaaccaaaactcagaatccgtttgctcaagatcaccttgtatgtgaaaaggtaaaaacgtgggattttatttgcgctcttgtctgatggccttcaaaacctgtgctcccaacttactatgctgtaaagaagctatatcgttctaactttctcctcctgtcccattcttcccttaattaatatcttcttcaattatattggtcctgggacatagccagagaacttcattatatatacatatgtataaatatatatttttaggtggagtcttgctctgtcgcctaggctgtagtccagtggccctattttggctcactgcaacctctgcctcctgggttcaagcagttctcctatctcagcctcccgagtagcttgggactacaggcatgcaccaccatgcctggctactttttttttttttttttttttttttgtgagatggagtctcgctgtgtcacccaggctggagtgcagtggggcatctcagctctctgcaacctctacctcctgggttcaagcaattctcctgtctcagcctcccgaatagctgggattacaggcgtgcactaccacgcccggctaatttgtgtatttttagtagaaatgaggtttcaccatgttggccaggctggtatagaactcctgacaggtgatccacctgcctcagcctcccaaagtgctgggattacaggcgtgagccaccgcgcccgaccccaatcttatatttggttttatttctcccatttgtctctctaaatcccttagttgataagttaattacactatctttgtttgaaaagaatataaacttagaacaagactagaacattatgaaacaacttccacgtaatgtcacaccaggacaagttattatcaagtgatcttacgtgatagtcactagtacttcaggagataagtttgccggaggaagtatatcaacaatttactaaaaaaccattttggccagaatggtttcaaagtttttagttccattaaaaactagtggacatttcccaaaaactagtactagatgagtgtcagggttgattaaagtttagaaattgttttaagaactttaattcagctgatatttagttgctagcccacatgtcctgaagattttcaaccatctttggtttggaaattatttgcaaataacatatgatcaccttttattaggtatttagaaaaaataacttcatctgacatttgtctctaggtatatggttgtgatgtcatcagggttacaatacaataaatactctagttatatgttttaaataggaatatatagcagtagtacaaagtctcatttttatttcagtaacttttcagaatgttgccatctgatctagctcaagacccttagtttgtgacactcacttgaatacttaggaaaagtctatggctttgatctgatgcctgtttgggcatcaaaccagagatgtggttgagtcccaaccagagtttaaccacagctcaaccacccttgacatcctttgacataccttaagctttatgggccaaaggctgcttgaggaggggagtacatggcagcctcaggggcagattgagtgctgcttttagaaactgagggacaggctgatctgcctagaatatattggatcttgctatgtaaatggtttgtatacattcagaatcaaattaacaaaagataaaaaagactagtgaaattgaaattatttgacttcttgaacaaatataattatttttgcacagttaccactagtactttgcaatacttgatctaagcattcaaacaccacccctgtgggcagaattttatggacactgcagtgactgtcaaaaacatgaaaatttcacatcttcccaacattttcagtttcacttctccattaatagtcactaccttatttttaaaatcaaaccttgtgttgtgtttagctgtttgtaaattgcctacgtcaaacgatacaacactctattggaaagttctttgttggttctgaatatacatacttggcttttcatggaataatgctgcagccacataacagaactctgtcatcagtgttttaaatcctgagtgattatatgcattaaatgtcattgtaggggctgggcacagtggctcatgcctgtaatcccagcacttagggaggccaaggcgagtggatcacccaaggtcaggagttcaagaccagcctggtcaacatggtgaaacccggtctctattttcaaaaatgcaaaaattagctggatgtggtggtgcacgcctgtagttccagctactcaggaggctgaggcttgagaattgcttgaacccgggaggtggaggttgcagtgagccgagattgcctgggcgacaaagtgagattccgtctccaaaaaaaaaaaaaaaaaagccattgtaggatagtagtaattttaaaaacatagaggacaaacaaaaagtactttctacttcaatccaagatgaagaattaaccatgtcagtaacgaaaaggtggaccattgcagcatctgtcattattgtttctcattttgccttcttcttcctgtcttctccccattgccatctcattttctctgcagccatgagcaggaactgtatgcaaagtacaaaagactgtattcctgaaacagaacttgttgaccccattttcttgactcttatttgacattgctttctaagagaagggttttggattacacactcacacacacacacatatgtacacattcatagtaataaatgtatttatcaactcagttgcaatgagattctgcttgttggaatatcatataataaatagctatattggtatttattgaacattggctttttatatgactgcaataagatttgatgctagtatttttaactgttgctccctctctgcctccatgcttagctgtttaacatgacattcattcatcaaaaataaatgtccaagtcaatggagtgtttctgtaacagatattagtcaccttaaacttgttactcatagcccataaactcttatcattctttctcagataacccagttgaccctacattagtagaaattgagagctctgagttcatttttgttgttatttgatgaatatatcacttggctgactattaggaatgtagcatttggaattgtataagtaacaggttaagactgtgtactgatttcctttttaaaaattctgttttatgagtttgtttatagcaacacaaagtaccttctttttgcatagctttttgttcatcagcattttttgcaattttaaaaagcatgatttttatgcttcatatttaaaataatcgctaactgtagcgtttaaatatttgccaatgtatgtctgtctgtacttaatactcctatggcaacaggcagagagaatttgcctagaaatttccatcacttttctgcactgtcaaattatattatgcagttacaagtatattgaatacagggaaatctgagatacaagtagttaacacattctatttcccactactctgttcagttcagccacttcgttagcattctgaaatttggcttatatactttgactcagatgcgaaggtgtttttctgatactgaaatgtgtggaacaaagctggaatttaattgacagttgctgctgctgtaatcagtgaatttttgaaaaatacagcaacagtttgctgtacaatatttttgggtttgctttcattttaagatttttacacatgggaagtcatgcgaaacagtataatgtggtagaccattgtaggtttgaattccaaatatgtctcttagctttttacacttggtcaaagcatttatgcctctgagcctttgtatcattttttaaaaaatgccagtgatacacctgcctcactgattgtaagaatgaaatgaggttatgtaaaacaactaacacagtgcctaatgctttcatttagtcttgaagtcccagagcttgttagtggcagagcctgaaaagccagctcttctgacacacagaagtactttctcaaccatggcacactgtctattatttttggttagtagggagtatgagtactggcagatggttatgcagagctatgacttttttcaggtaatttttccccataaaattttattagggattttcctcaagaattctaaaaagtcactcaaagtcaggtgaaaagtgaggggaggagtatagaggtgtccaggcttttgactgggtgattgaagataatggggccatccactgaaatctgaagcacaggaggaagagaagcagttctagtgagatggcaagttcatttaccacactctttaacattttgtttagttttaacctttatttatggataataaaggttaatattaataatgatttattttaaggcattcccaaatttgcataattctccttttggagatacccttttatctccagtgcaagtctggatcaaagtgatagaaattccatgcagtgctatctctgatgccatgaattggtcactaagaagaattgacttttccattgagtttcccataactagggccaagttaaaatctcagccttttctaatgacatttttctccatgaagatcttctcagttgtgaagaatatgtgtttgttaaaaagtaaatgaaaaattaaaacaatagcctgagtataaaactgggttacttaaaagtacttgtagttttacattgactgcctggaacgcagaattataaagtaaaagacagtgttagacaatatttccaaggctctccagtttgtaaagatttgttaatggatctcccagttcccttcctgtttctttctcttgctgccttccttttctgattctctttttctctttcttttttatttccacaaataatgcagcatactggaaagggcaggtcaggacagcctaggttcagaatctggctttcacatactacttgtatgacctcgaactgatatgtttaactctttgaccaaacctccatttgccagtctgtaaaatcgcaagactaatacctaccctaatgaggttattgggaaaaatgagaaaacagatttaaagaactcatctagttagtaagtagtagtttttaatattgttgttatgtatccgcttgaaactgtagagagaaataagacatagtaaaacttaaataagtaaatgtagtgatttatgggttcctaggtggaaagattttggttaaagagaagattgaaactaatagttaaaatgggttttctaaaagattatctttgaggttatccctcttaaccttgtgttctgtgaccatgacaattgactgtaaggaagatggaatgaggaaacaattctcctgccaacataaagaaaatctgtatgcccagaggcatgcatatccagccgtgttggagaaagtgctttaaaattcagccagcaacacttgatacctccctattgatgaattgcttgctaaactgtgccacagagtattcaacttaattcacttagctctcttggcacagcttctttatgaagtcagtgtcccccatgaggagggcaggggctggggtgtggaagggtccacaggaaagcccattccaaattgtaaagcaatcatatttggtgatacttttaattcattggattattcccttccccagttccccaagtattttggagacaaatttttcttcagcttcacatgttgaagatattctccaaagatgtcatcaagaaggtatagtctccctttttctcttgagaaccctgactttcagaatggcctggaaaaaaaaaaggtcttgaccactgtgcaggtgagcatcaagctttacacatttttttccccattttttttctggaaagaataaaaagattcagatgacatctgagacaacctggtataaacagccctagtctagctgctacacagctgcttagttctggttctgtgaccttagctaagatcccagtgtccacaaatgtaaatgatatattgacatcttgacatcttgattaattggagggttttttctgaaatattttaaacttttaattctgaaaatgttcaaacatacacaaatgtaaagaattgatcccctgctcccgtactcatccctcttctttcactaccgtcaacatttgctacatcctttatctcctctgcgcccctccctctactttttatggtttgtatgtttgttttgggaggagtgcatgtgtgtgtgtttgtgtgtgcatgcgtgcatgtgtgtgtgtgtgtgtgtgtgtgtgtgtgtgtgtgtgtgtgtagtatttcagagaaaatcccaggctttatgccgttttactcctaaacctctgtacatctcaaataaaacctaaaactttgaggtctgttacctctgcctctgcttacccttctgggaaatagttaccaataatataggaaatataaaaaattctgtttcccaaagatttctgattctgtaatagtcctgtttcagtaattcttaatttgaagtttatagaaattagtgggtattggaaccttctgaaatgaaatacagatacttacctttatgtgtaattgtgcttctggtgggggcgggggagatgggcttttattaaaaaatacaatgtcactgaagtaaataaaacttttaatgaagaatttattaaaaaatacactagcacatcatgatagtgtttttgtagaagaaaagtaagctgtgtctaattctgtatttagtaagccaaagccatttagatattaaatacatgctttacacaggttttttagaaaagaataagttcacttatttagagttaggtatatttatggcctcaagataaagttgttagtctcttacagtgtctgtaaagaaataagacttttctccttttttttgtgctaatgaaatgtttccaaaggacattcattttagtattgacttgggtttgataatttatttgtttaaaatttgatataatttatctagaaaatctttaaatctggatcacactgggcatctaaacctttaaattaaaatacatcctgcaactttggtcctgcagcagtttttctcagtagagaatgaggaattagcttaaagctggtaagtgtgccaaccctaggttaaagctttacatctgttaaagtatatgactctgatgactggctcctggaggtcataaatcttcttgctaagatatataggacctgaatttgaagtgaacttttggcaatttaacaccagagttggaaattagactagtgaagatggtaaaagctgctgctccctggagcagctctgagctggccctcataggctatccataagtgtcacgattcacaaaaaactagcagagtttttccagtactgtagtttaatttttgtttcttttgggagtatacttgttacttggagtattggtttatcatttgtcagtttttgttcttttgccttaccttgatttagtatcaaacatgagcaaatgcacagggttgtattagcctttgagttttatgtgactcaaagaagagcccttgtatttgaataatgcttaattcctacttctgtgggatgttattaaatatgagtacccacagtatccaaagcagattattaatgattattacaccatgacaagggtggttctcatcatacttcataattaaagaggatgattctgatggcattgttgggctacattcctgaccattggctttactttctcaggaataatagaatgtggattgtgttgccattcctttctgccatgtgccttgggatgaatgtagatagacaactgtgaaaagatcagtttttaaaaattcaacacaacatcactaaagcagaaaaagcagagtgttacacagttagctcttagaaaacaggtatttgggtcacagaaagaaaacgttccatggctgtgatgtaatgccaaaccaaagtcagcgtattttcaggtacacacaaaataatcaagtattaatatgatgtacaaagaacataggaaccctttgggtagaaacttctagatgtaacctcatgactactgcctgattatcatgctcttactgagtaggagaagacaatgtgtggtttctccttccagtgaaatgtataccccatatatttcccctgtaattataaaaggcaactgagaaaatggatgttgtaattacttctgtattttgcattctttgtactattactgatgtgtgttcttccttaagaatctgtattaatttcccaggcctgctgtaacaaattacacaaaataggtggcttaaaacaaaagaaatttattctcttgcagttccagaggctagaagtctgaaatcaaggtatcaacagggccatcaatgggtccctcagaaagctctgtggaaaaatcctttcttgcctcttcctgtcttctggtggctgctagaagtccttagagttttttagcttgtattggtgttactccaatctctgtctctgtcatcacacagcctttttccctgtgctgtgtgtctctgattccaaatactgtcatcttttctcttatacagtcaccagttactggatgtagagcccactgtgatttactgtgacctcatcttaattataccttaattacctgttttcaaataagatcacatttgtgagttctgggggttaagacttgaacatatctttttgagggacacagttcaacccagtatagaggccatggtcatgggtaagcaggaggataagttttcagtgtagatttggagttatggttttggtataatactattaacctgttaatcacagaatttaaaagtgtctgtcaattatctgaaaatataatgggaactcttgttaagtgagggatgattccactttgtgtagaatattttatttgcttagtttctcttcctctgcagcatttaaacaacagttttaacctttaggctatcttttcttgattttcctcttttaaatttttcattgctcgcatacttgagatagatttcaagccttagagcacatactctcatgtgttgagagtaaagatagagtgagagagaacttagctgtaaaccctatttagcatacatataaagtaacgaggcatgtttttatgaatgttctaataagccttgcagtttattatgaggattagggttgaataatgttattataaagtgtgtatgtagtaccttcatcttttctactaattttattcccgaaataaccctgtgaaattagaatatgtattatctgcccttaaaagatggaaaaacaagtgtatgtagaagtagtatgaatcctgtccagtgtacaaagtggagatatatgtaaataaggtaaaagcagaaaacatcaaatgtcccctactctcaagacatttataactgaatgcagggtgcagacaagttaacaagcaattctgtctgatgtaatataacagcagaagtgtctgtaaggtgttttgatagcaaatgggcatgggagaagatgacagaaaaagaagcaaaacgcttgaaaaacacttaaagaagcgacagactttctccttactttttccctttttttctcatcccctcctctccctcctcaaactagggtatagtttgtaaattttttaaagttcattgaacaaattaaaaaaagagaatgataactgcagaatactataatgtgctctggaagatcaggtgcaaatatttcacatcacagaacaaaaacattaggaaagggcaagacaatgtctgttccaggcctaaggaaaagcaggattcaggcagcatgctcttccgcctcagttgaggctgtgggttgagccctctctgctcctgaactgttgataaaagtcagggtcagcaaagtcagaagcagtttggctgatgattgggagtcacttgcggttgggaagattggaccctgtaggggtctagagacctgtgctctagatgatgcctccacatctgctggtctttgtttcaggcttctagactttggggagaaaagcaagccttctcctttactctgatggtcctttgcctcttgcctgatgacaagtaaaatgaaactccactcctcttctttctcttagagatctcaggataattcgagacctcacctgtctatcttgggttattgaggacctcctgagaggagcgaggaggttttgggggttgaggtcaaatttatatgtgctaaattaaacattttaaatttctcaatattacaactttaaaatactccaataatttcttcgtctataattgtatgtcaaaagcatgataaaaatgccctagttgtctactggatagcaatatcatcttaggcaagctacctaaattctcattggctcatttccttcaactagaacgttgagattgagagtctgtgaaaattaagtacttagtgtagtacatactaccttctaagggttcagtgattgttagctattgttataattattatgtgtgatgatttggtcagtttatgaagatctttgacacatatttattaaccatgagttattaaaattaatagttctaattgcagtacaaacgaaatcacagttgcttgtctacaatgtatataagtgtagagagaagtagagttaattgcatactgactggtcataaaattagctgctctgataattaagattcttgtgcaagcaacacttagatgacagtgtggaccccatatctagccaactgagtacaaggaaaagtagaaagctccccccaagatggtgcagaattagttaccagttataatcccatatttaaataggatgtaataattaatgtatgtaaatgtagaccatagtcgatgaaatgcattgtaattatttgtaattttcattttcactgtcttaaaacgtatttgtgtttttaaagaaaagatagttgtccttgttaaaaattattttgccttatgaaggaccttgtttgtatactagatcattttggaaaggtaaagttaaatttcgtagtagtgacagcagcaagactaaattggtttcagagcactttcaaaggtgcagcgctctttgcagttgatgtttcctgctaagcatttttgaagagctaaaactattgagccactctttgtgaagttagaggtaggctgctagtagaattcctactggttagtagaacagtaaattcaaacaggttggaatgccagttcttcaagatgtttggaaaatgcagttcaactcagaaacaggacttaaattaaatttggacacctgattattattaccttagttaagagttcagaaacaactcttctttcctcatgcctttattcaagtacactgacaacatactttagtgcagtggttctcaaggtatggtttaaggaccccagcatcaccattgcctgggaacttgttaggaatgtaaatcctcaggcctcaccccacatttacagaattaacaactttgagtggggagccagaaccttgtgtttaacaagccttcctggtgaatctgatgcagctaaagcattatcattcctttttataattgttggcccttacccaatttaaggcaaatttcaagaaaaaactgacaacctaaagaagtattgtgtcatagatggggaaccaagatgcttattgaaagacacaggaaggggaacatcacactccggggacagttttggggtggggggaggggggaggaatagcattaggagatatacctaatgctaaatgaggagttaatgggtgcagcacaccaacatggcacatgtatacatatgtaacaagcctgcacattgtgcacatgtaccctaaaacttaaagtataataataataaaattaaaaaaaaatctgagaaaaaaaagttaatttaaactttagcacatcgtatggttaacactaggtaaaatttcccttttgaagtcactaatatgaaatacataccacatttgttttctgcagcagtagagctaatatactttgacctttttttcccaaatgatactttataagtcttcaggggagagattgaaagtattaaatttcaagttacaaccatcatcattaagatcagctcagccttaatcttttggccttgtccctgcctttccctgcagtgccccagccagtctgtactttatttccttcagcttctaatgttttttcttcacttttggtgtaaaagattctcctctctctgcctggaaccactccttggccccactcttccccttggcaagctcattctttaggttttagcttagacatcactttcttgaagtaaatttcccttaccttctctgtgttcccacagacccttatgcttcctctttcctaacgtcatccactagagagtaattgcctgtattttgttctctaggccctaatacacggtaagctctataaggtcagggatgctcccaggctaccagcactgcacctggtacatgtcaggcatccagtgcatacctgatgagttgaacaaatgaggaatcattccactacgtaactagcaactaagcattcaagagatcagtatgaatgcatatatttatcgttattactatatatctgtatatcttggtttttacatttgttccttcttttgtatgtttggagaataaaatcctttataactcactgcatcccttccttaggaactcttaatacatctgcctcatcccatttatctgtgtcttgaaagggaataaacaggacccaaatggtagattatcccaatgtacaacaattcagcatgagaaattccatgttaatgacattgttacagtataaaagaaccttttaaatctgagacttggttttataaatcctgtaattaaccttacagagaaccatattggtccattttttccagttgtcaagagagaccccactggctggagacattcaatctaccttactctgtttccagtgagtgaaaatatcttcatctgtctatgtgagctggtgcacacttgttaaaggtcctgacatagtgcttggtatactgtaagtggtaaataaataagaattgcttcccttccctcatttgagctttcagaaacagggatggtggtaaaccgttcatgaaggatccacctccacaatcgagtcaccacctaccaggccccacctccaacaatggggattacagttgaacatgagatttgggtggggacacagattcaaactatatcacattgcaatggtaggatcaggtaactttctagtgtgatcagtcatcaggatcttctgctaatttggaggaggatgctatgatatgtgtctcctcaaaattcttatgttgaaatctcatccccagcgcaataatattaagaggtgaggcctttacaaagtgattaggtcatgaaagtggagctgtgataagtgggattagtgcccttataaaagaggctgaggaagcttgtttgtctcttccaccatatgagaacacgtaaggtgccatctgtgaggaacaggcctcaccacatacagaatctgctcatgtcttgatcttggactacctaaccttcagaactgtgaaaaataaatttctgttgtttataaagtacccagtctaaggtgtagcagccgaaatggagttagagtgtttggtgtgagaacaagacatgaagactttcatgattttgtgtgcaactcaagaggtgtgaagctactggacttgctagatagttctccttccatacaaggttggggaacttgtaagatatttctgggtgtcacacattttgaatgtcctttacttccactgataaaatttatttctaactttttttatgcgtatagatgaacttttccttggtaatgcaggtaaagatattagatgcaggtaaaaacactggattcctctggagttaaaaatcctgattaaagtccttcacatactaactagccattcctggagtgataaatcctaactaggtccttccagtgataccttgcacacagagatacatcctatgtctgtatcagtatttttcttcaaattgcaactctgatccatcagtgggttgtaaaatcaaattagcgagaccaacatcctttgctaccatagtataggatgggaagggtatggaatgaggctggagtacattacatgtaaaaaattgttttttgaacctttccttcctgttatacatgtacacatcattgtgtagtgctgtaaaatgcatttcttactgtgggtcgtggagaaaaatgtttgaaatcagcagttagtttttaaagtagattacaggtgatgtacatctaaaaatttagccaattctaggattataatggtttggaatttgctgactttttgtaggtcatatcagtaaataaaacccttttccatatttctgaaattatattcttcttttttattattattatactttaagttccaggatacatgtgcagaacgtgcaggtttgttacataggtgtacacgtgccatggtggtttgctgcacccatcaacccatcatctacattaggtatttctcctaatgctatccctcccctagcctcccagcccccgagaggccccagtgtgtgatgttcccctccctgtgtccatgtgttctcattgttcaactcccacttatgagtgacaacatgtggtgtttggttttctgtccccatgttactttgatgagaatgatggtttccggcttcatccatgtccctacaaaggacgtgaactcatccttttttatggctgcatagtattccatggtgtatatgtgccacattttctttatccagtctaacattgattggcatttgggttagttccaagtctttgctattgtgaacagtgctgcagtaaacatacgtgtgcatgtgtcttatagtagaatgattcataatcctggtggtgacaaaatctctcagcatttgcttgtctgtaaaggattttatttctcctttgcttatgaatgttagtttggctggatgtgaaattctgggttgaaaattcctttttttaagaatgttggatactggcgctcacgctcctctggcttgtagggtttctgccaagagatctgctgttagtctgatgggcttccctttgtgggtaacctgacgtttctctctggctgcccttaacatttttttcttcatttcaaccttggtgaatctgacgattatgtatcttggggttgctcttcttgaggagtatctttgtggtgttctctgtatttcttgaatttgaatgttggcctgtcttgctagtttggggaagttctcctggataatatcctgcagtgttttccaacttggttccattctccccgtcactttcaggtacaccaaccaaacgttggtttggtcttttcacatagtcccatatttcttggaggctttgttccttcctttttattcttttttctctaatcttgtcttcacgctttatttcattgagttgatcagcagtctctgatatcttttcttctgcttgatcaattcggctattgatacttgtgtatgctccacgaagttcttgtgctgtgtttttcagctccatcaggtcatttatgttcttctctaaactggttattctagttagcaattcctctaaccttttttcaaggttcttagcttccttgcattgggttagaacatgctcctttagctcggaggaatttgttttacccaccttctgaagcctacttctgtcagttcatctaactcattctccgtccagttttgttcccttgctggcgaggagttgtgatcttttagaggagaagaggctttctggtttttggaattctcagcctttttgtgctggtttttcctcatcttcgtggatttacctacctttgttctttgatgttggtgaccttcagatggggtttctgtgtggacgtccttttcgttgatgttgatgctattcctttctgtttgttcattttccttctaacaggcccctctgctgcaggtctgctggagtttgctggaggtccactccagaccctgtttgcctgggtatcatcagcggaggctgcagaacagcaaagattgctgcctgttccttcctctggaagcttcatcccagaggggcacctgccagatgccagccagagctcttctgtatgaggtgtctgtcaaccactgctaggaggtgtctcccagtcaggaggcatgggggttgggtcagggacccacttgaggaggcggtctgtcccttagcagagctcgagggctgtgctgggagatccactgctctctgcagagccggcaggcaggaacatttaagtctgctgaagctgcacccacagcctccccttcctcctagtgctctgtcccagggagatgggggttttatctataaacccctgactagggctgctgcctttctttcagagatgccctgccccagaaaggaggaatcttgagagacagtgtggctacagcggcgctttgcaagctgtggtgggccctacccagtttgaacttctggcgattttgtttacactgtgaggggaaaaaccacctactaaagcctcaataatggcgggtgtccctcccgtgcccaaggtccagcatcccaggtcgacttcagactgctgtgctggcagtgagaatttcaagccagtggatcttagcttgctgggctccgtgggggtgggatccgctgagctaaaccacttggctcccttgcttcagccccttttccaggggagtgaacggttctgtcttgctggcgttgcaggcaccactggggtatgaaaaaaaatcctgcagctagcttggtgtctgcacaaatggccgtccagttttgtacttgaaacccacggccctggtggcgtaggcacccgagggaatctcctggtctgcaggttgcagagaccgtgggaaaagcgtagtatcagggccagagtgcaccgttcctcatggcacagttcctcacggcttaccttggctaggggagcgagttcctggactccatgtgcttcctgggtaacgcaatgccccaccctccatgggctggatccgctgtgtaaccagtcccagtaagatgagtagggtaccttagttggaaatgcagaaatcacccaccttccgtgttgatcttgctgggacctgcaccccagagctgttctatttggccatcttcaagccaggctctaatttttgtatttttagtaaagacggggttttaccatgttggccaggctgttctcgaactcctcacctccggttacattattcttgtatagagttgtcagccaagatagtaaccagagatgttttgtttgttgaaaagtacatcttaagctgggcattccatcaataatagactattttctggagatgttaaaaatcactgttatgatagatctgtcatgataatatttagacgctgtgactcttcagaacaacagtgaagaaagaagatgtgatgtgatgattacagcagtaatgactctgagcatcagatttagtggtatttaagttatgctgttactttgcaagtgatacttaaatatggttaaaatacccttggcagtaaggatgttagattaaatgacttcccacctgttccagtctttctgatttttctttcacaaatgttactttttttttttttttgagtcagggtcttgctctgttggccaggcttgactgctgtggcatgatcatgactccctgcagcctcaatctcctgggcccaagggaacctcctgcttcagcttcctgagtagctaagactataggtgtgtactaccacatctagctaatttttttatttttatgttttattttgtagatgtgaggttttgctgtgttgtccaggctggtcttaagcttcctcctggcctcaagcagttatcctgccttgacatcccaaaatgctgagattacaggtgtgagccaccatatctagcccacaaacattagttttctaattaacttgtaataaccccctaagctttgctgtctctggctatgctgatggttctaatatgggaagcagttaccacccccacaccctcaatgtgtactctttggtattgttctacctatacagtgatgagttgtcaacatgtagtacactttctttaccagatctccctaagatacaacacaacagtgcctagcctggaagccacaaaggacttcaaataacacagagaagtgacccaccagaattacctgggaagcttttaataagttgtggatgttgcttgagaatctgtgcttttgttatgcagtgttcttgcagagattatttccacttgcctgccgtgcatagttttgaaaaaagccaaactagattgtgagctccctgagagcagggacatactcctttccctcaaaattatggcctttgtgtctcgtataccttctgacagatattaggcactgaataaatttttgttaaatgaatgaatgagtctttggtttcaatgacatttgcttctcttgaggaacctggttagttgacataaattgcatgataccacatagaatggggaagctctccctttcctctctcttgctcaggtctgcagaagtccaagggtcttctgcctctcccttcaattaaatttcaaaaccagcagttactactgttgggtgtgggacaaaatgcctactactggtgggctgctaagactaggcatgtacatacaagaataaacacaatatatatttaggcgtttgaatggatacagatgcctaagagagagagtctatcatgaaaaatttgaacaagtagccctcatctactataaaacctacagttttctaacctgaattattattgtttcagttatctgctaaatgtaagctctttgacggcagtatctatgtctattcatacttgtagccatcatagcatctgacacagtgcattgcatattgtaagagcccagtaaatgcttaatgagggtatatatggatcagattgcccagaaggaactctataaataatgattgaatatcttctttaataaaatgagggaactggatcagaaagtctaaaagaagttccctttattgctcaatttttatgatcctgtgatttagaaaaataattttaatgggcagtttcatagtttgaatgacatattattcaggctttttaaatataggtgttagaaatgaagcttaaagcagttggaagcaatagagaataaggcaggaattaagtacttctaattaacaatgctagataatgtcagtgactgtttcttgtatctgtactgtaaggacaaatgctgttcatagttgtaacttctaagacaaggctttgatttctttacagtattcttcacctacaccagaaccacttgtaaagaggcaagaatatttactaagagttgaatcatgatatgttttttttgcaatatattgtttaaggtttcttttaagtcctgcctctttcaggaagcctttacctaatagttcacttctctccaggaaaggactgatctttacatgtatatctttctgttactgtatttaggcccacaaaacccctaactagatattgcctatgggttaagaacagagtaaagatatgaagaactgttttcagacatgtaaaataaggtaatgtgaatcatgtagaagagacaatatctttattccttttactctcaaatcataaaaacgaaagttataggagggaagatttgacttaataatagggagaatgtttctgaaaggtagaactctttggaagggacatgatctactttctactgtgtgcactagtagtgcttaggcatcttgtaaggattgttgtgcagggagtttctctttcagcttgaaggtcagctaaatatatcatctgagaatctgtaattgaatttaacaaatattttagtgcatctttgcagtaggcattaaactctacataattaggtgatggctggtatctgttacagtctagcacaactggcttaggaggcaagtcttattcttgcagcactattcacagtcacaaaaatatggaattaacctaggtttccatcaatggatgattggataaagaaaatgtggtgtatgtatgtaacatggaatactattcagccataaaaaagaatgaaatcatgtctgttgcagcaacatggatagaactggatctcagctcactgcaacctctgcctccagggtgcaaacaattctcctgtcccagcctcccgagtagctgagattacaggcacctgccaccactcctagctaattttttgtatttttagtagagatggggtttcaccatgttggccaggctggtctcgaactcctgacctcatgacccgcccacctcggcctctcaaagtgctgggattacagacgtgagccaccatacctggcctggaggccattgtcttaagtgaaataacagaaacagaaagtcaaacaccacatgttctcaattctaagtgggagctaaataatatgtacacatggccagagggcatggaataagagtcattagagactcaggtgcgagggaggtgagagataagaaattatctaatgggtacagtcttcactattcgggtgatggttatgcaaaacaccatgtttagctttcccaaataatagcacagttattgaatgagggaaatgtggtataatggtagcagatttgtttaccagtgttggccagcaaccaggaaattagttggtcagtgagtcacaacattaatggggctgccaaaatatcctctaatgagctgttttgttgtattgaatgaagtaattaataatttttttaattataaatatttatattccaaatagaagtagaagttggtacttaatattgaacagactacaccaaagaagtaggttaagagagaatcttttaagagaaacaattttcttaggtactttaaaggagcattaataataaatacggggatagagagtaggaggtaagttggctattttagataacatgggcaggttaagttcttcctgagagacaacacttgaatggtagagaaagtggtcaactggagcagaatgccccatctgaaggaagaatctactctgctgcttcccagctgcagcttactgtcaccagtccagtgttgccaggactactatttttcaagagaaaccaagattccatgtttctttatgaaaatttttaaactgagcagataaacaagcatatctgaagaatagattatcttttctgtcagtttgtgacctgggtgatgctgtcttctgagtcctcagccctatgttggaacaaagaaaaaggctttgaagaaaccagagagctgctttaaatacttgtgggttatcaggtggaagacagatttgacttgttctatttccagaaggcagaacagagacaggcagattttcactcaaggaaacacttaacaattagagcagactagaaatagaataggatgtttgcttggaaattcttctgttcctggaaagtggtgttcaagctaatagtggatgatgagttgtcaaaagtgtctagggaagggtctaggtaagatgacatttcaagttcctttttatcttgaaattcttgaatcaccaagatctagatccctgttcagctcttctccatatcttcaccttcatgttcacagctgagttatcaccttcccatactaggaaagtcagtatgtaaagtcagtttcttaaaggcttggtttttctgtgtgtctgcttacataatgaaggttcattggtttacagttcttgtttaagatgtcctttgcatgttaggttcattggtttgcagttcttgattaaaatgtcctttgcatgttaagcagtcacaaaacttgaaattaaagcttttagagtctctgaagctataattgttttattctcccaactgcgcataaaacggtttgatagctagtgctttaactaaagctagttgtgttcgagttctaactttgcagctgtcttggagatctaatacattagcaaagtgaagtgaagtaaagatatatttttcaaaagtccttgagtgggattatcttacactttattatttatcttgatactaaagataagaaatagatctctgctatttcatttttctttactcagtatacataactttttgtcaagagttaatatagaagtatgtctgtttctctcataacccttgttttaatggttaacaattgtttatttcttatcaggatgagagttaatatattgccatccttgataagaactcttggtctaattttacttataactgctttaattactttataacacactaatgccataatctatataatgcttgcatgtccagtgcgtgtatttatttctagatcagtgattgtaataggtactaggtgcttaaaaatacctatactggaatataagcaattacattttttcaaaatgtatggagtctttattatgatactcatgaatgtttttaatgagaatatgataataaaccctacatctcttcctaaatctccgatcagtagtagtgtgacctggtgctacctatcagaagaatgagggccctcccttagcagtggagtactgaaaactgtatctctgcctctcctccttcacaccctccttcaattcatgatcctcagggagacttattttgcctagtttagttactgagtctggtggttgacctcttgagtaatgaaaggacattactgagaattttgagagtgctgagagtgagtggatacttttaaggttttctcttcaagcttttgttccctaatttggaaaggtaagtaatgtttgataatcttactaaattccacagttatttattctctcaaacccttcagaaaatacccaattgaataagatataaatgtttaaggaacttttttttctatgttgaaccagataaatctaagaaataaaagaaaagctacataatctgcagtataatattaatgaaaatacagcagagacttgcagttaccatgttaaggtacagatgatttcctaaatgaattcatttgtctatgatcagtaactaaagaagcagctagctggggtatctactcttgtaggggagcaggtagcctttctgggaggagagcacatattaactgacttaaacacctttgtttttttttttttctgtatttgctttaagtgatactgaatttgatggctttttctttggcttgctaaggataaaatgtagaaaatttaattctgcttggattaatgaacatatttttagaatcttgtacaaattgtagcactaatgaaaggtcctctgctccaggcataaggtttcatttaagaatgaaaaagcaaattgagctaatgtattgtgtaagaggtttgtagttaaatacataaaatgatgtcagtttgatttcagctggagctaaggtactctgatagctatgagatgttaaaataatagaaacatttaaagaagtatgatagctgaattttatataaataaagtagtttgattttttataactggtagcgtttattttacttcagtgatttggcagaggtactaagccaaataatttttaaattggttttatcttaaattggttatatctggtggtaacatttatggataattagagtcaaaataagcaattgtttcatccttttctactttaccatgttttaaacatttgagtttggaaaacttaaattatatacaaagtagaaaattagtataataaagactttaaatcacatttatcaatgcacagggaatcgtgttttaactatacccccaccaaacatatcttgcctcagattttaaagcaaattccaagtgtcaatcctttccttataaatatttcagtatgtatccttgagtaagtccataaggactaatttcttttagcataactataatgccattaaaacagctactttttagttgcagataagaagtagggtaggaattgctggggtctaacccagttctgatgacattaaatagatcctagatagttggacaaatcatttaactttcttctcttcctgctctcttgtcttttaaagggggaagctcaactaaattttctttaaaatcccatctgtctctgaaatttgttaatttaaaaaattagacttctagtttccagactagcatgtaaggagcttagaagtcattacgtcaaaaaataaacaggttaaaaagctgaacaaactgaaaaattaacagttcttcttagatctgttatagaagcaaggttacagggtaaaccactcccaccacccccagattgaagagacaggcaaatacagagaacaggagcagaagcctctgcaggaatcagcatcacagtaggaaaacctgaactgcaattgataaattgctggggctcaggatatacaagcttgagagtgaaaaactttaggggtgacgagtcatgagacctaatcataggactatagaatgctctaccctcccccgctttcttacccccactttcttagccctattttctgcagttccttttacccaattcaccatgtccagctctcaagaaaaaaattacaagtgtactagaaggcaaataatacacttcgaagagacagaacaagcaacagaaccagattcagatatggcagggctcttgaaattatcatatcaggaatttaaaacaactatcattaaaatactaagggctctagggataaagtagatgccatggaagagcagatgggcaatgtaagcagagaggtggaattctaagaaagaatcaaaaagaaatgccaaaggtgaaaaacagtgaaataaaaatgaagaatgttttaaatgagttcattggtagacttgacacagctgaggaaagaatctaaaaccttgagtatatgtcagtagaaacttccaagatagaaaagtaaagggaaaaaagactgaaataaactgaacagaatatccaagaactgtggaacaacaataggtgtatcatatgcatgatgagaataccaaacgaagtaaaaaaggaaaggaacagattaaatatttgaagcaggaacaacagaaattttcctgcaaattaatgtcccacactaaaccacagattcaggaagctcagaaagcattaggataaatgcaaaaaaaaaaaaaaaaagctacacatagtcatatcatattcaaattacagaaaatcagtgattaaaaatctggaatgaagcctgatggggtgtgcagggagacctgacttagagaattatatccaacatttcctcagaaaccatgcacacaataagagagtgaagtgaaataattagtgttgagagaaaaaaacttccagccaaaaattccataccctgcaaagttattcttcaaaagtgaagaagaggtaagactttctagctaaacaaaaattgagagaatttgttgccagcagatctgctttgcaataaatgttaaaagaagttcttcagagagaaggaaaatgacataggtcaaaaactgggatctccattaaaaaaggaagaacatcacagaagggataagtacaggtaaaattttaaattttttatttttcctatttttaatggacagatcaatctgtacaaaataatagcaacaatatattgtgtgcgtatacacacacacatatatatatacttatctaaaagtagaaagaaataacaacaatggtaccagggatgagatggaagaattagtattattttgttattaagtacttgtgttacctgtgaactggtatatatttgaaatatatttatttgaaagtaggcttcgattagttttaaaggtattttgcaaaccctaggagaatcatttttcaaaaagttaaagaagtatggccaggcagggtggctcatgcctgtaattccagcactttggggaggctgacatgggcagattgcttgagcccaggggttcaagaccagcctgggcaacatgttgaaaccccatctctaccaaaaaaaaaaaaaaaaaaaaattagccaggtgtcattgtatgtgcctgtagttccagctatttgggaggcagaggcaggaaggtgatttgcacctgggaggcataggttgcagtgaggcaagatgatgccactgctctccaacctaaaaaaaagtataactgataatctaagagagaaaatggaattatataaaatgctcaaaaccacaaaaggcagaaaaggagtgaaagtaaaaaataggaacaaagaacaagggcaacaaatagaaaattgtaacaaatcaatagataataattaaactatatttgaatgatcagtttgaatagcagtggcctaaatatacaaattaaatgtcaagagattgtcagcatggatgagaagcaagactcaactttatgttgtctataagaatcctactttaaatattaaaacacatgtagagtaaagataagttactggggaaagatatactatgctaacactaatccaaagaaagtgggagtacctatattaatttcacaaatagaagacttcacagcaaggaaagttgtcagagatgaagaggggcattacataatggtaaacgggtcaatacttcaagaagacgtagcaatccttaatgtgtatgtgcataacaacagcatatcaaaatatgtaggacaaaaacttacagaactataaagagaaatagatgatttggctattaaatagttagagacttcaggaccccctctatcagaaagtgatccagcaggcagaaaattagtgaggacatagttgacctcaacagaatcatcagtcagttgaatataattgaaatccgtttactacattatacaccaccaccacaaagcacattcttcttaagctcacatgaaacattcaccaaggtaaactgcattctggatcataaaacacaccttaactaattttaaaaatgctgtgcgaccacaatggagttaaactagaaattagtaacagaaagatagctgaaaatctcaaaatacttggagatttgacaacattattataaacacatgggtcaaagaagaaataccaagagagattttaaaatattttaaacaatgaaaacaaaaacacagcctatcagaatttgtgggatgcaacgaaaacagtgtttagaaggaaatttaaagcattgaatgcagaggttacagaagaagaaagatctaaaatcagtaatctaagcttctaccttagaaaagaagaaaaagacaagcaaatcaaattcaaagtaagcagaagtaaagaaatttaagaattagtgtatatattaatgaaataggaaacaggaaatcacagaaaatcaatgatctcaaaagctggttctttgaaaacatcaataaaatcaataagcctccaaaaaaagagagagaagacacacgttactaacatcagaaacaaaagagagggccaggtgtggtggctcaccctgtaatcccagcaatatgggaggcagaagcaggaggattgtttgaatccagactgggcaacacagtaacaccccatttctacaaaaaatagcctggtgccaccacatcacagttactcaggaggatcacttgagcctgggaaatggaggctgcagtgagctgtcatcataccattgcagtccagccttggcaacaaagtgagactctgtctcttaaaaaaaaaaaaaaaaaaaaaaaagaattgaaaaagaggctatcactacaaatattttgaacattaaaagggtaataaagaaatactataaacaacttcatgtcctagatgaaatgaaccaatttcttgaaagatacaacctgccaaaattcacacaagaaaaaatacacaaactaagtaggccttacatatatattaaagcggttgaatcagtaactaataactttccaaaacggaaagcaccaggcccagactggttcataagtgaattctgtacattaaagaagaaattataccaattttctctacagtcttttctagaagatagaagcagagagaatccattttaattcattctgtgaggccaccatcctaataccaaaaccagacaaagacattgcaagaaaagaaaactacacaccaaaaaatttcatataataggcgtaaaaaattttaacaaaatactagcaaatggattccaacagtgtgtagaaacaactatacaccatgaccaaatgggatttatcctgggtgtgcaaggctggttcagcattcaaaatttaattaatataattcatcccgtcaacaggctaaagaaaattctcaggatcatatcaataaagaaagggcacttgacaaaattcaacacctattcatgataaagacttggtaaactaggaatagaagagaacttccttaacaacattctgctcttacagcattgtactagaagtcctagctaatgtagtgagataggaaaaggggcaggggaaagtatactaattggaaaggaagaaattagactttcttcacaaatcatatgaccatttatgtagaaaaccgaaaagaatcgacaagaaacttctggaactaataagcaattatagcaaaattgcagtatacaagattaatatacaaatgtcaattgctttctatataccagcaacaaaaaagcagaatttatttatttgagatggagtctcggcctgttgcccaggctggaatgcagtggcacgatcttggctcactgcagcctctgcctcccaggttcaagcaatcctcccacctcagcctcccatgcagctgggattacaggtacatgccaccgtgcctggccgaaggaacatttttattaatcatggttatagtagtaggagttaattctggaaaggttaggttttgagattcagaccccttgaatgttggactgaagcagtctgtctagtgcttaagaatataaactcgatgcagactatttgagcttggatcttatctctgccaccttctataatagcgcagcttattctataatcgacataaatggtcatatgatttgtgaagaaagtctcatttcttcctttccaattagtataccttatctcccatcttctataatatagcacttaaatataggttacttaacctgtctttgccttgttcctcatgtgtcaggtagtgatagtaacactacctacctcatagggctgttacaagattaagagttcatccattaaagtttttagaacagtacctggcccacattaagcacttaatatgttggctattattcttggtggttgtgtggcgttttttttgttgtttttttgtttttttctttgagacagggtctcactctgtcacccagactgaagtgcagtggcataatcatggcctcaaccccctggggtcaagcagtcttcctgtcttatcctcctgagtagctaggactacaggcatgtgccactgcccctggcttatttacttatttcttttgtagagatgggatatccctatgttgcccaggttggtcttgaactccttgcctcaaggaatcctcctacctcagccttccaaagggctaagattactggtgtgagccactacacctggcctgtttacttcattttttaggcaatagttgacaagtttctgtatacataagaatcaaatacagagtttatgaaatgctggatcttattgccagagcttttgattgagtgggagctttcagttgagtatagatttggccagtgaatcataacaaatatgagggtaattttgctgcagtagcctacagcctttactttgagaaactgcagaatgttctagagattcagtgctgactttacaacaatggagtgggatgggacaagtggtctgttgggagaatttatctatttggtatcttcactgggaactggaagtgggtgaatagaaataaaagggttttgagatgagtgcttgagatacgacaaaggaagttttcacaggctttggtgtgaaaaaccactttgctattttgagcctttgtgactcaaagaagatggtacactgaagaaagaaaaagtcaggaagatgaatctgtttgctaaggatttattttgtttaatgtgattgaggtccactggggtcatgcttagtgagctgttcaaagatgctttcctgaatgtttctgcagcgggaaagccacagaagtagtaggttgtctaaaacaatagttgccaccagccagctttccagtttttcaggaaaatgctatgagtacaatatattaatatggatagatttaaatcattaaaaaaacttctctgatgcctgtgagctgtggtatatgtcagctgttaattttcttatccttttcttagataacattttatttaatagagctgtcttataagttgtaaagtgaggtttatagatttaccatcacttctgacatcttcagatctcctctttaaaagtacaaaatagaactttgcagtaaaaataaaatagtataaacagatttttttttagcctctgaaaaccactatatattagtttgcattaaccactatacgtagaaatatcttcctgttcaaatgtagttatgtgatactttgtgaaaatagggccttaatatttaggggttaaaattaattcaaaatattttcagtaagaatgggccaacttggcccacatactgtagtacaagctgataagtagtcattagaagatgatgatctaagactactaaataagctctcacagacaggtcatatgaaaccacgtttatatctaatgatttaagtgtaaagcatgtaggcaaacgctactagtcatcacactgtaatgtacagctttcagtacagaaaatttggataaatgttctgcagctatatccagaaatcagtttttcattaatttctctttctatgttttgtcagatacagtaattatatcacaagcagtcaaattctaaaatggtatgtgtagagaaaagaagcaacagagttcttgccattcctaattctgattaccctaatttgggataaatatttccttcttaattaattggttaatgcattaagattgtgagctgaaaggtatcataagtgcaattattatttgtatgaggattcttcgttcataattggcaaaaagtgaaacaaaaggaataaccaaaaatcataacaaatagcatcagcatttaaaagcaaatttctagaaatgattactataggactttaaacaaattttttacatcagtgatatgatttttaatatttttaatattcagaaggctttttatgtaagtgcatatatcaacattatcagttataccttcttactgataaattcctgctgtcagtctctccacagctctaccatgttctttttctccttactttctcgtctcaagttcattagttgagaaggatgcttactattactctgtccaaatttggtagtggttttctcaattttgggcatttcatgttcaattaaaatttatttaattgaacttttgaaagaactttcccagccatatagagatgtatttacattatagattcatttccagataacagtcacacagagacttcttttctgttacttttttcttgcctttgataatgacattaataatttaataataaactattaacatattaacagatataatagatgttaatattaatataatttatgtgtggttctataagaatagacacttcgatatcatgatagaaagattcttgattatgatgcaacttgaatatattaaacactaaactttcagcttatgatgccattaacagaacttttaacttatgatgcctttaatactttattcctgtgataagatgtgaatggaaggaaaaaataaatattactttttggtggaaaagtgtacccagttgtttattcatacagaaaataattattgaatgtcagtttctgtatgccaggcactgtttcaggcacctaggatactgtggtggaccaaaatcttatactcatatcttttctcccaagtgaattttgctatatcattattgtgctcctctataaagaattagaataacttcataataataaaaaattataagttgactccattaaaaaaaagctgaaaaacagctgattaaatcctattgtatgtaaaactgaattttgttttatgcgtgcttctagataaatagtgatagagttcttgagtgttttaatgaagtgttttaatgcaggtgaatgctttggactgatgtcaacagtgaatgttaatgatttttgagcatggttggcactatgaattggttgtttttaattttttgaaactaagtacattgacgcagatttatatgatctgatgatatcttattggctatgattaaccagaatatgtgatatttaaacgttgaaaatgcattaaaggatcaagaaaacagcttgtctttatgactttttttttttaagttttaaaaacactgagccaaattttggatttaacattcccaagctatggcctaagagaaagacaaatttaacagaatgagagtaaatgaagggctggcccatcagtgatctctttttataaatttacaacttccaagaaaagctaactaatagaagtatatcatgtcttgctttttcacaagatgtaaaatacgggaatacatgtagactaagaatggtaaatttttaagttacctcgtttgtaagggaaaaaagattccccttttttctcatttacatttaaaataaatcctcaatattatatggaactatttataatatagtgaaacccattttatttgaacatacaaatataaaaatttctggtagtctgcagctaatatgcactgtctgaagctaataggttgtgcagaatactgctgctatttgagtaaaagttaatgcttttgagaccagctaatacacttaactacactgtatgagctgtgggtgttccgcttatttttattacaggctttattactgtgcaattttgttgtacattaacaatcatccactttaaactagtgcttaaatacttattgaatgtggtagccaaagagcaaaaaaaagatctcaatgtaacatccaattgcttactaacataacctggattgtgatttatctctaattttatgacagtaatatttcagtatcaaactagaattctgaagagaataaagtttgcatcccccaaatgacacaattgtgcattagctctacttaactagacaaaatttaaaggcaaaaaattcttggtacgaaacagatactcccaaaatgatcaccctatgtgtgtccaaaggagttctcactatattgtgtaagtcttcttccctccattatttaaatagttataaattttcattttattatgtgtatattagactatatattttataattttcctctctgtaaatgtacaaatatgcaaacttgtataaattaggtaattgcataaaaattgaaaggcataaagatgtactactgagttcaggaaacagttggattgggggtgtgtttaataagtagcacaattaagatgtgagaaggaaaaactgaagaaaaggaaattctctcagtgtaatgctttattagctccaattttccccttgtctcttatctgaagcaagtgatttttttccatttgcttaaaaataaagcatttgcgcacagaatgttagctcattaaaaagacctttattgccataaatcgctgcatcatttgcatatccagattcacagaatcaaattacagttcaaccaagtatttagtatctggaaagcagtcttggtttcatgtctacttattttcccaaaactcttgttaattctccttatagttgttttcttagtggctgaaattaagtgatgtctagtaaataagccagattgcttcttaaataaaatctggcctgttatttatgtccccacctattgtttcaaactctataatttgaacttacacacttgaaatcaatagtaatagttatggtgatagggacaggtgatgggataaggattttattagtagaatcagtcatgagtctaaaactgcactgctagatacaacacacaataataactgctagagataatacttaaccgtaacctgcagagtaaatattcttaatcctagtttacagaataaaaagcttggagataaaagttaagttacttggtgtgaggtctgattcacacagccagtaagtggtggttttggtcacttcctcctcacccctttgacaagggaaggattcctgccatagggttatgaggatggctgaacacgtcagttgggctcagcagcagttagttacctatgttcacagctaaggcaaagaggaccctgtgcctcaagtggggtcacgtggagttgcacttgggaacagagtaaacaactaggagctatgggaggcaggctttgtagtatcaagagggtgggggtatcccctggttcccatggaaggatgtgattggcttgtttgaataattcctcaagctgacaagaaactgaaacctactattcaaggataaggaagaactgcatctggcccctttggtaaggtggatggtttcgctaggggcctttattcatgagagcagagtggagaggggaacgtatgggttacgtcggtggtccccaacctttttggcaccaaggtctggttttgtggaagacagttattccacggcaggggcggggcaggctggtttggggatgaaactcttctgcctcagatcatcaagcgttagttagattctcataaggagcgcacagtctagatacctcgcacgcacagttcacaataggatccccactgctatgaggatctaatgccactgctgatctgacagaggtggaactcaggcaacaatgcttgctccccagccgctcacctcctgctgtgcggcccagttcctaacaggctacagactgttagcagtctgtggcccagggtttggggatccctgggttagatcattcaaggccttcccgattttaccaggtgtcaaagcggcacatgatattgaaccttaattttaggtgttataccacagtggctaaactagagttctgattgtgaactttcatgactccagtgcccaggttcattctgctgttccatgatatttttcttcttgccagaatgacatgttaacatttcgttagtaattgagtactttgctttcactgggcatttcttagtcctgcgttcttcagaattcgtacactgtagcatctgttgtattctcatagaaaactggagcgctctcatttagaagacatttgaagatttgttttcctttaaaggaaaatctgagtataagttctaattatatcttgatttacagaagattttttttttttcctattctcaaagctgcagtgagctgcgattgagccgctacactccaaccttggtgacagggcaagatgctgtcccaaaaaacaaaaacaaaaactatactccctccccaaaacaaaatcttatttttccatgttccatcttatttttattagaacgtcttaagttccccctctgcagccatgaaactggcataccacaggtctggaatgcctctctgtctctccatttgtatctccgacattagaccatttcagccactcctgcatgcagttacacccacctcatttttatcacagttagggaatgtttcacagagtattttgcataatactatgagctgggtgctacaagacatttaaaaaataatagctggtttctgccattgacactctcactgtggagaacaagacataagagttgtgtagtgtaaaggtaaatcagtacacatagaacccagactcctaacccaggcccacaggccatacgtgagctggcccctgcctgcttctggaggctcatctcttgttctttctccctttcacttgactctggccacgttggccttccttccacttcccacacacgccaggtttttctcatcccagggcctttctccttgtagtttacttggcctgaaaaactcatccttacatgtctgactctcttttttcaggtctcattgcaactactatttatagggatagttcttccttgaccatgccacctaaaactggcccttttgacttttccatgcatagtaggtcccatgccacccacttaatacctgtgtaatttttccaagatgtttaatttctctgtgccacagtttgctaatctgtaaatccaggagtattttaatagattaggtttttgtgacagttaaatgcattaatatcatgtaaagtgctaattataagaatctctggcatatagtgattgctcagcaaatgcaatcagtttctgaccttcatcttcatcattaagggtaaaagaagtagtgtaaaacgtaagtactataggagctcagaaaggagaggaatgccggaggccctgaatcaccatgaacactttccttgtgacagtagaatcgaacctcactgcttctgtatagtgtctggcatgtttccgtcagacaggcactccctcctcctttggatttctacgtccttttggttctttgtgtgatacttgtatcgtagattgtgtatatgttctcacagaaaaggtcatcctgcatctctgcatcctcagcattgtgtgccgcacacaggacaggtggccacttatttgattaacatgagaaaaacacagagattccatgaaatcagcaagttttaaacaccctcagtgtgggcagtaaatgcagtatgagcacagtgactacaaagatcagttactggaaatgaccaagttggaacagtgaggggcagactattgtatggtcttaaattggctttagagtcagattaattcagcagatttgaagagcatcatttcatgccagtgtctaagctcagattgtaggatcacaaacatgaaccagtacaggtttctgtaaagcattttaacttgattcaggtgggacttcagtgagtaaagcaagaaaggtgttccagacaagcttcagaaagagcaaaagtaaaggtgcagagttgagaaggttcaggaattcaggttctctagagaaaagatttcctcatgctggagcaagaggaaataaggctgaagtgagggggtccaaattatggaggatttagggtaccagaaccagaacatcagctttattccataggagcctgtggaaggtttgagcaaaggattggcagaaatagtactcaaaattagatgatacatttctgtattttctgtagtgatagaagttccttgaacttaaatttgaaaaggtttgaattaaaagggacagatgttctcaagttatatactagacattttcagtagttgtacggtttttgagcttttattagttggtcctaagtaagttttatagcattatgataggcagttggtgacagcttagtcatgtgttctttcttgagtaataattaaagtattaatatttttccttttcattatattttatgcatcatggtttgatatatgcttgaaatatttactaaattagatattgctgcatgtggtccatcccacatataaatggaaaagagaaacttaacatagttcataaattaaaatatttggtttcagctgtattcatattgaaaccataaaagaatcagaattactgtgggtttatgattgtcaggttaccaccatcactacaaattttctgataacaacatattagtattctgataaggtttgtggcttctttgcaaggatatttgaatactactcaacacactacataatggttaactattgttgtctttattttaaggaaggcatgaatattgttagatttgcccctaagtaattgagtgatcatttttatatacaagaaaatcagagtagaatgcaaaatttggaacaggaactcaataatacttataaataagttgattcaaagaaatgtttcaatttcttgacattgaattcatgatgttttgcttttaacatgtgatttttaaaaaatactgttatgtgtacaggggaaggctaacctgagactttcccttcatgcgtattcttcctgtgcactgcaaaaggaaactgtgtgactgctttccttcctgactggccatcacatagggttactggcagatgccaggaatccaaggactaaaggaataaagggtgtgtgttatagtacctgcgctaagagatactgtcaaactcagaggcacccctcctcctccatgtcttaaccctagaattgttttagaacttcttatggataagtgtttggattaagggagatctgggaaatgggatttgaattttaagcaagtgagccctggggatggctagctgcccaaagtctctaggaccccaaagagattatgagagagaacgttgagaggtctggaatgaattatacatactcttataatgaactttctccagcttgtccttgagcagctgtctccatcccatccctcaagtgctttggaacccacatcttataacaatggaaagatagataaccttttattttaatgtgtttatttttattttaatgtatttaagtagtttaaacactttcagcgaaaacgcattgtatttctcactccattcctcaatccagatgtataactaaagtaccatagtgctgtccattattagcccattttgtgttttaacctatacagtttgaggaacaagaaacctacctgacatcaagattatactatcagtgaagccagagaagctatacttattcattgtagacattcttatctttttaaattttttatattaaaaaaaaaaaagaggctgggcattgtgtatcacgcctgtaatcccagtgctttgggaggccgaggtgggtggatcacgaacgaggtcaggagttcaagaccagcctggccaagatggtgaaaccccatctctactaaaaatacaaaaattagccaggtgcagtggcaggtgcctgtaatcccagctactcggagggctgacgcaggagaatcgcttgaactcaggggtcggaggttgcagtgagccaagatcacgccactgcactctagcctgagtgacagagtgagactctgtctcaaaagaaaaaaaggaaaaataatggggtctcactatgttgcccaggctggtctcaaactcctggactcaagcaatccttgcatctcgtcctcccaaagtgctgagattacaggcatgggccattgtacccggctatcttatcttctttatatagatatctaataagatgtaaaatactgacctgcattatctccatgttaacatttacacttcaaaatctgtaaacggacccacgttcatacgcgtgaacagaaatctttcagcaacaaaagagaaaattgtatttctcgatagaaaggaagtggtcagatcatgccagccaaacaaatctgtcaggctttgaaatatagaaccgttaggtaagatactgagaaaaaggataaagtaagatcagcctaaatgtttcagtctagttaagttgatttgtatattacttagaaatttcattttcagggaaatagttttcagatttaaataactgtaaagagctgagttattctttgacttggatttaaaaaaaaagaaaaaaagtgtcctgaagtcatttcctgccagtttgtccccccaactttttttcctgctcttcctgtaactggttcttgttacggcaatgtagctgtatatttaaatcctaagagactcgcttattgtgagtaggcagggtcagtagtctgctgaaacaagcacaggaaacttgaaacacctaggggctattttaaaaatcccttgccactgacattttagttagaattctaaagagagaatgggctgtttggatactgagctccagtacaaaagagctggggtttttacaccgacttgcaaaccactaaaatcatttgacctggtgttgtgtcacttgggtattctgaagcatcagatgaaaactaatatccaccctgcaaggttggcaggcaacaattgtacctgtgaagtgagcatctatcaaagaattggggaaggaaggccgggcgcagtggctcacgcctgtaatcccagccagtactttgggaggccaaggcgggcagatcacgacgtcatgagatcgagaccgtcctggctaacacagtgaaaccacgtctctactaaaaatccaaaaaaaaaaaaaaaaaaaaattagctgggcatggtggcgggcgcctgtagtcccagctactcgggaggctgaggccagggaatggcgtgaacccgggaggcagagcttgcagtgagccgagatcgcgccactgcactccagcctgggcgacaaagcgagactccgtctcaaaaaaaaaaaaaaaagaattgggtaaggaaacttaatgtgtggaggagatgccaccatctctgaagcacagactttgttagaggagctcactgacttgttcctaatagtcatgtggttggggcaggcctctagcactgctgacaggtagcattgattctgtctcatctttaagttatagcgtattcagtattgctttatgctattatttttgaaaggaagttgttaactgtacaacactttaggtgatattatgagctaactattttaaatatatcattttttttaattaccaaaagcagtgtcagaaaatgaaactcttcatttgggtcgtttaaaacacatttgcttttggtgtaccacttatattcaaagacgtttcatatttatttaagtactttaagaatgttattacaaagccttgctttgtgatttaaattgaagttccctagtgttcatattgttagttagaaatttagattttagttctgtgacttttatattgttgattgtaactttggacttatgtggcctgtgtaatacatgctacaaaaataaaatctgggagtaaaagaacatatgtatattttaataaagacctcattaaacattagtaacaataggataaggaatattaactgaaacagacaggaaatcagggtgaagatcaggcagaactgatccttttatttacaccaaactaaatgcactaaagagaagttttaatgaacttaaggagaataccaaaacatttctaaatttaaaaaaaaaaatgaatcctgctactgatgggtatatagcattaatctcccacccaaccccccaaaaaggacttgtctggcttcttgtaagagagggtgatatttcataccttaatcttgtgattaattccaagtattaagatctgtcttctgatcctaagtgttcgtaaagacatataaagcatttttatgaactcttatgccctcctatgtgtaaggaagaaagtcttactatgaagtatagttttaagtatactaaattaaaatgccttacataaggcactgagctttctgtgttgttttctataagatcttataaaagcctgttttatgagcttttattttttgatgtcagagcgttttttaaaatccaaaagaaattttcaaaaggtagaattttgtaagtgaataacttagccagccagatcatcctttcctcagtctgtatccactaccagtttgccttccagagatgcatagataagggggcgtggttactgattcttctgctttcctgtagctctgcctggggtttcccctcagaggaatgtggtttgaaaaacttcctccatcactactttgtttgcagtatgtattatttaattttctttgataatatatcaaatatctatattaataattgaaccaaatttagtaatttaaaattaacagcttgtatattagatgtatattacctgtgtcccctactaaactccctcacaataacaacagtactttccagttttctactcacctctctggccacacagcattcttcttttctggccattatccctctcgtggccattaatggaccaagtgttaggtcttcttctcttttctcttcctactctgtctttccctctgagtgatctcatctctgcctgtggtttcacttaccacctctgaactccagaggaatgacctcaaatatcataaaggcaccacagactattagatctgtcttagctcagcttccccactaagaagagccggaagcagagcagcatgtgctgtttattagggaacataatcccaagaagtagagtgagaaacaaggagaatatggtttggtaggggtggagagtcaatacatggataagctattgtggtacctgccaccactcagtcctgtaggttcgttcctgaaaactctcataaactgtgctttaagactgtaccttgtgagagaagaaaggaggaagaattttttcattagtttctgtctcccattggccaaagattcatctttcagtatattaattcctccatgggggtatgcaagtggggaatccaaagcagcgtcaacgcagatgccatagagtacaaggcaagaactgccccccgaggcatgaggcagggaactgtcagatgtacctatgtgaaattggtgctggttagacagctggactaagatacaagtaaggttgagaagatctgaatgatgcataaaagatgcccagtataatacacccctttaaccactgagatccattcaggctctacattatacgtagcttccatactacgatatgaggcctccatttttgtgagaataagatgccttcacttcatccctgagatcagaggttatgtgcaatcagtaactgaatccccttcaaggtggagccctgccacactgtccgaaagactttagacgggacagttagagaaacaaattacagtcccttctgctgcagctgaccgtgaggcagtaattgatacacatcttctatcactcattttaggttttcttcaccagttttgtttttttttttttttttgccagcttgtgttgcttgcctgctgaaataaaatatgacttatgtccctcaaatgtctgagcccttagttgccttgctgttgttgatccatggttgttgaaatatcccatttattgtaaccgctggctatggaagcaccacgagataccccagtgaatctctcaagttctggacatatttcttcttcccccattgtgtagctgcagtctttgcttcttgtggtggtccagattgaatattcctagcagtaacctgactcccttttttctactgatgtactggcttgaggaattcaaagtatcccagcagtatagtcagatcttcaagtttattggaactcttacatgtccactggtggaaacaatcaccccttaaccccatctggaagtcagaacctctaccttagtagagatgaaagtaggatgggtagaaaacacaagtttcacaaagtcaaccctactgtcatccttcagttcccagacctaagtattgaagctgtttataacacagcaccctgtaatggccattgcttcaatgcatatgcatataccataccctggagggcagtgctccaacactgcaggaagtcatcttcaagatgtctcttcagctgatattttttaataggctattctgcctacctattgggccagctgttatttgtgaatggagtgtacggtaaagcaaatggattctaaggggatgtgcccattgtcatacttctttagttataagatgggtactttgggcctaagacagtgtttggtgggatgccatgttgatagatcagttattttataagccctggaatggtggtggtagcagaggtattgggagctggaactaaatccatgttcagattaggtattaattctgtaaagacaaatcattgccaccctgccaccaactcttttactccctctacctccccactcccatgtaatcttatgccaagtgatcggtttccttgagtaatgatgtcatattgagtggttgtcatcagtctctttcattggcagtttacgcatttagcaatagcttttcaacattggtgagaggaagcaccttggccactctattatgggctcactatgtcaactctgtggtggcccaagtggaaggctggctgacagccatagaataaagtatcctattcacctcattgttgatattagacaacacacatgttgacatgctccattttggtagatacctcctggtagttattgtgagacacacaaatgcccctgatttgtgcccaattcatttttccagacctccttatcacatcatctttcactgttgttttctaggcccctgatcaaacagccagacaccatttaccactgccaatgaatcagagtatatctgtagctcaggtcatttctccctccatttgaaatggatgaccaccacatatactgctccggttgttctcatctgccaaacttcttttaccacagttctttaggtctgctcctgaataaggctgcagtgcaacagcagttcatatttggctagatcggaaatcctttttgccttgacagttggtcatgaaggagaaaggcgttagtgatgtgggagtctgagttacctgtgaatgtaattttttcatgcctcctgaatgtgcctgtgcctaatcccaaatataccatttccatcatacaacgggttgtttctctgcccgtcttgctactcagtgggtactttaagtcacagacttatttgttggcacatagtgaggcatgcaaattctcttagggccctgtaacatactaggatttgtttttctagcagaaagttcttctctgccactgaaccccaaggatcagcattgtgacttctcttttggtgcttgccagagactccacagcatttttatccgtcaatgataggtcttcagcctgggggaacagagagagaccccatttcttaaacagagaaaaaaaataggtcttgtaccatgagatccattggtcacagatgcaccatagctgggacctgctacagagtcttctttatcacactcggtcactcttgaaactggcatccttcggggtctctgataaatggatcaaaacggtgttaaaagtactgcatataaatatacagcctccaggatcaaagaaggtccacctttttcttaacagtagatttgagagatgcaaaaacttgtttaccttaaagaggatgttctcagcatggcctggagccctgaactccttaaaaagtttggcagtgtgtgcccataacccttaatttttgtgaaatgtctgctatgtgtattttacttaagctggctagggtactttccattttgtgctaaccagatgcagttagtatgctatcatgaatataatggaatgtgaagatatcccggctgactgaattttgagtgagatcgtaagagttaacattgccctggggaaggatattatggtctctttgccattgtgaaagttacctgcctttcatcttccctactgatagggactgagaagaaagcattcaccatatcagtagctgagtaccaaattgataccatatctggcatgccagttactactggggattctaccagtttaaggttacagttattcattatccgtctgtttggtttttttttttttttttttttatccgtagggtcataaaaggtatagaaagagaatatggtgaggaccaccacccctgcatctttaagtctttgatagtgctcttctctgtagttcccgagacttgggtcaaaactttattaattaattggcctccataaaccctcactctgaccagaagagcgtgctggcatttcaggtcccccagtattggtgtagtttagaactcaattgtaataggcctcaaaaagtttgggatttccctttccccagtgcagttatccatgcaaaacagtccttacatgctgtttcctctgcctgacacatttcattctccctgctttccttaggtattatctgatttccctgactaggtcagatcagccatatgttactaaatgatgtgcatctttttttcagtacttacaacagtagtagttttatattaattttctgtgtttatttaattaatgccagtctctatgtaagttccctgagagtagtgtcattacctgtttgtgcactgccctgtcccttggtgcctgtgtcacatattaggtgattaataactatttgaggaatgaatagttagatgggtgaaaggaagtgaaagaaaagcattttgtcccaacatcaggagccctgttattgtatctcatcagttctaagaagcctatttttacatattttaacctttctgatatcaattactttgggacaagtagttattgtgagttagttgtagttatgcattctttaaaaatcttgcaaaaagaatgtcagcagtttggaagaaaattccaggggcagttgtggagagaaatttcaagatacactacctcaacaatgctcttgatggcacaaaggactacattttgtggaaaaacaattatctctgagctgaaaaatgattcagaagaattaaactccaagtgtgaagaagttttagtaattctttttttgttcatgtaatcctttctttgtgctcaagtgtgatatatagcaaacatgactgttacacttatcaagagacccctttcaagaagagtaatataatttttgtgtgataagaaatcactatattacagcctaatttagtgagcttttctcagtggtttgtaaagtgatggtgcaccttattttatagtcaatgaaatatggtattacatggttgtcttcagagcctttattaacattcatggcattttgtgtgaattagaaaaatgtattcctttctgcaggccaaaacagccttgcagctgcatgtgaggaagaaaggttattaggaaactttgacagtatagcaaagtaaatataaaatcaatgttcagaggagtaagtttctgtttttaaaaattatctctttaattaaaggcagtatttttttttctaatggataagccagttgtgaagaagtttttatctgtggatatcagggtcttttagggtagacaggaagtctaacagagtttaattttgactgagtctgtcgaggttagtgaccccgtaatcttttcagaatgaagctcttgccacgaagccttccagttccacccctaggaacttaggtcaactcctgaaaggcatttctgtttttgatgtttgatgtaaatctttattcttacatctttggcaatgtttttgtttgaccatatactctggaactacttttcacactgatagtgtcaaaaatttaattttcacaactagcagcaggtaagcctaacttacccatgttatggagatttggaatactattaggaatagtctactaagttagtattttttaatacatgacctaatatgaggattctgattggaagctaattgggaatgatattagttcctgtcgtgaaagtatttcaacttttacagtaacattaaatacttgggatctagatattttctatttaaaataaatttctctcaccaattggagggtgataatttgtaattcaaatgtgttacctaattttgtataaaataccttttcctggttatgtttcctttctttatcctcatctttcttgtaatgtagacagaaaagtgcagtttgtagtaagctgacctctgaattgctctttgggagcgtagttacaagggattaaaggggccctctgcaactccagagattaggagattaagtcaggcagatccaggatctctggtacctggtgggaaaaataatgtcacaaattttagtgcacagttccatctgtttacttcttctgtctcctttcttggagttcaccacaaacttatattttctggtttttcaatggcttttagaaatgtaatatccatcatccatagagttctattgaattgccctcttacctaacagcccaaaggtatactatggcatgccattgtaagtatactagcagaaagagtttaaactggaaaaatttagggtaactcttatggcattacagaacgtcagtaggaatacacctatcactttccattgaactgtgtgtgctgcagcccaaacaatgaaaatgctcattttgtagaagtgaaaacatttggtaagtgtaagggggatttttattgttagccacatttttagatatcaacagactgcttacatggatttcttaaaaattttttggagaataaaacaacagatctttgtttccattgaccattacatcatcattattttagtaccaaatctcagaatgttcacaagaagtaactggatggaatttaaatatttgcttcttattttcaactctgattttaaaaattcggatggggtaagaatgagaagctgtggaacttggtgaggtttttgttatatctgattacatttgctcttttcaccactgtctgttactgataattaaaagacaattatccttattttttatcctgattggaaaaaccattatctggttcaatctaatcttttcagcatttaataagattgaaaattcttatgacagttctggtaatactgcaggtgattttttcctaggggactcaggggcagacagaatcaatcacacatcatgattcatcagttctaaaaacttatctcatataattctgttttgaattaactaaataatccagtaagcagtgtttttaatatctcaacggggaaaagttttaaagctggctaacaatgaaatttcccatttttcactggcagaaaccccagccctataatggggaaggtcccaccagtgcggaggccccacatggggacccctccccctagtgaggaaatgtacccctgaagaggcatcctcctggccactgggcccactgctaccctgccacgtgagtacagcaatggctttgaggacctcagcaattttttcatttattggtggccatttgtctgttatgggaattggccaggccgtcttccttttcatcccttaaacatttcagaaaatgagataaaagcctgcttttatccccttgcttcttttttgcaagtttaataaaaagaatttgtttggataaagaggttaggactattgggtagaactcagttaagtgtgattagtgaaacaatctgttcatatctagagcagtacttttcagtacaactttctgcactgatggaaatgttctctctctgtgcttccaacattgtaacactaacctcatgtggctactgagtccttgacgtgtggttctagtacaactgaagaatttaattttaattaattttaattaattttgctacatgtggctagtggctactaaatggggcagttcatgtctatatttaatgctgtgtgcctcttttaacattgctatagatacacctctttacctctttcattatcatctcagaaaaatttgccttgtattatattactagaaatatgattctttaaaagtgaggaaataaattaagaattctgatatcaaaatgtattcaccaacattgcccttatgtagttttagttaccttatgatattaagaaaatttatttaattttaaaattatgaagtatctatttaaatattccggctttattttctactttacgttttaatttgcaacttaatatgtatatagaagtaattacacacattaaaataactttttcattttatttctttttaatgagaatataaaacaccttacattagtatagtatgtgcagtgctattactaaaacaataaatttagcacttactaattataatatggtatttacaagtttcaaagttttattccagtaggtgggttactgaaattacagattaattaaatttgtagttttactggctgagaataaatgactttccactattgagctatcactaaaagttgctgacatcataaaatgttaataagagaaacttcttggaagatttgggaactttttgtactatctttgcaatttttctgtaaatctgcaactattgtaaaactttttaaatgtttattaactgggcacggtggtgcacacttgtattggaggctgaggtgggaggatccgttgagcccaggagtttgagtttagcctgagcaacatagcctctcctcttaaaagcaaataaataattttttttgaaaaattgctcatgtcaaatttgtcctgctatccatttagattcattaatttagctgtatatgcatctaaaataagaattcttagatcagtaatagaggtagtacttacctaagtctcattacatggcatcctcgaaacatcctgagcaatacttataattttacagatgaggaggctgaggcatggaataaagagtaatttgagcagggttgctgagctgatcggtgtggcaggtctgcaattgatagccaggaaatttaggtcttcagtgagcgcttctgacgactataccgtgttatctcttaaggagtcttgattatgtaatgtaagattttgtctctctgctatcagtgtagtaagatgtactttttgctataagaaatccaaaataagctaatatcctggtaataaagtacttttacaacatgaaaagtatagaggtatgctttatttctatttcagtaattcaaacttgattctcatacaatcgttagttatttttatgagcgaggaatatgttcatagtctctcaacaagaaatctctatgttggtggagttttaaaaaatatatttatgcttccctaagatagtggccaagtttgaaaaaaatagagcagtacctaaagggtaagagggatggatgttgttgcttatctcataaagataaatttttatcatttttattgaattattacagggttgttttaccatcaacctgttaatgttattcttactggaaattaaattatagagatttaattgttaaaatctaaatatggaaaaggttggtggtgagttttcaacaattctttgagatgtttttctgggctttggagagtatttctttggctgaaagtggggaagaaaaaggatggagttacttgcatagttcaaaaattgttgcagctggaatatgttagttcatatcctcatttaatgaatgttctatatccactggtgaattcacactttcaacagcacgatatatctagctactgtgtggatttaaggtcctacatttacttgtcagcaagagacacagtaggaagttctttaagaaaatgtgaatcataaacaggtgcaatttttatacagaatcttttttttttctgttagtgagtagacttttgaaccagctgacagtcctccattgactcttccaaagtatttgaatttggaacatggtgttttcttgataagaatgtatgttttgaatctatattaaaatttttgagagactttagaaagtttagtgtaaaagtcgtgtttataaaatatgggaattctagtgcacactgaccagttaaaatttatattcagattgttgatttagaataacactgtaacttgatcctagttataatctttattaggctaggtgataactgttacccaaatggttgagttgctactgcataattctgtgttggtcaaagatgagaacaactttatccctgatgggagaaagacattttaatgttatcattctgtgaaaaggagggtatgtcaggaggtctggtgagggcagtagggaggaaaaagacttgaaggaccataatttactacaaaatgcctatgatctaacagagttaggatggacaagttctttttatgccgtctcttgagttctgttctccacagcacgctggcacacccctttactcaaatagcaactatgtattctggatttcctggaacaggccaactttttggtatttcatcctgtttttcccataagtgcactaatactgcttagactctatgtcccatttttaatagtatccttagaaaaataactgctcttcaaagtaaatgataggtaaaatattttggagcatttggcagtggggaaataataagtattcttaaggcttaggcaccgaagtttgaatgtgccttcctataactggcaagtgctacttctggtagagtatcctaatggtttaatatataccattttaaatatgtcagttaaatcaacgtagttgtggtgttttcaacttatttaaaatattgaattttttgttaaaatgagcaactattttttaattcatccatttccgttggaaacaatatgtttggaggctctccatttgtttctgtttttttttgtggtgaggaaagaaaaaaatactttatatctttaacctgttttttaaaaagaaagttggcatgaatatgtcttaagggaagttaaacagaatatatacccaaagtattaacaaatgaaaaacaaagactacagttttagcctactttctctttccacatatttcacttctcatttaaaaattgtatgcatctttgaagactagaactgaggtgcttacaacagtggtttgaggatattttaaaatccctttttatatatttctgaatctggaaagggaatcattgatgatcttaataaaatataaatcaagatattgcatattaacgactttataaaacaaactgtgaatacatttgtcattatagattttcctaaccctctgcaaccaacagagctttcttgtagagcagtgtattacagctttcctttcaaaatgtatttgtacattggccaaggaagcatctcttcattgtgaagatgttacaaatatcttgataggggaagaaactttttctgagcttattatagtggtgctagttaccttttaaagaagatacacgtctagtagtaaacacctagaatgtctgctataaaataacttaaaggtatagttttctatactctttaattttacagaagggaggcagcattctgagatatttgcatattgtgtaagattatgttgctaaatgtaagtatttaatttgttagaatcatagactcctagaacttgaggaataagaggagacttgttttacctttgtcagttttgttctgtttgaatttttaagaagctaatgaatttttagatccccattagttgctctttaaattattttaatactttataaactgattttttaaattttaacagtacttaaatgtaataactttataccatgtgtttattagttattaacttacagtagaaaatctacttgaaacagcttattattttaaaagaacaaaacgctttgaaaaagaatggtttattttaaaaggtgccacccatgaatgcaatccatattttaaaagctgagagttgggtaagacctttaagggaggtctcatgtctgagcgctttccatctacctgctgaagtctgatttaagtctcatctgctaccttgtatctttagtctcataaagaactttaagacaaaaattatggaataaattgccagaaaagctaagagaagttttgcttacagtacaagaaatacctcatataacacagactgtgtttcatcctgctaatgggatagcccaacagctttcttccatccgtgtgtgatgtctgggtatgcctatatgagaaataatacgtgaatatgcacctagaataacagctcttttaaagttttgtttgaactaagtgcaagtttggcaagatgccatactattttttgatagcatacaaattcaagcactaaaataaaagactacctcctggtaaagtgttgtacagtgtacttcctaatttagctgaagctaaactcaaaatttgaactttgcatagaaaatgttaggaattttttttgtctgtttaccttacgttttgcagtattttgtttctttatgggtgtatccgagattatgaaaagtcattgaagccaagtgtggggacttgatccctaagcagaattcactggattatcatgtcttcctgcctaacccaggtctctgcatgacaagaatagttttaatgcagattttgctctcttctctttctgagagacctgaaaagtttagctttccaaaggcttccctgcatgcgaggtaaatagatggagcagaactatcaacaatctataattaagcagcttgactacctgtcaataggaaatgccctctgtgtctaccacacaagtgaattacaggaacctcagagatactgcaggttcggctcgagaccacagcaataaagcagatgttgcaacacagtgagtcacacaaattttttggtttcccagtgcatccaaaaattatgtttatactgtattgtagccaattaagtgtgcagtgactttatgtctaaagaggacaatgcatataccttaataacaagtacattattgggctaagcacagtggctcattcctgtaatcccagcactttgggaggcaaatgcaggaggatcacttaaggctaggagttcaagaccagcctggtcaacataatgagacccccatttctacaaaaaattagccgggctaattttttaagttttcagcttaggcggaggatcacttgagcccaggagttcaaggctgctatgagctgggatcacgccactgcactccagtgtaagcaacagagcgagaccctgtctcttaaaaagaaaaataagaaaactttattactgaaagatcctaacgatcatctgagcctttagggagtcataatctttttgctggtgaagggtctttccttgatgtggatggctgctcactgatcaaggtggtggttgctgaaggctggagtagctgtggtaatttcttacaataaaacaacgatgaaatttgttgcatcagttgactcatcctttcacaaaagatttctctgtagcatgaacagttgtttggcagtattttacccacaatgtaacttctttcaaaattggagtcagtcctctcaaactctgccacggctttatcaactgatattatgtaatattctgaatcctttgttgacattgcaacagtgttcatagcatctttaccaggagtagattccatcttaagtaatcactttctttgcttattcctaagaagcaactcttcatttgttcaagtttgatcataagattgcagcaaatcaatatctttaggctccacttataattctagttctcttgctatttctaccatctttgcagttacttcctccattgaaatcaaacccctcaaatcatccatgagagttggaatcaacttctatcaagctcctatcaacttgatattttgacctcatctcatgatcacgaatgttcttaatggcgtctagaatggtgaatccattccacaagattttcagttgactttgcccagatccatcagaggaatcactgcgaatgggagctattgccttacaaaatgtatttcttcaataataacacttgaaagtcaaaattactctttggtttatgggctacagaatggttgttgagttagcaggtatgaaagcaacattcatctccttatacatctccaccagagctcttcggtgaccaggtgcattgtcagtgagcagtagtgttttgaagagaatcttgtttttgaacagtaggtctcaacagtggactttaaaaatattcagtaaactgtgcagtaaacaagtgtgctgtcatcgcagctttatatagcgtaggtaaagttgatttagcataattatttaaggccctaggatttttggattagtaagtgagcattggcttcaacttaaatgtcaccatctgcattagcccctaacaagagggtcagcctgtcctttgaagctttgaagccaggagctgacttctcctctctagctcggaaagtcctagatggcctcttcttccaaaagaaggctgtttgttacccacacaatgggtgggtttgattgcttggtggatgacagtccatttaccataatcgaggattcagcaaggagattttattacttgtaataagaagaatgctgaggatagttcccaaagcaaaaccttcctgaacaatggtgaaaacaagcttttattgggctggttaactgagtcattgtatgttgaggtggagtaaaggcagcacccgagcagtccctgatgatgcttctatatatgctgcgtgtatagaaaatgggggctaagcttctctctgggcagggattttagtatgcattgaagggagtttgccaaagttcatctgcaactgacgcatctctagatccaactggtttttctggggctaagcttcttcctggaagtttttttgaaataacaaaagctcaaggtataacacttacaagtgagtgctttttcacagtggatacccaaaaacccagggaccctaagctacattttgtctgcactgaaaatctagacttaaatagccaccttcatcagtgatcttagctagatattctggataacttgctgcagcttctccatcagctgctgctgcttcatcttgcacttttttttgttttttggaggtagggtcttgctctgtcaccaaggctggagtgcagtggcgtgatcacagctcactgcagcctcaacctcccaggctcaagctcctcagcctctcaggtaacttggactacaggcattcaccaccatatccagctacttcttctattttatgtagagatgggatctccctgtgttgcccaggctggtctcaaactcccacattccacttttatgttaggaagactgctttttcctttgtgtctcatgagctaaacctctatagcttccagcttttcttctgcagttttcttactctcttagccttcgcagaattgaagttagttacagccttgcgctggattaggttttggcttgaaggagtgatgtggctggtttgatctattcagaccactaaaactttcttcatatcagcaataaagctctttcactttcttatcattcatgtgttcactgaagtagcacttttaatttcatgcaagaacttctcttttgcattcacaacttggctaactgttttgcacaagaggtctagttttctgcttgtctgggctgtcagcatggcttcttcataggcttcatcattgctagcttttgatttaaaatgagagagatgtgattcttcctttcatttgaacacttagaggctattgtagacctaatttcagtattgttgcgtcgcagggaacaggaaggcccaaggagaaggggagagagtagaaggtggccagtcagtggagcagtcacacaacatgtatcgagagtttgccatcttctatgggtgtggttcatggtgccccaaaacaattaagattctaacatcaacaatcactgatcagagagatcgctggtggtggtggtggtggtggtggtggtggtggtggttgttgttgtttgagacggagtctctatcgcccaggctggagtgcagtggcgccatctcagctcactgcaagctccgcctgccgggttcacaccatgctcctgcctcagcctcccgagtagctgggaccacaggcgcccatcaccacgctgggctaattttttgtatttttagtagagatggggttttactgtgttagccaggatggtctcaatctcctgacctcgtgatccgcccacctcggcctcccaaagtgctaggattacaggtgtgagccaccgcgcctggccagagatcactgttcacagatctcatactaatgaaaaagtttgaattagtgcagtaattaccaaaatgagacacagagacataaagtgagcatgtactgctggaaaatggtgctgatggactttcttgacacctgattgtcacatatcttcaatttgaaaaacaaaaaaatgcaatatctaagaagcaccgtaaaacaaagggcaataaaacacggcatgcctgtaaatggcagtaaatcagaaagtaaggtcatcatgaggttcctatatcatgtgtgcattctgatttgataattctgattccatctcattttttacaaatgggtttgaactagatctccatttgtgttcaattttctgccttaattatgtgcccatacagatttaaactaaacacagatcttctgtggtcacaaattattgacctctgttatgttttcaaagcctgccaaatactttaagtaagcaaatctatccatggaaaattctataagggctaccctttggctcctaagagatagtttttggaatttttttatggttcagatatttttgtagctgattcaacaaaatgaactttttaatttcataaacattcttctcattgacaaggcagatgtgactaaaagagatgagaaataataagaacaaaacttgttactgatacatatagttgaattacacccaaaaatagttcaacagttattaaaaactgcttttttgagaacttttagctcttctccaacttgtaatcatgagaaaataagtgagtagtaacaggaccataatgtttttacaaatccagacacctttatgaaacatttaaactatccagaacgtaaaaaggagaagaaacaaaggctgttgaacagtaggagggctatataaacacctccaggacctctgtaataacctttctattgctctgagttctgccatacaaactcagcatgtgaacaaattattcatgcctcgggacatattaagttgttatggaagtttctggagaaggtccaccagctggtgtagagagctattttgcctgtcttaattgcatattccttagaatttctgtgatctgtaaaatcgcaggccagaatgaagcccccttttcttagcatactttctgtgtaatgaatttaaatatttgtgttagttttaaatgctgaaaggggaatgaaaaaaaattacaaaatgtacttatgccaacagttctcttatggttaactaaaagtatttttccccattccttaatttcaaatcctgtgagtttgggtaggggtcgagtgcttgtctctgttttccaaatgaagaattcctggcaagaagattaagtgactaagccggctgtgtacatggcagtgctgggcagcagcaacacagtagatgacactttcaagttatttttattatttggaccagatgcatctggttggcaccttgagccaatgagctgccctcccagaggtcctctggcacagaattggagttagtatgaacaccagagatataagataaagcatttcagagaacactgaagttaaattcagaagacctcattcacatctctgccaaatcacaactaccttaagtgagcttgtgaaaatgcgctttttgcctaccatacagaatgcttatcacagaagtgttattgcttagtactcaggctcaaattctggctctacaacctctgttctgtttcctcatatgtaaaatggaaatggcacctacattatgggttacatgcgaggctcttagcatgatttttggtgtgtaataagccctctattgataggaacagcagtagcaggtagactctatattgatatataatcagaggagttacaatatgtatataaataccgataatataaagtggaaagttatgcattcaattagcataatttaaagctctttggtaattacagaaaggagagattattttcttttgggttgtcatgggagtgttcctgaaagaggtggtttttgagcttggccttaaaggatgaagatttgggcatgccaaggcaggaggaattgaaagtggtgaaggacattccaagaagaagcagaagtgtgaacaaaattaaatgttttatcattgttattttattgatttttaagaaattatatttaattcaccttttggccatgtatgtatgtttatatgaacatagcctgctgttttaggttctgagaatccttacaatactgttttaaatcaagatatttttgatttctgcagaaaaccagtaaggttttcttatttccattttatagataaggaaacagacttcacactagtgattggtagaatgggagaaccccagtgtataagcactaaatttcatgtgtttccacagcactgcactgcctctgttagactttaagtagaaataatttacacaccgtccaccatattccccaaagttgctttcttaaaatgtgtggcatatttagaaaagttggagaaagtctcggtgacctcatatagatgtaaccccaaacccacaaataactagtcatagtacttaaaaggcagccacaaatcatgtgttttattaacaccatgtgtggtgctccatcttgccaccgttagccaagctcttgcctcaagtttgctaggtaacttatctttgtctttagtttattaaattaaaactgaccaataaatgagtatcaggtcttagagctgttcagcagtgtggtagaggaatcctattcttgactcttgactcatacatatttgaaaaaaaaataaggatttttatttattcatattaggaaattatgttaataaattcataatagtcaaatcatttaaatagatacctacttctagaccattgttctcccagcaattttctatttaccattagtatgatttcctttatacaggttttttttaatgtagataaaatatcctgagttgcatttataatacattttagttgaagcaataagacacaaaagctcatgttttttcataaggtctctaagacagatatctccagtattagatgaacacagtgtatttcccaggattatgctattgcatacttgttacattttgaatatgaagttaacatattctgcttgaaatgtcttgattacattgcatgttctgaaaactcaaactattccaataaaactgttacttcaagagtaatatgactatatgatgtgacatttatattaaatgtgattttcatgtactgtatagggttttttgtataacaaactaatttcatccaattctggttgcattgtaaacttgggggtgagctaaagtgatttgtcataaatatcccactatggaatttattctgaatgaattgtagcatatttctcatttttaataatataaggttaatatcattcagtatgaaatatattttcaaaaatgcctccccaatgctgtcactattgtataaattttaacttgatgtctgcattgcctaacactttctgtactttatctgctgttcttaatattgctaagattcttataggaatatatgcctttgttgcccagtgtatagctagtatcaagaacacttgttaccattttggaaatgaagtagtattttcaagctaccaagacaattgaggagttttgaaatgttaataattctcattatgtggtaacggattttagaaattactgcatttactttaaaagcccagtgcatctctacttagtcctttattgatagtgttcatcagtcttcacaggtgtatgataatgtgtaatgaaaagtacagcttttcacatctttgctattcacgacgaaccctgaatcctcatgtttcttcaccccagcacagtcctttccctactcctctttgctaggcaccagtctaggcagacagagtaggtaagtgacattaggaacaggacaagattaagtgacacctgggtgctacaaggctgaagaaaggaccagaccaattctacgtcagatttcaatgtgaaaaaaaatacttttgatgccttcccgtctcatcttttgcatccctcattatctcttattctcctgatgatcctccacatctgatagaagagttacagttcttttacgtcagggggtaactgtaaccatcaggggctctggaaccccacttatcagcattgtggctttgggcaagttagttaaccactctgtgccttagtttccttgtctgtaaaattcgaatggtttgtaatggtgccccatcccaactggaatgtaaaatgcattaaacagtgcctaccatatagtagacactgtagaaatgttggcagcaatggtattatgacaataggttcatattacaaattagatggttaaggccttatgggtgagactttatatccacgctaaaaggagatcagtaaatgttgcatttactgaatgttgcattaatgaaaaacttgcctttacttgtaagtgccccttacttaaaattatctctttttcccccttaaaacattaattctttcagagtatactctagtaagggtgttaaaagaaaaaaaaagatgataactaaaccaaacaacaataaggtgggaatgattagtggctgcaccctaggaatgttttttatttaaatcatattaatttgcaaaattccaggcagcttggaattaggaagaggaatctgggccggtaacctgaatatccaggtcagtttaacttctcacgtcaaagaaaatactgctttactataagcaatgagaggtccaagattcagtttctaccatatattgactcctagtaactaggagtagtcataaccattaccccaggtcccacagaacatttagcctgtgggaccctctttgacttgagatgacctgacttcttgggttcccagatgctggaaatcttgcaaagagggcctcaaagtagcttcttgatctcattaagttgttctctcccctcaccattgtttctctaaaatgtttggctggctttttaaaaatagtacataaagtgtattatttctccttaattaccacacagtgtaatgtggtaaccattggatgccttatcaaatatgtttgagattgagcccatttaaaatttattccaatacagttctaaactccattcatgcctaaggattgtcatttactgtaatatagcatggtcctcagtcttccactcaaaggaattagaggaattaatgccagtcattttcattaaacccttttaatgttaaagatcataatgttcttaaatgttcaaaatatacagaacatatgaactgtgacattgggctccatttcaaaatagcatgtttgcatatccctgttgtggctgttttccacttctaatggtcataaaaccctggcttatatttagcagaaaatcaacgactttgacagaggagcttagcctggtaacagcgcaaattaataaccatctttaatagtagtgagaacagtctttgaaggggtaagccaaaacctgacccccgaaatcaacagtattgtcaaagtattttacggtagattggctgtttaatctactatttaaatgtacttactagttttatctaaggagacaaaaccagtaacttacctttataggaaatactttagttaaactgtagtgtaattgcagtgctccagattaactaccctcaagcagtaaactatattggttgcagtatagaaaggatgtctgcttagtatctgcataatatcaaccattgacataattttttagatttatttttaggaccttccaaatacaggatactattctaaaacctaataagaataggggagatatatatatataaagctatgctttaagagttcatttagaaactttattttactgtgctggaaaatactgtgtcaagttgtacttaaattcaaagacaaaataaattaactgtgaccttaaatcaaaatttaattatgtagtacctatttctttatcttaaaatgtgaagcaaatagttatgagggcacagttggtgtagtgagaaaatacttctctagttactgtaattatgggataattaaataacctttctgaacttcagtttcctcatctacaaaatgtgaacagttcttgtactgcttacttcttagtgtttgcattgggaatcaaatgagatgataatgtgagaaaatgcttctttaattactaagtgtttttcaaatgtctgtgaagtcctaaatacaaatcataaaattagcaatgtagaagactctaggctgcagctacacatgtgtatcttcgaagagtatttacccaacatcctttgaaaagcaaagaagtaacctgagctttcattgacacacaaattttcatcttaatttttgtgtcaaagagatgttgcttcatgtagctgataagctagcatttattgacttcttattgttattttagatattatttctgctaatcaacccttatttctacatgtcatatcatttaatcttcccaacaatcctttgaggtaggtaatgttagtagcttcattgagggaactgaagtagaattgcttaaaggattatctaaaaccacacagctaataagtggccaaatgaagactgaactcagagctgtgttattccaaagcccaggcagctctcctggcccccaaagtaggcaattggaatcacactaggtataatatagcttatcccatattaaagcaccccctcacccaaatcataacttctaaaagacctattgtcataaaatagttttaaaacttggtaccgtaacttttagccataaaagggaccaatagcctttgctaattaagagtactgacagattcattacctgacttgaatgcaagtgaatgactggcctctcagagaccaccagtggttacacagtggccaaattggaaattcattagccagaataagaagtactggaagaagcagctgctaacttctaccttctctttttgccacttccctgatcagatctacagaaccctgtatctctaaatcccactcatccttcagcttcccagcttgagcataactggcttttttccttaactaatgataagtatcaccacatgtttaaagaattaagccattttaattgaattcctacagaagccctgctgaacagtagatagcaaaggaaaagtgtatttgtttaactataactcagagttatatagtatgcctcacattctcacaaaaattattttttgactaagtttctagcctgagagcaatagtctgcatttatgggcctaggtacacattctttagagttgggtagcttcccctaataattaacacggttattgaggaatgctttttaaccattcttgtattaggatgccacctataaagatatcatccaaaatgtggcacattgtcaccagaagtatgcagaatgattactggtagtacaatataaacatttttaaaaattataattataaatgttaattttctgttaggaaaagtatacagccagcacaccaaagccatgacttcatgattttttaaagttgaggttaaactaggtattttatttttaaaaaagttaaaagaaatgtcaaatgaagaacccttcagttagtacctgaataggcaggtacacatataagtgagatgtggaaaacagtggcctgaaatacgcatgatgatctcagcactagttgtctacagtgcagcgtcctgtatgacagagtcttgatcatcctgcctttgtggcattctgtaatgaaaactttggattggctattacttttgttatagtgagcttattagggaatattttgtcccttgcagaatattttgtccagcttcaaaacagccttattccttcaaaataaggagtagtcccagagtctgttttgtttttgtttttgtttttgttttttgtttttgagacagagtctcactctatcgcccaggctggagtgcaacggtgcaatctcagttcactgcaacctccgcctcctgggttcaagcgattctcctgcctcagcctcctgagtagcttggactacaggcacccaccaccaccctcagctaattttttgtatttttagtagagacagggtttcaccatattggccaggctggtctcgaacccctgaccttgtgatccacccacctcagcctcccacagtgctgggattacaggcatgagccaccgcactcggcagtcccagagtcttatttccttatttttcttataatgacatattcattatttgccagctccttcacaatgggagaggctctgcagaatttactgtgatgagtttgcaaggtgaaagcaaaagaacaattatttttcttggtagtttaaatgagatcttgctatggaaaagtctgaggtaaaaccccaaagctgtttctcccccaaaaaagtaggtatttatttaggaagtaaagttggcaacaaggaatatgtaaacctctcttaaatatgacatgtatgtttcattaggatttcaaagtaactgtttatcaggtaatatacagtactacctgtgtttataacttctgactttgactgcatgagaaacctagacttgaaggttttcttgacttttgatcttttaagtgtgttttttactttgtggttgtgtttgaaaacaatttaacttgaatggctaagattcgtgctttgggaaagttttttgttgtttaatctgttggttttcattgaaaaactgctgctagaaacaatgtgaattttggaatccaactcgcttggtttagaatactgggtctcgacttctcactgctctatgactttgagcaaattggcgcctgactgagcctcagttacacaaactgaacatgggcctaacaatccttacttcatggggttgcaatcaagattaatgtaggatactataaaagggttcctgcagtgttggacagaataaatggatggtagctcttagttttgttttttttcagtctatagctgcactgtgatctatggttatgtaaccccaccatttatagcctcactatacttctaagtagctatattagtacgttctcacactgctataaagaactacctgagactgggtaatttataagaaaaagttttaattatgctcacagttttgtgagctgtacaggcttctgcttctggggaggcctcaggaaacttacaatcatggcagaaggtgaaggggaaggaggcacatcttcacatggcctgcaggagagagacagtgaagtgggaggtgctacaaactttcaaacaaccatatcttattagaactctatcacaaggacaggaagggggaagtctgcccccatgattcagtcatctcccaccaggtccctcctccaacactgaggattacaattaaacatgacatttgggtggggacacaaccaaaccatatcagtagccttctttccttgaacttgccctagagagcctccttattcttgctccacatggaccattcaggattttgctattcactgtgtatttttaagtcatttctcctgcccacctcctttcctgccagttctgcatcctatttccccctttatttcagtctttactgttgttttctctggactttcaattgttagcacacacttcagcagttgtttttctctacttccttgattcaaatcttatttctccaataaaatctatgtacacaagagcaaagaagactgtacctatacttttcccatattatctacaattgcttggcatagtgccagaaacaaaaaagatgttaaatcagatgcattgaaaaaatgggaaagcagtggtcttaaaataaaagcccaaaacattctgatacatttagtttaggtatagttatactatatcgagtacaatactaactacccagtaatggaaatgtaatggagaaaagaagaggaaatacactaaatcccttatgtgagacctagattcaaattctgtttctctacttgcatgacattaggcaagtcacctaacattaaatgtaaaattgcagggtgcaggagatggggagaacaaaccaaacaactaataagtacaacagacttggactctgaagattgaaatcttggctctggaactaaataactgcatgcatcttcttgaacaagtcatgcatctcttgatttccctcatctctaaatttagcgtgacaaaatccatctcacaaggctgttaggattaattagaacttgtgtgtgtcgatgcctggtatattgtgggcatatactaaatgttagatttatttatcaaaaaaactctgtggatcttatgtgacctcattgtagaaatgagggactttagttagccaatcactgaaatccccttgagctcttagttttgggcaggtataacaaagtaccatggactgagtggattgtaaacaatagaaagttacctctcacagttttggaggctggatgtacaagatcagggaactggcatggttgggttctggtgggttctctgttctgggttacagactaccaacttatcactggatcctctcatggcaaaaagagaataagaaagctctccaagtttcctttcatcatattgttgttaggatttaaacatatcaatttgtgggggacacaaacattctatccataacaagttccaacattctacatcagtcatctcagagagaagataatagataaagaatggatattgttctttttaagctcactagggattcctaacttatctacaggaaacagttgtaacaaatagagaaaaattgatgcctctaaattaaatatggtactagtaaaatatgtattattcatactatggctttaccttcatagtaataccagtggatatctatggcatcttcctcctgtgttttgatgtttcattttgcccagtaagaacctccctatattgcatgcttaaatgataaagtatctcagtaataaataaagcagagttgaacctgccaagttgaccgacagttcactggtagaagaagagctatattttataatgcatacatcaggtttgacttctccttaatattatacatgattaaacaagttcaaagagaatataacattgattcactgcatttctcagtgaaggattctgcctgttgaagagaagaatgtaatctattgccaattggggttttgtatttgaagtcctctgatttctaaaataagcacaaattgttttcttgtctttcatcttcacagcctttctatgcatagaaatcttgaatatggtctttttctggcaagtgtctgaataagggtttacaatgccttgtttatctgacaagcaaccatgttggcaaatatttcaaggctccagtaatactaatgtgagtctttaggtaaaggaagctggttatctgtctggcacatgggaagacttaagagcattgcagtaatgaactatttccttagaatgccaggtttaccagcaatcagatatggaggccgcaattaatacattaggatccaccaggaggtcctaaaattgggtcttgtagagtttcaaaagagatactgttactgtgcccctccttttcccactctgttggccaaagttctgagtatggcacttccctccttgcttccttgagatctcagcatttagtgaagtgaaaagttctctgctcacaagaaagatcctccccccaatccggggtttgacagacaggtctatatggtgtgattccatggatatgtggtatataatatgccagaatgtttgacctaccaggtaggaatctaaccatatcttcctccacaagcactaacatttaggattttggtttttgtttttcctcaagttgttattttgaacatcttatttgtaagttctctgagggaaattgaaatttaaaatatctaagacaaagaggaaaaatctaattgagttgatcatttctgagattactttaagtctttgtaaacttagtttaaattttcacatttgttccaagtaaatacttagaaaacttaagaactgcatttgatgccacagttgatcttctggcagcagatagtaaatgggagaaaagtaaagccagtaaaaacggttcttaatagaaatgtaaaggaatttaataagtatatattctgttcttaagcctttgaaaaccatgagagattacttttataaaaatatatatatttttttttgcgtgaactccacttcttggagctcaagttcttggcccaaattgtctctgcaaatctgtattatgaaagtctattcttaggtatggtttttaaaggatgacccctggacagttatgttccgacacttttaaccatgtaaccctttcttcacacaaaaatatttcattgaagtacaatatctacagtgagccccctctgtttgaagtggggtaaagaaagaaaaacagaagtccacatatacacacagacatgcaacatgtatgcataaatctgtggtttcaaaggtcacagtttgaaaatcctgagtattttactatgttttcattagaaggacagccccagtttttcaaattctgaactagaccttgagcaataattattttaaatttaaaagtacaaactacaggaagaagattcctgaaagatggtagcagtagtgacattgttctttaatctcatcataaaacagagcaagtaggatatcaaaaccaaaaacctacagatagcaacaacctcaaagctaagtatccttataaacccccaaatactagcaggtaaggacaaactgccaacaactacaaaatcagtgtgggatcagtaaatgtgtggaaggaagcaaatgtaaggaaacaaggtggttgatgggtcctgagaagaggaaagcccttgaagtgccagcaaatactcattggaaagcacagcaagccaattacatagcaaccactgagattgcttgggcgtttttgtaatgtttaattcataggtgaataaaggagactggaaagtgattcagtttgatagtgctaaagcagtctgggccttaaaaactcctgaagcagacaaaccaaagttgtcttccagaacaaatgctgtcactgaaggaagctacttgaagtagaatccaaattaagcagtacaggacaaaaggggagaagaaacaaagtccatataaaaagtgggcaaggacaacagagtaggcagtcccacaaagtgggagaccacattttgtaaaatcactttgtgaaaacaattgaaaagacagctttggaatcattaagttgggaagaactaggctggactgtccctttcacagtacaggaaaacatctttaaaaaaaaaaaaaggaaaacaaaaatggttaaagcctttataagataaaagaatacagggcaaaataacgttcctacaatgaaaacatgccccaaaaaatccacaaaatagattaaaactatgaactattacttcaaaacaagctaaaagaagttttttacatgatatccgaaaggaaagacaaatccaaattagaaaagactcagaaattaggtgattgagtaaaaatcaatggagtatataagatattttagaaaggaaaacatgagccacttactttctgtccagccagacttaccttcagttacagctcccccagacaatcaaatattgctcacatgagcccttgctgagaaatctactggaaaatgagtttcagacaaccaaaatgaaaaacaaattgtagagacatcagaataaggactggtgaaattttgtttcttagcacttagatacaggaccatgtgactgagtcctggccaccgacaaggggtagcagaaatacaaggtacttccaagcaccatcctccatacttttttcactgatttgtcagctaggtacaaaggatccagcaaagtattctttgtcaccaatagaaataacttcacagttattccagatatctttaaataatgcttcatcacctcattacaatttttagacctagcagattaaattggattttgtcatttattattaaatctgtaacactttttttttttttttgagacaggattgctctgtcacccaggctggagtgcagtgccgtgatcacagctcactgcagcctcaacctcctggactcaatcctcccacctcagcctcctgagtagctgggaccacaggcgcacatgctaccaagcccagctaatttttttattgttactttttgtagagacagggttttgctgtattgcctatgctggtctcaaactcctgggctcaagcgatcctctcaccttggcctcccagactgctggaattacaggcatgagccactgtgtctggccctgtaacacaaaagtttttaatcctttgataactttatttcaatataatctattttctttgtgatactgtgcattttctgttatgatttaaaaatattatcctgagaaaaggtccatatgcttcactagactaccagatgggtccatggcacctgatttaaatggaagaagacagggtctttaaattaaatgggagcagagtgcctttcccccactctatcaatacacattgaaaatgacttgagccagaaatagtttttgtcatgtttaaatgggaaaaaaaagcacaaaggaaagttttttattttattcaaatgcttttttagaaagaacattaatattttcttaatgttttagtagtttttcattattcaaaatcagtttacatggtctttactgattatccccaggggtcaaaaaaagcaccaatctacctttaatttttgtggttgggaaagctagaccaaagtgaaaaaaatttttttgtagtatttccataggtttttggggaacaggtggtatttggttacatgagtaagttctttagtggtgatttgtgagactgtggtgcacccatcacttgagcagtatacactgaagccaatttgtagtctcttatctctcacccccttcccaccctttccccactgagtccccgaagtccactgtgtcattctcatgcctttgcatcctcatagcttatctctcacttaagagtgagaacatacgatgtttggttttccattcctgagttacttcacttagaataatatgccattaattaattcctttttatggctaagtagtattctatcatatatgtgtaccacagtttctttatccacgcattgattgtggacatttgggttggttccacatttttgcaattccaaattgtgcagctataaacatgcatgtacaagtacctttttcatataatgacttcttttcctctgggtaaatacccagtagcgggattgctggatcaaatggtagttctatttttagttctttaaggaacctccacacatttccatactggttgtaccagtttacattcccaccagcagtgtagaagtattcccttttcaccgcatctatgccaacatatatatatttttttatttttttgcgggagtaagatggtatcgcattgtggttttgatttgcatttccctgatcattagtgatgttgagcattttttcatatgtttgttggccatttttatatcttcttttgagaattgtctattcatgtccttagcccactttttgatgggattgttgtttttctcctgttaattgtttaagtaccttgtagattctggatattagtcctttgtcagatgtatagattttgaagatttttcccactctgtgggttatctgtttactgactgaagtgaagatttatttcttacagtcattctagtcctcattttaaaatgcaaatttggtacaaagtactcttttctgaagggaacgtgcagatttcagacacaaatacacgttattgtacatttctaataatctatcacaaaaaaatcatagaattataatgtataattttggaatttattgttgaagggggctttggtgatatctaatccaccttcctcatcttcataaattaaggatctgaaaagtttaaatttatatatggtcacatttaccctggtcacacaactggaatggcagtctagaataaaactatgctgtttccacttatgtggtaataatgcgttagaccaattacagtcttacacagtcttcatcttcctcccctttcctccttccttcctgtcacagcagaaaaggtgtcagtgcttctgtctgtggtttaatcctccttcctgtttggacattttgtatgccccgcccttcttatcccccattcacattcctctctagcttttcacatccagacttctagaaacagaaacacattgtctctcctttaatttttttatttcttaacccacaaccgatgacaagcatttcactcaaattgctcctctcaaagtcaccaactgcattttgctgaaagtgatagaactttctccatgttttccttcaccactctgcaatacacaacactgttgaccacattcttctcctcgaagtgctccttctctcagcttctgtgataccatatgcccctgagtttcctcttgtctggttgctctttctcaccctcctcatctgttgccaatacctttaaatgtcagtaagtgtttctcagaactccctcctaactcccctccttttgcagtgctggttctgtcataacctaatccactcataggggttataaagaccaacagttgtgagcactgttgactcacaaatctctgcaatacagccctttttacctgaatttcatacctggctggcatctgcagatggacatgctacaagtcctccaaactcaatatgatccttttgtgtctcaactctgagatgtattacttctttccatgctcctgtcattaccaccatcatcttatacctcagtcactataaagccctgtaactggtctcatgtcctcaatctcagctatatcctcactgctatcagggtgatctttttcatatgaaaatctgttgttccatgaaagggtcatatatgcaaagtgactcctaaactcagaaggagccaagaaacctaaggataaggctcgcaaatccagtttttcaggaaatggtaatttatttgggaacttacagatggaagcatactcttgggtggcagcaagacaggtagatctgcacaccactactgcccagaccggggcttttataccacagggaaagggtttacaggctctatagaaacaatttaagacaacccaccagaacaggcaagaatgctaggtacatcatgcctgtgcagtaatttgtgctgtaccatcaagattgctttgatctaaaagcaggatttacagtgagtacatgttcttacactaaagacagctagtaaaataagaatcaggaggccttcacaggactggagttaatcagaagtcagcattgtggattagtattcaagatggagtcacttttgtctaagcatctgtccatgttcacttatcttttcaaaacctctcctcttccttccctttccatattgtgttctgcattgtctaagtgacccaccaagcaaattttttgtaaagtggattttcgttcccttacctaacttactttcctcaatattgggttgcctttctatctaccaaacagtaggattcatacctgtctctgagtgtttgtggccattgtttttgaaacttaagaaatagaattggtgttttgaaaacttggatattgtcgtaacactgatagtgattctgtgggcataggacattgaatgtaattattatgctagataccctaagacttatgaaattggcactaaagcaccattaagagatactgacccacagtttaaatttactcaggccaggtgcagtggttcatgcctgtgatctcagcactttgggagaccaagggaggaggcttgcttgaggccaggagtttgagaccagcctaggcaacatagtgagaccctgtttctacaaaacatttaaaaattaatggggtctggtggcatgtgcctgcggtcccagctattcaagaggctgaggtgggatgattgagcccagatcaaggctgcagtgagctgtgatcatgcccttacactccagcctggacaacagagcaagaccctgtctcaaaaaagaaaaataaattttaaaaaattaatttactcaatctaaatggtttgatttttaattttaccatgtttggtgtttaataaactattctttgttatttccattctttctgttataaaagctgtcacgagttactgcttccaatatcatacataaaacaggactaatcaaattggattgtgccaacattttaactgaggagtcccagagtatttccatttgtagtgttgatttaattctagaagtttgtgttaagttccttattgtttcttttgttgaaaatattctctatctttattttaacattatttgatgaactaaagagatgtaattattaacaaaattatcattttaaaattttacattgtgaatacttagcatgctgtggtcataaacagtgtaattgtgtttgcagtgaataaattgttagcctaaaatagaaagaagtcttacatgaattaggacaaaatttatcttgatgttttgcaaatccttagccagctgtgaatatacaactaaataatactacacttcacagagaaagcaatttatcatgtgtgaatacatttttaggagcttttgtatgattagttttgaaatagaaaaatgcaacttgtgtaagtagagaaatttcacaaagtaatagctaaatgtgtaccacatttagctgtgttttagggaggttgtttttaaaaataatttggagtcactaccttaagccttgttttattatttaccattatttctcacaatcagtatattacatgtatacttgtttatttgcttactgttatcttcccttcgctaggatataagttccatgaaatgaagaactttggacttgtccactgccaaatctgcagcacatagaacagtgccaacatatagagggatcttaggatatatttgttgaatatatgaataagtgaacaagtaaattttatttagcatcttttttactttttacttatcatgttttgaggatttctccgtgttactgaagagtaaaatacctttttaaggaagaaatcatggtgtacctactgatgtactttggcagtgtccccactcaaatctcatctcaaattgtaaccgccataatcgacacatgtcatgggaggaacccagtgggaggtgattggatcatgggggcagtttccctcatgctgttcttttgacagtgagttctcacaagatctaatggttttataaggcgcttttccccctttgctcctcacccttctctctcctgtcactctgtgaggaaggaggtgtttgcttccacttctgccatgattgtcagttgaggcctccccaggcatgtggaactgtgagtcaattaaacctctcctccataaattacccaatcttggatatttctttatatcagtgtgaaaacaaactaatacacctattccgtcctcagcactttttgtcaatgttacaagtgtcagttctttatgaattcataaatccaataaaaagtgttgttctagtatttattatgtggcagacatcatcacagctgcctagtatgcaaagataagtaagacacagtgcctgccctcaggggactcctagactgtaaaagacaggcaacaacataaccaggggtaaggataatttattttgctggttaggagtgaaaccaggttttacaaagtggctaactctgagaaaatggcaacagactgatcaccaaaggaaatttaaacaaatatatgacaattagagagtgatagaagaggatagtgatattcaaaagaaataagactaagtacaaatagaacacacagatttccaggtcccatcagggaacaagttcaatataagtcagtagttttcatacatcaagaactgatgtgaaacaaaaatattaagaatagagcctccaaaaccaaaaaagtaatatttttcttcccgtagaagagaagctggtctttactaaagtagcaaattcaaatctagtctttactaaaatagcaaattcaaatctgttctcatttgatcatccttttacctattatgtgcagagagtcatcttaaagttagattacaaaaaattaagaggtgagtcatgatggctcttgcctataatcccaacactttgagtggctgaggcagaatgatcacttgagcccaggagatcagaaccagcctgggcaaaatagggaaagcccatctgtacaaatatatatatatatatattttttttttaattagctgagcatggtggcacatgcctgtggttccagctactcaagaggttgaggtgggaggattgcttgagcccaggagatggaggctgcagtgagctgcgatcataccacaggatcctttgtaatagtgtcacaggatccttcaggtgttgcttttctagccagaaacttctgtggtaggtggtgcctttgcttgggttttgcttgggcccactgggctcattccacccacttggcctggaatcagctgtgcttgactcatgctaccagcctggatcccacatctgccaagggtgagccaggcacggagcagtgagaggtgtgtgagcaaacaatcatggaatctagtcactgtgcatagccaggcatgccagctgctgtggtggggcaggcagctccatgcaagactgtggctagatcagacgtaccacaagtgacttctgctacaggcacctgcatctgaacaatgcatctgaacgcagtggcaaccagaaacttggagaccccaggaacagcagagcctcaaaaaggatgtcaacagtcctagctcagggagcccctaggcctgggctccccagagggccgtagctcttctctctttctcttcacccacaagatggtgagttggggggtagggggggtatgtttcagcactgtttgtattacagctctttcagtctcaccatttggtgggtcccaagttcttgttccacatccaggaagaatgagattcggacaactggagggtgagcaaggtggaaaggagcttcactgagtgacagaatggctctcaggagacctgaaatgtgtagctcctttttgcaggcagcttgtcccaatgaatgtccagctctcagcagagaggagacctgtagtggctagctcctttctgcaagcaggtcatctagaggagtgtgtaagtctggctgagtctggggtttttatgtgctcagaatggaggcagtacatgctgactggtccatgggctgtcacgggtgggcctggagaaagcaccatctggttggccaggtggtcatcaatgaagttctcactccaggctgcagactttgctcagaactggcagcccagcccacaggcttcaggccatccccagcctgaaggtggagtttcactggggacctgccccttcccgcctaggaacctatctgcttttcataccatccatggcacccaggctgtctgtgccaagaggcgcccacaggtccatgccaagctgcccgcagtgcccccggcctccctcctgcactcgtaggtgtctaaagtctggaaggagcctgtgcagcagggggctggtgtgtcagtgctgccctgagcatgttcatacccagctgggttgtgatagcacccaggcccacccacaactttgctccacctcagagtggatgcccagagctgggagaggccagggagtgggaacaggtactttgaagcctatgggggcagggagcttcctaggcccccaagagtgcagggatgccttggtctggagccatggctgggtggctgcagctgtgcctagcagcacagggctcctgccccgccagcttagtagagggtggggctcccgcctgatcccagccccgaccggttccatggagggtgcagccctcgctgcgcctcccccactacagctggcatccgtacagcagctgctgcagagaggccactgccgccatgaacagagcaagaccttgtctcaggaaaaaaaaaaaaaaaagaagaggattcagagatccaagaaaggcataaaggtggaaaataaaagccattttaaatgctgtaaaattgcttagtacagaaaaaggatttctaccttcctaactttccagtaactgaagggcattgacaaaatggttttttgaacagaaatagaggaaagggccttatatgtagcaaaataaaaatgaaactaagcattagagaaacctttctagtgtaagaaatattaaccaaatacttgaaagtcagtaattggcgaaactgccttctttgatttagggggacatcctgcattttgttggcggtctagaaacaaagatttattgtttccaatgatttggataaatagggtattctttgattcaaaattattagatacaacattttagcaaatatatgaagtatcaatggcttttgtaatcttaacatataaataatgagagttagatttggatttgggttttgatcttcccaaaggaaaattaaattcatcaaagcaaagaagcccagctggcataagcacttgacagattcaaaaaagataggactgttggttgtctataatatattctattctcaaccttttgtttcagctttaacatttctatcctttcaaatgctactctatcccgtccacctgcatcaaatgagtaatagcgttttacaagtagtagcaatttttctgaatgtaagacaatgagtggccatctttagaaggaaattgctttttaagaatcaggctatcgtttctcatttgaactaattagttggtgccttcagagctttgctttcatatactatgtatatcgtagttgtactacgtcctttgcatttgtttccatctataaagagtacaattagcctttttaatgcttagttcagtcacaattaaagctcccctaatggttagggattggtctttccaaggctgagaaggtgtttttaattattcattcctctgtttgtgtcttacagcagcctcagctgtgctttattattcaaaggttaatgcaaactgagaagtggataaattaaatctgcctggcagccaacaacccaacatgttagcagacactgtaagatggggatgggcagtgtaagttatttccattattgcagcactgccaaaagcaaaaaccactaaatccttcaaagatagccgacgttgacaggaattattaagggatactacaagttgatggttcttaaatagcagatcttctgtaaaatctgtgtttgttttgcttacaaagagaaggtagtggcagaaatctgagaggcaataatagctactgtagaaaattgatgtagataccatgactagtgaactctgtatagtattaaatcaccaactcgagtgctagaagtcacttctataaatgttttacaacagccaactgcaaaatctcacatgaaagctagggcataatagaccatccttagacaactaagcaattgagtagtgaactgtgacataatgtgaaagtgctgtcataacttcactcttttgagcaacaagatgtttctagagcctttcatttgcttccttttgaaaatgtgtatttatagaactcagaattttatagactcttaagagggtgccctctagaaatactgaccacaaatgatgtggaaggaaaataactcattttatcaagggaagtagagtttatgaatataccaaaagccaaaaagtaaacttgcgtcttctgtttggttgcttatcatctctttccaccaggatattctgtgtggctcatctcttaaaaacttgtttccagctggggctacacctccaccaagagccttcagagctcaattaattaccttccatcacttttctgtggaacagaaaaggaagataaacctatgtcatgctgcccacgctgttcttgactccctttgaccgaaaacccatctgtcttcctaacctttgctgatggactaaaggaaagaaggaaggataggtgatgaaatctgaaatctgtgcctgtcattgacagcctggattattattatttttttttaacacaaagcctaattctttcatgaaagccactgcaaagttttaggaaatccaggtttatgagattaaatagggatttaaggaggaaaaaagtaagtagagcaacctgatttgagaataataatcctatctcacttagttgtcactaaggttaaagaagatgatgaatgtgaaaatgttttgtcaacttgataagcctatccagagattaaatattgttaaataaattgccaaataactaactgaatgttattatataaatattgttagtttaattgctaagtgtttaggagatattaggacatacctataatttcttcagactataataactctaatctgtacttttattggcacttgtttgtaattctagtcaattctggtctcttaaacagaaaggtagtgaactaatgttgacaccatttagtttatcattgctgctatggtcttctgtatctcctgctttcagtccacactaagccttgctgtcagagtgttgcatggaaaagaagatgagcttttcagtgctcgtctaggtttgaaatacagtttcatcatttactgtgtaaccattgccaagccactgaatttctttgacctttagttttagataacatttaagtttgcagagtgacagtaatttgaaaaatatatgtgaatgataatacttagatttttaaagaacctactctttgccagacactacatttgacactgcatgtatgtaaatataaaatgtcttaattcttattataacttcacacggtaaaaagtgttaccttttttacagataagagaactgaggctcagtggtatgaaaggtgtctggcttaatgtctggcacacagaagatgctcagtaaatggtgaatattcttatgtggattttattatgtgtttcctatttagaaatttccactagtgcctatcaaacttttaatgtacacaccaatcatccaaggaccttgtcaaaaatgtagtttctcattcagtaagtttgcccagtgctgcttcttactggaccacactttgaggccctcagtgactccatagtctgtaatagtagttctatcatggtgattctagttgttcattagattctgattcatctggtctgatttgggatctaggcctttttgttgttggggcagggtgggagttccagaagctgttcaagctctttttaaagcagtggactccttttattcaaagagtatttaaagaaattatgtactgacaaggtacacaaacacagcggagtttgtcttgttgaatctcagctggggagggagcagcgaacttaatgaccccaaaagacctcagtggagccctgcagctcctaggagcaacaaatttgaatatcacggttctccagagtacttttgcaattctttattacgtcatttaaggccctacactatctaacctcagccatcctggtatatctgctgttcttccaaagggcaacccgctttcttctccctgcctttttccatgaagtgcctttagcctgttatgctttatctccctataccagttaaaatccacttcacctttccagcccagcttaattgcttaattgccaccccttttatgaagcctttccctggaggagatgtagttcatgtcagaacctcctgtgggacttgttcaaaccatatacttatcctgagagaacctaatgtttctttttctcaggtcggtgctgaaatgaaacatggtactactgtggtataagacagggtgaagaagctcacctaccaggaaatgaaaacttttttttttacagggttcccatagcatcttgattatgaatcctgtggaacaaatacgtcttaccttctctcttgttgcccagacaggaagccctttgggaatcaagaatgttctttatcttgcctagatcacagtacagtgatgagcactgatgcaagatgtgtattactccattttcgtactgctgtgaagaaatacccaagactgggtaatttataaagaaaagaggtataatgaactcacagcttcacatggctgggaaggcctcacaatcatggcgcgaggtgaagggggagcaaaggcaggtcttacatggtggcaggcaagagagcttatgcaggggaactgccctttataaaaccatcagatctcgtgaggcttattcactgtcaggagaacagaatgggaaagacccacccccatgattcaattaccttccactgggtccctccatgacacatggggattatgggagctacagttgaagaagaaatttgggtgggaacacagtcaagccatatcagtgggtaactactgaaaataagtctcaacaccatatagctagtattttagtcctgtgggagtcttgatttcctgaagtaatcatagaaaagtttttaagtgagtccacttaacactacctttttttttttttttttttttgagatggagtctcgttctgtgacccaagctggagtgcagtggcacgatcttggctcactgcaacctccacctccagggttcaaacctcccaagtaatctcagcctcccaagtagctgggagtacaggtgcctataaccacacccagctaatttttgtatttttaatagagacaaggtttcactgtgttggccaggctggtctcgaactcctaacgtcaagtgatccacccacctcggtcctcccaaagtgttgggattacaggcatgagcctccacgcctggcctcaacactacctcttgttggcaatcaatcaatatcttttattgttggattattatttacagagcctattttagccatctagcacttttcttcttgaacaggtctgacatttagcctttcttcccctattaaaacaaaaacaaaaacaaacaaaaaaaaaacctctcttgtttttgttgaagtagtaatgtgtgtatatcatggaggtgagaggattaattgtaaagccactgtttcagagtatgtgggaactttggcctggcgctgccttcagatgttataggatggatgatgcaaaactgaaggtattcttcactgaattataaaccaagaatggtgggacttatcaggtcatttgtgcatttctttcatgatctcagaatttaatggggagaagtatgggggacagagagagacattagcatgcaagatgtcatacagctggtatagaaaatggaaattagagcctttaaagagaaactcttactgtttccatggtataagtgcagaggtcaaggaggaggtgagccctactagtttcttgctttgcctggtaacaacagtagtgtcatgggatccttcaggtgtcgcttcaccagctggaaacgtctatgaccagcagcgcctctgcttgagttttgctcatgcctgctggatttgttccacccactcggcccagcaggctgcactcagcttgcactactggcctggatcccacacctgccaagggtgagccaggcacaaagtggcgaggggtgtgtgagtgagcaatcatgaggtctgcccactgtgcacagccaggtacactggcttcagtggcagggaaggcagctacaggtgccagctccgtgcaaggctgtagctgtaccagatacaccacaagaggcttccactgcaggcacccacatccagacaaggggaatgcagtggcacctgaaagctcagagatgccaggaacttcagagccccatagaaggtattacagtgtgtcacagctctggcttaggaagccctgagatctgggttcccaggaaggctgcagctcttctttctctttgcccacagcatggcaaatggaggaaagcatgttttctcggggtcatgtttcagctagtttgtgctgcagctctttcagtcccaccgtcctgctccggcccatggctcctgagctgacctgaccccaccactgcaggtttcaagttcttgtcccacgtctgggaagaatgaagttatgcagacaactggagggtgagcaagacagagagaagctttattgagtgacagaacagctctcaggagactcaaagtggtaactcctttcagcaggcaggttgtaccaatgagtatctgagtctggctgagtctggggtttttatttgctcagaatggaggaagtaggtgctgactggtccatggtcgggcctggaaaaagcaccattcgactggctaaaaggcgtcaatgaagttctcactctaagttgcagactccaccttggattggcagcccagtccccagacttcaggctgttcctggcttgaaggtgggatttcactggggtcccaccacctcccacataggcacctgtctgcctcccaccaccatcaacatgctatctgtggtgcccaggctgtctatgctgaggggtgcctgcaggcccatgctgagcttccctcaatacccccggcctccctccctgagttcgtcagaacccaaagcttcagaggcggccaaggtggtgggggcagggggctggcatgacagcaccaccccaagtgtgtgcacacccagctcggtcgcagcagtgcccaggctcagctacagctttgctctgcactggagcaggtgctgggattgggaagaggccagggagtaggagcaggcacttccaagcctgcaggggcagggggctttccaggtcctgagagcacagggatatccgagtcagaaccactgctgggcagctgcagctgcgcctagaagtgcaggctcccaccctaccaactcggtagggtccggggctcccactgggatcacctgttccctgcccctgccagcttcacagagcatgcagccccagatgtgcctcccccactgtggccagtgtctccacagtggccaatccggttgcgctactaccgccatcaatagtataaacttacatagccattactatgagccaggcactgttctaggcaccttacatatattaattcatttgatgctcacatcaactttctggagtagctactttttcagagatggacaactgtaacattaagaagttaagtaacttgctctgagttacaaggtaagtgggactgccaggatttggacgcttcatctctggatctgaagcatactttctttaccaccatgttacggtaatagattcatgttttacaaaagatatttctttattattcttcaacaagcatttattaagtgtctctgtgtgcaggtcacttttgctgttagtcttctggttgaattgtcttccacttcctctgctttgataacgttggcttccagacagcgtggtagaagagacagtgttgatgggtcttggagctagatgattgtgtaaggaatatttaaaaaaaaaaaaatgcaggtagtaggatgtcacaaccaacctttttaggaataaactagacaactgtatgaagaaattgtttattattttcatagccaagaaacaaaagatgttctcagccaaagagaagtatattgagtgtcttgtagatatttaacctaccttggaaacaacttgtcttgataataactctttatacagattacatttcttttttttttttttttaattagactttaagttctgggatacgtgtgcagaacgtgcagttttttgttacataggtataccagtgccatggtggtttgctgcacccatcaacctgtcacctacattaggtatttctccaaatgttattcctccgctaagccccctaccgccccgccgacaggccccgatgtgtgatgttcccctccctgtgtccatgtgttctcatcgttcaactcccacttatgagtgagaacacaaattacacagcttaactagtctgtctaagatagttaactgtccctcagatctgccccatcttaacttctaaatggaatttttactgtgattacttttgtaaatattagaaagtaataattatgcaattagaatgataccgggaagctttacatttcaccgtgtatgagtggtaacatttttgagaattgaaaatttttgagaagcgatttggcttcctgaaaactgtgtaggggcagcaatggtttaccctcttgtcagaagcttgtttatactgcagataagatcggtagatacattaaaactccacagtttccctgcctaacaggtgggaggtgggggcggaattaatttaagaaatattctttgctacatttgctagctcataggcccaagtgttcttacagtacagataagagaggctatttctggaagccctgagtaccttgaggcctttcattacatatttgaaacatgcccaggatgaaaaggttgaaaaatatactcagatgctcatcttaatctctggtgtcctgtcaagcagggtagtttatcataatggttacctttctggtttttttacttcagtcttcgtatctaattggcagatgtagtgacaggataagagtcttcactttagaattagagcagtggtcccccacctttttggcactagggaccagtttcatagaagacagtttttcaacagacggcatgggtcggggagatggttttgggatgattcaagcacgttacatttattatacactttatttatattattacattgtaatatataatgaaataattatataactcaccatcatgtagaatcagtgggagccctgagcttgtttttctgcatctaggtggtcccatctgtgggtgatgggagacagtgtcaggtcattaggtactagattctcataaggaatacacagcctagatccttcacatgtgcacttcacagtagggtttgcattcctgtgagaatctattgccaccgctgatgtgacagaagaggacattagcatgcaagatgtcatacagctggtatagaaaagggaaattagagcccgtaaagtgaaactcttactgtttccatggtataagtgcagaggtcaaggaagaggtgagccctgctagtttcttgctttgcctggtaacaacaatagtttcatgggataatgcgagtaatgcgaacaatggggagagcctgtaaatacacatgaagctttgctcactcacctgctgtgtggcctccttcctaacaggccacggactggtactgggagtgggggacccctggattagagggttcaggttttcttctctgggtgtgaccttgagcaaagcacttcacttttctgacccttaatattatcgcctttgaaatgaaggccttcaatggaagtgttcagcggggaaggagccttttcatttttcctaagtattcctttctttccccttccccccatatgcatgctgagaatcactgctgaagtgagtcatttttactgcaaggaaaggaaggtatagtggaaaagggaaaaaaatgttgagaaccacacagctcatttctggagtcctttcagctaattaaaggattgcagatattataattcagtattttaattctgattgattttatgcctaattgtccaagtgaatggatttctagtccagttctaatgcttgcttgcttctgtgttataaaaaaattgaactctagatggtttccaaagtctttataatcataacctatttctaacaacctatgtatatacatgttgaacatctgaaatttgaaaattttaaatctgaaaaacttctggtcccaagcatttcagataagagatacttaacctgtaaaaagtaagacttagttcttgttgattccgtggttggtctttatgtttacaagtaaatgcatattataaaaatgtagcttaaaaagaaaaggaagaatatacagtttttccctgtagtctttcttcctgcttcccagtttctctgcttatccctgctcactactttatacagttatgtctcttaaaattttaagtctgttggcatagttgtgtactcattgcaaggtatccacacattgggaaaattaaatatacacgcacgtaacacaaaaagaggcagggaagtcaaggagtgtcatgaacttactgaggaagtcttcctttctcagtgactcatagaaggctcgtttactctctaagcttgctggctactgctttccctgggaaaaggaagtattatgatgattaagtagtagttattttttcatttaaaatattctttttcttctatttcttactctctgctaagttgttgacagtgataacaaagggtacagagtaggtaacaatagtgactttaaaatgatatttggtgaaagatagccaaaatcatttttttcatctttacatctcaaatctgtaaagtgtgattgagggtaaatatcattcccatttattaagcattcactgacaaaaaagtacaaaataattatttttcttggaatatttcaggagaattagaaccagatgtttaaggactaggaagaagccttatgggggataaaattaacagtccatttctgcatggagtttagtgtatgaaatgggtcttttctatcagcgctattatatcctaacttcctaagatgttttggtagactttggcagtattggttttttaaaaaaaaattaatgaatacaaatacagggaatctcaggagtctatggaatactagtcttcatttgtcctcctctcagacactacagtactggcctgtttctgaacaccctctggggcatagggaatgccttttcactgtcagtatagagttctttttttcctttgatccagttaatgctgtttcttaatatgtcttcttcccccaaaattagaggcctatgtctatgtttttataacgtttatatttgcacagaatgttaccacttccaaaggagaacctagtacagcctttaggggatcagaaaggttgcagccaagttaagaactaggggtcaaatagaatggtcagacctacagaacatcttatgcaaaagccaggagacaagaaagagcccagctctcttgaaagctctgcaagtaattccagtatgattggagtaatagagttgaaggggagctttgggatggcaagggatgggaccagaagtgtaagcaggagccaattctttatgaaagactttgtatgctgcaaaggactttgggcttgatcgtgaagaacctagagaaagcagggaagcaaaagatcctacttaaaggagtttctggaaattgccctagctgcagtttggtaaacagattggagggaagcacaactggaggcagggaaaccatgcaagatgctggtgccataatctaaatgagagctgatgcggccaataatcagagtacagagataacaatgaagtaagattcaacaggatttgggggacttagagcagaggagaaaaaagaggcatggtcaaggatgactctcagatttatgaccagattagagatgctaacagtttggtaggtgattgtcaaaggtaggtaatgagatacccagaatgaaggtgaagagactaggtagctgagggtagaacccctaagtaggcagacattgaagaggacaaacaacatggagtagaaccctaaattagagggagactgtcactagagaaacaccttcattattgtgttgtatgccagaagctcaatatccctgcagctagcttccaaagggactttggacataggtgcaatatatagtttgaatgtgaacaatgtactttcccacaggaaggatgaattcagttacatggactctgcttataagcaaggattgctaaagcttttgaaaaatcccctcatcttcttctcactaccctattccctggtaatttcaggtcagttccctggacttacagggactgaacacctattcttcagacaagatactccctacctgatcaatcacacacatactttaagagaatttcactgggttgtaggattagcagacagcaattctcacttgctgtgtagtatgattagattttttaaacacacagtttaggtatccattaccattaaaagtttattttcagctagctaattccatgaatactaattttaaaaagcccattcccctttgacttcttctagttatgccatcaattataatcccttcaatcaagatttagacttaacaatatacatagcttatgttttttcagcatttgatatgttcaagcaaggttctaagcactttttttgtaataataccattaaacctcccaataacctcccaacttctttgattcatgatgtagaaatatagtgtgagctatgtatgtaattttaaatatcctagtagccacattaaaaagaagaaaaaagaaataggtgaattttattttaatacatttttagcccaccatttcaacctgtaattattattaaataattattaaatagataaatagtaattattaaaattactaatgagatattttactctcttttgaggtactattatctcattttacttaagaagggattgaggcacagaaaggtttagtgaaaagtggtggcaagtcagacacattctttctgtggagccagaatcccaacattgccgaggcatccttcctctttacctgtcccaaagtcagtgttaagtgaaaaagcagtagacacagccaaaaactcttggtcttagaatcacaggtgtggcacagcagattgaaagtattcagtatatctaaagcatcttatgatctttaagatgctaagtaaagacagcgagagcctattttcatgatttttattgcatgtaatatttcagctgtacataggggctcatccactgtaggctgcagcatgggaagctgaacacagtttgattctgttgcagaatttctcctgaagcagcaaccttgggcattcagccaaatcgtaatttgctgatatttttcattctaaaagatttacctcattgtgtttttattttgaaatttaactatgaaagctttaggttttttttcttatttaaaaaataaaatctgaaaataaaacagtaagggaattgatcattttcagaatgttgcaagtgggaaaacattacttaataacctaatacctgaaaatcctgttgttaaataaacattctattcattgataatttggatttcctaagagtggcagcagtggatatacatgatttctaaagttctgctatatctaaatatacatcataagattaggttacagaatcattatttttttttgatgtacacatctttgtagccttgtttttcagtcctgaaaccattcttataaatttacaaagcagtcaacctctttgagtgtatttttgatcatctgcagcgtgtaacagcaagcacaacagcaactgacatttggagggttactattttccaagttctgtgagtacagttctactaaaaatttacaagatttgtgctataatgatctcattttgcagtcaaggaaactaagacatagaaaaattacacatttacccaggtcctaacaggctttaaatgccaaggctaggattcagacaacttagtctgactccagagcctgtttatgttcttcatcattgctctgtactgcaagtgtcctctggcaccaaattttatttgttcagcttgagagataagtgatcattaaaagattaaaagatttctttctcacttcttgattcatgatacagaaatatgatgtgagccatgtatgtaattttaaatctcctgacagccagactaaaggaaaaaaataagcaaagcatattttcatacatctttacgccaatacattccaagtattaccatttcaacatgtagttgttcattaataattattaaattaataggtaaatagtaattattaaaattattaatgagctattttactttcttttgcattaagtcttcaaacttaggtatatattttacacatacagcacatttcaatttgccctagccacatttcaagtgcttagtagccacatggctaccatattatacagcaaagttttggatgttgggttctcaactggtacatatccaaataggagtggggcagagggctgtgtagttcaagaaccactgctgtaagctttgggatttcaagtgatacatttctaaaatgttagaagagtccaggttgctaaaacccaatttttatatgagggaagtagtattagttttatatgcttttttcttttttttttgagagtctcactctgccacccaggctggagtgcagtggcgcagtcttggctcactgcaacctccacctcctgggttcaagcaattctcctgcctcagatagtatcccatcttctatctcctgggataggagtatttcagatactcctcccgagtagctgggattacaggcgcccaccaccacacctggcaaatttttgtattttttttagtaaagatggggtttcaccaagttggccaggctggtctcaaactcctggcctcaaatgatctgcccgcctcagcctcccaaagtgctgtgattacaggctagttttatgtgcattttaaaataccagtctgttttcaagataatttgttgctactggctaagatttcttaaagtggcacactttgacagcataaaccaattcagagtgataatattagctgtgttattttagtccactgttaataactacatagacagctgactgacttcaaagaaccaataaaacttggagttctgactgagagccaaataaaacttggaatgggcaaaaattgagtttatgttatctgcagacattgcccttcttggtgagatactgctgtcttctgcttcagagtcccttcctcagccacactatttggtagtgactccttatttagcctatatcttgtaatttactgtggttaccattcttgggaggccattttaagatttcttaaagtgacccagagaaatcgtagcttggtatttactaaatgtgtttgtgtatgttatttcatagctgtatacgctcacctgtgtgtactttttaactgaatttattcatctaccttgaagtaatgttgtaactataaacctgtgattttctctacttttaagctcttccttctgataagcttatctattcatattgggtttaattatagctcagggcataaccatgtgtattattcatctgagtgagtgagcttgtctggcaacaagaggctgttgttgccaaagctttattgtcatctgggctgaatatactctgtctatgcctcattgccagcctcaggaaaaggaggtaatggggtgatgggggaggaatgctgtactctagtcccttacaccactgcttctcaatatattccaaccctttgcaataagctaggataactgtgattttatttacttcatccttttttaaacaagagaaatcaaacactagaaataaaatgtaactctccttcatttcctatctctacatctgtttcctcccatctccccattccacctcatcccttgttgttctcataaccactatcatgaatttaggtttatctttccagttaatttcttaaaagactttgacatagatatgtatccataaataatataaaatattcatacagtaggacctgtaaattcatacagtaggatcttttttttatttatacagtaggatcacattgtacatatgcagcaagttgcttttctcaccatattggtagacctttgacataatttttcttaatataagaatttggtacctatgtaataacgtatctaacacatggtaggtgagaaaacctagtaataaaacagaaagcacctgaatccactgcacacactgagaagtgaaacatacccagaaccattgaaactccagtgtgctgcttctccaacctctgctcctacccaggaaaccactcttctgaacttttttcttactggttttcttttcttacctcatatttatgtgtccctcagtagtatatgtccctgtttgcttgtttttaagctttgtagaaatagtatcctactgtatagattctttttagtcttaattttttattaaatgtatttttaagattcattcatgttaatctgtatattgtcactgctatatagtattcctttgggtggatttacccatttttctgtcagtagccatttgtgttgtttccaattttgctattataaatagtgcttcaataaacattattctcaatgtcttctggtgatacacacatgtaaaagtttctctgtagtgtatacctgggagtatagttgctatgttgtaaaataggtgtacagttgacccttgaacaactcagggtttagaggtaccagccccctgtgccatcaaaaattcatgtataatgtttgactttctccaaatttaactactaataataccctacttttgacaagaagccttactcataacataaacatttcaattaatacatattttgcatgttatatgtatatatgctgtattcttacaataaagtaagctagaaaaaagaaaatattaagaaagtcataaggaagagaaaatgcatttacagtattgtaccgtgtttattgttaccctgagtttacatcatctgtttacaaggtgaaatggcagctaaccacaactacagacctcaatctacagtgtatatcaagtaattcaactttttcttgtaatggcatgacttttctctgcttcttgggactacttccagaatcactagtggcccttcgtatggatcccatggtgttatttaaggtttacggtattgcacaaacacaatgaaaaatatgcgagaactgagagagagcactttttatggcaatacgcaatttgctggagagatgaactgctcatgcagagatgatttttgtcacgtggcattttaggcattttaagcagctattggcaatagctgagttcattgcaatagcaacaggaggtggctacaaaattattacagtagtacagtatgtattatagttacttttatgcagttatgatttaatactctatgtttgtgtttgcttacatttcttttaaaatgctcatggcatcatgtatggtttgtgggtataattttaactttgtaagagatcggtatatattttctggtagtaaataagaaaaactaatatctgtgtatattttgtgcactcatgacgttcctttttcttaatttttcaatatttctaggctagtgcgttgtcagcgagttttttcaaattgtcacaaatctcaaatttttctaatgtattttcttgaaatttagttcatctaagttgacccacgcaatgcagaccctgttgttcaggggtcaactgtatattcaacttaactagatgagcctatattctcatccgaaggaattactcatactcatcagcagtacataggagttctagtttttccacatcctcatcaacatgtggttttgtcaggcattgatttttgcatttgcattttgtaaaataatattactgaattttgattttcagtttcatttccccgattttgatgatattgagcatttttcatatgattattggccatttatgtttccctttttttggaaatgtctatgtcttttttaatagagtctttttttagttgattcttaggaacttgtgtattctcaacactagtatttggtcacttttatatgatccaaatatcttttctgtttgcagcttgccttgtcactctcttcagtcaaactctaatattttgacttttgcatttaaatatttaatccatctgcaacagcatttgtttatttactgagggtaaaaatccagtttctctgtttttcaaatataaaaacttttcctagtcccatcagttgacataaatcaggttttcatatatgtgtggaaaagtttgaggaatttctttgagcttccgaaaaaattttaaaatcaacttgtcgagttttggttttaaaaagcagttggactttttaattggaattatgatgaatcaatttggagaaactgacatttgatatcaggtctccctacccataaacttggtatctccctccatttatttaactcttatgagtacttttcaataagttttatataattttctccataaagatcttacacatcttttatgactttattcatagcttccctacaagacctattgcaactcatttaaaaatacattttctaggggccaggtgtggtccagtgatgcatgcctgtaaacccagctacttgagaggctgagacccaagaatggcttgagcccattcttaggattagctaaatcctaatctcattttgcccttcttttcacctgagagaactaatacaattcactcgactcatgtgggccatattgttttcagcaaaattctctgaaactcagagacatgtgtactgctagtagccatgtggcttcttcacttgctttgttattaattcatcatcatccaacatactgacttaagaggcactaaggacaaggtacaacctgttcctcaagcaccttctagggagggtagaaagaagcattagttgcaaaacacagttataaaacaaaatgatacatcttatcctctacagacctcattggtcatgatgtatgggtcaggaagtcctttgggtggggagaaagaaaggaagattcagatgggatatgatatttgagcagagactttggatgatgaacattgaacctcctttgtgttctcagttgttagcaaagggatcagactagtcattccccagaggtccttctaactttgaaattttgtctctgacatcacaaataatttcatgctttcattaaacatttgtgtttctacctctggcctgtagtccttggactcttgttccataggcgtagggttgtgaatggcaaaagaggatcttggtgttcttttatgaagtgataccaacatatttcacttctaggataatgacaatattggcaatatgaatcttaacatgagagttaactgattaactttttgtgtttttatggaattgctcaattggttatcataaatagattttgttaaattccagcctttatgtaatttctaagcacatttcatttgtatgtcttatttcagtgctggacccaaaggagacaacatttatgaatggaggtcaactatattgggacccccaggatctgtctatgaaggaggggtgttctttcttgacattaccttttcaccagactatccgtttaaaccccctaaggtcagtatgaagttttcattgatttttagcaatatggattatatttctagatacatatacttattcttaaatatgcattctagggatgcatgtctattctgttgtcacagacagcttcccaggattgatagtgtataaaatgaaacaatgtaaaaaattgtaggttattcctccaccccagctttttactgatttcattgttttttttctcctcctttttctcctcattatctcctttctttgttatatgttttaatgtaacattaaaacaccatgttttatgggtgaaaatgggggcataaggttgggccagggtgagtaccagagcccagaaaatcagacgtagcctggagccagagcccaagcaagctaagcgcaagaatcaggctaaaggcagaggaagccttgcctaggcaaggtttatagcaccagctatggaggtttgagttttggtgcctctagagttcagctgctcacatgtagcacacatggactagtatggaaagtatgacccacagagacttaaaagttgtgttaaaaaatttcgtaaagtatttataatagttcattaatgaaactaatcaatgaaaagtcatgtatgttcatgtctgatgtggaagagtgcagtgaaatcagaacatgaaagaatcctcacttatttaagccaaggttatatactttagaaagtcttcacattcttttctactgcctataagtcggatatttgactgttttaaatattgtgtcgtctccattagcatttgttctccactatagcaaaggaaatgaccctgaggacactatgttttgactaccaagaaagaattctcgtctggccctgacttaacgtcacaatgcacagggatagaaaacttgtttgtattgtgggttggagtaaacaatataaaaaaacaagaataagactagacgttcaccatgactttctataattcccctccctcctcttttttgcccctgctcttcctttcttccttcctttccattgatgcttagatagtgttaccaaagcaaaaagtagtagctataattaccctcaatgaggaaaccaaggacagaggaactaagtaacttgtccagcattatgcatcaagcaaattgtggtgtaaggatttgaatctggaaagcctggctccaaagcccatacttcttcctacattacacaatacattttattcaagctgtcagggctggtggcactggtgaccaccaagagcttgcatttggtaggttttcaatgacaaagccatggtaaatctaatacttatcttctccctttactggatgggacccttataccttccttttctactttagaccagcccttatgtcacctggagtatctgttgtactatgagggatgtaaggacctttctttctcagcctctacagtaaaggatgcacagagtgaggaaggaggaggaaaactcagaccaggctattgtgctgcttgtaaatctgatgtgatctgttccttgagattagtagtttcagaaaatgtgtgggcttatcctagttctgaatgacagaaatgtgtagattaaacaaagctagaataagctggggggagagagtcaaatcgcattcttgactttctccactgagtcgtgcactccactgggcatcagctctgccaactcatttcttctccagaacactccagtaagactaggatgttcccctgtcacagaggaggaaacatagatgagacttagagaggttttccaagagtgtacaaccaggaatctactgaagtctgactccaggggccatgtactttccactgaattatacacacttgccttggagaagttgactggtaaaaatagggcgtgggaggaatgctttatctgtcctcacatgttttagggactatggtgtgggtaggggttggactttatccaggatggttggatgggacaaaaatagaagcaggagggtgtcagttaccgggaagtagatttcagttttctctgagggaaatctgacccacagtgggacagtcaacttgtgtgtagctctacctctgagacaccacacttccctttactaggagtgttcaagaaaaaactgagttactacctgtcaagaattttaccagaaaaaatggaatccctccacataatgaattggaccagacaatctctaaggagaaaaaaaaaagcaaactttggtacctataaccacaattcaaatgcacatttgataggtatctgtggaaagtatttaaaagcaaattatcaactcctaatatatcagttttagagatcagattctgtagatagatgtgttactcgagggagaaaaaacttggggtgtagtgaaggctattaagtaaaacaaatactcttattattaatagttttgatgtaacaactccatgccttcctagtgtcctgttactgtaaatagtacatgtttcaagttgtcttgggttttttttctctgctgcttggtatttttctctcttttgctctttttttttttttcacgttagccatgcattttgattcctgcaacatttcccaatactctgaagaatgaaccagggaagcagtgggtgtcagggggaattacttataagagcagatgcttataaatacatctgatgggctatctgatggttatttgtgtggatatacataccataaaattagtccgtagcatgattgggttcatgagataattttttccaaattatcataaatagaaccttttatgaggacttctaaacactgcagagctcaaatgtagcttttaaaggtcagaggaatgattcgagatgccccttcttgttgcaggaactttttcacagtagggcttgatcaggttgaacaccctatattccactgcccaattttttaaaatcagagatgagctattctagtaatttcttccagaatttgcctaaattctaataaggcgagcaaaacaattactacctgagtacataatgttaattaaacttagtattctagttttaaataggttgagtattagtacttttcaaatgctatatttcagtacaatttttagtacattgaatttcttatatgtttatgccttttacttaacctatagcacaattttactatttcaaagtaggtaaggcattttacatagtatcttttcttgtatgacattgtccattgcatttgatgtcaggtcttcagctgagtatttaaccaccaatgataatattatttctctgtgaaaatacctgtttaatagaactccacctaggaatactacattatggccaaaaagaaaagtgtaatgaactgctagtgtgtgtaaaagctttttacacctatttatttttcagtgtagacatatgttttaatgttttcattcagtatctttttaaggtagaagttgctttgttttttggggttttttttttgtcatttggttggttggtttttgtttttgtttttgtttttgttttttgagatagagttcgctcttttgcctaagctggagtgaagtggcacaatctcggcttactgcaacctccgccccctggattcaagcagttttcctgcctcagcctcccgagtagctgggattacaggcacctgccaccacactcggcctattttttgtatttttagtggagacagggtttcgccatgttggccaggctggtgttgaactcctgacctcaggtgatccacctgcttcagcctcccaaggtgctggattacaaccgtgagccaccacgcccggccagaagttcctttacattttgctggggattagcttttagattcatagataattagtttttaaatttatgggtaattactcctcagccaggtgcagttgctcacactggtaatcccagcactttgggaggctgagacaggtggatcatttgagatcaggagttcgagaccagcctggccaacatggcaaaatcccatctctactaaaaatacaaaaattatctgggcatggtgactcacacttgtaattccagcttctcaggaggctgaggcatgagaattacttgaacccaggagacgaggctgcagtgagctgagattgcaccactgcactccagcctgggggacggagcaagactctgtctctaaatgaataaataaataagtaaaattactcctcaaagtgctcaaaatctgtactttattttaaaagtttaatatgtaagtattttaatgttattcattttgcagcctacatatttgttacataattaaaaaacagttgcagataagcaaaagggaaaaaaatttgcctgtaatctcccccaaactgattattcatgccatttaggtatatctgttttaagacttttgtttccttcatttgtatcatatacatataaatatgtacacgtacatgcctgtacatatatatacataaacacacatacacctttttacaaaaattgggccatactccccatggcttcatgattactttttaatctaatgttatattttcatcccgtgccatatattatatatttccagtaaacatttaattgtgttacagttagaaagggtgcctagtattccgttgtataaatataccaaaatttaatcactttcatgtggctgaacaattaggttcttctcattgcttctgttataatcagtgatgtgatgaacattcatataattacacatttttatacttttatgattttctcaggttaaatttgttgctgtggaatttctgggtaaagagtttgcacgtgtttatagagtttttggtaacgattgacaaatcgtgctccagaaaaattctatcagtttacatcgtgaccatcaacatgacagtgtagaacttccctacactcccctcagcttttaggattttaagtcttttttactggcaatagatgaaaagtcgtatcttatggttgcattaatttacatttatttgactacctgtgaaatgtatgacagttttcatgtatactgttgtcctatctcattatttcttttcgtgaataatataaaaaacattttatcttaaaagtcttacatcaaataaaattaacaaggatgcttgaagaattcagaaactaatggaatatattatgttggggttttttcctaccaaaaacactttgaaaatattgtgacactctgtgtctaatgtttctgtttcagacattctttcttttttttttttttgagacagggtctcactctggggcccaggctggagtgcagtgacgtgatcatggcttactgcaacctccgcccagtctcaagcgatcctttcacgtcagcctcccaagaggctgggactacaggcacacaccaccacacctggctaatttttgtttttttttttgtttttttttttgtagagacagggttttgccatgttgctcaggctggtcttgaactccggggctcaagcagtctgcgcactttggcctcccaaagtgctggaattacaggcatgagccaccgccgccggcctgtgttagaaattataatgacttacatcctcactaaggactcatgttaggtaacaggtcaggtgtttgtcttttcagtagaaatgcataggggtaacgcatttttaatttagctttttctgtctccctgtgaatctgtacatgacataaaaaataagtgtaaatagatttgaaattaggtaggtgagagagtcactcatgtttgttttttattttcagtatttcaggcaacttatgcacaggttagacatgctgtgtccatgttcctgggaaacactgttttctctggtaatggcaagaagatagtatctgctggtgataaaatttgtgcctcaggtgttttataaaacaagacaaaaaattacacacatcagtaaagtgtctgtaagtgaaattaagaatgatattcaaaatcttttaaaatataatttgttctttcactacaaattttaccaagtacattttaaaatcctagagatcaattcagagcatatcagtttatgggtttgtttgttgttattttttataaagtctaactatgggttgcttactaatgtcagctaatgcggaaggccttcactgcttttgaaaagtgaaatagatggggtcttcaggttttcaaaatctttatttttctcattagattttaaccttaaattgacaggtcatggctactcataaataaggtagctaattagttacgataagaaacagtgatattcagcatctgaaagccagagagagatctgtaactgaagttcaacaatgagttccacaactgcacccttactctagattattattatgtacttgtttttattgttaatgctactactcaaagaagaaagttgaatgtgtttcccagaattttcagtaagagcagtgatttatgtgtgtaaacccaactacccattcatttactccagccttggttagagaacatgcagttgtcatggaataacatgaattggcttgtttttaacctgagttcgtgcattcatataaagcttggccatgggtcaagttctttcttacattttgaattgcctatttgacatctctagttgaacatccagtagtcatctcaaacttaacaaatccagaaccaaattattgattaccccattctacatcagccagaccagctcctctagtcttccccatatcaatgaatgtcaggtctttttttccagttgctaaaactaaaaaccttacattcattcttgactcctttcacacagctagccagacccagtcccactggctcaatcttgacaataaatctagaatccaaacatttctcaccatctttccctagaaactctttggcgcaaaccaccgtcaactgttctcctccctcagattattgtggaaatctcctatgtggtcttcctggttccacccttgtcccttcaacagtacaccccatatgctgaaagattccttttttatttttttggctggaatggagtggtgtgatctcagctcactgcaacctcagcctcccgggctcaagcaatcttcccaccccagcctcccaaatggctgggaccacaggcatttgccaccatgcccggctaattttgtatttttgatagaaatggggtttcgccatgttgcccaggctgatctcgaactcctgagctcaagcaatccgtccgcctcagcgtttcagaagtgctgggattacaggcatgagccaccacacccagcctaaagcttccttctatagtgtgtcagattatgtaaattatttgcttaaacccttcagtgattcccagctcctgaataaaagcctataaagccatatagaaccaccccgtccacagaacagttttcaaagtgccagccatcattttttactcaaatactcaaagcatgcttcttcacaagcctttccatttgttcttccttctgcctgcgtttgtatgccacccagaaattcacatgactcacttcatttctcccttgatgtctctgctcaaatgtcaccttttcagagaggttcttggatgacaaattccaacctccttaggttccctataaacttcctcaaacttcctcacaaccactagtatacttgattttttgctatagcacctctccctcttggtgttatatatttctttgtttatttattatgtttccctttccccaattagcatgtaagctcaatgaacacagaaactttgtctattttgatgtcactcctttaatctcatccatgtagaacaatacctggtgattcagtaggcagtcaataaaaatttgttgaattagttaaatgcatgtaactgtgccctaagcaaaatgtttattacccccacttcatggatcagaaaactgagctccatggaggttaagctgcgcacaggccacaaaggaagtaggtagcagaaccagaatctaaacccagttctaaactgagccttttatctccaattatagagaaggttgaggttgcttatatccctggaagaaggaatacttgttcctggattatacactctggtatgaattaattatatcacattattctccaacccaagtatttttgaggggagaggaaagacagtatgaggaggaaagagatggtttgaggaggaaagaatgttagaagagattttgtgtgcctttctgttttgccaggaatcctctttccgaagacactgggggcttttcttcaatatgtttctaattcacagactaacgtgttatatctacgttaaataataaatattgatttctggattttgccagctttaaagaagttacttcacatttcacagatcattttcacatttaactagtgtcagaatggccttgtatcctcagtgtcatgactgggctgtcataggtttgcttacatcacatgagtcagtttttctttttggtccgtgctccttttgataaacttttaataatggcatgctatccttaaatgttgtgtgaaatcccaaaatgaatgtgatgattaaaaattgatcaaaatggtgtcattgtctttgtgcttttaaaataatgcacattatatctgtgtgtccagccaccacctacaattaccaccagtttagtaattactaagaagtaggattgggttttgttttcagggcaaagaataccaactttattgtaagccaaattaaatatgcctataagctaataggaaatcagccttttggttgacaggaagtttaatttagccatattttgggaagatacgtttgttcctagctttctatagtctaatgcagtttgctaattttaaagaaggacctttagtttattattgtctcctgagatgcttattgctcaagccagcttaatttttcaggttggatcaactcaaccaactgtacgtttgcacaagccttgaagaggtggtggtgaatcagccactctgatatctactgacacacccttataagagccctgccataaaggtggaggtttcaaacaagtattttactgtgcttctccatgccctggagttcctatctctgtgaatgtgaccgcactctaaatggaagtttgtgttggttgatattactgtcagcataactgggaggggtagataggcctaaattccttcacgatggatgttcttccgcggagaagttatgtgaacaggggagactgaagtgagacattcagaagcttggaaaatgaggatcttctttgccttcagggctcagaaaaggttcaactcacttaccaaagaggggtgacttttctaaggaaagattcacagatgacacaagtgataccctcccctcacgtgagttttctgaagagagaagggtagggtaactcctccaggtacagtcttcagtatcccaaacatcaaagggtattgagtgatccactcactggtcccataaaacagtgaacactggaaactctgagagaaacactctaagcacataaaatttaaggacaataaaatgatactggaagaaatattcttgtaaagaggaaaaccttctgtagtactgagccagatgaagcttcagttttggcattttcctaaccttacaggaaagggcttttatggaaccagatcaagacatggaacagacaccctgtgttgattgtctgtaaatttgaaaacaaattatatttcattgtccacttgagagatgggatggggaaataatattctacgtgtgatgaaaaaaagtataatattctccactttatttaaatatgttacttgcttagatagttatttgtgacgttattttgttcaagctgggatacagtaggcaggtctgagttcatttctgagactgcctgccaaatatcaatccctttatggcaagtgatcaaatttccttgattttttcttttttttaatatatatgtttttttattatacttgaagttctagggtacatgtgcacaacatgtaggtttgttacatatgtatacatgtgccatgttggcgtgctgcacccgttaactcgtcctttacattaggtatatctccgaatgctatccctcccccctccccccaccccacaacaggccccggtgtgtgatgttccccttcctgtgtccaaatgttctcattgttcagttcccacctatgagtgagaacatgcagtgtttggttttttgtccttgtgatagtttgctgagaatgatggtttccagcttcattcatgtccctacaaaggacatgaactcatcattttttatggccgcatagtattccatggtgtatatgtgccacattttcttaatccaatctatcattgttagacatttgggttggttcgtagtctttgctattgtgaatagtgccacaataaacatacgattttttcttttcattagagttggagcaggatctctccgtaaggtagcagcctcttagagatttgttcaaggagatctaaagaaaatgagacagagagaaatgaatgttcctagtttgcagctgtccaagagaagagtcagtacatgatcatggcttattgatgaattagagaagataggaccacctgtcctttcgcaggtgtggtgcaggtcttgtcctgccaaaaataaggagaaacaaagtcagacagtcaacaaaaattataaataaaatgcatctaggggactgggcatggtggctcacgcctgtaatcccagcactttgggaggccaaggtgggtggatcagttgaggttaggagtttgagcccagcttgaccaacatggtgaaaccctttgtctacaaaaaatacaaaaattagccaggcttggtggcacacgcccgtaatcccagctacttggaaggctgagacatgagaattgcttgaacccaggaggtggaggctgcagtaaattgaaatcatgccactgcactccagcctgggtgacagagcaagactgggtcaaaaaaaaaaataagataaaataaaatggatctaggatcagacaaagttattcatactgattcatataagcatacctattctaaaccatcaggtgaatttttcttatggtatcagtgtattagctgttaacagagacctgccaaaaattcttgtaggttggttgcttttttaaatacctgttttaaggctcatttataaagcagaggtttattgagcccctactactttccaggcccttgatatataaagatgagtaagatacagccctggaagcatggagacagaaagaacaattaggggctgacacaatagttcagcccagaaaagaattaaggctcagctgtgaagataaaaacaaggagaataatgtataaattctcttctcattccattattaagtaatcatgtatgtaccatgcagtggtctagatactgaacatagagaagtgagcaatggcatgccccatcttgcatagaatttacattcaaggtatggtagaataggattttttcaactttgacccagctgacattttgagcaagataatactttgtagtaaagggctaccctttgtattgtagaatacatagcggcatgcctgatctctacccactaaatgccaatagcaatctcccctgtccctcattgtgacaacaaaaatttctccagatgttgccaagtataccctgaaggaggggatcaccctgttgagaaccactgtgttagcactgacatccatatctactggtgactagtttgaaacatcaggaaggactctctggtttctgatctgaatgaccaggtagggatatgttgcctgtgaggaacttatgggacacctgagtgggaagtgcagaaatgttcagccaacagcttaatagatctggagttcaggtgagtcatatgagctagaggtactgatttgggagttagcagacacagatttgggtgttaaaaccctagatagaataaatgatctcacctagagaaatgggcaattttcaacccaaactgaatttttgaacctatgaatttccagaatgggttttccaaaagaaaagaatgatgactgaaaaaactaacaaagctgatattttctctttttcattaagttctcactgtttggggattggaaagttattttccatatagagtattattgctggaaagcttatataataatacctcataaaatatcatgcttttattacaaggaaaaaacctcatttgttgttaataaattatataaattaattttctcacaagtgcctaaatcaggcctaaaataagtcaaaataattacctgtagttgcagtggccttctgcagggcaatggactaaatgactttttttaagctcctcttgagcctttggtttcagttttaatcgaactaaaacttatataagtaatgtgattaggatcacatagctaataaggccagggtcaggattagaactcctggcctcctaatttccagtcctgcagcccctactcttcacacctgaaccaactgagctatgaagtgatcttggtaagtgcacagtaattcagttttttgcctacagcctttctttcctgcctgcctgcctttttttttttttttctatttattttattatttttgttttttgagacagtcttaccctgtcacccaggctggagtgcagtggcacgatctcagctcactgcagcctcaacctccagggctcaagtgattctcccacctcagcctcccaagtagccaggactacaggcatgtgccaccatgcctggcaaatttttttgatttctgaaagagattaggtctcactatgttgtcacgggctgatctcaaactcctgagctcaaccagtcctcctgagctcaaccagtcctcctgccttggcctcccaaagtgctagtattacgggcatgagccactgcacccaaccagccatactttaggtcactctttgtgttcttttctgtagtcccttttgcctctatttttgtggagaattaaggttaaataagattttttgtttgggcacttaccaagttgtatatctgtgtatagactgcgctcagtggctcatgcctgtaatcccagcactttaggaggccaagacggccagatcacctgaagtcaggagttcaagaccagcctgcctaacatggtgaaaccccatctctactaaaaatacaaaaattagccaggcgtggtggcgcacgcttgtaattccagctactcagtaggccaatgcacgagaattgcttgaacccaggaggcagaggttgcagtgagccaagattgtggcagagcaggaccttgaccatacatacatacatacatgcatacatacatacataaaaacttaaaatatctgtacatgtacagtatactatatatactgtgtatttatgtttcccccatacttggccactaatgcattttaaactctatctctgtggataaaacattacagtagtttgttcaacaaggaaataacatataaagcaatatgtttatttcaggttatttccagtttattttcttcatttcttttttcttttctctcttccagacatcactacttcttgtagtgatttgcttttaaaaccaaactatttttctttttaaattagttttaaataggtaatatatatacacagtaaaaagttcaaacagcacaaaaggtatgcagtcctcctcattgcccagcattcccgttaccttcccaaagacatcttttattctgcatttactttttgcatttaccatcttgaagattatcccatatttgtatgtgtagatctttgttagaatcacataatattatattgaacaagtgtaccataagttttcctgtgattgacatacagggattttttttaatcttttgccatcacaaataacgtttcactgagtatctttgtacatactgtctttgtggacttctgcaaatatatccgtgggataaattcctagaagtggaattactgggactaatgatgtatgcatgttcaattttaatagattctgcccagattgccctccaaagaagctatacaaagttatactcccaacttaggcacacctgcctcttttcctacatccttatcagtgctgtgtgacatcaaatatttgacctttatgaatctgatataaataaaagaatatttataattgctttctctcattataagtaaaataataccttttcatgtgtccagaatttggacttttttttattgaaagtaagtgtacactttttcttattgaaagagtgtgaagagtttccatatagaaacctatggatgtagtattttcatctgtagaaagaggcttaacagtctctaagtttcctttcacatctttaactgtcagtgatttgtcactgccctgcttaaaactcttcagtggcttcccattgcacttagaataaaatccaaacttctttgtcttacaaggccctacgtgatctctctgcctgcctcatcacatgcaggccctcctaggcctcctttttgaccttatgatttgccagtacatttgactggaacatgtttgatccagttcttcatgtggtcaataccttctcattgttcaggactgttcagagttagatcctgagaggtacattttctgaccaccttctataaacagtgccacactagttgttgctgtcacgtcaacctgatggtttctttctcacgttaccttctaagatccaaagaccttatgtgccttacagtacctggcagatatgattgatgaagcaaatgaatattcatttagcctgtgtatccttaacacttctgaaatcttttttgccctgttggtttgtagtactgaaatattgtgcagtgtgtatgtgttttcattctcattctcccatatctaatcatatctaattcttatacccagaaggcagggccttgcttttccctgaagatgcctgccataaaggcatccagtaaacccagtagaaagtaatattttattattattattattatttatttttgagatggtgtgtcggtgcctgactgcatgagaaatgacaaatggaaggaggctgagcagacaagtttgagaaagcacaaaaaagtggttaaagaacttcatcaagctgagacaaggagaaatgtcttaggagtctggtcaaatagaggggtttcattcaaacaaaaagccaaggggattaagaattgaggccacagtactgaattggtgaactccgagaatgtaataaaagtatactaatgaaaaataagacaatgattaagcaatagataaggagtaggaataaactgcagtttgtcttcagtttcagtattgggtcaaaatctgctcttaggtttaattttgatcttgtcctttggaagaccaaatagctgaatttctgattaatcatttccatcatctctgaacctggcatgatcaatgattgtatgatttgtactaaagaactgaccttcatgttttctgaagcttactctcaaatagttgtagggacaaaataaacttggggtgtgtgtgtgtgtgtgtgtgtgtgtgtgtgtgtacatatatatagagagagagatacatacatatgtatagagagagagataaagcagatttagcaagctgttaacagttggtgagtctgtttactataggtttgaatttttttaataagttgaaaaacaatgaaaagcaaagtgaaataggagatatttcctcctgcaggtgtgcacacacatgtaaatacctaacatttggagcactgttgttgaacaaacagagtggcagggaaggctttctcaaggaagtattatttagctggtccatgatggatgatagaatttcaataggaaggagagagaagataggtttatcaagctacagaatgacaatgtttttaaatgtgaaaaatacaagccctccctcctccttggacatggataccatctcctcctggcaattcgattagtatgggtgtataaccagcatatactccctgtaaaaattagacagacacttgaaattttaatacgttctcattaattaagaacatataaaagtggtataaaaatttgaagggcaaggtgcagtggctaacgcctataatcccagcactttgagaggctgaggtgggaggatcgcttgaggccagaagttcacgacaagcctggacaacatagtgagatcgcatctctacaaaaagaaaaaaaaaaaaaagaaaagaaaaaacgagccaggcgtggtagctcacacctgtagtctcagctactcaggtggctaaggcagagcttgagcccaggagttggagatagcagtgagctataatgatgccactatactccagcctgggcaacagagggagaccctgtctctgaaaaacaaaacaaaaattaaaaaggagcaaccagattaatgtttcttaagagaacatttcttacatcattccactccaaaaaagatgttgaagtacatgtgcatgctttgaaagctaacctgcaggtggaaattcagaaacagttgtatcttggataccagttacactgttctattactgtatttctagatacatagtttaagaacaacttttttccctcaaaagattgtgtgaacaacaaatacaagcaaaaatattagggggagaaagaatatatatcagagcaatagcattgtttgttataaaaatattcaaagcaccttcttagagcagtgcataaaacttgagtttgtgagattacttcagtgaaactgcattataactgtgaaccaaatctgcaaaacagatggttgaaagagataatgtttttaccttactcagttggtattagagaagaaaagcctaataacactatggtaacagactctgataccagcagtatctataacaaaaaaaatcttgttcctccactaggctcagtataaagtaagcagatgtatattatagcagtcaacagtgtttagaaaatactattcctgcagtataatatcaaagtgaagacaaaattcttaaatatttttaatagtgaaagtgtaatagttagaaatttggatgaaaaaatttattcttgtatcctctattcttaacctttttaatagatttatttttatgaccaataaaggatgttacttccaaccaggctaaaagtattttactatgtgactgtataaactaatgatacaggtttttagtacatacctgagaaatgagtcttattaatttaaagttttacaacatctagctaaagccatccatctaattgtgggacctctagatatgtgttctttaacaccttagaacatatcagtttcatgatgaacatgaccactttactatgatgatatgttagtttttacttcaaacaaaactatttatttctgtcctttaataccactagataattttgactaaaataggaggaaataaatgaaacactgaccaatacaggcctttgaagaaagtgcattcttctaatattgtcagaacaaaagtccatgaatcttcttttaaaggaaaaaaagcatagttagtcttttctaccgagacatcccagctttttaaattatttgaactgtttatttgaagtagacacaatgtagtgatatgtgccatgcttctggaatttctatgagttttattttctaatatgaagaattaatgaaatatttaaaatctcaactctgcaattaatatttaagacttataatctctgtcgactaaaatactaatcacaagactttttaaattgccttaaatcaaaatttgaatgacaaagcacatttccctacataagctttacacatctctccattgacacctcccatctcagactcccaaaaagaaggcactgtaaacctaactgttgaaacatcagaagctctcgatcaattgtcatttttaattatggtatgtgtggcctcctttcaaatgtaaatattctgtgtttttccagttaatttgtttattgaacaaatacatgtcaatatcctctttcctagaggggataaaaatcagtatcagagataatccctgtccttatataaatttgttccctttgtaaataaacatttttgctagcctgtctacaaaaaatttatttctgaaatctttatttagctgtacatacaactatcagttttgtaaaatgaagttggcactatttatttaaaaagccacatgtggtgcagttgtttgcttctaaaaggtggtattgttataccacagcagacaattttctactagatagaaaatttcaaagataaatgttgcaaattatatggaaaggaaaacagcggcctagagtgtttatttaagatagtacttcagatttcttttagggacaggagattcaggaagcaggaataaaacattagaaaatgggaattttttttttcacacaattctgagtcattcttattccccctactccccactcttccttttttctttttccttgtttctatcagatacatttctacacagctttaaggaaaattaacccattttttttagggcagtagtcttacagagaatattggaggggaaaagataaacccaaaagaacaggctttggaagccgtggaatgtgaatgaagcaagatactctagaaggtggaagtagagactgaagaaatcatgtcagaaatcatagagtggtagcagagattagatatggacaagtggggaatagagaagaacagaagagagagattgcctgggataaaagaaaattaggcatggaaatttaagtggaaaacaaacccaggtagttaccattagatacaaataaaatttaagatattcctcataatactacatattccttcagtaagactaaaaagtaattcttgaatgcttgccacgaaggcagaaagaggtatgtttgtgatagtcctggagttgttgaaatgagctgtgagctagtttatgtttacagtgaggaaggaaacttagatccatccttataaggatgccttgacctgaagagtcagaaggcttgccttaggctcttctcatatatttgctgccttccttttcccctctccgatattctccacagtgggttccaggaagtggtgcaggcttgatgggaactggttttcagtaagttctggctgctgtgtgcctgcagtgccttgtccctttttccctctgtccctgcctcagattgtggattgtgttgcccatgttttctccatctccccctcccttatttctgtttcacatatattcatttctttcttggtttggtcagctgttaagacaatattcaaagaaaatggtattaatcatataaaagccattttgtgaatttaggaataagttagtgtcatctaccacaaagcatttgttccacaaaaggctaatttgagaacgaacatcatataacaatcctgttccaaatccctaaaacacctctttcatcatggcattctcctaaactgcaggatgaaagaccagctcctcagtttgtcattcaacatctactccttcactccttccctaagactccaatcttattttctaaccatttttaagtaaaccaatatttgtatgtcaggttggttgcaagggggtcatatatcaagcaagaattagcacattctcaaatagaaataactagcttagaaaattaagtgcacttctactttaccaaggtttttttttttgctattttattcctttataacaaatgcttatacattatcatttttctattttacaatctaattcaaatcatcacatagtattagtcatgcctgttataaaaccaactaaaactttcaaatatttaataaaagtacccttttttatttttcaagtatgcttcctgattagctgttactttcagtgtacagtattatgagtatcaggttagttaactacatctattctgcatagatgtttaaacaatattcactagaatattctgtgtgctgagatttaagttattcaaagattatacatgttaagtgagagttttcaagtcatgttgaaacagttgtttacttttttaactgacttgggtttttttgcctttagtaatctcacaatagtaatagtgaatatatatatgtgtgagggttttttttgttttgtttttgagacagggtctcgctctattgcccatactggagtgcagtggcacagtcatggttcactgcagcctcaaccttgtgggctcaagtgatcttccctcctcaaccttctgactggctagggctacagacacatgccaccatgcccagctaattttttttttttcattattttgtagagacggagttttaccatgttgcccacgcaggtctcttaactcccaggctgagcctgagccaccacacccagccatgaatatcattaaacatttcttctcttcgctattcactttacatgcttgatcattttgtcagaacttgatctgagaaacctgttgaatccctgtgtcattagctttgctctgtaaagtcaaactgttgagatctggaatttacataattttctttattatttttttctgtcattttctttaattaaaaaaaaaactttgagggtgtggggttttcatttgtctttgattattttgtattttccttataagctttttgcttagtattggaattgactttactgtgaggatttgaattcctctcaacctatgtctgtttcttagtaataatagtacccaccttacaggatgagtgtgaagattatgtaataaatgcaagtcacctaggacagtgcgtggcacataaacatggcattattggtagctattttaattattactattatttttggttacaacttactgtttatacatgtggtattttttaactttatggtaagaacataggggaaaaatatgattaccctcaagtatgcatacaaagtttggaaatttttatagtatttgtgaatactctgctactttcaaagaatgtctcttttgtgtgttgtacacatagcattcaaccaaaagagtgggaatttggccaactctataatagctgtaaatttacttatcattaacagaatcagtcattgttttactatatttttattagttttagagacacagagtctctgtcattcaggctagagtatatggtgtaatcatagctcactacagcctcatattcctgggcacaagctgccctcctacctcagcctcccaagtagctagtaatacaggcacacacaaccatgcctggatagttttttagttctttgtagggacagggtcttgctgtgttgcccaggctggtctcagatttctggcctcaagtgatccctgctcctcagcctcccaaagtgttgggattacaggtgttagccaccaagcccagctcatgtttttttttatatcatgtttaaatatagtttacttctacacttttgtaggctgtatgaaaagctaaatcatcacttctagctagtttgacaaatactttgtattgtgttgtatatgaactggattattgatctcttaaaataaataactgacccttcatatatctataaacataaaatgtattactcctttcctgaaggatggagtaatcctgtacattattttcattttacatttatcaaatctgtaaatatgctgcgtcttacagaattgccttggggagtgtgagacctataaaaaatgtaaagaaaagaaacgaaaaggaggacattctccttctgtttgtgtttatgtcactgtctttagttaaacagcaagtgtgatatggtcagtcatttattacatgctttacatggaatccattaactatctcagctgttgtgcttcctaattaattgttgttatgtatgagacacttttgcagttctaaagccagaaatgaatcatcttgtctaagagatgttggtcctttggacatctgttaaattatcttctgtggacagtactaattgataaataagtgctgttggctcaacatagccccacataatggttgttaagtttgttattcaagagcaattgttctagtacctgactgggggagactgatgcctctaggacaagctcatccaatccgggcccaggatggctttgaatgcggccaacacaaattggtaaacctccttaaaacatgataaggttttgtttgtttgtttgtttgttttagctcatgagctatcataagtatattttatatgtagctcaagacgattcttcttcttccaatgtagcccaggaaagacaaaagattggacacccttgctccagaaggaagattaaaccaagaaagctttgggttctggttttgatggatccccgtgtaccccccacccccccagcactaattgagcacctactatgtatgtgcttaatgaattaaagcagtgtgaatgtttaaatgattatttgtgtacctgtttaagtttagataccaggttatctttatttccaccacagttgtttggtggaacagccgtttttaaatccgtatgtgattatgttattggataacttgtcctaaggcacaaaaactcatttgtagaaaactcatataaccagctaattttttttttttttttttttgaggcagagtctcgctctgttgcccaggctggagtgcagtggcacgatctcagctcactgcaagctccgcctcccgggttcgcgccgttctcctgcctcagcctccggagtagctgggactacaggcgcccgccaccacgcccggctaattttgtgcatttttagtagagacagggtttcaccatgttagccaggatggtctcgatatcctgacctcaggtgatctgcccgcctcggccttccaaagtgctgggattacaggcgtgagccaccgcgcctggccataaccagcttattttttaaattccttgttttaaatttctgttttgcttttttgagtaaattttttaaagacttgttaaaatctaagccttcaaatagtgagtttgtactcttagagttttgtttaatttctgaacccctccacttttttttaacccattgagaaggaaacctctatatgcatgccaaacaagcattgattgagctggtttcaggcaactatgtctttaccagatagtatctccttcaaaagaaagtatttgagatgtcatctgtaggagacttctatgaagatttgaatctaaatcagctcttcttttcctaagggattattttattttattgccttatgttttggcatatatggtacagtctagtctcaaactagtgttacctgaggcccatgaagatgcaaatgcaaaacattccacagtccaaagcacatgggacttctatagaaagaaaaaaaaatgcccactgagaatgaactcacactcaaagatttctgtctgtaccatgatacaatctaccattaaggagaatcttctggaataccatttctgaaacttaaaaaaacagaacaagtcaagagacaaaataattgtgtaaagataaaaaaatgaaatatgaaatataatgaaagaagtaactaatttaaaaaaaacacaaatttagaaaagaaccagtgaactttattcattataggtatgttccagaaacattctatataaactgaatttttataaattgcaaaagaaggaatctgtttgccccttatcaagtcataccaagcatcctgcgctgtaggagttgagagtaatttgctgtattgtaggaaagagcactgagaattgaataagatgctcccaatcttctaagagatttgcttcccgtgatggggaaaattttctagttgcatgtttttctacatttatacataaaaggaaactgagaaagacttttttcaatttaaatgtctgtggcataaaggtcttttgttttaaatcatttgaattgtacttgaaagctaaaagatagtagtcttatcatgtagcatgctctagcatgtagttagtattcacagctggataggtgtcatctttatgcattatggttttcaggtgatgtttaatttcagttccttcactgccagttattcaagggccagataatattcctatggggtggggggctgggggaaggtggtgttctgttttgctaatgtgtatttcttagatatacatatttttcaggatttattccctcactataatgaggttttccatttttattttgtcactaataaaaaattaattttagggtgtatgttagttattggtgcagtgctctcaaattggttttaagaaaagagcacttgaaatctcaaagaggggattttttttttttatgtatactaacaacctgtttaaataaactgtagtttcatagtgagcctaatgatgttaaccataccattttagagctttgttacatgatttactgattcatggcatgggggcttcaaatatttgtggggttggggggttctccgtggaaaagtatttttaaaaagaatgttctcactgattgcagattttctcagtaaaagcaaggcaccatttatgtccttatcaaaattttttgaaaaattgaaaaacattatcattgaaaaattattttaaattgttattttgaatgttattatcagaattagtttttcatcttggaggtgcttacttttaaacatctttctaaattatgtttagaatcagtttgtcagaaatactgtattaaaattttttttatatttatgcctttcatgatctctgtcctcttacaaaattactttttatttatatatggagtcttgcctataccttaaagtgatgcattctcagttaatcttataactagtaactaggggatgtaagagaagggaagaagaactaatactcattggattcctgctgagtgccaggcaggctattagaaccatttgtgtacttcagtcttcacagctactgtgggtatagctgttattttcctcattttacagatgaagaaactgaatctcaaagatgttaagtaattcatccaaaaagagaattccagcccaagtccagctaactcccaaacccatatattctttccacaatacaactcatggatcatggaactagaataagccttagaaataatctaagcctcttgttttgttaggaaagagaggctcagagttgcaaagttagttatccaagaatgctactgtgttcttttatgctttagtcaacataaagaatgttaactctttctagaattatttttaaggagagatgattctgtgaagtacagaaatagcacagcttcatttttaagtaccttttaagagaaagtaatgagacagctgggagatacagatacacacagacacacagacacacacacacacacacacacacacacgtgtgcactatattagtttcctgttgctactgttacagacttagtggcttgaaacagtatgaatttattgtcttatagtcttatagttccgtgggtcagaagactcaaatcaaggtattagcatggctgagttcattcttgaggctttaggggaaaaatccatttccttgcctttttcagcttctagaggccaactacattccttggctcatggctccttcctcacatcacttatcacatcccctactactgaccctgatcctcgtgcctctctcttaaagtacccttgaaattatattgggcccacctaaataatccaggataatcacccccatctcaagattctccgcctaatcacaaggctgtttttatcatgtgaggtaacattcacaggttccaggaattaggatgtggacatctttggggcaagagggcattattccatctactgcacatgtgtacccacacatgcaggtgttgggtgtgtgtttatcacacataaattaaaacctttgttatccagggccatctgggaattagccattctaaataaatgttttctatatcgctatatccaagtcgtatttttaaaatttcctttttatggaaaatgttccaaaaggtgctgtcctccctgcctttgaaaactgttattctcaatataattttacctatcattgagaaaaggtggctaccattgtaaacatcagttattgagctatgcttcaaatacagctataaatgccaatgtaggcgtaactagtttgatacacagaactcagcgggtattaacccttgcaatggaagtgcagtttgctttatggtcattttttatcatttgcttgtttgtcaggaacatgacatgaaggatgtatagctgcccagccccctgatcaaaataatgtgatgggctttctggaaaattgagtcagagatcggagtagtcttgtaggttaagggtgggaagacttcttttctcagcctctaaacttctccttctggcagttgcaaattctttgctatttgtcactattcaaaacattatttcctatttctgaatcactaatatctaaggaccgcaaacaattccttatcagtttgcaagtattctttctcattttccctagtttgttgataaggtctagaaaagaatgctggctgcttcaagggcttttattagcgagtttttaccttgattgtagaacatgtttgctgatgtaaccagaccactcatttcttaggttctctttagcatttaaataggaagtagcagcaatacaaatgtttatgttggagtgcccggcacatattgaatgcttactgaatttattatttctattattagtttagcctatatgaagccccttgtgaaataatattataacctgtaggaaaatttagtaaaggaacatgggacagaaaaatgttaaagagatcttctccttcctcaggatattctctagtcttccagcttttactcttaagttatggttctaaaacgctcttttacctaaaaaacaataagaggttataacccctcagagaccacgagcctgtggtgtgttagcatttgttcaacaaacagtgggctctttatgtatgccaggcagtgctttggacatcagttgaaagacaatactttcatgagtaattcatgatttcatgaggaggtcctactgcaagtatagtattgaagtaggaatatgatggcaggacccccaaagaggagattgcttacatttcaatagataaacacataacacttcttaaaacttagggatcaagattttgtttcctgcttcaaaaggtggtagttgtgggagtctctgacattagaacatgttggaacagtcagtgtgtctgtttaattcagtgtggtttaattcatgaacacctgtcagaatagaagttgacaaacatcatcatcaaagtagatccttttgttatcattataaaatattcaagtttaaaactctgtccagaaattcacaggattctttgcaaactcaaattttattatttttcatccagttatactttggttttaacgaaatgtctccatttaaaacaccataaagtcaacaaaatttattaaaatttttaataaaaactgagcaaaagatgtgacaaactgtagaggatatccagataacacataaacaaatgaaaaagtgttcaacattattagcatttaaggaaatgtaaattaaaaccacactgaggtatcattacaccttatcaaaatggctataatgaaacatagtgataacaccaaatgctagcaaggatgcagagaaactagatcacattgctagtgagaatataaaatggtacaaccactctgggaaggagtatggcaggttattataaaactaaatatgagcttaacatatgacccaccaattacactcttgggcatttatctgagagatataaaaacttatgttcacacaaaacacatacacagatgttcatagcagctttatttgtaatagcttgaaaatggaaacaaccctgcgatattgtgatttttaataagaaatatatactatttggtcctgatttttggcacaaagctactaaaagccttgcgatctcagaaatgttaagtgtcttctgatgctaatgaggtgactggtggctggggtctcctggaaggcctcaggatggaagctggttgccatcatgtcacaatcatgtgattagagggttggaactttcagcccctttcccctataaccctcagggagaggagagcatctgaaatttgagttgatcactaatgaccaatgatttaaatcaatcatgcctacataatgaagcctccataaaacccctaaaagcaaggttcagagaggttctgggttgctgaactcatggaggttgttgtaccccaagagggcatggcaactctataccacccccaccaccccaccccaccccttatggctcgtaccttaccttatgcttatcttcttaactgttcagctgtatcctttgtaatatattttataataaaccagtaaaggtaagtaaaacgcatttatggattgtgtgaactgctttagcaaatgattgaacctgaggagggggttgtgggaacccccagtttataacagtcagaacttggattggcatctgaagtgagaagcagtcttgtgggactgagacctaaacctgtaggttctgactctaaatccaggtggatagtatcagaattgaactgtgggacacccagctagcatcagaaaattagttgtcaggagaaactcctcaccccacatttggtcacagaagtcttctgtgttgagagagtaggaaaaacattttgattcttccaatctcatagaaacccagatgcccttcagtgggtaaatgggtaaacaaattggtacatctattactgtttggttcttagtcttatttggagaaagaattctgccaagctactggtttagccagagaaagagaattcattgaaggaaaatacagagtagggagtttatctagagagacagtacactctgaaaagatgaggcagggcgagctgctgaaagagagtgagccagcagcaccccgagagtggtgggtttttatgatttcagattttttcttgaagttcctgcctctttcttaagtctccgcctttttactttgtttagttttctgcatctgccttaagtccctgccttttccctcacctagttcccgccccaaggttgtgggaccctcccttactattggtgtgcacgcgtgaacccgatgttggacacaaattgcttctgcgtatctcttaggaattttctcctttgccctcttccctttagcatgcatctagctacattctggcaggttaactggcagagtgagcaatcactggggtcttaagggggattcctttctgcctaggtatttcccctcctgtctgttcatatctagcacgcctgtttggggtgatccctggggcatgagattttccagactccttttctcagggcagcccttctcctcctcatgtctgtttatctgcctattctaccacatctatgccgtggaatactactcatcagtaagaaaggaacaaattattgacacgtgcaacagcttggatggatcttaagggaattgtgcagagtgaaaagaaccaatttcaattggttacctactatacgattccatttatatagcgttcttgaaatgacaaagttgtggagatgaggacagagttgtagttgccaggaattgaagtaaagggagaaggcaactatggctatcgcagggtaccatgaagaatgtttgtgatagagttgtttgtgtgttgactggtggtattcacacaaatctatacatgtgataaaattacatagaactaaatatacttaatatgcatgagtgcacataaaaatgaaactggaaaaggtcagtggactgtattaatgtcagtttcctgcagtatactgtagttatacaggatgttttcattggggaaaattgagtgaaaaatacatgggatctctttatttcttacaactgtacatgaatctacaattatcccagaattataaatttttaacgaaagaacagaggcattgatgctgagagacaaaccgtaggcttttggatcagcacaattgtgttcaaattctggcttccacttaccacttgtgggatcttgagccagttctttaacctccctttgccttagtttcatcatttttcaagtggttgccaataatattattttccctattgagttgttttgagggttaattatcaatattatgtaagccactcattggttaaattgggatcgtaaaaatattttatcttttcatttagcacttaaagggataggcactctgccttctccagagaaattttaatatcacgagatagtctctgtttcattaacttaggctagtgtctttatttcttctttcatggagtttactctgttgttcttttactaccttcctgagttggacacttaactcattaaatatctgtcttccttcctaatgtatgtgtttgaaactgtagatttctcttttacaactgttttagctgagtcacaaaattttgatattggcaacccaatattttcattgtcattcagcaataatagtaactgatttttttctttgatccaagaattatttgaaaatgagtttttcagtttccaaacatatgatagggggatcttttatatgtagattctgactttacattatggtcttaataatgtcaattctttgaaatatgtaaagcttcttttgtggcttagcatgggatcagtttttacaaatgtttcttaaatgttccttaatcattaagtgtaggattgtgtcttcattcactcccttgattttgtttatccaattgttcagatctccaatatccttactaatctttagtctggttgacctatcagttactgtggtgaaaatgtccctctttgattatagctatgtcattttctccttataattttgcacatttttactttgtatacttttggctatattgttagatacagcacattcagaattgttactgttttcttgatgagttgtttattttatcagtaacgttctttgtttctaacaatgctttttcccttaaacatattttgatctgataatatagtcatttaagctgtttttgttagctagtgtttacacagtatatgtatctaggatttagaattctcaggaaaaacatttctcttctcattctagagcccacgctttctttggtaagtttctttgctatctctgtcataaggcatatcttttcaagtccatgcatttactgaaagactagccattcgagtttcctaattgatataagggcgctcaattctaaattcttgcaacatacaggcctaagatttcatcttctttttccatgagggcatcaaaacccaaacctccactttattaagactgagtaccatcttttactcccttccctcttcccaaaaccccacccatggcaggtgcagtctcagcttgttgcgcttactataatttttggtttttaattctgggctctgggaattccccttacagattttgctatgcattttaaagaatgttggttatattttcttcaacatttctaggcatttaagatgtgtatgtaggtgtcatggattatctggtctggcatgatgctagaagggcagttctcattagaagtactaatttaacctgagaatgatgtctcttgttcgacaaccacataagtctctagatttgccctttctgagacttcgcatcatgtaaattacataaatctggtgtttgactggatgctggatgccctggtggagtggcagcacctgcagagatctgcatgtgtgtttttcttggttcagagctattttgaacatagggtaccaaaagactgtctttagaaccctgagatttttgtatatttcaacttaaaatttaagaacatttatgaacataatattaatcaataatattcacatcttattgccgtttacataacacttttattaaacagttttagtagttataaaactgatttgcacttaattattttcgtagttataaaactgatttgcacttaattattttcagttgaagtgttttacaaatgatatggtcatgtttcacaattacatgtaagcagcatacagtggtgatctagctatcacagggcaaaggtaggatgcactaatattacgttttaaaaataaaatttaagaaggaaaaggtttctaaattacagctaattgtaactagtaatataactaaaatagtaaattgtaactactataattatactaatatagttctatgaactgggcatgttatttatataaatgccttagtttatgttttaaaactgtgttataggccgggtatgttggcttacacctgtaatcctagcactttgggaggccaaggcaggcggatgacttgaggtcaggagttcaagaccagcctggccaacatggcaaaaccctgtctctactaaaaatacaaaaattagctgggtgtggtggcgggcacctctaatcccagctacttgggaggctgaggcaggacaatcgcttgaacccgggaggtggaggttgcagtgagcaaagatcacgccactgcactccagcctgggcaacagagcgaaactctatctcaaaaaaaaaaaaaaagaaaaaaaaactgttatagaataatatttattttctttgtattagtactctcatgctttttggtgtttgaatattataaatgtacaaaatccttaaaataactggaatctaacaaaagttttctttgaaattttttagaagtcagagtcagtttctccccatgaacattcctgtagttgtatcaaaagtaaattcagtccctaaaacatttgttaaataacaggactctttataagaagcagaatgtcatggttttgctgttgatgtttatttctctgtgcccaaaatgacaaattctaaaatgatgatctctgttgattaatctcatgtgcccaagaaaaaaatcaagtgtatgttaaccaatagcctgggctattttgtctgataaaataggcaattttattagacaaaaattgtctatagatactgttaataaacactttgtctaacaaaatataactttacattttcttgtaggttaccttccgaacaagaatctatcactgtaatattaacagccaaggtgtgatctgtctggacatcttaaaggacaactggagtccggctttaactatttctaaagttctcctctccatctgctcacttcttacagattgcaaccctggtaagagactttaaatctagtatgaattggagcttgtcaagatttaaatgtcagacccttagtaacttgtttactactgctactaccactaccaccactgcttctactactattattgttaaattttcatagtatgtaactattttctttttaaattgggtcttctcattagtgtttttaagacctatcatttgccaaaaaggaaaaagtatagtgtggtaaaaaaaataatgaaaaatcattttagatgggaaagtacgtttaaagaatgaattaagttatcctgccaaataataataaaaattcaagttgaatagcttaatctttaattagatgcctactagaagatgttaatttgaggaatgtgggctattaaaatctgataacaaccaggcagcaccatgcagacgtgacctttttggcatcctagtaactgtgcatcctgacaagctattataacggtcctgaatggtctgttctaggaaataccccaaaagtaaacaaggaaatacacctcccaagaaaacgaaaaagtctatagccaggcctttatggcttgctggtgtgcttaccactgaaaattcttaattcctgggccatgtctttacaaattgggtttattttagaaaatacaaaaatccaaagatagctatagggttttcattgatgttctcagtgggagaattattttatgagtaattaatagcttaaatattgcatgagattccctcttctacaatcatgagtaaactctgttcactggatacatgaaattttacacaaatggaaatgacgagtatcagtggggttgcttaggatcctggctgttttataaaacatcaagaaataacagtctttctacttttatatttctttatttttcagcagtaaaatcttttttaaagtagcaaattagtattttttttttttttttttttttgaaactgagtctcactgtgtcacccaggctggagtgcagtggcacgatcttggctcccgcaacctccgcctcctggattcaagcgattctcctatcttagccccccaagtagctgggattacagccgtgtgccgccaagcccagcttatttttgtacttttagtagagacggggtttcaccgtgttggccagccaggtctcgaactcctgaccttgtgatccgcccgctttggccccccaaagtgctgggattacaggcatgagccactgtacccagcctgcccaaaaaataaaattgtgcaggatcattataaaatattttttgaattaattcatactttactacagacagtaaagtccaataatgttatactaatttaaagttaattttgttctttcagtcctgttgttcccattttaatcccatttgtctgtgactgtgtataaccttgtataacctcatttggaggtaatgttgcaagaaggctttttttttttttttttttttgaggtgatttcgaagcctggcctgctttgcctccaagtcagctgaaatggaatctgttaccctgaataagcctgtatatgacagcctgttctctctacagatattcctgcttaaaggaatagattcattccaccaaagccttctctcagcaatcaaaaagacttctgttcagtgaactagttttttttttttgctccgtttcagaaaattacaaatgcattctgcaaaaacttaaaaatcactcctaactaaagcagaaccacataagtaaaagaaatagattttgaaataatgctattgatagtaagaacaagcctaaaaataatgttccataaaaccaaagacagcctgcctcatatgagactagaagagaatttgtaaaatacatgctaacatttagtttatcacactttttaacacataaaaataaagtttcctaattggtttttatgaatgttgacacttctagaatcttaaatagagttgtttattttaaagtagtcaaatgtccattcttttgcttaatggacttatttcacactgttatctggtacactttcaatctctgtaggtttttttacctacagaggtaggaaagattaggttagattgaagtttatcttaaatctatcttcaaattatcacaaaaacaagtttgatagaataggaataaataagattttcctacactgaatctgtagagctattttaacccggaaatgctgtcacctcaaaaataggccttgtataatgatacaaatttaactcacttaaaaaatactttctcactcttatccatacataaacttattttctaaatctttttcatactctttttgtaatttgcacttgtctctttaaagaatttttggtccattccaacacagatgttctttagggtatgactacccatccttatcagcatgatatttgtagacagcagatgtagatttgaaaaccagtttaattgtttattagtcatatcacattggatgggtcacttaactttccacaggcttagtttttgatataaaattgggattagtaccagccctgcctaaatcactggattcctctgaggttaaaatgagatggtatatgtgaaagccatttataaatggtaatgtgttgttgatattgttacccagagtatttgggacaccaaatgggcccacaataggtgaccgataaacacctactcagttgaatttaactggggagatagtatcgaatagtatctaacgccgtcacctcaacattgacacttggattttacaatcgaaaaaagctgaaccttgacttagtaggattatcactcaggtggcagatgtccaaacgttatcagccagtcgatgggtgcaccagcaataatcattctgttttcaatgcaattgtctaggtagatctaactgctggtcttattaggccaccacttcatgatggtgtttattgagcctgatagagcattctttttttttttttttttttttttgagatggagtctcgctctgtcgcccaggctggattgcaatggcacgatctcagctcactgcatcctctcctcccgggttcaagcgattctcctgcctcagcctcccgagtagctgggtctacaggccccaccaccatgcctggctaattttttgtatttttagtagagacaaggcttcaccgtgttagccaggatggtctcaatctcctgacctcgtgatccgcccgcctcggcctcccaaagtgctgggatgacaggcgtgagccacccaaccagccaagcattcttatttgttagacgttacctggctttttctgagtttagtcttgcttactaaacattatttaatttgtgaattgccaaagttgagaataccattggggaatcaaatttctgtgctttcttatttgtaagtactttcttctggagtcattatttaacacataaaatttaagttctatttggtttcatcttttgaagtttgtttttgctattttgtggactttttaaaaactcttagatgtttggtaatattctttatatgaaatctgtttctttaacaattatttaaaatgtgcttatattatggccttcagacctatttaaaaaatgggtattttacctcatgcaaaattaatcattgtgagaacactgacaattagaagatcaacagttttcctttacctgatgcttagtttacagagttatggctataaatatttctaacctttttttccttcttgagacgtgtataggtctgtatatcatctagcattattttattaatctcatttctatttgtctgctctactactgttactctctaaagtgtttttgagcttgttttgttctaaactcagttatgatgtatcatttaaaattttcccccaaatatgtatgactcttatgagacagtcagaaagttgacaatgaaacatttgatattgagaaattattgccagaaatttttgagcatgacaatggaattgtacctgtccttaccttttagacatctgtactggactatttgcaaataaaattctttgatatatggaatttagttcaaaataatccagaaagattgtagatggggaggaatatggaagatactgagattgaccattataactgttgaatctgagtgatgagtatacacatgggtgctcattatacttttctatgtttggatatgtttgaaattcttcttaactttttttagttgctaaaaatcagacatactaacagtgtgacataagtcctcgtttaatgtcatcagtaggttcttagaaactgcaacttttagtgaaacgagataatgtataatgaaaccaattttaccataggctgattgatctaaacaagggttaatttcccgtggcatacagtacttcattttgcttgaagttgcagtttccaagaacctatcagccacattaagtgaggacttaaggtaatctgtaagtggtacgtgatttggctctcttttgctcttgaagggaatcatctgggctctgaccctggcttgtgtatttcattcccctgtcgtctgccttcagaccataagctgccttgtggtgcagcctggaccagcaggggcttgcattcgtaagcaaccatgaagtctttgtctgtctctcttcaaacaggcagaactatacaggtcaggtcaaatgaaaatgctctaagcatacccacaaacatcaacactcaggatggatgagctgctccctctccctgcatcacctttcaaataaaaatcaagtatcggttactccagtcttagatgtgtgcagatctgtattagaacagcaaatagagctaagaatggccactaattaaccctcagccttgtatagtgattaagctgagggtgagcacagctgcagtttcattggtaaaagctttattcttctcaaatggactgagcaaaagaaaagaggaatttgctcccagtggctcttttatagtgatctataaaagcttgggagaatgtttccttcttcattctccaacatcacaattttttgtttcagatcacttaaggccctttttttaagcaatgaaaacaattcttattcataaattgtctctgataccttagctttgattgttattaattgcttatctttggattagttatgattaggtagtaaattgtgttagtaaatattaaaattttacaattgatagtgactgctggtgggtgggaaccattaagtcagattaattatttcagcacatttatatttgtgtagattatttataccaagtttgggagccgctagactgatgaaaggtacatataacacctcagtaggattctagtgcttacacaatagtgtgaaccttgctgctgcatgtctcattctactatacttgagaactgaaaaagaacaatttctttaactgaaattcaggtaaaatggtaagtctacctgttttcaaagcagactgttttagcaggactacaaaaaaaaaattttttttcctagaacaataactacagttggctacctagataccagatttcttctgatgcctatggcttttttaaagtgaaaaatattaagtagaaatacgtggcacaacatatagctaacttcagactgttttcttgtgaaaagttggcttgtcttctgtcaacttctgtctacctgctaaattctaaaagtcactctaatcaatacttccaaatatggatgtggagagactccacattattgtcatttaacttcactggcacctcatacaaagaaaaggaaagctatggttatagagttcatactttgctcctgttgtttaagtaaatattaaataagtgctattaatcaatctacctggtatttttaatagcaagacagtaaacaaagttcaaaacgtttattaaagcctttgggttccaattcagtattacctgtagaatcctgggacaccgtccccttccctcccctaagtttcccataggcttactcagatgcatttgaaaataatgctattcataatgttgaggttctagaaaaattgaaggcttattaagatggatgaataaaatcagggaatatacgttccctgttttgtgaattaaagaagatatacagaagtgattgtgtaccatcataaatttggtttaaaaaaacaaaaaataacaattctgagatgcttaccttgacccctacatatttgtaaatgcaaattttaaatgatattaaaaggattatttccctactttgtcaattctgtaaaaataaaccatttctttagttgtcttacaagagatactggtgtataataatgcaaacaaaaatatccattagtttgtagcacttttaccaaagaatgattttctaggaaatactgaatgagaaaggaaagccaaaattaccccattgtaggcttagatcttggattccctagttgtgaaacaagtcaaaaggattcatcctctttgactcaaagagttaccaagaaaggattggtagcttcaggtgagggatgacttcatgacaaagcaaggatttcctatttagcccatggtatttctgctttgtgtgggcaagtctttatttataaccaacaatttgatatcctcctcaaacatccaatttgccttggtgaaaaggagcattaactgtttattcttttttgatagattcttactagaaatgctgacctgctaaaactttgttactttcataacttaaatatacgtcctttgataggtttgattcttttaaagatggttaaaactagactttaccatatttgctaacatatgggataccttaaaaagtgcttttaaagtttaaagtttcacccttatctcttatctaactaaaagggcctttggagaaattacttccatttggtaaataagaaaatacagtgttgtgtttatcatcttcatgtatcttttccttacttctgtttccttacttctaacgcagggagtatctgtcaactttacttgacctataaagtgctaccagcatttttaaagtaggaaggtaaatcccttagagtgggaatctgtggttccttttctgtttctttttgactgttacagagttgttcacgcatccatttcaggtttctgattggtgtgttctgtaatagcaggtacagtaaaatcttactagttcagtataattgagaaaagatcagactgattttttttaatgaattggaaattttcactaagtgaagacgtaataattttaagtacatataggaaatattaggtaaaatgtgtgaactagatggcctctagactctcctttaccaaggaaaaggctgaagtgggtttttcacacattcacaaaaaatagagaaaatggttattataagtcccagtgtgtccctcacccagcttcagaactcacctatatttagtaaggtttaggaattagggttttttgtttattatttatttatttatttttagagatggggtcttgctctgtctcccaggctggagggcagtggtgtcgtcatagctctctgcagcttcgaactcctgcactcaagcaaccctcctgcttcagcctcccgagtagctaaatattctcagataatattgttttaataccattaattttcatgaaaaccatttttaaacaagacctagtaaatgtcagaacaggttgctgcatcagaattaagttagcagtggtgaacttaagggtatgttactaaaagatacagcatgtgccctgtggaagataagccactgagtaaagtttgatgcccttttgtttgtttgtttgtttgtttgtttgtttgttttgagacagtttcactctgtctcccaggctgcagtgcaatggtgcgatctcagctcactgcaacttccacttgctgggttcaagcaattctcctgccttagcctcctgagtagctgagattacaggcgcgcaccaccacgcccagctaatttttggatttttagtagagacggggtttcaccatgttgatcaggctggtctcaaactcctgacctcgtgatcctcctgccttggcctcccgaagtgctaggattacaggcatgagccaccgtgcctggcagactgacacctttttaaaaaaatagagagagagatgaaacctcattctgttgcctatgctggactgtagtggcacaatcagaactcactgcagccccctaccggaactcctgggctcaagtggtctcaagtgatcctcctgcctcaacctcccaagagctgggactataggcacatgccaccatacccagctagtttaaatgtgaaatcaggctttttaaatgtgaaatttttaaacatgaaattaagagaaattatttaaacagcatgtttaaacaatacatatttgaaattaaaataatgcattgttagtgttatggaaattccaatctgaaacagcataataaaacaactctaattattcagtaattgacttgtgtggacaaaacatccagatgattgaatgacattttctctttttactgtgaatacttaagattgtacagtatcttgggagaaatgttgtaattatgaaaatttgaagaattaatgtaacactaccaatgtctgagtcagatcccataacaaatgggcagttctctttattttacttattttctgactcaacttttcattcagtatctagcctgggcaaggtgctatcagtaacaacactcacagtgcctcttcctcagaaaagaaagcgcttccaaaatgtcagattaattattcctatacaactgtaataactactttctctttttcttctcttcatatttgttctttagtagatcctggagcttaatgtgtattatggctgttgaatttttcatgtcatattggtgaataattcacacaataagcagtacaagagtttgcctaaattactagcatatttctttctggagcaggtctgttcctggaaaaaattacaaatcagaatattttacatgtattggaagaactttctgcttaagagtatcctacagggaaacctgttgccacatgaagcttttataaagttgaatttttggaaaatgcaatggttcttccccaccaccgccccaattcagcactgtcttccttctgaaagcattttcccaaataagacatattgtttgtgctattcaagtgcctcggccaaccaacaaatgcctatctgactatgtgcctataggctgatgtagttagtaccttttgacgtgactctttacaccagtgaggtaaaccaccttccttgcatacattgtgaccacatgtgtactccagtgactttcttgtccagactggctggctcctgtgatggaaaaaatgttcatacacagactaatttaaatacataagggaaactaggaagagtgcaggcctagagaagatgtcttcatagtttatctagctttggatgccagcattatatttttataagaaaaactctagaaaagagttcagcttacaatgcatgaataaccccgcatcactggggcaaaggcatattagagtgccagccacccgtggtcatcgtaggagggtacatttatctgagggatgtgtattttttaatcttggtaatagcctactagggatggtatattttaacttcagccttactataaatggttctgtatctgcgggtaatgcatcttttctgtagattcataatcaaaataatgtggttagcttagagttggggttaatcatatatgagttcaaaaagttaatagtccatgtccaatttggtaaaagtttgtaagtgaaaaattactatttgggggaagtttttgtttgcttctttgatttgctggagaaatgatttaaagttgcagtattgtaactaggcaaagaagcctttgatttagatacatgtgggagttgcatttggggaacttaggccatgtgtatcttcatagtattcatggtggagagagagtgttttcaggtgaaaaagaaagttttagattcattccttaataaaatgtattttctgtattggctttttgttattttcaaaattgatgtatctttattattttttcttatacaaataatacctgcttattaatttttaaaaatcagtcgtcttttcaagataagtatttaatttttatttgaggctctttgctctgggaactcaaatttggtgggacccagcaaagtatatttgtcagttaagtttgtctggttataatcttggtgtaaatttagacacgttgacctcagggatttagccttggctttgacctgcttttgcttagcatttccctatgcatattttattgtctcttaattaatataaatgtcgacatggattagctgttgatacaaattttcttttataaagtccattgctctccctgcagtagtaacctctaattggttggtttagaagttgatcttggctaggtggctcatgcctgtaatcccagcacttttgggaggccaaggcaggaggatcacttgaagccaggagttcaagactagcctaggcaacaaagtgagaccctgtcgctacaaaacataacaaacacttttaccacttctattcaacatagtaccagaagtcctagccagaacaatcattcaagagaaagaaataaagggcatccaaactggaaaagaggaagtcaaattatctctgtttgccagtgatgtgatcgtatacctagaaaaccctaaagactcctccagaatactcctagatttgataaatgaaatcagtaaagtctcaggttacaaaatcagtgtacacaaatcagtagcattgctgtatatcagcaacagccaagctgagaatcaaatcatgaactcatttcctcttacaatagctgcaaaaataaaataaaatgcctgggaatatagttaaccaaggaggtgaaggatgtctgtgaggaatactacaaaacactgctaaaaaaaaaaaaataataatagatgacaaacaaatggaaatacatttcatgttcatggattggaagagtcaatattgtgaaaatgaccatactgcccaaagcaatctacagattcagtgcaattcctatcaaaacaccaaaatcctttttcacagaattagagaagacagtcctaaaattcatatggaacaaaaaaagagcccgaatatccaaagcaatcctaagcaaaaagaacaaagctagaggcattatgttacttgatttcaaattatactacaagtctgtggtaaccaacagcatggtattgttataaaagtagatacataaaccaatggaacagaatattgaacccagaaataaagccaaatacagccaactgatcttcagcaaggcaaacaaaaacataaagtggggaaaggacaccctattcaacaaatggtgctgggataattggcaagccacatgtagaagaatgaaacttgattcctgtctcttaccatatacaaaaatcaacttaagatggattaaagacttacattgaagactaaaccataaaaattctggaagaaaacctaggaaaaactcttttgggcgttggtctaagcaaagaatttatgagtaagaccccgaaagcaaatgcagcaaaaacaaaaataaatgggacccaattaaactaaaaaacttctgcacagtgaaagaaataatcctcagagtaaacagacaacccacagaatgggaagaaatatttgcatactatgcatctgacagaggactgatatccagaatctacaaggaactcaaatcagcaagaaaaaaacagtcccatcaaaaagtggacaaatgacatgaatagacatttctcaaaagaagatatacaaacggccaagaaacatatgtaaaactgctcaacattactaataaccagggaaatgcaaattcaagctacaatgaaattcacctcagccctgccagaatagccattacttacaagttaaaaacagtagatattggtgtggatgtggtgtgaagggaatgcttgtacactgctggtgggaatgtaaattagtacaagctgtgtggactatggagatttctcaaagaactacaagtagatctgaaggggtgggttgcccctccacacctgtgggtgtttctcgttaggtggaacaagagacttggaaaagaaaaagacacagagacaaagtatagagaaagaaataaggggacccagggaaccagcgttcagcatatggaggatcccgccagcctctgagttcccttagtatttattgatcatttgtgggtgtttctccgagagggggatgtgtcagggtcacaagacaatagtggggagagggtcagcagacaaacacgtgaacaaaggtctttgcatcatagacaaggtaaagaatcaagtgctgtgcttttagatatgcatacacataaacatctcaatgctttacaaagcagtattgctgcccgcatgtcccacctccagccctaaggcggtttttccctatctcagtagatggaacttacaatcgagttttataccgagacattccattgcccagggacgggcaggagacagatgccttcctcttgtctcaactgcaagaggcatgccttcctcttatactaatcctcctcagcacagaccctttacgggtgtcgggctgggggagggtcaggtctttcccttcccacgaggccatatttcagactgtcacatggagagaaaccttggacaatacctggctttcctaggcagaggtccctgtggccttccgcagtgtttgtgtccctgggtacttgagattagggagtggtgatgactcttaaggagcatgctgccttcaagcatctgtttaacaaagcacatcttgcacaacacttaatccatttaaccctgagtttgacacagcacatgtttcagagagcatggggttgggggtaagatcatagattaacagaatctcaaggcagaagaattttttagtacagaacaaaatggagtctcctatgtctacttctttctacacagacacagtaacaatctgatctttcttttccccacaagatctaccattcaatccaacaatcctactactgggtatctacccaaaggaaaataagtcatttatatcaaaaagacacctgcacatatatgtttatcacagcgcaattgacaatcgcaaagatatggaaccaatctaagtgcccgtcaaccgatgagtggttaaagaaaatgtgatatgtatacaccatggaatactactcagccataaaaaagaaggaaataacatctacggcaacttggatagagctggaagcctttattctaagtgaagtaactcaggaattgaaaaccaaataccttaagttctcacttataaagctaagctatgggcacacaaaggcatacaaagtgatatggataattggagactcagaagagaggaggtggggcagttggtgagggataaaaaactatatattgggtaaagtgtgcactactcacgtgtaggtatactaaaatctcagactttaccactatacagtttatccatgtaaccagaaaccacttgtatccctaacactattgaaataaaattaattaaacatttttaaaaatttttcaaagaacttgatctgattgaaaagtcactgtatcttatgaaaattctcttcagtttatgtttagaagacttcattttggagttacccttaaaaattaccagtgacctatttttgttgtcattgttcttgttgtttagagaaacaaatatttcacttaaacaaacatcattctttactcacatgtcttttactcagaactatttgcccaagaaatgattcagagtttctttgtttcccttacttgaggaatttctgaagtcaagaacatttagatttttttttttttttttttttttttttttggattcggagttttactcttgttgcccaggctggagtgcaatggtgcgatctcagctcaccacaacccccacctcccaggttcaaacaattctcttgcctcagcctcccgagtagctgaaattacaggcatgcaccaccacgcctggctaattttgtatttttagtagaggtggggtttctccatgttggtcaggctggtctcaaactcccaacctcaggtgatccgcccacctcagcctcccaaattgctgggattacaggcatgagccaccgcgcccggcaagaacatttagattttaattaatttttaaaaattatcttttaatgaagataatgaaaagataaagattatagtggtgaaaacagatgattaattctctccactctagagtaaaaataacttttctctaatgacagggagagaattatgtattagtatatatgccagttatacatgcttttttcccatagttttatccgtgcttttttgatgacttggattattctgtttctgttagagttattttattgagcatacatattttattgcaaattgactcttgtttggcaaagtgaggtgtataaataagaaattaagtttttttgcttatggtaggatcaaggagcacattttgtaactaccctgctcactatttgggtttatttacagcttctctcaagagaggaataactgtgtcaggctttgctaagcaatctcgttccaacaataagacatttttttctgtgtctgttgtccagctgtttagtaggttcttggtctccacactaacagaaaggtttcaggtgttactcccaggcagggatttaccacaggtgtgtgtcttttccaccatttaaaatacccagaaatgatgagattattaagtagctgactatggtctgtatacttctcttagttcttcaccagttgctgcttttgaaattcttaagtgctatttctttattggttcatttgttttgctatttagatttatttccccattcagtctacatttataatgtggtggtctgttaatacagtaagcttgttattggtaaatggagtcattctagtgaaatttattgtcagaaacacctgtacctgatttataactaatgcagcatggattttactttatgcaaattaaacaaatgtgttttaaaatttgataacagcataaaacaccctcgaggatgttgattgctcaccctaactcagaaggctctcaaagctgatacttctcttcctaaataggagacattcttttctcagtagagatccccatgtggctgtcacattcttttttcaggtcatctttcagaatgtactaccttctgagacctctgatactacccacccagccctaaggaggtcccagtgaggtgatcacattgacttttaaaaaacttttatgcccagaggatttgttaaggaagctattcccatactttgaagtagctgatgtcctcagggacctggtgtgaataccggagggaagactggagggaagagtgatactcttaaggttagcattagactctctcctctgcctgcctgcagagaaatagccaaatcagtgtgaactactggcttttatatacatatgttctcacatcagcttactcatgactgccttctaaagactgcctctttcaggaatcctaatagaaaaagcaactaagagaaagaaaatgaatcacgtcagaggttacagaaattataacctacaccatctttcacaactagaacatcatataaagctgtttcattatttttcttactccttttacacatttttcttactcctctttgtcttgttcctatcagcccagggactctgttgcattttgctttactttctggtgtttgtaatataaaaacaatttatctattgtacatgttttccatttccagtacatacacatgcacaaaccccaccttcacctcaggctttgatttgactccaccttcaagctggaagcctaaccctctatgggagtcactaagatggagccaatggcaaactgaagtggaccagcacttacttacttctttaagacagaactttgcggtgtattcttggttgttccttctctctaatcccttttcccgttagctggtctcttctctctgcatttccagcctcctgatttttctgctgctgtttctcttctcttttcttatccttatggttcacgtgctgctctcctccttaacttcatttaaccttgcttgcactcagtaaaatatttaaaaacaaacagaaggacttccaagccatattttttattttttaagagtagctttatttattattatctctataaccatatgactcagcctgtactgtctgttagaccaatatataatcttggaatatcccttttcacttcatgtgccaagttggtggctcctgttcttctggtatgccagggcaagaatggccccatcagctctcaaaagaggtacatagtagcaactctgaaaatgtggctgaacactgtgagtaatgttgtagttcttgccagtctcagccagtacctaccttcttaataaatggcctctttccccagctaaactgtttctttttttaacctactttggaaaatatattaaagtcctatactttgtaagcagcactgccaaagcagtatcatgcacatagcataataatctcattttgatgttctaaagttctttctttgtcctttgtaatggatggcaaggttttaaatgaaaacactggagttgctccatagcatgagatggttttttattgttttgctctaagctgttgccctgatctctactacatttatgcctgatttctctaagtcatagtgacatgcccttgcatgcatcttttcagcaaaccttatgatgcctattgctagacttatcagtgtcaggtcatgagaacaatgcaaggttataccttgccatgttaaagaaaattaagtcaaaggacctaagttatactgagttttgaagctgtcaagaaagccagagccttggcccagctctctcactaactagctagtgaccttggataaatcggtgccctcatttgtgaattaaagattgtacttctgaccctatcttgcagcattattgtgaggaaaaaatggtatgtgtggacctctgtaaacactttgaaggctatgagtatcattacgtggaatgttattgaactgaaagtccatattagctgtgttaggtgtgatgacctcgcctttgagatgtctaaaaaaggaatttcaaccgggcgcggtggctcacacctgtaatcccggcactttggaaggctgaggtgggtggatcacctgaggtcaggagtttgagaccagcctggccaacatggtgaaaccctgtgtcttctaaaaatacactaattagctgagcgtggtgggaggtactggtaatcccagctactcaggaggctaaggcaggagaatcgcttaaacctaggaggcgcaggctgtagtaagacgagatcgcaccattgcactccagcctgggtaacagagagagactccatctcaaaaaaaaaaaaaaagcaatttcattctcagcataaaatctttagataactcctttatagtttgttaagtttggagtttcaaatgtggtggaatttactttctataaaaaaactagtaggaagaatgaattataactcaaacttgatttaatgattttaatttgctttaggctcctatttttataatctagataactattgaggattatcttctgtcatctataaaatgaattatgagtctgcctctttattcccagcacctataatgtacaaactgtattcccctatgcaaccccatgtggccaaagggctccccgtgaaattgccttatttcaagcccaagcctcttttaaccttgactgctatccccactgttcctttgcttttactctgtataaatctcaggcataagagacaacttaaaatatgtcaggatattatattagataacaaaactcctagaggtcaaagactatgttgtccagagagttttgttatcgcaaactcctggaggtcagagactatgtctagttaagatgggagtgaaactcaactttttcacttctgcttctggccatgaagaataacaggagccagatttacactcctaccttagactacctttctagttagaaaactagacattccctgagaggagaaacagatgaagtaagccctacaattgtccccagcttactgcctagaagcagtttccaggatactgtacaaggagaaagaaaccaaagagagaggccagcagtgtcactgagttgaggagacagagataggagtttgggaagatcaagatggctagcatttgtggggcagaaacccagagaagagggattgtacagagagaatgccctagaaatctgaagagagatccccttgagcctttggttaagtttgcatataatcatcaaaagatcctgccttattagtagggatgaattactctaaagactacattgcatctgctctaacagtttaaaagcaagttttgaaagtatcatactgttcctaaataacttaactccctgttagagtaaaatgcaacattctttggaataaggtacaacattctttatggaaatacaacaaattccaacactcaacaacataaaaattgcagtgttcaacattccataaaatattaccacggacttaaaaggcaagaaaagagaattcataaccagttgaaaaataaataaaaatggaaaagactaaaacatttttgtttataaaagggcaaccttttaagttaattactaaagcattataactttggtaagtattctcaaattgatttagttcttaacttcatgaaatgtgaatgctttaagaattgaccagcatgtcttttgcttagttaaaaccagaatattaaactgaagagaaacttatgttggctctatattagtagaaacatgcaaacagctatactattcaaacttgctagtaacttggggctactatcattactgttactgtaggacttacatggctggccatttacaatctaaagaaatgtgagtgggaagtaagagaatcacagaaacaatatgttgcctcattggatctttgagaaggtgtggttagaaagaatgggggcagctggaagaggattatcctggagtagaggacaaagaaatgtggggatgagagagtaaaaaggatgactgactagagggccttgcatggtgggagatgacgatagggatgtaaagcatggtttgctgtagctggtcccaggctcggctagggcctcgtataagggtgtgtgctacggactgaactgtgttctccccaaaattaatatgttgaagccctaactcctaatgtgactatatttggagatagggcttataaagaggtaatcaaagttaaactaggtcataagggtggaaccctgatccaatgggattcatgtccctttaaggagagacaccagagaactctgtctttctgccttgtgaggacacatccagaaggcagccatctataagcccccaagagtcctcgtcagaaaccacatcagccagcaccatgatctttgagttcccagcctccagaactgagagaaataaatttctgctttttaagccacccagtctatggtttgttgtatggccacccgggcagactaatacaggtgtattaaagttttagtcagcagccaggcttggtggcacccccctgtagtcctagctactcggaggccaaggtagaaagatcactggagcccaggggttcgaggttgcactgggccaagatcaggacactgcactccagcctaagcaacagagagagaccccttctctaaaaaataaagtttcagtcagaatgtcaataaaaatattctgcatcatgtaccaattcccaggggactgagggtgttgagtagatctggatttcatgataagcgcctgtttaactaaactaatgggttgcttttcatctaggcacaaggtaaagaaagcataaacaaggacagtcaccaaggagaggttttgggttttaacatttctacagttccaagaaataaataggagttagcacaaaaggaggtgtacgtttgtttctgcattcccactctacagttgattgtctttgtacaatcagcttctttacaaattgtactttggaacttttaagaatgtaaggttttgtggcatttctgttagctgacctcagttctccatcagttgttgccacatgaatgcaagtacattctgaaatgctattcaactaccattcaaggctttgaacaggcagctattgccataactcattcagaaaaacacctcaagattaactaaaattgtctttattccatgctgttttcaatccagtctaaaaactaccaacatgtgtatagcaaaattaattttgcaaaatgtacgaatagtattttctatgtaaatttttttatgttaagaaaaaagtattttactttctaagttttgataaaccctttcttattgatttttaatctccttgattatatccaccctggagttttatggataaaagttgaagatgattgtaggagaaaaatgagagagaaatagaaattttctcttttgtgttaatggtaaagttagcctacttacctaaagataaaattaataaattacttgacagattttcattgttaatatagcccaaaatgctctatatttcccttttatagtatgatagaaacctttggtcacactttaataaaacaaaatgctatattaagaatcattgatattacattataaactttatgacctctaaaaaaaaaaataatttcaaagaagcataacttgtgagcatgtggtaaagcggcatcccactgaagatcagtgttactgcttttaatctcttttaagttaatacttcagtatactggtagctataactatagggcctttgttttggtcgatgatatttaacctaccatttatgttaataaactgacattgctcttaaagtaggttgtacattaaccacccaaaattggacatctgttgctgaaggaaatggtttcattttctgaatgcctctgttccctttatagtcattttttccattattgacaatagttatttgcatttttgtagacatgaggaggctttctcaaaagccgtatccatctaataaataaattcagtaaagttacaggatataaaatttaaaatctagatagaaaagtccatggcatttctgtacacaagtgacaacctagccaagaaaagaaatcaaaacaatcccatttatgatagcatttaaaaattaaaatacttaggaataaatttaaccaaggagataaaagacctgtacactagaaaatgataaaacattgatgaaagaaattgaagaagacacaaatagaaagatatttcatgctcatggactggaagaattaatattgttaaaatgcccatactaccaaaagcaatatgcagatccaacacagtcactatcaaaatcccaagggcattgttcacataaatttaaaaaaaaaatcctaaaacttaccaaagaccctaaatagccagagcaatcctgaggtggggttgaggggggaagagatatcacacttcctaattttaaattttatttcaaagctatagtatatagctatagtaatcaaaacagtgcagtactggcacaaaaacagacacatagaccattggtacagaataaagatttcagatataaatccaaacatatatgggcaactaattttcaaaaagggtaccaagaagacacaatggggagaggatagtctcttcaaataaatgattccggggaaactggattgccacatgtaaaagaatgaaattgagccaggcacagtggctcatgcctgtagcctaagctacttgggtggctaaggcaggaggatcacttgagcccaggagttagaggtcacagtgagctatgatcacactgcattccagactgggtgacagagcaagaccctctctctttaaaaaaataaaataagaatgaaattggacctttatcttacactatacacgaaaatcaactcaagatagataaaagacctgaatgtaacacctgaagccataaaactcctcgaagaaaacgtgggtaaaagctccttgacattagccttggcaatgatttcttgaacatcacaccaaaagctcaggctacaaaagcaaaaataaataaatgtaactacatcaaactgcaaaacttctccacagcaaaagaaacaacaaaatggaaaaggacaactacagactgggaaaaaaatatttacaagctgtatatctgataaggggttaatacccaaaatttatttttaaaaaaactcatacagttcagtagcaagaaaacatataatccactggacctgaatataccttttttttttttctttttgagatggagtatggctctgttgcccaggctggagtacagtgatgtgatctctgctcactgcagccttatctcctgggttcaagtgatgctgctgcctcagcctcctgagtagctggtactacaggtgcctgccaccacgcccgtctaattttttgtatttttggtagagataggatttcaccatgttggccagtctggtcttgaactcccgacctcatgtgatccacccgcctcggcctcaaagtgctgggattacaggcatgagccaccatgcccagcctggtcctgaatagacatttatccaaagatgacattaaaatggccaataagtatatgaaaaggtgttcagcatcactaatcatcagggaaatacaaatcaaaaccactatgagatatcacctcgcacctattaggatggctgttaccaaagagacgaggttaagtgttggcaaaggtgtggagaaaagggaaacctcgtatactcttagtggaaacatagattggtacagccctgagggaaaacagtatggaggttcctaaagaaataaaaaatggacccatcattccctctgctggatatatacccaaaggaaatgaaataccacctcatatagatacctgcactctcgtgttcattacagtattcttcacagtagccaaaatatggggaaaaacctaggtgtccatcagtggacaaatagataaactgtggtgtatacatacatacatacataaacacacgcacatacacagagcagaatattattcagcctttaaaaaggagatcctgccatttactgaaacatggaaggacattatgctgagtgaaataagccagacacagaaaactattgcatctcatttatatgtggaatttttctttttaaaggtcaactatataaagatagcaaataaaacaggagttaccaaggttgtagtgtggggaaggaactggaaagatgtaggtcaaaggatataaagtaacaagtagaaaggtctcgtgtgcaacataaggactatagttaataatagtgtcttcaggatttttttctaaatgagtagattatagctgtcttgccatgggggtggggagggaaatgggtaaaagtgttaggtgatgggtatgttaatttgtttcactgtagtaaccatttttctatatattgtatcttttaacaacgtgttgtataccttaaatatacaaactttttttttttttttttttttttgagatggagtcttgctcttttgccagactggagtgcagtggtgcgatctcagctcactgcaacctccacctcccaggttcaagcgattcttctgcctcaagctcctgagtagctgggactacaggcgtgtgccactgtgcccagctaatttttgtatttttagtagagacggtttcaccatgttggccaggatggtctcaatctcttgacctcatgatccacccgcctcgacctcccaaagtgctgggattacaggcgtgagccaccatgcccagccaataaaatttatttaaaaaaaaaaaaaaaaaagctatactgaacaagatagggccacctcaaaagtaaacgtgaaaagaaagattagaatcattgataaggcattggtattaaaaaccagcttatcctagatttaagatgaaagcggtattgtggacatttgttaagtcctccaaaaccactaatagcttatttgaggttaaagagtcctcccttaaaatatgtactacaaacttatggtttagaatttcactgttttgcctcacacatgactttacaatgtgtaaatcaggaatccagcatttcttcccgtataccaacaaaatttatattttaaattaactcataataatctatataattttaaagcaaatgctgacattctgtgacccataaatagcacacatggaattggtatgtcctgtagaattattgctttctttacctatccgtaatgtacagtaagtcctcatttaacattgtcagtaggttcttataatgagaccagttttaccataggctaattgatctaaacaattgccaagtcccttcggcacatttctcatcacagacatatcaccaaactcctaaaggaagacctaaaacactcctaatactaaacattgaaatagatgtgagctatccatacatttaagaaacactaaatacaagtaagataattatttatccaattttagggaaatcagtgaatgacggtgtttgtgttggtggtggactaaatcaaataagtttttgcaaagcaaaaattgtgaggagcacctcctacaaccatgcagttcagatgctaaccaatatggcaggctcattgaatgctttcatactacatcatttactgttgcgcattttgtatgattatcatagactaagcacttctattttacaatcctttgtattcattcattcattttccagcttgtttattccagtttaggatctcagtcagctagaacccatcctggcagcccagggtacaagacgggaaccaaccctggacaggatgccattccatcgcaggacacactcacacacagacccatgcttcctcacactgggacagtttagatacaccagttcacttaaatacacctttggggtgtaggaagaaactggagtacccagagaaaacccacaccagacgcagtgagaacatgcaaactctacacaaacagtggctctgtcaggaatattattttttctcgtcaaccaacattgaacaaaatgacatattggagaccctgctgtagttaatgcaattgatgagattcaacttccccatcattaacttactttttcaaatataaggagcatagcagcctcatctataactttttccaaaggtaacttcccacttctttatcagcaagtcactctgtcactgtattttaatatcctcttgtccacaaaccaggcttacatagtcttccttggagtttatagggatctgacaaattctttcagaaagtcagcatagctttttgtctatattgacatcaacacactaggtcagcctatgcgtctaagagaaacatgtcaacatggctgtcttactgcgtttctcattgtttttctctagagtgatatcccttgaaggtcatattacagatcgttttatcaaaggcatgtcaacaatagtaactgggcaatggttggtttcacctaatgagataagtcctccaaaaccactgatagcttgatgccctaacaaaacccagttgtctaaatatttcaccatgacttcaaactagtctcaaacttaacataattgatctgcatgtttcattctcagtcctcaagagtacattgcttaagatgtttcttctataagtatagggtgaaagtgcagataaatccaagtgtgcaaatggtatttcacttcattattcctccttctctgcccctcagtttatacacctgggcaaacatagatgtacagacatatctttatgtagttatgtatatctttacagcttgatgcccgagtctcagactcatgtaaaagcaaatctggtaaatgaattcagattatgacgtttgtaccatcctgaaatcagtctccaagaaaaggttcaagataccaacttatcagcagatttttttctgaaataaagactctcttcatggttaatttatagaatcttattcttactgtaacttttaaattggaggagattgggaggcatgacatataccaactttttgaatatggcattgtttcctagcattggtcaatgggatattgcccatccaggatgaggatattaatgtgactatttcaactcttctcttcactgaaatctgttcatctcagtgttatttattgccaggcacagtggcatatgcctgtattcccagctacttgggagctgaggcaagagggtcccttgagcccaggagctcaaagaccaacctgggcaacatagcaagaccccatttctttttataattgtatttatattaactgatctgagtgctaaaaataaattgtatagacacctttattcccataattagttattatcattcctaagaaattctaatgaggttagtcaaataagtcactggaaaactgaagtctcaacacaagagtaatataatgatttgcttatgggtacaggctgaatatattagaactccatgaactttagttttgacagattaaaaataaccagctaatgaaattaagcactgaagctttattcttaggttatccctagagaaataattcctcatttttattttggcttataacttgattacaaattgagagttggcttttttgtaccttttatggaattcaagtgcatttgattaagcatttaacatcactcccagaggcaagcaatctcaaagtgtcactgggcatggtaggcattaaacatcctggtttttctgacctgtagtcaaccttaaccgtgacctatcacctcctcaccacacactagattacctggaggcccttctctatcagaaagactatactagagatttgaacttcgtacaagtgagaattagatttaaattactaagctgattttcatttccgattttaatcaaaacttaaatacttgtctccagaaataaaagatagtcatgtttaactaataccagcagccctgtggctgtcctgccgtgagcagcttatcctccctcccccactcctttcctttctttctttctttttgtacaatgttgagttaaggtcaccatcatctactcatcactccaataagaattttaagtctggttaaaatattaaacatgaattgacaccacagtggtttggtatcatgcacgttagaaataactgctcaagttaaatgctgatgtttaattcttttgttatctttataggaatggttctccagtattattttattactgattttttaatgattatcctagactgggtaatttaaatatgtaaagctctgtaagtacatactggacctaatttgcaagtaaaaatatacctcatgcacatagtgggtgtgctctttagaggccaagaggctgttcagtatctgtcttaagatgtacctcccactctgtatctgtttattaatatggggctagaaatatctttctttttatatatgtatatatgtatttttttattttattttaagttctagggtacatgtgcacaacgtgcaggtttgttacatatatatacatgtgccatgttggtgtgctgcacccgttaactcatcatttatattaggtatatctccgaatgctatacctcccccctccccctccccccaccccacaacaggccccggtgtgtgatgttccccttcctgtgtccatgtgttctcgttgttcaattcccacctatgagtgagaacatgcggtgtttggttttctgtccttgcaatagtttgctcagaatgatggtttccagcttcatccgtgtccctacaaaggacatgaactcatccttttttatggctgcataatattccatagtgtatatgtgccacattttcttaatccagtccatccttgatggacatttgggttggttccaagtctttgctgttgtgagtagtgccacaataaacatacgtgtgcacgtgtctttatagcagcaggatttataatcctttgggtatacgcccagtaatgggattgctgggtcaaatggtatttctagttctagatccttgaggaatcgccacactgacttccacaatggttgaactagtttacagtcccaccaacagtgtaaaagcattcctatttcttcacatcctctccagcatctgttgtttcctgactttttaatgattgccattctaactggtgtgagatggtatctcattgtggttttgatttgcatttctctgatggccagtgatgatgagcatttttttcatgtgtctgttggctgcatacatgtcttcttttgagaagtgtctgttcatatcctttgcccactttttgatggggttgtttgtttttttcttgtaaatttgtttgagttctttgtagattctggatattagacctttgtcagatgggtagattacaaaaattttctcccattgtgtaggttgcctgttcactctgctggtagtttcttttgctgtgcagaagctctttagtttaattagatcccatttgtcaattttggcttttgttgccattgcttttggtgttttagacatgaagtccttgacccccatccctatgtcctgaatggtattgcctaggttttcttctagggtttttatggttttaggtctaacgtttaagtctttaatccatcttgaattaatttttgtataaggtgtaaggaagggatccagtttcagctttctccatatggctagccagttttctcagcaccatttgttaaatagggaatcctttccccatttcttgtttttgtcaggtttgtcaaagatcagatagttgtagatgtgtggtattatttctgagggttctgttctgttccattggtctatatctctgttttggtaccagtaccatgctgttttggttactatggccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtgtggccattttcacgatactgattcttcctacccatgagcatggaatgttcttccatgtgtttgtgtcctcttttatttcattgagcagtggtttgtggttctccttgaagaggtccttcacatcccttgtaagttggattcctaggtattttattctctctgaagcaattgtgaatgggagttcactcatgatttggctctctgtctgttattggtgtataagaatgcttgtgatttttgcacattgattttgtatcctgagactttgctgaagttgcttatcagcttaagaagattttgggctgagacaatgggattttctagatatacaatcatgtgacctgcaaacagggacaatttgacttcctcttttcctaattgaataccctttatttctttctcctgcctaattgccctggccagaacttccaacactatgttgaataggagtggtgggagagggcatccctgtcttgtgctagttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctatttatatgctggattacgtttattgattttcatgtgttgaaccagccttgcatcccaggaaagaagcccacttgatcatggtggataagctttttgatgtgctgctggattcggtttgccagtattttattgaggatttttgcatcgatgttcatcagggatattggtctaaaattctcttttttggttgtatctctgccaggctttggtatcaggatgatgctggcctcataaaatgagttagggaggattccctctttttctattgattggaatagtttcagaaggaatggtatcagctcctccttgtacctctggtagaattcagctgtgaatccatttggtcctggactttttttggttggtaagctattaattattgcctcaatttcagagcctgttattggtctattaaaagattcagcttcttcctggtttagtcttgggagggtgtaagtgtccaggaatttatccatttcttctagattttctagtttatttgcatagaggtgtttatagtattctccgatggtagtttgtatttctgtgggatcggtagtgatatcccctttatcgttttttattgtgtctatttgattcttctctcttttcatctttattagtcttgctagcagtctatcaattttgttgatcttttcaaaaaaccagctcctggattcattgattttttgaagggttttttgtgtctctatctccttcagttcttctctgatcttagttatttcttgccttctgctagcttttgaatgtgtttgctcttgcttctctagttcttttaattgtgatgttagggtgtcaattttagatctttcctgctttctcttatgggcatttagtgctataaatttccctctacacactgctttaaatgtgtcctagagattctagtatgttgtgactttgttctcattggtttcaaagaacatctttatttctgccttcattttgttatgtacccagtagtgattcaggagcgggttgttcagtttccatgtagttgatcggttttgagtgagtttcttagtcctgagttctagtttgattgcactgtggtctgagagacagtttgttataatttctgtacttttacatttgctgaggagtgttttacttccaactatgtggtcagttttggaataggtgtgtggtgctgagaagaatgtatattctgttgatttggggtggagagttctgtagatgtctaagaagtatcttttagtgtgctcagcaagtcatgttattttctttgatgtatttcttctttgaagcttttaacctctttgtttatctgtattgcatcctttaaagaattcaataaatttcaaattgaccatttaaggatataagcaagaatactcactaaaagtagctataagtgaaatattggtaaataaaattaaaaggatcatttattctattaatattatttgccccaagtagttaatgaggtgtgtattttccgtaagactgcattgtttgtttttttctaggcctaagacagtatagcatgtgtgagggccaaaagttttgtcctgttacctctgacaagatggagcaaaacttagaggtctagagggttgatttaagcttccaaaaacaaaagaaagaaagaaagaaaaagaaaagaaaagagaaagaaggaaggaaggaaagaggttttttctgtttttttttaccattcctaagaacaaccatgtgtttgtgtgtgaagaatggttatttaagcagggaaaacattataggtacacgtacaaatgatacctgatttacaagtaaaaatataattgatgatgtaaatgtgagtgcattcacatttaggggcaataggtctgttcattgcctctccccacttcccaccccaaaatacagctctggacatatgcatgatcaatatgcaaatatacacagcatatttacattggaaacaaatgtagctagttatagaaaaataggtggagctgttttaagcattcattaaatctctcagtgcaaggggatgaattaaactttataaggctgctataaaaagaactattttagaatttaaatatggctgtataatgtagtgcttgttaccatgttcaattttaacacccaaatccaatctccaaaaaatactccaaatgagggtaccacattagggaacctgtgactgtgcccaccacacaagcattttaaaattggggcctcagcatgtctcattttatacagaattaaaaggaaattccttgaatttccaaacataattctgtggtttgaccagtcttaagtaaatatgatgttgagttagggtcctggtagataggattctgtcagcacatccacggggtagaaagcctggtgctttccacctgttactggtctgcgcggtcacaaccaagaagccaggtttctacaactcatgttcttgtctttaatgatgtatcttggagaaagaattaaagtagtgtaatataaatgttgaaatgtatgtttaaaaattaaaacaccaatgagggtcacattttcatgaagaatgactggcactgctacttacatgagaagtaataatcaaaaccaggcatatgagaagggcaaggaaaaggtgcagttgtgtgccagacattgtgctaggtactttacagtgggagagtgggtggcggctttcagctgtgtaacttgaagaaccgaaaattcctccttgtcaaaaaagtaaacaatatacacacacacacagacacgcttttgttcccattattttgtgtcagtttcatttatttttgttaaatatagcttctctttatggttctctttgaaaatgtgcatccctctgggagagatgacacattaggtgacagtcacattatgatgtgagtcaaggtatatgaacgtgtcaggaaggggaaataggtcccggaattagccaaatagggagggagggaggcaaccagatgcaagccggatttccactactttacaaagctgctgtgcagtcttttagagagaggcccaactctaattattacactctcatgaacagtgagaaacttggagatttcttttgtatgtccttatcccaaaaataggcatggctttttttttttttttttttttttttttcagtgaaagaggtttgcagctggactgggagaattaaggtgagaaaggtcaacaggttacagaggccagtgcaacagggcttgttagacgtaatcaaagacctgcttagggaagctgcaggaagcagaaggttgggatttccacctagggaggttataggggccctctggctaaagggaagttggctcaactctgaaaaggtttaaaatccagtttaaaattctgattaggaaaatcccacaataagcagttggtctttttaaatgtttcccctctcacagggcaagatgcttctgcctaatagttcagcatcattggaaaggacttagtgtgttcgcagatcactttgataagcgcttctgccacctcttttctttcctcctttttgtgctttaagaacctccgtcatgagatcgttttcttctttctgagattggtctccctagggaagaccagaatgacaatgtagactaaattgttgtccagagttgtcattcatttgttgcttttgaacttagagagatggaagccactacatattaatgcgttgttttaatgtataagccaacacctcacacttactgagcataaagttttttgccatgtattttcccttttttgcagtagtcttagccctctgtcaaattaacatgtttgcctcttttgaaaactcatatttcctcctgaaacagtaagaactaaggagaagagcaaagcattggaacagtccctgctgaagacaatagtatgataagaacattgaaaaatacaatttaataggctaaaatgcatttgggacatcaagttattggccagaatgcatctttatgcatagcaagccttgccagtggggatctcatggggagtaatggtgattaaaaggtttttgaagagcgaagttgtgtaaccaagcttgtataagagactgaaacttggttcatctcgtagtggacagcctgaagacagacactccagacatgtgttagtccatttgcattgctataaaggaataactgaggctgggcaatttataaagaaaaagttttatttggctcacagttctgcagggtgtacaagaagtatagtgccagcatctgcttctggaagggcctcaggaagcttccaatcaatggtggagagtgaaggcaagtcacatggtgagagaaggagcaaaaacgaaagcaagaagttgccacactcttttgaacaaccagatctcattaccactcattactgagggaagagcactgagccgttcatgagggatccacccccctgaccccaacacctgccactaggccctagctccaacattgagggtcacatgtcagcagatttggaggggacaaatacccaaaccatatcaagaaagtatttggtggcccagttaagagatgacaaaggctacaaagaggaaggaaaggggaaaggccaagagatatctgggaattagaatcctcaggacttagtttccttaccactatggcagtatcagtagtgactgtgtcccaagctcaagaaagtgaacttgactgtgcctggtctctcacaaatttccagaccagtcttagtgaggtaaaaagatgcattctaggatcagtgaatattatttagtcatttcatgtacccagtgggttaatgcttctataactaaaacaagccattcccccttttctgccagcagaaagatggaaaacaaggttcacaatatgcttcccgtgatgtgttaggatttgtttggtcatgattttttatccataatagagggatatagtaagagtttgaatcccagaaatagaactgcccacttacttggctgaggcaggggtaggggagaagcactgtgtgtggacagaatttcgtcaggtggtagaacatgttgcctaaggggtttaaacaacagtatgttcgagttcaggcaagatgtcagtaaaacaggaaactactgaatacagactaaatgtaagaatctttatatatgataagaatcgaaaccttcagggactgaaagaaggtcatggggaatctggaagaccaagcaaaaggtcacttataggaaatggatcatgtctgctttagattcaaagccaagacagctgtatattaaaccccaaaaagtggcaccagacctgtcagaatgctcaccacgccaagtcagtgacttaaagagtcagtgatcctatgggtataaatatcagttaggcccaagaatggaaatgaagaaggatgtctagtctggaagaacctgccaccacccacaaactaagtcatcttgaccaataggttgaactgtacatgaatccatatattaaacaaatacttactgcatggtcatctgtggtatcctatatcctagacactttgttggttttgtgatataaaactgaaagagacactgcatccctcaaggagagggggaagttggcaggcacagagcaataagtttcctcctttttagaggtaatggttggtcccacctttagcagaagattcatataacaccctctcacaggagagaacaagagcaaggcctcagcccaaatcagagcccacactttcagtggacagtcactcctcagcacagacagcacccatgtgactcaccagactcccttgaccacagtttttccacagtcaaaggcaggcagaatggtctataaactgaaaccactgggttatttttatttcttggctcaagttcagattcccacacgtggtggagaccacggatacgtaacaatgtctagggcatgactgttgtattcacacccactatcacaattcccttgtcctactcttacccactgaagaggaatgtgaacagaaaagactttggggggtggaattgatatattttgcagtactagttactagtgggtggactacatgtgaggattatggaataaaaatttttttgaacaaaaggtgtgcattataaacaagtctcattatattattattatcattttttctttcgaggtgggagtagacagaagagacaatcaggataatcttgtctgtcatagccagagaacatcagaaaaatactccatttaaagagaatttattttctctggctggcagaaacaaacgcttgtatatcttatatataattatatacatatatatgtatacatatatacacacacatatatatatgtatacatatatacgcacatatatgtatacatatatacgcacatatatgtatacatatatacacacatatatatatacatgtatatacacatatatatgtatacatatatatatatatatgtataacactttataaaatacctggatacctggtgggtatagactaatgcagaataagctattctttaaaatctagtatccacagataataacaagtattggtgaggaagtggagaattagacattgctagtgggaatgtaaaatggtgcatctgccttggacagcactttagcagttccttacatggttaaacatagagttataagaccaagcaatcctacaactaaatatatacccaagagaaataaaaacatatgtccacataaaaaggtgtacacaaatgttccttgcagcattatttgtaatagccaaaaagtgaaaacagcctacatgtccatcagttgataaatggataaatataactgatatattcatacaatggaaaataatttgataataaaaaggaatgaagtattgatgctaccacacggatgaaccttgagaacatgctttgtaaaagaaaccaatcacaagagactacatattattccatttaggaaaagttttcagattagggaactacctagacaccaaagtagtttgattagtagatacccagacctaggactggtggatttgccagcggggagtaactgctaatgggtacagggtttctttttggaatgacaaaaatattctaaaatggattgtggtaatggttgcccaatctgtgaatatactaaaaaccattaaagtgtgcactttaaatgggtgtattgtatggtatgtgaattacatctcaataaagctgtttttaaaaacctagcttccaatatcttggcatcttggcctgtttcctccactacttgctgcagctagagctttttgcagtggtatttgggaaaagtaatgtgtggacctctggtatcttaagtcctctactgtaaggatattttctgagatttcattaaaaattattacttaattaagcctggaattgcaacccaatagcttctcagtaggaatacaccatctgtgctgttctttagatgagtttattctaaaaggacattttatatttcaaagtgtgcattgatttaatgtatgtagcactgctatatagacttacaggctgagtttttaagtttttaaaaatattttatcaagtatatacagccattgtatttttactgttttatgagcactattgactcaaggggcgttaattttgaatggttttaattttatccagttactgccttaggctatgttttgtggaatcttgcttttctatcccttaacaatatctagcagatcttttagcactcactactgcgggtcactttctcattattagaaggtcaacctggtccatttttaaactcccatcttatacctgatttaaatctaatatcttctttctactccatcaaaatgcgaggaacatggtctggtacctcctttttccccctaatcaagccgtaactccttgcgggtgagggataggtaataagtgagaacagtgtccctttacctaatttcacatggttgtcatcttcctgcatctttggcaaatacagccttgccatccatgccttctgggtaacaggtgtcaaaatgcttcttcacattgggtaactgggagagttcactgcccagttccctgatgttgaagacctagcctagactcaacccccttgcccagcccagcccatttcccagtagtgtactggtaaatgtttaacaaaaggctgggcaggggtggtatgtgtatatgtacatacctaagtttattgtacattttactgatgtaaacaatgtatagtaaataatttacaacagtaaacaatgtataataaataatttataaattataaaatatacagtactcttaaatgtaaatttcatatagccagctgattcttccagaaaggcattgatatttgccaaactctttcctgtgtattcatcctgtgattgcacctgacaaatgagtatatttctaacatgactgttgggtgatattttcatttaagaaataagacaaagtgaaacaaagatgtcagagcttgtttttagtaatgtcatgagcaacttctttgctaaatcaaataatagttttcaaatactagaagaatgtgtcctccaatttttgtactgttcacagtgtgaggactctagagatgatagacttttaagtttaatctgcattattagcatcttctttatcacttccttaagtctagacagtcaacaataaatcaagtcctgattttgtaccatttttgcatttcaagttgccaacataactcttaataaatggataattgggacaagatgcatgctagcacaatttttcccaccatgcacatagacaataaaaaagtaagagcatagagggtaatagtaaactgattaagaagtgatgagtttttaagtattttctatgtttgtttttaatattacctatttaattataagtttgtataatgttttaataatggctccagagcaccactgcccctcacacacagcattcttctaagaatctctttgctatcagagtcccctcacctgtgtgctcctttctttttttttttttttttttttttttttgagacagagtctcgctctgtcagataggctagaatgcagtggcacaatctcagctcactgcaacctccgtttcccaggctcaagtgattctcctgcctcagcctcccgagtagccgggattacaggcgtgtgccaccacgcctggctaatttttgtatttttagtagggacagggtttcaccatgttggtcagactggtctcaaactcctgacctcgtgatccgcccatctcggcctcccaaagtgctgggattacaggcgtgagccatcacgcccagcctgtgctcccttcttgataggacactgacaagatagcaaggatcgtacagaccgctttttttgccacttcctctctctactcagctagtctaggagcaggtcagcaggtcagctacctaagcaactcatatctgatttaaatttccagacagggataacactcaagagtctccttgaagacactctgaatctttactaacgaatctcttggtaccctcccgaagtggctttgagaaaggaaagccatcttttggaggggagggtgtggagaacaggacacctccactgccacacaaactacactcccaaggtagtagctcagtattcccacaaacgtcctttctcttctttttcatgttttatgttggactcctggagctggcagagccagcttatcttaataagtcctgagggagatattaatgtctccttggaatttgggatagttaatacctcttttagtatccctggttattgattctgaagcagtagcacatgttgctagatttaggcagttttatttagcattcccaattttagatctagtttgataatgtccattatttgatttaaatcatggaaatgatcgtttttctcccttaatcactacaagtcacacactgttatgtcttttgaggatacttaatctttctggtttgggttaagcctataattagtagtcaggtttttctaccttccaaactacaaaaacccaactttgtcctaatcacttcattttagactcagaggaattccagtgtttctaaatcctgataacattatatatgtatgtataattttaatttttattgtagattcagggagtgcatatgcaggttacaaaggtatattgcgtgttgctaaagtttggggttctgttgatcgtgtcacccagatagtgaacataatacccaataggaagtttctcagcccttgcccccttccccgactctcactctccttttgaagtccttagtgccttttgttcccatctttacatctgtgtgtgcccaggcttaactcccacttataagtgagacaatgcagtatttggttttctgtttctatgttaattcacttaggatagtggccttcagctgcatccatgttgctgcaaaggatatgattttgctccttttgattgctgcatgctatcccatgctgtatatgtaccacattttctttatccagtccactgttgatgggcacctaggttgaattcatccctctgcttttgtgaatagcgctgcagtgaatgtacaagtgcaagtgtctttttggtagaacaatctattttcctttgggtatatacccagtaatgagactgttgtgtcaaatggtagttttgttttgatgacattatttagagggacatgagagtcctataccctggggtgaaatgctttaattgctccaagtattaatctcatcaagattagggttctcaaaaaaaaattacagaaggaaaggaatgaggtacgatgaggacttaatttactagatatcaaaccctactataaagctatagtgatacaaatcaggagtgagtaaagcaaaagacaaattattccgttgaaagaataacaagtacagaatcaggtccagatacacataggaagcttgtgtatgataaagttaacatttcacataaaagttactgtaaatataggagaaagtaaatacgcaaagatatttctaaactagtgcagtgaatatagagagcctttataaacatgcatcaaaccagaaaatattaaagaaagatggactgctttgaattcttaaattttttaaatttatatttggccagagacatcataagctaggttaaaggacaaatcatatactgggagaaaatattttttccacacataatagatgaatcgtgttatctttagaagtgcactaaatttattttggctgagtactaaacagccagtattaaaatcaatgaacagcctaaggcaaagctgaatgttcccatcataaaatgaccttctgagatataagaataaatatgaaattttattttcaagaacttaatgttacagttttattattaaagcatcagtatgtttttaaggtttgtcattatgatgtaccaatatcttttctcagtgctgccagctgctaggtggttcctccacacttgcaatacctaaatagctgcttgttgtcagctgattaaaagcgtggattttgtgggcaatgtacgccaatatgggttactattcatggagattgtgctattaggtcaataagctctcctttttcttgaatagtaacaaaagggtaaagtcttctcaactcctagacttaaaaacttagctgatgatgacacactgtcattgaaacaatttcacaaactaaagctgtgtgcaatgcttaaacaaaacactttgactgaataaaaaaaaatgtggtacatatatgcaatggagtactattcaacagtaaaaaagaatgagatcctatgatttgcaacaacatggacggagctggaggtcattatgttaagtgaaataagccaggcacagaacgacaagcttcacatgttctcacttatttgtgagcgctaaaaattaaaaccactgaactcatgaagatagagagtagaagaatggttaccagaggctggaaaaggtagttggtgtcagagggagggaagtgagcacagctaatggatacaaacagttagaaagaatgaaaaagacctagtgtttgctagcacaacagggtgactataataaaaaataatttaattgtacatgttaaaataactaaaagagtacaactggattgtccataacacaaaggatacatgcttgaggggatgaatactccatttgccatgatgtgattgttatacattgcattcccatgccttatcagagtatctcatgtaccccatcaatatatacacctactatgtacccacaaacattaaaaattataaatttttataaagaaagcagtttgcaggctgatctcagtggcacacacctgtagccccagctacttagaagcctgaagcaaaaaaggattgcttgagccaaggagtttgaggctatagtacactataatcatgcctgtgattaggcactgcacttcatcctggacaacatgatgagaccttgtccctaagaaagaaaacactttctcaatatttaagaagcagacataagacttctgccattacatttttatttctaatacttttgcattcacttgctgcttcacacagtcaccagatgtgctacactttatgccagcagctgttgcttgttaccaagtcattttcttttggtacaggttgagtgtccctaatctggatattgaaaatgctccaaaatctgaaactttttgagcacctacatgactctcaaaggaaatgcgcattggagcatttcagaatttggatcttcagattagggctactcagcctgtattagcacttgcagtggataacattaaaaccatgtttgttccagcagccttttaacatgtggtggctgctcttctctctcattttgaacatttgtgtgaatacatgtgtagacaatgccagatgtttccttcatatattatgtagtttgtctttggctaaaagagatttttagtcccaagttacattcagaatgcttaccaatatttaaaaatcagtattcagatactaacagtaagtccaagtgatgatgttatgcttactatatgtgataataacctatatgatctttgatctctacaagttcagtaaacctggaaatgacattgaatgaggcatttgcctattccgtcttccaaaagctaaagcaaattttgaccgagtactgaggccaaagcttagttatagtgtgttttcaatatttatagtgtataaagtgttccttcatattagaaaaaatggactaaggacatgaacaaaatactcacagaagaaatacaaatggtgaacaaacttgaaaaaatgttaaacttcagtaggtatcaaattaaatacaggtacaacgacagattatttttctgttagtttggaaaaaaaacaaaaaagctgataatgagttggtgagaatgcccagaaagagagtaaattgtacatacttttattgaagggtggtttggcagcatttaccagacatttaaaatgtatacagtggtccaggaatctgccctccagaagtactcaaatatgtcctcaaagatttatacaagactgtaatatagttctaacagcaaaaaatcaaaatctaaatgtgatcataaggggagtggaaaaatgaatgctgactcactatgcaaaggaatgccttatagttactaaaactaatgtgctaagtcaatatgtgctgtctcagaaacacagctacggtacattgttacagaagaaaatgcgagttgcagaatgtctgtgcgatttctatttaaataaataaaatatggaaggatgagggtcaaaccattaactgtagttgcctcaaggtggaagggggtattgagttgaagagaaggtagtatttttttactttatacatacttctgtattatttgaatttattataatgcacatctgttatgttttaattttataaaagatttaaataaaactaggctagaccaaaccatggaataaaagtattatgaaagaaacaaaaattaattatttctctcattttaagacaactcacagatagcctccagtgacttggggagcgaaaagaataacattaatcaaagatacagtggaactgccggaggacagtggatcatagccttgaagaatccaagaaatggcaaagtgcaggccacaaattccaataacaaaataattatgtttaaaaaaacataatttttaaattatgtttacataattagaggagaaaagtgaaagaatgctgttaaaatcaccaccatgtccctatctctgacttcctagtaatccttgagtagagacaggacaaacatctatgatgcaatctatttataatgctagtgctgcaaaggaacacctgccttgtggagtgactgtgctatatatggctgttgttgtgtgtataccttatctacttatattcttctaatcatccatccatccatgcagtaaacatatagggtaagagggatacagagatgacagacagtcctgtgaggggagaaacttgtttagcactggttctccagtacctggaacagagtaggggctcaataaatatttgttgaatgagtgcatgggctcccgtccagtgagaaaacagaaaagtaaacagacagctaaaaggcagtactggcacacctcgtttgacagtgcttttgtgtttcacatatactgttgttattgttttttttttttaacaaattgaaggttagtagcaagcccgtgtctgtcagccccatttttccaacagcgtgtgctctttcatgtctctgtgtcacattttggtaattctcacaatatttcaaactttattattatatcctttatggtgatctgtgatcagtgatctctgatgctactattgtaattgatttgtaatggcctctaagtgttcaagtgaaaggaagagtcaaatgtctctcactttaaattgaaagatggagataattaagcttattgaggaaagcatgtcaaaagccaaaacaggccaaaagttaggcctcttgtgtcaagcattagccagttgtgaatggaaaggaaaagttcttaaagaaaatacaaagtgctactttgatgaacacaggaatgatttaaaaaaaaaaaaaagcaacacacccttattgctgatagggatttagtggtctggatagacagtcagaccagctacaacactcccttaagccaaagcctaatccagcataaggccgtaactctctgcaatcctgtgaaggccgagaggtgaggaagctgcagaaaaaaagttggaagctagcagaggtaggctcacaaggttttaaaaaagaagccatcttcctaacataaaattgcaaggttgagggtgaccaaggaacaaggcaggtgcaagatgtagaagcagttgctgatatagaagctacagcaagttgtccagaagatctagctaagataattgatgaaggtggctacattaaacagattttcattgtagatgaaacagccttctgttgaaagataccaatctaggacatttatagctggagagaaatcaatgcctggctacacagctttaaaggacaggctgactctcttagtaggggtctaatgtagctggtgacttcaagttgaagccagtgctcatttaccatttcaaaaatcctaggacccttaaaaacttgcctgtgcctactctgcctgtgctctctgagtggaagaacaaagcctggatgacagcacatcttttttaatatgacgtactgaatattttaagcccacggttgagacctacctctcagaaaaaaaaaaaaaaaaagattcttttcaaaatactagtactcaaagatctaatatccagagtctacaaggaacttaaacaaatttacaagaaaaaaaatttaaaagtgggcaaaggacatgaacagacacttctcaaaagaagacatacgtgtggccaataaaaatatgaaaaaaagctcaaaatcactcattagagaaatgcaaattaaaccacaatgagatatcatctcatgccagtcagaatgtctattattaacaagtcaaaaaacaacaaatgctgtcaacattgcagagaaaaaggaatgcatttacactgtggatgggagtataaattagttcaaccattgtggaagacagtgtgatatttcagtgacctagaggcagaaataccatttgacctaccagtcccattactgggtgtatacccaaaggaaaataaattattttgttattaagatacgtgcacacatatgctcattgcagcactactcacaatagcaaagacatggaatcaacccaaatgctcatcaattatagactggataaagaaaatgtgatacatacacaccatagaatactgtgcagccataaaaaggaacaagatcatgtcctttgcatggacatggatggtgttggaagccattatcctcagcaaactagcacagaaacaaaccaaacaccacatgttctcacttataaatgggagctgaatgatgagagtacatggaaacatggtgaggaacagcacaccctggggcctgtcagagggggcagggaaggggagcatcaggaagaataactaatggatgctgggattaatacctaggtgataggatgatctgtgcagcaaaccaccatggcacgtgtttatctgtgtaacaaacatgcacatcctgcacatgtacccctgaacttaaaagttaaaaaaaaatttttaaatactactactggttgataatacacctggtcacccaagagctctgatagagatgtatgaagagttgaatgttgttttcatgcctgctaacacagcatccattctgaaggccatgtatcaaggattaatttcagctttcaattcttattatttaagaaaactaggcagggcgtggtggctcatgcctataatcccagcactttgggaggccaaggtaggtggatcatgaggtcaggagatcgagaccttcctggctaacatggtgaaaccccgtaaaaatacaaaaaattagccaggcatgatggcaggtgcctgtagttccagctgctcaggaggctgaggcaggagaatggcgtgaacccaggaggtggagcttgcagtgagccaagatcgtgccactacactccagcctgggcaacagagcaagactccatctcaaaaaaaaaaaaaaaaacctaaaagcctgggtgtggtgactcatatctgtaatcccagtgctttgggaggctaggtgggaggatcacttgaggccaggagtttgagaccagcctgggcaacatagcaagaccctttctcaacaacaacaacaacaaaaattaaaagttagccaggcatgacggtttgtgtctgtagtcctaactacttgggagactgatacaggaggatcacttgagcccaggatcgcgaagttacagtgaactacgatcgtaccactgcactccagcctgggcaacagagcaagaccctgtctcttaaaaaaaaaagaaaaaagaatactatttcctaaggctatagtttccatagatggcgattctctgatggatctgaccaaggtaaattgaaaaccttgtgtaaaggattcaccattctgtgtgccattaagaacatttgtgattcatgggaggaggtcaaaatatccacattaaccagagttttgaacaagttgattccaactctcgtggatgatttgagggtttcacaacttttattggaggaaataactgcagatgtaatggaaatagcaagagaactagaattagagtagtacctgtaaatgtgactgaactgctataatcttatgaacaaacttgaacagatgaagagttgcttattatgggtgagcaaagaaagtggtttcctaagatgaaatctactggtgaagattgtttgaacactgaaatgacaacaaagtttttagaatattacatataaacttagctgataagacagtggcaggatttaagaggcttgattccgattttgaaagaagttctgtaagtgaaatactgtcaaacagcaacatcacatgcacagagaactctttcctgaaagggagagtcgatcgatgcggcaaactgtattgttgtcttattgtaagaaattgccatagccaccccagccttcagtaacctgatcagtcagcagccatccacattaaggcaagatcctccaacagtaaaaagattacgacttactgaaggctcagatgattgttagcatttttttagcaatatttttaaggtatgtacttttttaagacataatgctattgcacacgtaatagactacagtataaacacgcactgggaaaccaaaaaatatgtgtgactcactttattgtgacattcactttattgcggcagtctgtaatcagacctgtaacatttccaaggtatgcctgtatttgcagtgcaatgatagagatatgaacaaacaaatcagagatgggacacataagactgctaggaagcccctggaagacatcctcagggaggctatgcttgaactaaatgttgagaaatgagtagaagcctgccaggtaaaaaagtagaaaaggttatcccaggcagaggaaccaacataagcaaacaaacataatcataaaagagcagggcttatttttttattgcatattttaataacttgattcaggtaatcagatgtcccagaaaatatcccaaactttacaaaatatcttaagttttaaaaatccttatggtaatgtcacgtaacttcctatctaacgtcagatctgattcatgttaaacacgttttgcatatggcaaagggcttttatttcaggtaaatggtgaaattgttggtccttttattatttttttaatttttatttatttatttttgaggtggggtctcactctgacacccaggctggagtgcagtggcacaaccatagctccccacaatcttgaactcctggactcaagggatcctccagagtagctgggactataggcatgcaccaccacacccagctaatttttaaaaatttatgtagaggcggggtctcgctatattgatcaggttcatcttaaactcctggcatcctcgagcagggcttatttaaaaagctgaaagtcatttattatggttaaagcatgaggggaggaggctagaaagataaagtctggatcacagaagaccttgggagccatgctgagtttggattttatctgaagagaatgtctttaagaagacaatcaggtatatattcttaaaagatgcacacaaatacatatttgttttcaatttgtatatgctttacaaggattaattcacttaattctcataacaaactatgaagtgtaggtaccattattctccccattttgcagttgaggaaactgaggcacagtaatttcccaaggtgacctgactccgtggtggaactaagttaaaaacccagacattctggatccaatgcccatgcccttttccactatgctatactatctttgtgtttcttcaagatgtgtatgttttcttatgaaaggggaataaaaaaatttttcgtgtaatttcttccataccacctaccaaccaagatagaatgttctttggtcttgcaaatagagtcattcagcagttcagcagtctgcctgtcttttctccatttcctcaggattcactttcctcttaccacttagctgctgcttatcccttttagtctggattttttgttttagtttcaggggtacatgtgcagatttattatataggtcaattgcatgtcacaggggtttgatatacagttggttttgtcacccaggtaataagcataggtagtttttctatcctcacccttctcccaccctccaccctcaagtaggccatggtatctgttgtttgcttctttgtgtccatgggtactgaatgtttagctcccacttataagtgagaacatgcggtattttgttttctgttcctgtgtttgcttaagatgatggcctccagctctatccatgttgctgcaaaggacatgatctcattcttttttatggctgcataacattctattgtgtatatataccacggtttttttctttatctagatagtctaccattgatgggcatttaggttgattccatgtctttgctgatgtgaatagggccatggtgaacatacacatacatgtttctttatgatagaaatattcctttggatataccccgtaatgggattgctgggtcaaatggtaattctgctttgagttatttgagaaatcaccacactgctttccgcagtggtttgtggaaacgctttacactcccaccagcagtgtataagcattcactttcttcataacctttccagcatctgttattttttgacgttttaataatggtcattctgactggtatgtgatgatatctcattttggttttgatttgcatttctttaatgatcagtgatcattttttcctatgcttgttggccacatatatgccttcttttgagaaatgtctgttcatgtcctttgcccaccttttaatggggttcgttttttgcttgtaaatttaagttccatgtagactctggatattagacgtttgttagatgcgtagtttgcagatattttctcccatgctgtagagtgtctgtttattctgttgagtgtgtgtgtgtgtgtgtgtgtgtgtgtgtgtgttgtgtgtttgtttgctgtgcagactctctttcatttaattagatcccatttgtcaatttttgtttttgtcgtagttgcttttggagtcttcatcatggaatttttgccagggcctgtgtccagaatggtatttcctaagttgtcttccagggttttcatagttttaggttttacatttaagtctttaatccatcttgagttgatttttggatgtggtgtaaggaaggggtccaatttcaatcttctgcatatggctagccagttagcccagcaccatttattgaatagggagtcctttccccattgcttatttttgtcagctttgtcaaagatcagatggtcgtaaatatgtggcattatttctgggctctttattttgttccactagtctatgtgtctgtttttgtaccagtatcatgctgttttggttactatagccttgtagtatgctttgaagtcaggtcatgtgatgcttccacctttgttctttttgcttagcattgctttggctattcaggcccttttttggttccatatgaattttaaaatagttttttctagttctgtgaagaatgtcattggtagtttgatagaaatagcgttgcacctgtaaattgctttgggcagtatggccattttaacaaacttcttcctttccatgagcttggaatgtttttccatttgtttgtgtcacctctgatttctttgagcagtgatttgtaattctcattgtaaagatctttcacctccctggttagctgtattttattttctttgtggctattgtgaatgggattgtgttcttgttttggctctcagcctgtatggtgttgatgcatagaaatgctactgatttttgtgcattgattttgtatcctgacactttgctgaagttgtttatcaggtcagggagctttggggcagagacagtggggttttctaggtatagaatcatatcgtctacaaacagggatagtttgacttcctcccttcctattcgaatgcattttatttctttctcttgcctgattgctctggctaagaattccagtgtaatattgactaggagtagtgagagagggcatccttgatttgttctggatttcaaaaggggtatgcttctaatgtttgctcatttagtatgatgttggctgtgggtttttcatagagggctcttattattttgaagtatgttccttcagtgcctagtttgttgagggtttttaacatgatgatatgttgaattttaaaagccttttctgcatctgttgagatgatcacgtggttttttgtttgcgttgtttatgcaatgaatcacatttgttgatttgcatgtgttgaaccaaccttgcatcccaaagttaaagtctacttgatcatggtggatttgcttttttgtatgctgctggatttggtttgctagtattttgttgaggatttttgcatctacatccatcgatcccttttagtcttgttccctgtctctgtcctcccttttctaggtgggactataaaccctttggcttccagggtacccagtgtagctccatccattaaagaggcaaggtgggagttgtctgagcctttttcctctagaatcaaaggtgcacataccacagatctcaaaaaatgcgaagaggtagattacgcaatatgacaatctttttttttttttctggaaagacggtctcgctctttcgcccagctggagtacagtggcgcaatcatggctcactgtaatcacgaccccctgggctccagtgaacctcctacctcagcctcccaagaagctgggaccacaggtacatgccaccacacccagctgttttttgtttttttttttttttttttttttttgtagagatgggttctcactgtgttgcccaggcttggtctcaaactcctcggctcaggccatcctcctgcctcaacctcccaaagtgctgagattacaggcatgagccgctgtgcccagttggtatgacagtctttcactcgcttgcaaataatagtgattgttagttgacaggtatgtactctttgcttctaaattgtgtagggagacagaggtgagatagaggaagtagaggtgagtaagaagaaggtatgttccccttcatcagtgatcttgcagtcttacgctttcattcaggttattattttatgactggtattttgttaacaaaaatgccatgatgctggcttggagcagcggctcatcctgtaatcgcaccacttttggaggccaaggtgggaggacacttgaagctaggaatttaagaccagcctgggcaacatctgccgtctctaccaaaaaaaataaatcaataaactggacatgctactgtgtgcctgtagtcccagctactcaagaagttgaggcaggaggattgcttgagcccaggggtcaaggctgcagtgagctatgatcccaccactgcactccagccagggcaacagagtgagaccctgtctcaaaaaaaaaaaaaaaaaaagacatgatttttattaaacagatgaggaaatgtgatttagaggaaagctttgtatacctaacttccatctctatgatattctgttaaccacactgtagatcctatacttctgcctcaggaaacctctaatacatgccgtactggtgtttgggagaattaagtacttgaagtcatctaactctgttctgcataagtctgaacatgctcctcttttcaaaagtgtaaataatttttgaacaaaaacagaaaatgtgggaggctttgatttcaatttacttatctactgataaattttgtggcttttctttagtaaaaatgaggaaaactgacagatgataatctcaaatattaataaagatttgggaaaatagtaacaatctagaaacccaaaatgatgggaaatattttcttcttgttagagaaatagggtacagtaatttatgtttggagcctggcttggatggcagagtgaaactgtctcaacaaaaaaaaaaaattatttggttgataacatgttttttttttttattaccttttagtgttgctaaattcatgacttttatttaccatttattaagtttaacattctgctaagaaacagtattttcagactttcacattgaaaagtcctcccttaattaagcatatacaatttaccattttcagcagagatccattttcacaactagctcttcaggattattccactgagctgaatctttatgtgcagcatatgaaaaagtagtttgtagcctttttctcctttcatgaaatattagcttaaacatcagcactgctactgggggtaatattcagaaaatcatagggacatgtaaattgatatgagaagatagttactatgttgaatagaattttaagtgaacatcaaatactaattgttagtggtcttttttatttttttagaaacagagtcttgctctgtcacccaggctggagtgtggtggcatgatcacagctcactgtagtcttaaacttctgggctcaagcgatcctcccacctcagcctctcaagtaggctggactacaggggcacaccaccacacctggctaatttttgttatttttttgtggagttgggggtctcagtgtgttgcccaggctggtcttgaactcctggcctcaagctgtcctccaccctcagactcccaaagtgctgggattacagacgtgagccatctgacccagccaataacatgatttttttaattccttcattgtgtatttttactttatcccttcattttatactttaaacaaatttaagatttgtataacttccaaagatgcatgcatggtaatggtcctcacatcgttgtttttaaaacaaaagttggagagtacccaaacatctaaaaacaggaaattcgttcttaattcaggtattagaaatgatgaagtagatctacaattatctatgtaaaaagttatttaccatatcggtataaaaatcatagttattttttaaaagattacaaaagcagactataaattaatccctttttttttttttacatcatgtgattagaagtgtaggaagaaaacataccacgatgttaacagcagttttctttgcgtggatttatacacgagatggtctttactttcaacttcctgtcttgcatattgtctgaggtggttttctaaattattattaattactgttttatagttagtgtgtataattttacaggtggaaaaaaaattttttaatcaaatttgaaaacgtaaaagaaccttgaaagcaattaaatgttaagcatgcaaaaaaaagtttgcacaacgcacgctaattgttaccagcactctaacttgtttttaattgtttctccttttgcctgtactgaaatactattaacagttgatatgacacattttcccaccccacagcttcttgttccctttattcttcatttgtttccctccaccccctttgagctgaagtggcagacctgtcttattcccagtgtgtacactctggatgtgggtacagtttgaggtggaacatataagtcagtgttattcttctgacattgagccttaccttcatcagtaagttagaatggatcttcaatgtgtttcactaatataagttctatttaattaaacacctatcttgagtgatacagacttaaactattaaggatgcccacgtttcaccctactctttgcattctagaatgccaggaatcagaacaagattactttttttgaaggtagagaaatgtgactcagatttcactttggcccctattactctaatgtcattacttaagctcaagtgaaaggctacatttttaaaaaagtatcctggccaattgccagatattttgtgtctgtatttggtagtgctggtttaaatcttgttgaatcttgactggactgggtgaaatggtagagttttcatttcaacatctgagaaaatgaagaagaatcacaaagagtaggcagagaggcaaacgtttcgaacaaacccacatactaagtagtctactaattgtgatataagtgaatgtaggaaactggcttctccctggaataattattacgagatttacacaattccaggaaaacttaagcaagtcttgttgagcaggctttcaaaggctttgttatcatgagcttcagcagataggttaaaaagtggtgtttctattatacctttcatattgagaacatatgaccatgagtgccttacaaggttagtctcaggatcttcccaagttgccggtggtgttgggccacagacgtagttccatattctctactatttttttcctaccaaacattagcttttgatgatttttctcattttccctagtggatcctccttacctgactgctctaatatacccaaattcccaataccaaaaataggggaaatataaatcggggaaagagtgaaattagagaattggagggaaaagagtagaatctgggatctttaggaacctaagttactttttttttaattgctttgctttttgtttttttgtttttttgtttttttttttttgtctttttttttaaagagggtctcactctgtcacccaggctggtatgtggtggcacgatcatagctcactacagactcaaactcctggactcaagcgatcctgctgcctcagcctcttaaagtgctaatattacaagcatgagccaccgtgccccaatttttttaattaaacgttgacccaatcaatattctggatagagagctatctcccagcaccctgttaagttaagcaccctgttaactaacagcaccctgttagttaagagggtgaactctggctccaagccctgctccacccctttctccacgttgggcaagagactcagcctccttatgctccaatttcctcctgtgtcagctccttagaaatccatgtcattaacatattagagttttaggacatggttagtcatggtgagtgttagctattattaacatctattagtatttttgtaataatgagctatgtaggttggatgttaccaaattttgaggaagaagtggaccatctctcccctcttttgactgtccagctcagactctggcgtctcctcagataaggtaatctggcaggagaatgccacctgcctgtggtgctagcctagggtaaggagttgtccagaccgccaaacgtcttcccaggagagctcatcaagagcccatgagtcccctgcccacagcccacctgcattttctccgtgaaatatctacttgaagacaggcatctcacacctgtaatcccagcactttgggaggctgaggcaggaggataacttgagcccaggagtttgagactatcctggacaacatagtgagacccccaaaattacaaaaaaaaatttgaaaattagccaggtgttgttgcacacacctgtggtcccagctactcaggaggctgaggcaggaggaggattgcttgatcccaggaggtcaaggctacactgagctgtgatcatgccactgcactctagcctgagtgacagagcaacaccctgtctcaaaagaaaaaaaaaaaaaccaatacgaggggagcaaggtgagaagtatgtggtgggtacagggaaagagaataagacttgtcaagaaatatgacaagagctatcagtaaaatacagataggtgactcttggggcagctggtgtgaaatgtagtctgtcagcagcaggtgactggctcagccgcagcaatggtggtccaggttagaacagcagcttctcatctcctaccctcccactccttgccagctttctgaacacttcttcccccacagtgctggtatttactgactcccaactctgctttccttgcagctgaccctctggtgggcagcatcgccacacagtacatgaccaacagagcagagcatgaccggatggccagacagtggaccaagcggtacgccacataggggcctgctgcctgccgccccgcgggacctgtgcaagcacattcaccaagtgcatcggtagccctgcccacccctccagacctcggttcttattttcctatttttattaaatttggaaccattttgtgatggtatgttgtccatcttcccatcccagttcttcctgccccccttcctctctcccacgctctcttttatctctcattttattcccttgttgatttctgttaacttgaaagatttgggattttttcccacctcatcatagatgggaacttttgttttcagtgcaaacaatgttggagctgtaatagtaagagctttcttacaaagctttgtattactgtgtggttttgttttttttgttgttgtttatttgattttgatttttttttcttttatgtgatctttgggaaaacacattcagaattatatctcgtttctacttaaatgtagtgcttagggttaattttttgtactgaagtctttattggtgggtgcatgctactgggaacaagtttttgtacaaaagcttcaatcagaatcactgtgcattactgagactctgtttatcactagccttctgtccctcccgcagaagactgttggattgaacaaaataatatgtattttgatttacttaaagtgcttgtaaatttcttagggacctgccacttttgactgtggatcagttgatgtacacttgtattattaaagcactcaataaatcactgtggctgataactgcacttctggtaacccgacatttgctttgtgtcctggtgaccgctgtagccctacgtgcagtgaggcttgtctaattcaattacaggttcaagtgtatttttcatctcaaacctctaatatttctttggagttgagttgcttagcatgtggaatttctccagctgtcagtagcctgatgattttatggttgttatagtaaattgctatcattttacatattgactgggcattctttctgttacagccttctttatcaacaattaaaatatgtaactccaaaaatagccttcttgtgaaagtgaagtctgagctaatcattgtgttcagccactttcaactttatttctctcaaaattgttacagtgattgccctcaagctttgtattgttcatttttgttgttgttgttgttgttgttgctgctcttttttctccatgattttagcaaaagaagtaaactcaactgtattggtcacggtcagcccattcaatgacaagggtgtctgtctggcttcaccttcaggctattttagtgtgcagctataggaggcagaggaaacgtgggtggtgtagtttctaaaacacgctgacttgctgattgataattcagggttattagtgtaacaaagcgtagtggaaactcctactcctgctgcaccatacagttacagaccctaccatactcttggtctcatttaaggaaccattaacaccttcactgctgaaaagcaggatttataagcataagtcatccacctctaaatattttaacatttaaaatgcctgattcaaaagatacagtttttgttgtttttaactagttaaaaataaatcctaagaaaatatatttaaatattgcaaatgccacttctaaaccaaaatacctgagaatattttttgtctttttaataacgattttaccattcattttatttaaaaacatttctcagcatagcagggcactgtatggtctctgatgcactactcaaccctctagttgtagtagagggagccacagacagtacataaatgcattgggcagagctatattccagtgaaactttatttaccaccataggcatgggatttggcccatgggttgtagtttgccaatccctgacacagaccaacatagactgggggctggatgaaaaacaaataacgatgtgtcatttctttctttaacataaaataaattcaatatggtacaacactg

SEQ ID NO: 727 - DNA, 4667 bp, Homo sapiens
acacgcgtcctcccctcggcggggaggccggctaggggcaggcgggcagcgatgcctgcgtcggccacagctgcctggcactgccctcctttgtgcctgcctcctctgccagcctccgctccaacctccccccccaaccccgcaacgaggcctgctcctgggcccggccgcagggcccgttgcccacagagcgcccaccctgcgcccacccggggtgccctcaccttctgggcccctggctcctggcctcgggtcctgctggtgcccaggtcgcccggccccgtcctccgtgctccgcgtttgccccaccctgctgcccgagctcggcggcgagcctggcacggtgccaggctgcctgggagcccagcccgggcagggcgaactttccagcgagggtgtgtatgggggggagctgcggggtgagggtggtgcctggggagggagagggccccaggtgcccggcggccggcccccggcccccagcccccagcccctggccggcctgcgggggcctcccctgcctcccgtccccagagtcccacagaggcgcagacaacacgagcgcttgagtcccagcagccatgtgcaggagccggcaaacaaacaaaagcccttatttatttatttagttcacactcccagataaggaggcgccttttgtgcacataatttcacacacatcagaacggaggcgatgccacggtactccccacagcccgagagccccggacagccgcccggccctcatgaataattgcatcgcctcggcctgggcatttccatatttaaattgggcagcagcgtatgattaattaagaaggaaaaaggcaaaaaggaagaaaagcagtgggggtggggagccggacactctgggcagcgcaatgtgccaaggtgcccgcggcagcttaactcctcccatgccagggcccagggggaggccacagcaggggctgggaggggaggctcccaagaccctcagcctggagggcggcatgtccttgcctgctgtcctgtgtcgagtgccaccccagcctcacatgctgcctggggaaggttctcttcctcctgttcgtattccgggcagctcaccattgctcaggtcaaaatgtgccatgccagtgctggggaaagagacacaccgaggccccccagtggggcacttccagcgggaactgacctgtcttttgccctgcacagcttcaccctacatccctgccacatgcaagctgcaacgctgccctgcctggggaggctctgcggcccatccccactctcacaagcctcctcctccaaagggctggctcttctggccctgaaagcagccggcctgttccgggagtggggcaggaaggcctgccacccttctagaaagatttttggctaagtgagtgccaggaaagactatattcctaaggcaagaagtggccccggatttagagtctggccatcaccaaggtttggccttattgtttgccatttgtgtggcctgaggcaggttatctggcctctctgggcctcggtctgcctggttgcaaaatgggaatgatatgaatgcccactattcctgccctgtggggtcccggcgagcaagagcagctcctggttggcagagagcctgcccgagttcccagactcgttgtccttgtggtgggctgaggtctgagccagaacaagtccagatagacccaggaccatgcagccctgcccctgctgaggccccaggacactggtcagaaatttgctgagaaaataatctgaattcttgtggccaagagtgtcctagggccaccaggcctggcttggttgtggggggcccatctgcccttgagcgtatgcaggggtgtgtggagtgggagggctctggggcaggaccagctgcccagcaagagcctcctaggggtcctctggggtctgggcagcattattatcaccccctcctttacagctgggggaactcaggcatagagagttcaggagcatacctgagatcacaccaaagtgggggccctgggatttaaactcagagcaccccaaatcccatcccaaggcttttcttttctctttttgagatggggtcttgctctgttgcccctgctggagtgcagtggcgtgatcaccgctcactgcagcctcaacctcccaggctcaagttatcctcctgcctcagccacccaagttgctgggacttacaggcgtgtgccaccatgcccagctaatgtttttttttttaacctttgttgctcaggttggtctcaaactcctgggctcatgcaatcttcctgcctcggcctcccaatgtgctggaattacaggtatgagctaccgcgctcagcccaaacccagggctcttaaccaccctactatgtactgtgctggcccccggtcaagggagagaactcacgtcaggcaaaaatgttttacagagaggcagctaagtcttttccacagtggatgacacagtccccctcacaaaccaccccacagatccaaccccaaggaactctgcttctacgtgtgcccttggggcaagggatgcaaagcaccaggcgatggagctcagaggatggcactcttccagagagctgtgtgtctctgggaaagctaacacacctctctgagcctgttgctacagctttaccatcagcgatgtgactgcaagccttctcagctgcctgtcagcagatgcacaggcctgtgcacagagctctgcggagaccacgccgacatcgccgcacacccaccctcctgctcatgggacagaccattcacacctgcttcaccaccagccacaggcttgtcggaaggagcagactcttctccacggacaagccactgcccctttgagggcctcagcttccttaccctatgagatgaggaaacagatcttcacttgccacaggacttggggggatgaaaaggtaacctccgtaaagctgcccctggtgtggggaagccaccccatagatgacattgcccgccctccccctaggcccagagctctacagagtcctcaagctggtgtccctccaggctaaaacacttccaccccctgggcagtgcactacagggtggtggggaaggggccatctgtggaagaaacacagggcctggcctggggtcctgggcaagacctctgtgacctcagtttccccagatccctccaggtgtgaccttgtagatggcctctattctggattcacagctgctgaggaggaggaagaggacactgaaggcattccttcagtcccctggggaggttcagatgctcagactccctgataccacctttcctgggcagaataaagtccccaagatgtccaagccctaatccctggagcctgggaaagtgttacctcccagaccaaagggactttgtaggtgtgtgattgagttgaagatctgcagtgagagggtagcctggattagccacgtgtgcccaaaagcagagactccttcccagccgtggtcagagacagaacaaggggacgctgctggctttaaagacggaagaagggacgaggagccaaggagtgcaagtgccgccagaggccagaaaaggcaagggatggatttttcccctggagttccaggaggaaccagccctgccaacacctggattttagttctgggaccccacctcagacatctgacccccttgactgtaaggtaataaatgtgcgttgcttaagccactgagtcagccataagttgttacatggctgccacaggaaactaacaggccctcccctctggccccaacatgcccagctgcctgtgaaggggaagaaggatggcacaaggcacggccctcatcgatgtgttcacacaccttgctcccctactgagctggccctggggctgcagacctgatccctgctctcaggagccttcgccagctgagagacgcccgcagagcctcccctccactgcggaggctcgaaccttccctcctgctgctgctgccccatcctctcctcttcctcctgctgctgtttgttgagtgctccctgtgagtaggcaccaggctagtgtcctcctcccaaccccagcctcataggctcagcggtcaggccacccgagcagtcacattgtagacccctgaatcctgcccatggtttggcaggacaaagggccttttctgcttcagagtcacaaatgtgtcctcctcacaataagggtggcatggaggtccctgggccagtgcctcagcctattgagcctggggtccttgtctgtacagggggatgaaggtagcacctcacagatggcgataaacccagccagtgcagggcaggcagtcagcgctccaaactcgcttcaagtctttgcctatgctgccaatcaagtcagctgtgggaagagtcaggtttttctcttgaaagtcagggccgggcacggtggctcatgcctgtaatcccagcactttgggaggctgaggtgggtagatcacaaggtcaggagaccgagaccatcctggctaacacagtgaaaccctgtctctactaaaaatacaaaaaattagccgggcatggtggcacgcacctgtagtcccacctacttgggaggctgaggcaggagaatcacttgaacctgggaggcagaggtttgcagtgaaccgagatcacgccactgcactccagccctggacgacagtgagactctatctc

SEQ ID NO: 728 - DNA, 4530 bp, Homo sapiens
ctttccctgggtgcccacatgaacagagacaccaggatggtgagatctcccgaggaggggtctctgaggaggggtctcggagacacggcctggtgctgggtgaggggttgggaggctgaagcggggccaggattcctcaggttccctcagtttccctcaaatttccctcagtttccctcaggttccctaaggttctccaagttccctcaaatttccctcagtttccctcaggttccctcagtttccctcaagtttccctcagtttccctcaggttccctcagtttccctcaggttccctcagtttccctcaagtttccctcagtttccctcaggttccctcagtttccctcaagtttccctcaggttcccccagtttccctcaagtttccctcagcttccctcaggttcccccagtttccctcaggttccctcagtttccctcaagtttccctcagtttcccccagtttccctcaaatttccctcagtttccctcaggttccctcagtttcccccagcttccctcaggttccctcagtttccctcaagttcccctcagtttcccccagtttccctcaggttcccccagtttccctcaagttcccctcaggttcccccagtttccctcaagtttccctcgggttcccccagtttccctcaggttcccccagtttccctcagtttccctcaagtttccctcaggttcccccagtttccctcaggttccctcagtttccctcaagtttccctcaggttcccccagtttccctcaggttccctcaggttcccccagtttcccccaggttcccccagtttcccccagtttccctcaagtttccctcaggttcccccagtttccctcaggttccctcagtttccctcaagtttccctcaggttcccccagtttccctcaggttccctcagtttccctcaggttcccccagtttcccccaggttcccccagtttcccccagtttccctcaagtttccctcaggttcccccagtttccctcaggttccctcaggttcccccagtttcccccagtttccctcaggttcccccagtttccctcaggttccctcagtttccctcaggttcccccagtttccctcagtttcccccagtttccctcaagtttccctcaggttcccccagtttccctcaggttccctcagtttccctcaggttcccccagtttccctcaggttccctcaagtttccctcaggttcccccagtttccctcaggttccctcaggttccctcagtttccctcaggttcccccagtttccctcagtttcccccagtttccctcaagtttccctcaggttcccccagtttccctcaggttcccccagtttccctcaggttccctcagtttccctcaggttcccccagtttccctcaggttccctcgggttccctcaagtttccctcaggttcccccagtttccctcaggttccctcagtttccctcaagtttccctcaggttcccccagtttccctcaggttcccccagtttccctcaagtttccctcaggttcccccagtttccctcaggttcccccagtttccctcaggttccctcagtttcccccagtttccctcaggttcccccagtttccctcaggttccctcagtttcccccagtttccctcaagtttccctcaggttcccccagtttccctcaggttccctcagtttccctcaggttcccccagtttccctcaggttccctcagttttccccagtttccctcaggttccctcagtttccctcaggttccctcagtttcccccagtttccctcaggttcccccagtttccctcagtttccctcaggtttcctcaagttgcctcagtttccttcaggttccctcaatttccatcaggtcccctcaggctctgccagtttccctcaggttcccccagtttccctcaggttccctcagtttcccccagtttccctcaggttcccccagtttcccccagtttccctcaagtttccctcaggttcccccagtttccctcagtttcccccagtttccctcaggttcccccagtttccctcagtttcccttaggtttcctcaagttgcctcagtttccttcaggttccctcaatttccatcaggtcccctcaggctctgccagtttccctcaggttcccccagtttccctcaggttccctcagtttcccccagtttccctcaggttccctcagtttcccccagtttctctcaggttcccccagtttccctcagtttcccccagtttccctcaggttcccccagtttccctcaggttccctcaggttcccccagtttccttcaggttccctcaatttccatcaggtcccctcaggctctgccagtttccctcatgttcccccaggttctgtcaggtgaagctgatgggctgttggggtccctgaggtgtagggggtggctgatgagcccggggaggtcggatggaggaactgaaggcctcccagccccggtgctgttcaaactgagcagggtccccactaaagggccagtctgaaccccaacatccctgcccctgctggtccccacagtttgcccccaccctgcctgctgggggtgcctaacctcccttcctttgcctttccagctctcctgagaccacagcaactgcagaagctgaagacatttccagaagttcaagcttccaccctctgcaggtccccactgagctgggacccaggtcatccaccccaccccaaatccctggataggaaacccctttctcctcctgctccttgtccccttcatccctgccgcccagcatcctactggcctcagcacctgtggccagaccgtccaagatcctctgaaggcccagctcttgctgtccaccccggcagtaggcaggcagcctggccatgtgccctccggtcagcatgcggtatgaggaagagggcatgtcctacctctacgcctcctggatgtatcagcttcaacatggagatcagctaagcatttgcttcacctgcttcaaggctgcctttctagactttaaagacttgctggagtcagaggactgggaagaagacaactgggaccctgagctgatggagcacactgaggcagagtcagagcaggaggggtcctcagggatggagctgagctgggggcagagcccaggacagcctgtgcaggggggctctgaggcatgggggccagggaccctggcagcagccccagaagggttggaagatgcaggtctggacccccactttgtccccactgaactatggcctcaggaggctgtgcccctgggcctgggccttgaggatgctgactggacccagggtcttccctggagatttgaggagcttcttacctgctcacactggccaagcttctttccttcatagcaggggtttctcaaagtggacctgcccccaggggagcccgtggtgttgaagctgggcattacctgggcagtggaccctgccgaggctgaggcctagttactggccctgcagcttgtctccatggtgggctgctatgataccatctacctacagaagatgaccccagacagggccctgaggaccccagggcagcactggaaattgctgctggagcctggtgaagtgtgggtggtgagactccaagatgcaccccaagagcaggacctgcactggtggatgctgagcattctagaaacatcgttaacaggacacagggcagagctggtccctgcagcctcagccctgcagaagaggattcaccatagtctcttattcaccctggaccaacagggagagcaagaagggagactcagcctgtaagccacagtcctccagccaagaacaggatctcagcacccctgagacacagagcaggggtcctgaggaaagcctggctgttgcaggagcctcggccatgggggagctgccctgtttccagcctcagtccagggccccagaactgagagactaaggctcatgtagctgccattgtcctgggcacaccaggacatcagagactgggaagggccagcaattgctgttccacaacagccaggggagcagttggcaaaggaaacatggggagcaactttaggggctgggagatagggcctgttgtggcctcagagggaagcattacaaatattcataacctggaaacaagttcttaccagttgattgtcacatagttctggatgtgttggcctgaatggctgttgtgctgcttgtgacatggggggcagggcacagaacttgtgcctatttcaccttggccatggggagggacattgcttgtaaaacacatgctctgcagaacacaccagaatctgtggtgacctggatgtgttctcgactttgccaggacaatctcaggggtgccacaagaccctgtcagcagcactaggatctctggtctacagtggagggagagctggttttaaatgttggccgttgatgcaatttaaccatttaattcctgttgctctatatgttgtttttaattttaaaaagtcataaaagctttcaaacaag

SEQ ID NO: 729 - DNA, 15904 bp, Homo sapiens
aataaggaaagaagcagcaagcagactgggtgtgttaacaagtctgggccactgcaggaggtacattgcccaatttctgcaccccgaggccctccaaagtctaggagaagctcctgggaggtccagggcccaagaccaaagcctctatcaactctcccacctgtgaactgcccctctcccaaggtaggcattgtcggggtgtgtagactgggagccacccacacacctgactctcccctcctaggaaatgcgtccaccaggtcatttctcctgcaaaccctcattttaaagtgtcttggatgctttcctgccctttttttttttttttaacataaagaggggtgagagcccaagagctacagcagggggaatagactgaaactgctgcctactcacacgccagtttcccttcttagaactctaaccagaagccaatggtttcctcctaaaagaaaaactcaatctgttgactttctctctcctctcctgccagcttttctgcccgagccgggctctctcttctctgtgggttcgtctttcagccagtctttctctgcttcagattcttggtttcttgctcccggtagtccctgaacctctttcactctttaaaaaaaaatggggaggggcggtgaacaagcaaagaggaagccctcacccacccaccaaatctctttcttactagcaactaattccctctctctttccacacacacagtcatacacacacatacacatacacaggcacgtactccggcgacctccagatgttcccgacagtgcggccatctgcttagattgctggggcgcgcagggggagggggcagggatccgggatgcaggaagctgtgagcgaggccaactagagggggcgggagcagcgcacttttgagacgctccctagagtggaacccgggctcggctcaggctccgcgggcggggcgcgcgccgagagaggctggcactttggcgacactccctgagccgccccgcggccggcccgagccgccacccggcgcccggcaggggggagcctggctgcgggcggggaccggggggcgggccgcgccgcgcggagaaaagcgctggccggagggcccgcggccgggccgccggggtgagcgtgccgaggcggctgtggcgcaggcttccaggtgagtgcagttccccgggcggggcgagagtccgcgctgcggttgaagatcccaagtccccgatcctagcctcgcggccccttcggagggcgggctggggacgccgggcgcaggggcggggctgggtcccgccgaggcccctcaactttcgtcggacgcctagggctgggcgggagtggggaacgccgacccaggggagaggtcttgcgggagacaaaggctacgcccaggggccgtgtgggtctttgtgcggacacgtgcatctcacgtttgtgggtctttgtggatttgcggtcggggacgcgccgctgtcggtgcctttgtgtgtccgtggctttgcgcggctgctttgcgcccgtgtccacgtttgcgggcctgcgcttggctgtgggcgtcggtgggcgcatcgcgtgtctccgcgtacgtggtcggtgcctgccgacgtgtctgggctgggtgtccgcagagggtgtgcgcaccgagagcccaacgccgccccacccccccgctcccccgccgtcccctcgggcccacgacttggctccaaacttttctcccggttcctcgggcaacagccccagtcctccccaccgctacccggccgggggcgcagacagccctccccctccccctcctgaggtcccaggacagcaaggggctgcgacgggattggtggtcgggggatcggcagcgcctggggactggctgggcaggggctgggcggagcgtgcggactccccctcagaccccggctgggaggaagaggcgagcggtgggtcccaggctccggccctgggctggggagaggaagggacagggcggctggcgttgccctccccgcgcttcttggaaagagtgtgatccagagttgcgtctgtttggtagggagacaggctccgctttgagacccactctccgtttgcagcccgcccccggggtagggggccaaccctcggacccggtaggggagagggggactgccagtccagatctgggcatgcccgaggcgccggctcacaggacccggagctgggctgggggccgtgggagcctcacatacacaggtttcaactgggacggccactggcccctgtgcggcgctggcaagttgctcagcttcgcggagtcgcggtcactctggcacggacagggcgagaactccctcgcggctcggggcgtgcggtgggaataacccgcgcctctggagccgggcggagagcagcgccagcccacacttggcctggcgaggaggtgactcaagaccttcgattcttctttcatctttgtgcgccctgcccttcggataagtctagacttgcagtgcctggggctgaccggaggtgggggggggggggtgctcagagctgcaggagcctgctgggcttttgagcctaagtcgcaaagataaccgtaaacaccctcctccccactgctcactccagtctttaacctagaactttgtcggatgctgcagacatgatggaagggcacaggccgctaacctgggaaagaaacaactgtgggcattttcctttccctctccggcctcagtttcccttctggaaggggaggtattgatagcctcttctgttctggctgactgcttcagatcccagaacccagaaacactttgatgtttaacctacacctccattctgacctgacctattccgaggcactactttgctccccaggaaggctgcaatgcaaccgccaccgggcttccacctacccttcctccaacaccaggaaaggcaaaagctgataaatgagtcaaaaatggagagggaagggagggggattgaccttttctcctcttactttttaaatgacagtttgtggtggtaaagtccagatcagtcttcttcttaatcataactcctgggtcaacacaggggatgcagttaagagttcatgcttcagttttcagagcaaggctggcctgggcactgaggacacttcctaaagagggttgggtcctccctgaaagccacctggccaaaacaagtcctaagaggggttctgtgggaataacccggagaaggggcctgacaggagattcctcctgctcatggttttgaagtcagtgggtacacaggggaggcaggaagaatctcccacaaaaggatcagcatgtgcaggacctgtgcatgaaaacagcacaggtggtcagcatggtggaccagcagacgcaaggtcttgagggtggtgaattggaagtgaacttgaggctgggaaggcagggaccaaatcaccaaggccttgaatgtcaggccgagaagggggatttgagcctgtaggcaatggagagctcctggaggatttaaacaggcacagcagggtgcggttggtaattctatgaaacccgtctctggcttgtgggtggtgctggaggccgagagaccaatctggagggcgagtgatccagcctcttagagtcaaagggacccagattttactcccaccccattgcttcctacctctgtggcctgggacaagtaacttatttaaaatgtgaggatactaattcttgctccactgatttggtgtattaaataagataatgaattacatgtgcaaataaataaaaagtggtttgtagtgtgtattacattgtgcagacattcattggattgcactgacaatagaaggcagagacagcattgactctggtcctaaacctgatctcaccagcgggcagagccctaagcatcctgcagggttgcaccaattgttatgttccccacaaagcagaagggagctttctgtccatgacatttcattcatctgatttatcaccttcatgtggccaggctcgtgcaggcaaggaggtagacacagattcgtagatggccacagaagtgggccagtaccttgtcgggggcagcccaagggccatgggcgctcacaggatgggtggcctttcctggatgagcggcaggttagactgggaaagcctcacagaggaggtggctttttgaatgaaatgtgtgagagtttgctggtagacaaagaagggtatctttgcatcagagggaacaacgtgtgcaaaaaggcaggtggctctagaagagtcacaggcctctagactagaaagctgtctctgtgggatgggttttaaagagggagctgtagtagggtcccagacttctgttgggaagtgcgttctggtgccagcatggctggcagttggagtcaggccaggagcgaggctgttgcagcaggtctcttgagcctgacctggacagggggaggtgactgcccagcttagggatgagggaaagggaagacagtgaccccaactgcccagggggatctgcgaatttgatgctgagccctcattctgtcacaggcaacacagcagcttttgcctgctttggtctctgagacctttccagctcacccttcccagtctcctgggagtgccttgtcagcatcttgtagccacactgggatcctggatggtatgtggagagaggatccaaggcctctgggatgaattgtggattcttctccatcttcagcccctgccttccctcaggatttgctggtgtcacagcacctttttcttccctggtccctgaaatcactcactggggacaggaaccaacattcagtgaataccaacatgtgccaggccaggtctgggtcttcactttgcctcatgtaatcatcacagtgacccgttaggaccagcactgggattatcaccatattacagacgaggactcagaggggtgagggcacgagcaagcctcagagcagtgaaggccctgttgggttggaacccagactgcctggctacaaaacccttgccctctgccccatagcgcctcctcatgtgtccatgtacgctgcctcaggttgatgggaacttgaaaatcttcaagaagaagacatattgaaaggagaaaatcttactgggagccttgcccatctccctgtagattatcctccttgggtaagttgctaggcttacaggtccctgcgatcatgtcatggaggaggccaggtactggatgtcagaatacctgggtcctgggtccagcccctgtcctctctggctgtgtgactctggacagatcacagaacctctctggacttcttaacacagctgtaaagtagatatgacgccatctaacctgctgatcctgcagggtgactgaacagatggtagttgaggaagcatgggagaggttgagaggtgtcctttggtgaggtagcggtattctagatgcttggtgcatcttcacgtggtgtctgctctgtaccaggctcagtgctcagcttcaagggcataaaaaggaacctaatcgcatccctgcccacagtaggatagacagttaaacatgtaagtacagttcagcatgaccaggtctaagcacatgtgctcatttgtaagctgaggcagagtggatttggagctaagacatctggggttaagtccggggtcctctccttcccagctgagtaacatccatttctgtgtctgcaaaatagggacagtatccccagggtcaaggctctggtgaggcagaagtgagatgctggtggagagcacatggtgggctgctgtgtttgtccagatgtgctgcattggtgggtctgttgcaagagctggccctcagggctccgggagtctggccttgaaattctttctgccttgcgtttccagagctgacaaagtggttggagggcaggacgtttctgaaccatccacctggggatttcctcggcatcagcttgagtgaactcatgactgaggggagcagggtgggaggcagctctgtgttgaggaacagctgatcgagacaaaggccggtctcgggggtgctggggccctgtaccagtggggccctgtgccaacagtgccctgtggaagttgtcgagggcggtggggggagctggaaaactttacagaccagagatgctgtagtgcagcaccagggtcaggcagctggggccaggtaggttcaagctggaacccaacacccagagagctgtccttatcagcagacaccagggaagtgactgaagaatgtcatcacagccagtctcggacctgctgtgctcctggcgccacactgggaacttgggtggggaggaacatgaaggatcacatggtgactgccttcagaaggcttagcaaatcaccgtcattgtctaccacacattgagtatttgtgtagcagatagtgagtggaatgcctgccattctgtcatttaatcctttcaacaaacctgtgttcttagccctgttgaggaccctcggagcgggtcccaagacttacccaaggctggtaggtacagagctaggttcacacctggtctgggtcttgcggttgacccgttcatcctgctcttcctccacacaccctctaggcctggctctgatcccaggtgggggaaagaacacacaggtaaagtaggcagggcaccgccccaagctgcttacacatcaagtaggaaaacagcaggtaactcacggcagagaatttactgaaggaggcctgtgggtagcctgtggggtgagaggccaggagggaggggtggcccgagggcctgagtggacagaacaggctttgttttgctgggagcaggccaggggcaggcgggatggatgcatgcagttctggcagtcacatgaggcatcaggtcccaggtcctgggccctgctctgccattccttgctgtcactgcccctctctgggccccagttgcccatgatccccaaggggccttccagctcccaagccctggaattctccaagtttggagatgtattagcagaggctgagagttgttcaaagtccatcaagggaaggctgttcccactttggctgtcaaggagggttcaaatccagatgaggggctggggacaggtgggaggggagaagaaggtggtgacaacttacaggtgcctcgtgcatgggagaacttgatttctgtaggtaaaaagcagaacccaagaggtttctgataaggagagtgatgtggccaaagctgttttagaggtgtctcatagcagtgtgtgcggtgtcacctggggagacctgcctggagcctgttggggccgtaccatttactctttgtccttgcaggccatcagcaaacttagagtcactgtggacctggccctgtgggcccaacaatgcatgattcatggcccctgcactggaaggccttacggtatatcccccaaatcacagatggatgtggtttctaagcccttgtcctcctgttcttgtgttttataatctggtcaatcagtggatatcttgtatctgcaggtcaagatttggaaaaaaatgttgaatcttgactgaaagatccctttctccctcagccttctttggtggctaccagtcttcatttctctttttcctgggggtagagtacgggtcccagagggaggcagtgtgaatactgttacacagataagaaaaccaaggcccaaagaaaacagggaaggtcacacagatagtggcacacctgggactagagccccagtctcctgggtccaaagctggtgttagtgatcttgttataagttggtcttctgttctcattgctggtctgtaagccccatgaggacagggaccctagtatctatcccatcaccacccaccccccgccccccactccctcctggcctagcccagtgctttgtatatacttagtagaaatttaggatatgcttttgttaaactttaaaatcctgaaactctggagttggattatctaaactgaacctcttactgtgaagctggagaaactgaggcacagaagggggaagagacttgttcagagatgagatgaggacagtccatggcagagcaggcactgagacctagggctcctgaccatcctgcaggacttctcttgtcaccaggcacagttgccctgtcacctccctgtcagtgccccagagtgtggggagggaagtagtcggtgactgtgtctcagggggcttcatctaccattggctgcacatttgtcagcgtcctggtgctgtgctgggtgtttcacacgaacgatctctagcccttgcggcaactccttgaggaagggagtgttaactccattttaactccccatgacttctgatatggtttggctgtgccccacccaaatctgaacttgaattgtatctcccagaattcccatgtgttgtgggagggacccagtgggaggtaattgaatgcaggaagcttttgcttcctcctcattgtatcttgccactgccatgtaagaagtgcgttttgccctccgccatgattgtgagaccttccccggccacgtggaattgttaagttcaattaagccactttcttttatatgttgcccagtctcaggtttgtctttatcagcagcatgaaaaaggactaatacagtaaattggtaccagtagagtgggggcattgctgaaaagatacccaaaaacatggaagcaactttggacctgggtaacaagcagaggttggaacagtttggagggttcagaagaagacaggaaaatgtgggaaagtttggaacttcctagagacttattgaatggctttgcccaaaatcctgatggcaatatggacaataaagtacaggctgaggtggtctcagatggaaatgaggaacttgttgggaactggagcaaaggtgactgttgttatgttttagcaaagagatggcagcaatttgctcctgccctagagatttgtggaactttgaacttgagagcaatgatttagggtatctggcagaagaaatttctaagcaggaaagcattcaagaggtgacctgggtgctgttaaaggcattccgttttataagggaagcagagcatagaagtttggaaaatttgtagcttgacaatgcattagaaaagaaaagaaaatgccattttctgaggagacatttaagccggctgcagaaatttgcataacttgcagctgaatgttaactcccaagacaatggggaaaatgtctccagggcatgtcagagttcttcaaggcagcccttctcatcacaggcctggaggcgtaggaggaaaaaaatggtttctcaggccaggcccaggatctccatgctgtgtgcagcctagggacttggtgtcctgtgtcccagacactccagccatgactaaaaggggccaaggtacaactcagccatggcttcagagggtgcaagccccaagacttcgcaggttccagaaccaccatcattcactgaccttgggcaggtgacccaatctctctgagcatccacagaaggggataattgttcattttacaaaacccaaaccaaagctcaacaccacttggcagcttccatgtggtgttgagcctgtgggtacacagaagtcaagaattgaggtttgggaacctctgcctagatttcagaagatgtatggaaacacctggatgcccaggcaaaagtttgctgcaggggtgggaccctcatggagaacctctgctagggcagtgcagaaaggaaatgtggggttggagtagagtccctactggggcaccgcctagtggagctgtgagaagaggggcaccatcctctagaccgcagaatggcagatccactaacagcttgcactgtgcacctggaaaagctgcagacactcaacgccagtccgtgaaagcagccagaaaggaggctgcaccctgcaaagccacgggggtggagctgcccaagactgtgggaacccacctcttgcatcagcatgactcagatatgcgggacatggagtcaaaggagatcattttggaactttaataagatttgactgccctgctggattttgaacttgcctggggcctgtagcccctttgttttggctaatttcttccatgtggaacagctgtatttacccaatgcctgtacccccactgtatctaggaagtaactaacttgcttttgattttacaggctcgtaggtggaagggacttgtctcagatgagacattggactgtggacttttgggttaatactgaaatgagttaagactttgggggactgttgggaaggcatgattggttttgaaatgtgagaacatgagatttgggagggaccaggggtggaatgatatggtttagctgtgcccgcacccaaatctcaacttgaattgtatctcccagtattcccatgtgttgtgggagggacccagtgggaggtaattgaatcatggggccagtctttcccgagctattctcgtgatagtgaataagtctcacaagatctgatgggtttatcaggggcttcagcttttgcttcctcctcattctctcttgccgccgccatgtaagaagtgccttttgccttccaccatgattgttagaccttccacagccacgtggaattgtaagtccaattaaacctctttcttttgtaaattgcccagtcttaggtatgtctttatcagcagcatgaaaacagactaatacaacttcccagagttgcacagtgtagcaagtcactcctgctaaagatggtcagccaccttccttttccgatcctcagtttctctgctctaaaatggggatgagactgctggctcacagagtgactgtgcggactaaatgaaagcatgtgtgtccagcactagcagagagtgaggactggccctgactgtcactgtcgtcacttcccactgcaaatgcccagccccgggcataggcccggcacagagcaggaaccccgggagaggtgtctactgtgcagggctgagcaaggaacctagttcagtgccctgggagcatctgcagacagttacctaggtaactcctgcccctttacatcagatgcctctttacatcggctgttactaccattgcctcagttctgtatcttctggctgctgggtgatgactgccctgtgcctgtgcacagcccttcacagttggcagtaagggttaatcaacttaggtgaagagggcagggcagaaattgccaccctgtagtgcagaggacaaggctgaggcttaaagaggggcagcgagaggtcccctctggcgggatagcatttgggtcgtattttgagctgctggttacataagtgggagctcatatgaggccatttggcatttcacggaccccttgtataatcacctctgggaatcaaagggtaatctcagggcctttgtgctgtttgtttaaaccccaggaagggtgggtatgaatgagcagatcagcttagcaggggaggtggggcctttggtggtaatgagccctgcggtgaggagctcgcccaggggaacaaaaggggcctgaagcaacttaatattttccttttggttccagacattggaacactctgtcctgcctcagctgggaccatgcccaggatgcacctgggctggatttaatcctgaaattggcctctacaaaagaaaggggtgggagaggagggtcccacatggggaggggggcaggggagaagagtcccacttttccctgcccctgggcaaagccagagtgcagatcaagtggctagccctttaaagtttcatgcagggctggtaatgcaatcctgctgctccctcccacccaccttccagtctggaaggtgggcaggtccctggcccatctcctccccctctctcacctccttcctgaagtccagagggagggatgggcaggagggcaggggcccagagcagggccacccagatgaagagcctggctagaaggaagcttagtgccttctgtctcccaggctgctgaggggccactgtgcagggccggggtgacgacagactatccaattggtctagttagaagctcccactgcccaaccctctccttctcatgctggcaccactgagcaccaccatcccaggagctacagtggacgtgaacacaggctttgaatccaacagcagtgggtggtgtgaccattagatgtgacaacacgtatgtagcacctggcatctgtagcagccaccactgtaattgtacagagggaactgagatctgaggagggacactggctcatgccacagcatgtgtcagtgggaaaagcccctcctgcaccctgcctctccaccagctactctgccagtcctgctggaggcaacgcatatgaatatagtaattggagtacaccaggcctgggtcccattcctgccctgcattttactagtttggggtaaggccctattcctctctgagcctctgtttcttcatctgtataatgggggaagcagcctaactgcctgcccgaggttaaaggaagaaccaaagaggtgtagtagcttaatctgctggtggcaagggacagagtaagggggaaagaggcttgggacaggtgtccccaaaacccatctgggaatctggacacccacgttggacaccaggatgcccaatgagaagggaagttcctgcccctggatgacaggctagggggacagggcaggtggagtatgggtgcggtggggcagtcactgcaggccccattgcagggagggagtcctggtcttgaaggccagccccggccagaccacaggtgctttctctgtcagtgtcccctctagtgccactccactctgctgtgtggctgtccaaaagcgtcttaacctaaggcccagttcccttttggtaaaacagagaattttctgccttggaaggtggttgtgagggtcagatgcgaccatgctgtggggcagccagaacagtgcctgacgtgtaacacttgctcagcagagagtggggcaccctgggcacaccctaccctcagccctgtggatgagcccctcacccggggcccgaggtctagaccaaaccagggactctggaccatcagagctggagaggccagcccgagaaaccgtctagtctggtgggtttcaaactgggtttcctaacaccctaggcagggatggtgggcagaagtcgagggcttcaggtccccctcacttcagccagaccaggcccgccttcatctgctgctcttgtttaagaaagggatctgctgcttctagttgaaaattcaccacctggcctcacgccccttaccatacaaatggagaggcagaggccagagaagaactgggactaggaactctggggagtgttccaggaagcattccaggaggtcggggtctgtgacaccttccaacagtgtctagactgggctcatgtcctgtgtggtggctttagaccatctggtgcattcattcctcacctgtggctctctttctagcccccaccatgccgtggcccctgctgctgctgctggccgtgagtggggcccagacaacccggccatgcttccccgggtgccaatgcgaggtggagaccttcggccttttcgacagcttcagcctgactcgggtggattgtagcggcctgggcccccacatcatgccggtgcccatccctctggacacagcccacttggacctgtcctccaaccggctggagatggtgaatgagtcggtgttggcggggccgggctacacgacgttggctggcctggatctcagccacaacctgctcaccagcatctcacccactgccttctcccgccttcgctacctggagtcgcttgacctcagccacaatggcctgacagccctgccagccgagagcttcaccagctcacccctgagcgacgtgaaccttagccacaaccagctccgggaggtctcagtgtctgccttcacgacgcacagtcagggccgggcactacacgtggacctctcccacaacctcattcaccgcctcgtgccccaccccacgagggccggcctgcctgcgcccaccattcagagcctgaacctggcctggaaccggctccatgccgtgcccaacctccgagacttgcccctgcgctacctgagcctggatgggaaccctctagctgtcattggtccgggtgccttcgcggggctgggaggccttacacacctgtctctggccagcctgcagaggctccctgagctggcgcccagtggcttccgtgagctaccgggcctgcaggtcctggacctgtcgggcaaccccaagcttaactgggcaggagctgaggtgttttcaggcctgagctccctgcaggagctggacctttcgggcaccaacctggtgcccctgcctgaggcgctgctcctccacctcccggcactgcagagcgtcagcgtgggccaggatgtgcggtgccggcgcctggtgcgggagggcacctacccccggaggcctggctccagccccaaggtggccctgcactgcgtagacacccgggattctgctgccaggggccccaccatcttgtgacaaatggtgtggcccagggccacataacagactgctgtcctgggctgcctcaggtcccgagtaacttatgttcaatgtgccaacaccagtggggagcccgcaggcctatgtggcagcgtcaccacaggagttgtgggcctaggagaggctttggacctgggagccacacctaggagcaaagtctcacccctttgtctacgttgcttccccaaaccatgagcagagggacttcgatgccaaaccagactcgggtcccctcctgcttcccttccccacttatcccccaagtgccttccctcatgcctgggccggcctgacccgcaatgggcagagggtgggtgggaccccctgctgcagggcagagttcaggtccactgggctgagtgtccccttgggcccatggcccagtcactcaggggcgagtttcttttctaacatagccctttctttgccatgaggccatgaggcccgcttcatccttttctatttccctagaaccttaatggtagaaggaattgcaaagaatcaagtccacccttctcatgtgacagatggggaaactgaggccttgagaaggaaaaaggctaatctaagttcctgcgggcagtggcatgactggagcacagcctcctgcctcccagcccggacccaatgcactttcttgtctcctctaataagccccaccctccccgcctgggctccccttgctgcccttgcctgttccccattagcacaggagtagcagcagcaggacaggcaagagcctcacaagtgggactctgggcctctgaccagctgtgcggcatgggctaagtcactctgcccttcggagcctctggaagcttagggcacattggttccagcctagccagtttctcaccctgggttggggtcccccagcatccagactggaaacctacccattttcccctgagcatcctctagatgctgccccaaggagttgctgcagttctggagcctcatctggctgggatctccaaggggcctcctggattcagtccccactggccctgagcacgacagcccttcttaccctcccaggaatgccgtgaaaggagacaaggtctgcccgacccatgtctatgctctacccccagggtagcatctcagcttccgaaccctgggctgtttccttagtcttcattttataaaagttgttgcctttttaacggagtgtcactttcaaccggcctcccctacccctgctggccggggatggagacatgtcatttgtaaaagcagaaaaaggttgcatttgttcacttttgtaatattgtcctgggcctgtgttggggtgttgggggaagctgggcatcagtggccacatgggcatcaggggctggccccacagagaccccacagggcagtgagctctgtcttcccccacctgcctagcccatcatctatctaaccggtccttgatttaataaacactataaaaagttctttgcttta

SEQ ID NO: 730 - DNA, 298761 bp, Homo sapiens
tcgggctggagcgcctgaagccgcgaccgccgcctcagccgcctcagccgcggtcgccgccgcttcggctgacttaggctccgccgccgcctcctcacccgcctcgccccgaccccgcccgggcctcccggcctctccccgccggcccgcgggctcgccgtccggcgcagggcaggtgagtgagcggtggcgggcggggtcggggtcgggcgcccttgcgggttacggggacccagtccccgacggaggccgagtgacggggcgaccccgggccgcggcaaacttcgcccgagccggggcgggcgggggtcccgggctgggtcgcgccgtccccgaccgccgccggcgcctgcggcggcccggggcagcgaggggactcgcgctccctcaaggtgcggtcgccaggcctggcccgcccgcctccgccccctccccaaattcggaagttgcggcgggaagccgagaacgtctcggatgtgggtcagaaaacgtctggactacttgaggcttcagtttcaaaacggcacaaatttcatctcttgattgagaagagatctggggaacaccccggagcggccgcggcggctggagggcggcggggcggggcgcggggcctcctccccctggacggccgccgggagagcgcggcctcacccctcggtgaccctgcggagagccgcgcgcgggcggtggggcgcgcgcaggtctctcttgttgctcgctgtgttttattttaattttgggggtggttagaacgtgtttcttattgtccccacacgtgttctaattggaagtcttgtttcgtgaaagagtttttttcttttttttgcctggtgatgttttccaattccctccgcgccactctgaagtatattactggcataagaaatttgaaagttaaccaaaagtcgggtcctaaatctcgtggctcggggttggttatcttccaccgtccttcagagcagcctggatttgcaggtcttgttagccctccatgtgagccagtagcactcttagttgttgagtgtttgtagagtgggattcgccagaaggaatcttgagcagcagggccttgcggagaggcctttagagattagactgggcaacttatagactccccccatttcaaaaatattcctctggcacaggccctcacatatccctctgaaattgaactcactttcaggggcaaactgttgccctttttcttttctttggactttctcagatgtggatcccaaaggagtgtgcaagggtgcttccctatttaagagaactaactcccagtcctcctcatattcaagaataattcatcatcttaaagcgtgtcagagatacctattttggccccaaaaggagtgtttgtagaacagtggcactctaaagggatcatttgcaagatctgaaaggacctaattgatcatcacacgacagaagcagaaatagttctggtgttttcaggcttggagatctgtcagaaaacatggggccttaaaactaacaagtgcagtgaccgactaactgatgtctcactttcgagcagtattttttttttttgcttgtatgtagatgctgttgtttatacagtgcaagttcattacgaatggtttagaacttacgtagcttcacgtattttcttagttgataatattataaggttttgaaaaagttttgatgataaatggggtctttataactgaaaaaaatggactctgtctagaattcagggctttttggctggcgttgccccaggtgctgctgattagtggtgcttttggacctcaaaacatcactttcccagatatctttataatgctcatggtgggggaaaacccacacagctttgtggttacgtttttagctatttatgcgaaaaagttcaacatatagttgtattttgctagctgttttgaagaagctattctttaccctattgttctgaggaggctgacagcatgctgcatttataaatttgaaaaagcctcacgagcttcttgaaccaatctagctattcagatttggattctgtgtatcagttttgattatttcagttcctgtgtcaatggcagaatcatttctatttttacaaaagtctcatggctttattgtaaaggtgaacactgaaacagattttagtagatgtaagttgtgtatcctctcagtgaagaaggcagtgctttgggccataaccaaggaaaatacttgctcatgtattggaattgccccaacttaaacattagaataaatgctgtagattttggggcagctctgatgtctcagctctcatccctggtggcagtgactcagaggcaaggcgtcatgggcccgctgtccatggtgctgaatccgtgtcacctgtttctctctctctctctctctctctctctctttctctctctctctctctctctctctgtgtgtgtgtgtgtgtgtgtgtgtgtgtgtgtgtgtgttttggggcagggggagctcaaacttcctttccagtgtactttaaaattaatttcagaattcatattattaaataaaatttgatcagggaaattatgttgaatgggagcgtgtcttgaaaacacgccattttattcttctttttaaggaggataattatgctacaacattcaatttcctttgcttagtcttcactgtctctctaggtgggagttttgttgcttgagtatgggcatcaagtaacaaatcactgacattaaatgaaaccctgttttcttaacaaccattcctttaagaaagtaccagtttgttttagtttgttttcttttgcttataacagaatacctgaaactaggtaatttacaaagcaaaggaatttatttcttatagtcatggaggctgagaagtctaaggtccgggggccaaagccaccagctccactcccatgacaacccactaatccattaacccatgaatggattaatccattttatgagggcagagccctcttgatccaatcacctcttaaaggtcccacctctcaatactgcttctgcattgaggattacatttcagcatgagttttggaggggatattctaatcatagcacctttattacaatatagacatacatctgtaggcatatatctatgtaggggcaacttgttcccaaaagggttgactctagcatgttttgcattctccagcatgttggttctcagcctttcctggcgatgggatctgtttatgtgttgggctactgagtggttgccaggcattcctgttgtgttagagctatatctactctcttttctctaatattgaggacatctttgtaaatcattttacatgaatcttttctttctcttgaggttaatgttgtcagttactttagaattgccccacaggttagcagtaaaaaaaaaacaaaaaagatagatgtcacttgtggtacagagatgtcacatggtagtaagttgtatatcaagctaagcagtggattgttgaggtgctttttgttatgatcatctgaactgattctgtggccccatttgttgtacacttaacccaggttactctttgacatctcttttgttgacagaaactcaggaaaacttccttctgcctcatccaagcttcagaaatactccctgattccctactgtttgccatttcctatgctatgatctgggaacccatgagggaatgagacagagttcttattgaagggctcacctgttcggattgaggaaggaacatgtaaacagataattacagggggccatactcagtgctgcagttgggatacatagaaaaccaggcaaacgtgttgaggggcaattcatttgggccgagaatcagggaaagctttagagaggaggtggcctttgggctggaccctagggcatgagttataattgggcatggattgggtatacatttattagaaaaagactggaaggttggaataaccggagtacagagtgtgtagtggtgtggaggctggaggtatggaagcatagtgaaggagttgggaccctgctggaagtgttaggggcattgtgaaatggttggaactttgttggagatggaggggggtgaaagtggaggaggagttgcatggtaggtagaataatggctcataaagctgtccacatcctaatctcaggactatgttatgttacatggcaggggagttaaggcagcagatggaatgaggttgctaatcagctgattttaaaatagggagattatcctggattatctgggtgggctctgagtaatcacaagggttcttaaaagtagaagagagaggcagaatagtcagtgtcagagtgatgtgaggtgagaaagactctagctgccattgctggctttgaagatggaagggtgcactagtcaaggaatgtgggaagcctttggaaaaggcaagaaaagggattctgtcccctagagacttgggaaaggaatgcagtccttggtttctagcccagtgagacccttgtctgacttgtgacctccaaaactgtaagataaatgtttgttgtattaaaacactaagtgtctggaagtttgttccaacagcagtaagaaaccgataaaaactgggtctcttcatttggcagtcttagctgacaaaattaaggagggaataacatgattagattggttttagaagataaaatgatggagctgccacttgggtataattcagcccagataagcatagttctattctctatttcacctcctaggtaagactggcatctgatattgtcttatttggcccaaatcccacttccagtctctctcagcagcttccacagcctataccactcccaattgccgtgtcccactgggtcatctttcctctgtgttggacacttgagaaagagtagaccaggtatgcacttaccactgagattgtggtgtcacaggctaggcccaattccaacctcatagctgttgtcagattactttccagaggtttgtttctttacatcctcactaatccttcgtagcttcagatgttttaattattgccaattgagtagatattaaatatcttactgttttaattagcatttccttggctagtgagtttgaggattttctacccatactttggccacttgagcttcttctaaaaattgtattcttatattgtttgtccacttattgtctggattatcctttttatagctttttagaagttctttacatattctggattctatttgtatcctgttctttatccttttaaatgtgctgttttgatgaacagatgttcagttttaatgtagtcagatttatcaatattttccttacagtttatggtgattgagtctgatttaagaaatcttgtgttactacaaggtaattgttttagtccattttcatgctgctgataaagacatacccgagactgggcaatttacaaaagaaagaggtttaatggacttacagttccacgtggctggggaggcctcacaatgatggcggaagttgaaaggtacatctcacatggcagcagacaagagaagagagagagcttgtgcagggaaactccccttttaaaactatctgatctcttgagacttactcactgtcacaagaacagcatgggaaagacctgcccccatgattcaattacctgcttactgggtccctcccataacacatgggaattcaagatgagatttggttggggacacagccaaaccatatcagtcataatatatcctcctctttaaaaaatatttaaatatttgctttttatagtctacttagaacttatttttgtgtggggtatgagatagagatccaattttaaattttttccaaattcataaccaattgtaccagtattgtttattgaatacagtcctttccccagtgatctgcagtggtacctctgaaacacatcagatttcacaaatgcatggatcagtttctggttgcttcatgtacctaatgataatttaatttctttctccctagttcttaaatcttttattgatctttttttgtcttttttcctttgcttggaccactagagaaagttgtatggagattgtggtaagattatccttatattgtttttcatttaaaagaaatgctgtgaaagactgaattatgaactttgttattttttttttggtagattcctttattaggttaaggatgatcactttactagtagtttaataaaagctttttaaaaaaatcatgaatagattttgaattttctcaaatggttttctatacagtgtacttatttagataattttaagctttttttaaaaatcgtgattgagatgagatattttattcttttaatttaagccatcattgatttcctgggagaaactgtgatgtactacattaaaaaatattaccaggccaggtgtggtggctcacacttgtaatcccaacactgagaggctgaggctggaggatcatttgagcgcaggagttcaaaaccagactgggaaatatagtgagaccccatttttacaaaaaaaaaaaccaaagaaaaaaaattagccgggcatggtggcatgcatctgtagtcctagctacttgggggactgaggttgaaggatcacttaaggctgggaggttgaagctgcaatgaactgtgatcatgcctctgcactccagcctaaattattggacccaatatgcaaatatttgggattttggcatatatattcataagaggtgttgaccagtgataatcttttcttgtatcacccttattcagatttggtatcaacatgatacttcatcatctttgtaataatttctttcttttttttagagacagggactctctctgtcacccaggctagagtgtagtggtgctatcatatcctactgcagccttgaagtcctggactcgagtgatcttcttgccttaacttcttgattagctgggattataggcgcaaaccaccatgctcagataatttttaaattttctttttgtagaataagggtcttgctatgttgcccaggctggtcttcaactcctgggctcaagaaattctcccatcttggcctcccaaatgtcatagttttggaaagggaggaatttttatttcctggaaatttggcaaaatcgattcttaaatggtctggatctggacctttttaaatatggagacacttgcagtagcaattaatcactttggaagggtcgctagtccattctgctcacatttcattggccagaaggagtcattctggccatacctaatttcagatggggcggggtggtagaatcttcctcatcctggaagcagggggcactcagtccaatagcacaaggaaacaaattttgtcaataatcttgagtgagcgtgggaacagattcttcccgtcaaggcttcaggtgagaacacagcctggcaaacactttgaatgcagctttgtgagaccctaagcagaggacccagttaagcctgcttaaattcgtgactcacagaaactgtgagatattaaatacatattggtttaaggtgttaaatttgtgatagcttgttatgtggcaatagaaaactgatgtactgatctctactgacctccccttagaagtggatttgggttgatgaagggtgttcgactctatttaaggtaaccagcttattatttattttcttttatacaacgttttttctatttataaaagtaatacaaatgttttgtgtagaaaaattggaagaaacagaaaattataaagtagaagatcaacattatccttaatcttagcacaaaaggatattcagtgttttttcctacttgtatttatgtatgatatgcatatcctaaagttgggattcattccaaagtatgttttttgaaccaatatttttccttttactagatcatgagcatttccttgtctcataatgtgttcttctaaaatatgatttcaaatggctgcatactattccaaagagtgtcccagtttattgaaccatttccctatagctagacatttatgttgctttaaaatactcatcatgataaataatgctttgaaaaatatcctatacaaaaatcattgtgcgtatcactgattgcttctaaatttctaaaggtagaactattagctcaaaggttgtaaatgtttttaagtccttttctacctaaccatctattttccaacatttctaaaaaataatgtaagacttagacatctgtttctgtaactcaccaggttgggataggacagaactattgatttttgagcatctaggttcctgttttcttaaccctgtttgcagagtggttttaaattattcattaaagtgcaatatggattctatttatagacgcatttgtgtatgagatcgctcctttaatgtttggggaaaagcctacaaattgctattatcacattcctatctttgtaaatccttttctactcctattcaccctttctttgttctcagtcaacccagtagagacactgagacaaataaagccttgtatccttatattattcagacagaatggctgttctgagccagcccttgttcttttcttcttgccatttattaattagttgatctcaaaaagatgagagatcagaatattaatgattaattcaaaaatatttttcctggtccctaaagtaatggatgtttgtgtagaaaatttctaaaggaaagattagcataaaaagcagaataaaatcttgataattctactacccacagatgactactatttaaacataacttgatcatgccagcttattcttaaaatatgtgactggattctgatggcttttttttttttttttgagacggagtcttgctctgttgcccaggttggagtgcagtggcatgatcttggctcactgcaacctcctctttccgggttcaagcagttcttcatgcctcaggctccagagtagctgggattacaggcacgttccaccacgcctggctaatttttgtattttttagtagagacggggtttcaccatgttggccaggctggtctcaaactcctgacctcaggtgatctgcccgcctcggcctcccacagtgctgggattataggtgtgagccaccacgcccgccctgatgactaatattttgtttggagtttttgcatttgtgcctgtgagtgaaattggcttgtaattttcctttcttatagctgttctcttttctaatctgagatgaatgcttaatttattaatttgcagcttttcctttttttctaatatgtgtgtttaaagtgatatattttcttgtaaacaatgcctcaactacatcatacaaagtttgatctaaggcattttcattattgtttgttatgctttctaatttccattatggttttttcttggattcctaggtaatttagaagaacgtttaaacatttctaaacatatgcatattttcttgttttattattcttcagcaaaattatattgcccaaagatcctgctttctatgattttaatcctttgaaatatgctgatttgccttgtagcccagaatatggtatgtaagttttctcagatattcctatgtgcctggaaataattgggttcaatgtactatactaaatattctgtttagctgagttggtaagcatgttacatctgctttcttactagttttttttggttgttatattcattactgagataattacacaatttcatgatgattatggatttgtcttattttttctagcagttctgccagtttttatgtataaatttttgagactgtgttgtcagggccacacagatttaaaactattaggtcttcctgatgaatggagactttaattattatgactggttctctttatatctagtaattaatatttgactttatgatatggtatgtctgatgttaatattaacatagccatgctagatgttttaggctcatatttacatactatctttgttttttatcttattctcaaccttactatagttttatgctttaggtatgtctcttgcaaagagtatagttagatatttttttcattcaatctgacagtctttgtcttttaattggaacagttcatttacattaaatgtaattactgatctatttgggtttaaatttacgattctattatgtatttgtcttgtcctacattttctgtgtttatttttctctcttttcttgcattattttaatctgataatgtgattttttgaaaaaatcattccatttttccaccttctccagtagtttggagattgtcctattttttgttcttttagtggttattgtgtaaattgttactaacttatccagataatgtagttatacctttatctttctcctagacagatcatagtttcttagaagacttgaactctatgacccccctccagattcatatgtgcttattattatgcactttaattctatatattctttttaaattcagtgaaataaattaatattaacggtattatattaacaatattggtattaatagtattattactggtaacattaacagtattgtattaacagtaatattaacagttagtgttcatttagatttattcagatacttgtcttttctttgctcttcattgctccctggcatttctaacttattctgggatgatttcatttctgcccaaagggccctctttagaaattcctttattgcaggtcagctgatgtagacattgcatttttttttttttttttttttgagatggagtcttgctctgttgccaggctggagtgcagtgacgtgatctcagctcactgcagcctccacctcccaggttcaagtgattctcctgcctcagccttcccagtagctgggactacaggtgcacgccaccacgcccagctaatttttgtatttttagtagagacaggatttcacgatgttggctaggatggtctcaatctcttgacctcgtgatctgcccaccttggcctcccaaagtgctgggattataggcgtgagccaccgcgcctggccaacattacatattttttaatctaaaaatatttttatttcatcttttaacaaattctttcaatttacttaaacgttttgtgggatataattcacacactataaaattcacccttttaaagtttacaattgagtgttttttggtgtattttcaaggtcatgcaactgtcattactacataattccagaacattttcttcactttaaaaagaaacctcatacacagtaactacctgtttcttcctccccaaaggccctggcaactgtgaatttagttttcatctctaagaatttgcccattatggaaatttcatatgagtggaattatatagtatgtggccttttgtgtctggcttctttcactttgcataacattttcaagctttatccatgttgtagtatgtatcagtatttcattcctttttgtggctaatattcagttgtatcgatatatggcattttgtttatccattcatcagtagatagacatttcggttgttttttggctgttatgaacaacatgctatgaacagtagtacgagttttcatatgaatatatgttttcacttgtcttggtttacactagaagtagaattgctgagtcatacagtaactctgtttaactttttgaataactgccaaattgtttcccgaagatgctgcaacatcttcgggaaacaatttggcaatgtaaaattccaaacaatttggaatgtaaaatgctgcaccattttatattcccatcagtaatttatgagggttccaatttctgcacattctattctctcaaacacttgttattttccagttttttgattatagccatgtagtgggtgggaagtagtagatattgtggtataaattagcatttctgtagtgactgatggtattcagccctttttatgtactgcttattggccctttttgttttttctttggagaaatggctatttaaatcctttgcccaagacttcatgactaaaacaccaaaagcaatggcaacagaagccaaaattaacaaatgggatctaattaaactaaagagcttctgcacagcaaaagaaactatcatcagagtgaacaggcaacctacagaatgggagaacgtctttacaatctatccatctgacaacggtctaatatccagagcctacaaagtacttaaacaaattttcaagaaaaaaaaacccatcaaaaagtgggcaaggcatatgaacagaagaagacatttatgcagccaacagacacatgaaaaaatgctcatcataactggtcattagagaaatgcaaatgaaaaccacaatgagataccgtctcacaccagtttgaatggcaatccttaaaaagtcaggaaacaacagatgctggagaggatgtggagaaataggaaagcttttacacttttggtgggagtataaattagttcaaccattgtggaagacagtgtggcgatttctcaaggatctagaaccagaaataccatttgacccagcaatcccattactgggtatatacccaaaggattataaatcattctactgtaaatacacatgcatgcatatgtttattgcagcattgttcacgatagcaaagacttggaacccacccaaatgcccatcagtgatagactggataaagaaaatgtggcacatatacaccatggaatactatgcagccataaaaaaggatgagttcatatcctttgcagggacatggatgaagctggaaaccatcattctcagcaaactaacacaagaacagaaaaccaaacaccgcatgttctcactcataagtgggagttgaacaatgagaacacatggacacagggaggggaacatcatacaccagggcctgtcggtggtgggggcctaggggagggatagcattaggagaactacctaatgtagatgacgggttgatgggtgcagcaaaccaccgtggcatgtgtatacctgtgtaacaaacctgcacgttctgcacatgtattccagaacttaaagtataataaattaaaaaaaatagctgaaaacaaaaacaaaaataaataaatcctttgcccatttaaaaactggattgtctttttatcgctgagttgtaagtgttctttatgtattctgtatgttagtcccttatcaggtatatgatttgcaaatattttccctccaactgtgagtagtcttttcattttcttttctttctttcttgagacagagttttgctctgtcgcctaggctagagtgcagtggcgcaacctcggctcactgcaagctctgcctcccaggttcatgccattctcctgcctcagcctcccgagtagctgggactacaggtgcccgccactgcgcctggctaattttttgtatttttagtagagacagggtttcaccgtgttagccaggatggtctcgctctcctgacctcgtgatccacctgcctcggcctcccaaagtgctgggattacaggtgtgaactaccgtgcccagcctcattttcttgatagtatcctttgatgcacaaatgatttttattttggtaatactgcatttatctatttttttcttttgttgcttgtgctttgtcatatttaagacattgcttaatcctaggtcacaaagatttacacctccgttttattctaagggttttatagttttagctctgaaatttaggtctttggtgcgttttgagttaatttttgtctatggtatgaaggaggagtttaacttcattcttctgcctgtggctgtctagtcctagtaccatttgttcaaaagactacctattgaatggccttagcacttctgtcaaaactcagttgaccataaaatatgggtttatttctgaactctcaactctattccatggacctatatgtctctctctatgccagcagcacacagtcttgattattgtagctttgtagtaagttttaagattggaaagtgtgagtccttcaactttggtctttttatttattttggttattcctggtcccttgcattttcatatgatttttaggtttggtttgtcactttctggaaaaaaaaaaaggcaggtagaattttgatggggattaattgaatctgtagataattcggggagtattgtcaggttaacaatattaagttttccaatccatgagcataggatttagtagctataatagttttttagtggattcctgaggattttttatatgcaagattatattatctgcagatatagatacttttaattctttgcttctaatctgcatgcctttttaaaatttttctcatgtaattgccctggttataagctttaacacaatgtttaattgttgtggcaagggtggacatcattgtttgttccttatcttagggggaaagcttttagcctctcaccagtaagtataggtagctgtgaatttttatagatgcccttaattaggttgaggaatttcccttctatccctattttgttgagtgttattatcatgaaagcgtgttgaatgttgtcagatgcttttcctgcatctatactgttatttttgtcctttattatattaatgtcatgtattacattgattcagttttgtatgttgagccaactttgaattccctagataaatcccacttgtcatggcatataatcctttttatatattggtggattcggttttgcaagtgttttgttgaggattttttgagatggagtctcactttgtcacccaggctggagtgcagaggtgcgatctcagctcactgcagcctctgcctcctggagtcaagcgactctcctgcctcagcctcctgagtagctgggatgacaggtgcgtgccaccatgcatggctaatttttgaatttttagttgagacagggtcttaccatgttggccaggctggtcttgaactcctgacctcaagtgctctgcctgccctggcatcccaaaatgctgggattacagacatgagccgccacacccagccttgttaaggatttttaagtttgtattcttaagacatgttaatctatagttttcttgtgatctctttgtctggttttggtattagggtaatactggccttatagaatgagttggcaagtgtccgtttctccttgtgaaggattggtgttcattctttaaatgtttgatagaatttaatagtgaagccatctgtttctaatttttccttgtgggaaatttttaaaatactgaatatctttacttgttttaggtttttttcagatgtactgttttttaagttttgatagtttctgtctttctaggaatttgtgaatttcacctaggttatctaatttattggccatcagttgttcataatatttctttatagtccttttatttctgtaaggttggtagttttctttctgattttagtaaattgagtcttccctctttttttcttggtcattctagataaaagtttgtcagtttcattggtctttttttaaaaaaaaaactttggtttcattgttgtttttctattttctgtttcatttttgctcgaatatttgtttttttctttcttccacttgcaaaggtttagttggctctttttctgatttcttaaggtagaacgttaggttattgatttgagatatttctcttttaacataggtgtttacagctataattttgtaagaactgcttttactgcctttcataagttttgatatgttgtgctttcttttactttcctttttttttttttttttttttttgagacagggccttggtctgacacccaggctaaagtgcattggtgccatcacaactcactgcagcctcaactttgagtctcctgagctcaaacgatcttcccacctcatcctcctgagtaggtgggactataggtgcattcccctacacctggctaattttttaattttttgtgagacacagtgtcttgtcatgttgctcagactggtctcgaactcctgggctcaagcagtcctcccgctatggcctcccaaagtgctgggattacaggcgttagccactgtgcctggcctcatttttaatgatctcaaagtattttctaatttcccttgtggtttctcccttgactctggttatttagcagtgtattgttaaatttccacaaacttttgaatttcttaaatttttatctgttactgatttctatttttttcccttgtggttggggaacatattttatattacttcaatcctttaaaattttgggacttattttcttggctaacacctggtctgttctagagaatgttccatgtgtatttgagaataatgtgttttctgctttttgaatggagaattctataaatgtctgctaggtctaattagtttattagtattgtttaaatcttttgttttctttctgattttctgtcttgcattccatcctgtattgaaaacggacttttgaagtttccaactgttactgttgaactgtctgattctcccttttttctcttaattttttgtttcatgcattctggggctttattttatatgtatacacacacacatatatatatgtatatatatgtatataattgttagagcttcttgatgaattgacctttttatagttataaaatattctttgtctgtaataacaatttttgtattaaagaccgtttttttctgatgttaatatagccattcaagctctcctttggttactgtttgcattgtatatatttttccatgcttttaacttatttgttcgttgtatttaagtgtctttcttgtatactacatataactgaatcattaaaaaatccatttagacaatttctgtgcttatattggaatgtttaatccatttacatttaatgcaattttgacaaggtgaaatttatgccagccattttgcttcttgttttctctatgcaatgtctttttgaattttctattactccattactgactttgtgttaaatagatattttcatttattttactattttttattttcttaggggttacttggggtcttactactggcaatttgtaacagtttagtttggattagtaccagtctaatttcactagtatacagaaactttgcttctgtatatctccattccctccttcttcctttgtgctgttattgtcatacaaagtacatcttgctgggcatggtggctcacacctgtaagcccaacactttgggaggccgacgcggacagatcacttgaggtcaggagttcgagaccagcctggccaacatggtgaaaccccgtctttactaaaaaataacaaaaattagccgggagtggtggtgcatgcctgtaattgcagctactagggaggctgagacaggagaattgcttgaacccaggaggcagaggttgcagtgagctgagattgcaccattgcactacagcctaggagacaaaggaaaactccatctcaaaaaaaatatatatatatatcttgtacattctgttcacttcaacacagatttgtaattactggcttttacagttatctgtacttgttacagttttgtttttaataatttttatttttcaatttaaaaatagatttagagggaacaagtacagttttattacatgcatatattgcatgctggtgaagtctaggcttttagtataagcatcacctgaatagtgtacattttaaccattaggtaatttctcattccccaccccctctcaccctcccacctttccaaatatctggtgtctattattacattctgtgtgtccatgtgtatatattacttagctcccatattctctcgtaagtgagaatatatggtatttgactttctgaattatttcacttaagataatggcctccatttctatccatgttgctgcaaaggacatgatttcatttttttatgtggcttagtagtattttttggtatatgtatactacattttctttatccagtcagctgttgatggatacttaggttggttccatatctttctatcatgaatagtgctgtaataacatacgagtacaagcatctttttgatacagtgatttcttttcctttgggtagatagccagtagtgggattgccagatcaaatggtagttctatttctatttttagttctttgagaaatctccacactgttttccatagagattgtactaatttacatttgtgttccttttctctgcatacttgccaacatctgtcattttttgactttttaataatagccattctgagtgttgtaagatgatatctcattgttgttttaatttgcatttctctggtgattagtgatgttgagcactttttcaaatgttttttggccatttgtatatcttttgaaaaatgcctgttcatgtttgcttacttttaatggggttatttttttttcttgtcgagttgtttgagtttcttgtagatcctggatattagtcttttgttggatgtatagtttgcagatatttctcccattctgcaggttgtctcttcactctgttgatgattatttttgctgtgtagacacttttaagttattattaagtcccatttgtctatttttgttattgttgatctcggttcactgcagcctctgcctcccaggctcaagtgatcctcctgtctcagcctctcaagtagttgggactacaggtatgtgccaatatacctaagttttttttttttttttttttttttttttttgtagagatggggtttcaccatattgcttaggctggtcctgagctcctgggctcaagcaatctgcctgccttcagccttccagagtgttgggattacaggtgtgagccactgtgcctggcctgcatttgcttttgaggtcttagtcatgaattatttgcctaggccaatgtccagaagagtttttctgtgggcggcaagccacccaggtgctgaggcaagagactgagggcacgagctgttccagtataataaaatatataaaataacaagagttatactagatatagatcatagatatgattatatgtaagtatcactaatcattagtttgtagtaattactctttattcaaataatataataatccccgctctacaatcataacctagaaaaaaccgggccatacagaaataggagctgaagggacatgatgagaagtgaccagaagacaagagtgtgagccctctgtcacacctggacagggccattagagggctccttggtctagcggtaatgccagtgtctgttgccaagtggactgtggtttagtggtagcgtcagtgccaaggaaaagcacccgctacttagcagactgggaaagggagtctccctttccctgggggagtttagaaaagactctactacaccacctcttgtggagggcctgacatcagtcaggcctgcccacagttatctggaggcttaaccgtctccctgtgatactgtgcttcagctgtcacactcctggtccgctttcatgttccatcctgtacacctggctctgccttctgacaacagtagcaaaattagtgaaagtactaaaagtctctgatatgcagaaataatggcgtaagctgtctcctctctctctctctctctctccaccttggctgccaaacagggaagggccccctgtccagtgaacacgtgacccacgtgaccttacctatcattgcagatggctcacactccttaccctgcccccttgtcttgtatccaataaataacagcgcagcctggcattcggggccactactggtgtccgcgtcttggtggtagtggtcgcccgggcccagctgttttttcttttatctctttgtcttgtgtctttatttctgccatctctcatctctgtgcatagggaggaaaacccaccgaccctgtggggctggtccctacatctttcctaggttttctggaatttttatagttttaggtcttacatttaagtttttaatccatcttgagttaatttttgtatatggtgagagataagggtctagttttcttctgcgtatggctatccagttttcctagcatcatttattgaatagagtgtttttccccagtgttttgttaacttttcaaagatcagttttctgttggtgtgtggctttatttctgattttctattctgtccccattgatctatgtgtctcttttaataccagtaccattctgttttggttactgtagccttgtagtataatttgaagtcaggtaatgtgatgcctctagccttgttctttttgatttggttatttgggctctttttggttccatatgaattgtatgattgttttccctaactctatgaaaaatgacattagtgttctgataggaattgcattgaatctgtggattgctttgggcagtatgttcattttattatactgatttttccaattcatgagcataggatgtttttctttttttttctttttttttttttaactgtttccaacttttattaaaaatacaaactcacatgtataataaactcagtaaaacccaaggagagtaaatacacacacgcataaatcacacctagaaatagcatagtgaaactgtttgaactaaaaataaagataaaatcctaaaagaagtcagaaagaaatcacatatatacagaataataataatataagaataataataatataaatcacaaacaacttctcaccaaaaataatagaagctagaaggcaattgtacaatatttttaatgtgatgaaagaaaataaactatcaacctagaactccatatttaacaaaaatatccttcaaaactgaaggtgaaataaaggcattttcagttcaattgaaagcaaagagaattaattgccagcaaatgtgcactatgagaagtgaaaaaaaaagttatccaagacaaagtaaaataataccatacagaaattcaaatatacaggatagaatatttcaaggggactaaaattataataacattagctaaatatattttcttaatttctttcagagacaaagagcttttattttttttaattttttttttcttttctttttttattatactttaagttttagggtacatgtgcacattgtgcaggttagttacatatgtatacatgtgccatgctggtgcgctgcacccactaactcgtcatctagcattaggtatatctcccaatgctatccctcccccctcccccccaccccaccacagtccccagagtgtgatattccctttcctgtgtccatgtgatctcattgttcaattcccacctatgagtgagaatatgcggtgtttggttttttgttcttgcgatagtttactgagaatgatgatttccaatttcatccgtgatgtttttcatatggttgtgtcatctacagtttctttcatcagcattttgcagttgtccttgtagaaatctttcaccttcatggttaaatgtattcctaggtattttattatttttttgtagctatcacaaatgaaattgagttctttatttggttttcagcttgattgttattggtgtttagaaatactactgctggggtacagtggttcatgcctataattccagcattttgggaggccaaggcaggaggatcacttgaggccaggagttcaagactgccctgggtaacatgatgagaccccatatctacaaaaaaataaaaataaaaaattagacaggcatggtggtacatgcctgtagtcctagctccttggggggctgaggtgggagaatcacttgagctcaggagtttgaggctacagtgagccttgatcacaccattgcaccccggcctatgtcacagagtgagatcccacctttaaaaaaaaagaagtgctactgatttttgttagttaattttgtatcccgaaactctactgaattcatttatcaaatccaggaatcatttataagagtctttagggctttctaggtacaagatcatatccaaacatacgaccttccaaggttgaaccaggaagaaattagtagaaatcctgaacagaccaataacaagtagcgagattgaatcagtaacaaaaattctcccaataaaacaaagcccaggaccaaatggaatcacagctgaattctaccagatgtgtaaagaagaaccggtactaatcctactgaaactattccaaaaaattgaggaggagggccttctccctaactcattctgtgaagctagtattaccccaaaaccaaagccaggcaaggatacaatgaaaaagaaaactctagagaccaatatcattgatgaaaatacatgcagaaatccccaacaaaatactagcaatcgaaatccaacaacgtatcaaaaagataatacaccacaattaagtgggttttgttccagggatgcaaggatggttcaacatatgtaaatcattaaatgtgatttaccacataaacagaattaaaaacaaaagccatatgattatctcaatagatgcagaaaaagcatttaataaaattcatcttttcatgaaaaaatcctcaataaactaggcatagaaggaacatacctcaaaataattcaaaccatttatgaaagacccacagccaacatcattctgaatgaggaaacgcctaaagcattccctctaagaattggaacaaaacaaggatgtccattttcaccacccttattcatcataatactggaagtcctagccagagcagtcaggtaagagaaagaaataaaaggcatccattttggaaaagaggaaataatactatttctgttcatcgatggtatgtagttatcttttaaatcaagtaggaggaaagggttacaaacaagttacatttatactgtcttttatatttaccattatagttatatctttactggtgctgtttattcattcacctggattttctgtactatctagtgtcctttaatttaagcctgaaggactccttttactgtttcttgttaggtaggttttctagtgacatattctctcagcttttatttgagagtgtcttaatttctcctttgtttttgcagaataatttttctggatatagaattcttgtttgacagtctttttctttcatgattttgcatatgttatcctacagccttctagtttctgtggtttctggtgagaaatccgctattgttcttattgagaattttttttttttttttagatggggtcttgctctgtctccagactggtgtgtaatagcgcgatctcagctcactgcaacctatgccttccgggttcaagtgatttgagaatccctttttaatgagttactctcttgctgctttcacaactctttgtcttttgatagtttgattataatatatttaggtgtggatgtctttgagtttatccttgaagcttattgaggttattgaatgtataattttttccatcagatctgggaggttttcaattataatcctttcatatattctttgtacccctttattttctctccttctgagagtttcattatgcatctgtttgttctttctttctttctttctttctttctttctttttctttctttcccccttcccttcccttccctttttctttctttctctcattcattcatttattcattcattccatttttgtagagatgagttctcactatgttgcccaggctggtcttgaactcccaaccttaagccatccttccacctcagcctcccaaaatgttgggattacaggtgtgagccaccatggttggccatctgttggtattcttggtggtttcccacagggctctgagtttcagctcattttttttttaacttctttactttctgttccttagattggttaatctcagttgatctatcatcaagcttactgattctcctgcctgttcaaatatgatgttgaaccactctaatgaatgtgctatttcaattatcatattttttaactccagaatttttatttggtttatttttataatttgtttctttattgatatctgcttggtgaaacaacactgccattctttaatcctttagacatggcttcctttagttattcaaatatgtttaaaataggttatgtaaagtccaacactggggcttccttgggaacagtttctattgattgctttttctttccctgtgtatgggccatattttcctgtttctttgtatgtgtcatagtacttttttgaaaactttatgttttaaataatataatgtggcaactctggaaatctgattctcctttcttccattttttttgttgttgttgttgctgctgcttgttatagtagtttctgttcatttgtttatgtagtgactttcctgaactaactctgtaaagtctgtattctttgtcatgtatcttcactgactctgtacttgaatagtttagtggtcagctaataattggacagacgtttccttaaatgcctggaatcagtgagtctcatagactttcccaagagaccccatgtgtgtaacctaccagtttataagtgccttagccttcattttctgattgtgcagagtctcaatgtcagctcagtgtgagagcttagggctatctcagggcactccagtttcttttctgggcattcgcacaaccttgagtaggtgcatagctctatgtatgcaccatggccttctagatttccagaaatatacagtttttaataccctgtgggcatctcattccccagattttccttttaagcttttgagttaatatattatttgttccaactgttgtccactgtctcaggtagtcacaaaattaaacaattgtctttgttttgaaagatacctctaaggaaaatacttttcagtgagctccgtgtcaggtcaaataaatgtaacctggcaagtggaacctgttagccataacaaataataagactttgaaggagctctaactctgttttgtcctcttctgttgctgccaggctgttggttttcactctgattgtaggtggttggttttcaagactactatagagctggggtagggttgggggtggggggatgggaatagggcaggttaaaatattacaaaatttatgttcttaggatatttaaccatttttctttaagaaatgttctccagattgtggcaagcctttggttaaatttctagatttctaaaaaaaaagttgatttggccaatttttggcatttaaaaattgcttttgggaaagaagggatttttggaagttcttactttactattttcactgatatcacactctcatgttattcttaaaagattttgtttccgtatattgaatttaatgttggcattattttttttcagcacattggagatatatttccacagcatctggcttttcttgttcctgttctgaagtaaatgtaactgctatcctctggaggtaatctattgccataaaggattttccaattatccttaggtttctgtggtttcactaagttccatgcatccctgcctgaggtatgttggcttcttgtatctatgacatgatgtctttcataagtctggaaaattcactgccattttcttcagctattgcttctgcatcatctcttttctttctttctgggactctgattaaatttgtgttagatttctcaccatatattctcatgctctctcttatatttctggattttggccactccactttactttgaatattttattttattttgacctagtttccagttcaccaattctttcttcagcagcactcaatctgctttaaaacccattcatgactttataacttttcagttttagattaaaaaaaattgaaactgttactttttgtagcttctaatttattgtttctgtttttaactatagcaactatagttttaaaattttagttaaacatatataacataaaatttgccattttaaagagtacattttatgtgtacaattctgtgacattaagtacattcatgttgttgtgcaaccatccatctccaatactcttttcatcttgcaaaactgaaactctttacacattaaacaataactccctctcccaaacccctggcaactaccattctactttctgtttctatgaatttgactactatagatacttcatataagtgaagtcataaatatttttccttttgtgactggcttatttaatgtagcgtactgtcttcagggttcatccatgttgtagcatgtgttggaatttcttccctttttaagactgaataatattccattgtgtgtgtgtgtgtgtgtatatatatatatatatatatatatatatatatatatatatcacattttgtttattcattctttgatggacacttgggttgcatctaccttttggctatagtgaataatgctgccatgaacttgggtatacaaatatttgagtcccttgcttttacttaatttgtgcctatacctagaaatggaattactagatcatatgctaatacttttcttaactttttgaggaatgactgtattgttttcatagcagctccgcattttacatttctaccagcaatgcacaagggttccagcttctccacatcctaaccaacacttattattattttgataatagctattctaatgggtatgaggtgacatctctttgtagttttgatttgcttttctctaatgattagtaatgttgaccattttttcttgtgcttattgcccagtagtatgtgttattgagagaaatgtctattcaggtcatttgccagatttttaattgggttgtttgggtttttgttattatacaagtgtagttgttaaaatagactatgttgggtaattccaacttcttgtctttgtagatatgtttttgttttctgtgatttctactctttcttcctcaatgggtcactaatttcttttaggctactagacatttgtatttgcagaatattttgaggaataatttgaaataatttgggatgattattgtttttagagaggttttcatcaggtactgctaaggttcttaaaggagcaagcttaatccagtgtagtcttaaggacaaccggatgagtagaacaaaggctcagtgcttgggagggctgacttgcttctgaggacttattctttaccttgaggggttagccctttgtggttccagtgcaaattgaggggtggtttctcagtatctgattcatgcttttactctgtatctcttccccccaatttttggatattttggttaactttcaatcccacaaatttcagggccttacatggtaaaatttacttcttgctcatgtaacagttcactgtggatgtacctcatcagtgatcaggtttcctctgtgtggtgattcggcccagctcctcacagtgggtggtcatgccatctgctacggaggtggcatccttatcctctaggcccagcttcctgtcagtccagctggcagatgagagagcacacatggagaaggcacacatgcttctcagccatgttggcccaaaagtgacgaggaccatgatctgtatctcttcatactttccactggcaagatccagtgatggggttctatctagatgcaggcatgaaatctgcagtgtgttgtttgtggttgacagttgcttcccagtttcaatgctgtcctgggaaaggggagcacagttctttatgaacagttagttatctgcctcagtccttcgccttggcacacccttctttcacgactgtcatgcactcatctctccagggacacaatccagagttgccccagttactgtgtcttgcacaaaggatggatttctagcattgtgtggtctttatcaaatccagttgtcgctcttgtcgtttgatgactgaactgacacacaggttgtctgctgttcacactgtacaatagtggagccaaaccaagccaattgcaatttttaaaacttccattttggaaggggagaatggaagataaacatcagttcttggtccacagttagagcaacatcccatgggcaagtattatgaaggcatctatcaatgttttctaagcaaaggccactagacactcacctgggaaccatggggtgttgtggtaagagggcgttagaaagaacctgttacaggatttgggctttggttaggtgatttgggggagggttcaagaaagtgggatggtatcagtaagtggggacaattttttgatgagtgtctgtaaatcttatctacaaggaggttagactggagtgaggttaaagctgtgattggtaaagaaacagtcatcacttatgtcagtggggagagggattttgacacaatcttgtttttgtcttcattcatcatggtcagtgtggcgtgtctgattctttcaccttctattctgggagtgggggcaggagaaactggtctgttgtcctccaggcctcctttctctgtccctccatctggctaggccttgggagtgctatggtttgaatatttgtcccctccaaaactcatgttgaagtttaatcttaagatgtgattggatcttgagggctgttcccttatgagtggattaatctattcatgggttaatggattaatggattaatgtgttatcaggggagtggaattggtgactttataaaaagaggaagagagacctgagctagcacactcagccccttattgtgtgatgccctgcaccacctcaggactctgcagagtccccaccagcaagaagatcctcactagattctcctccttgaccttagacttctcagcttctataactgtaagaagtaaattccttttccttataaattactgagtttttggtattctgttataagcaacagaaaatggactaaaatagggagtacatctttcttaggggttaggggctgcaagatcccacagcctgctttctgcttgtggaagtttggaggcctggggttgttttgacagtcactgactgttttaggctcatgtttctttggcaatgcagtttctccccaattctagtagcttctgatctatttgcgtctggtagtttcatatgccagtaactatagccaaagttcttttctagtcttccagctacttcatatttttgctttcttatgcatgtgtctctccctacccagggtatcttgaggcttaacataatacaatagtcatgggtgtgggtggagacacacctgtaatctcacctgtgtgtacagtttagccctctcttcattgtggagtcttaatgggtctttgctgctcagaacatgttcagtcgcatatcttactcttggggagcagagggatagcttttcccggattgtgaggcccatatttctggactgtctctagacgctttcctgtctctctgaagccagctagtttttgcctaagcccgtgtctttctgtgatgctcaactgagcaaaatgggtaacagtgacctagacagttggcattcctttttctcttccccctgagctggaggctgggtgtgtgcattatctgccttcaggtgatcaagggtaaacggtttcaccaaatgacatgcactgtataaaataggtcttctcattaccagctgtctgacagcagtttttattatggtgtcaccctcttcaaggagcccaattctgtgttaatttatttctgttgaaatatgtatttaataatagataatttgaaagaagaaaatttctgattagactctttctttgggaattaattatttgacccattttctacttccctccgcctctccactgtttggaaatgaagctgtacatttgtggcagttttctaagcagacgtcacaaaggtgtggtatggcagttcatcttttttgtttttaactgtattaacactggaaaatcaaaccttttctgatttcttacaagaagaaaaaataagacacttcagttttttttaaataaaatgagatataaagataaacatttttgatgaagagaagagttttgtatttaagttgcagtgatgtggataactcccagactcatccctctctctctgtagtatcctacaagaagtgcctgggccttcttgctttgaatctttttctgctttgaagacaggcagaagtgaatacctggcctgagcttctcctggggcccttgtggaagcaacatgagatgactgatgtgcaaacacattcaagagtgaagctctctgggtagagaagacattattatttcatcctgaagtactttcggaaggtaaatgatttatttagcacactaagttcatcctccgaggccatgtgtttctactataaggtacccaaaccagccttggaaacttacagcattgagagaggagaggtccagtgagcatgtctctctatgagttttacttagttgggtgctcttctatagagttctgagctctatttataattatccttaagcaaaaaagaaacaatccaaaatggtgacacagagagtccaatttacagttatctgtggtataacccagttaataatcaccataatacttagggtgctagactgctggtttgagtttttatggaattttgaagataatgagattttgtaatggaaccatgtttctcagtaatgtctttcactgaattatcttgacttgagtcaagacaagactcaagagtgactttattttaaatgtaaatccaccatgtaacttctgactaaccctgagccgataatacctccacaatgtttagttgatgttgttattctttatgtaggaagaccaattcattgtaagttttcttcaaaacaacccttgttgttgcagagatcataggctgtgatgactgtagcatcctacacatatcttccagagcactatactttcgttccgagatataaactctatgtctgggggtttgtgcagagatctacctgtttgcacctgcccaagaccatgattctgtctgtacattctccagtaaatcacccaataccaacaaactggatttctctgtctccttctttggtttcttggctcctttggtatttgaggattgctttgcatatatggccctttcacaggatacttcattaattatctaattaattaaacaaataataatgaagtaggttatgttgcttactaaaaaattgataaacttgaggtagccatacttctctaggtccacttaggaaactgaaagttttggtttaatagtctttttcaaagataagccatgtattattcatatgattagtgtggaggctgatattgagagaaggtgtagtagcttgcttttatatgagggcactggaatgagatgtgatccgtagattcccatagtggtctgtgacccatgctgggactggctcttctcctcggctcctggaacagggatccagccccacatgacttcccccttccctggctcagttggatatccacaggggcctctttctcttggacatgcccccacctagcacccaccatttctatttctcttgctctggatgccaccgcatcttcaggacacagcttctcctgagctgatagggatgccctggagcctgtggagtgcctctgttgtccagagttctgtggtaagatcccaagaaactttcccacctgaagaacagagcatagttgaggcgaggtcctgtgctttgcaggacttactgaggagactttgaccctggtcttccttctgtcatttccaaaagtgagtatgtgggggcagtggggtggaggtcagttcagtgagcacacatgatggggaggcagagccctctacctcttgggcagctgaggctgaggtcctgggctgggcctgtctgcttagtgtccttgatgcagggatagatcttatttaagtgaacatgtccctacagacaggcaggtaccacctagggaacccacaggcaaggcccaaatgctcttatttgtggtctacattaggcaaagaaccagattggactatgaagccggaagggagcttataacttcctgctgaacagaggataaaaatgtgacccactgagggcagtaatagctgatgagcaatcatggtggttcttactcctggttggctcagggctgggagcactaggcgtattgcagtgccagtgaaagcagagcggggcctcaaaccctcttttttcacctctttttttatgccatagcaaccacagtaagcctgtaaaatctcctgtgatttgtggagtctcgggctccctggaaacctttcagggggctcataaggtcaaaactgttttcataatgatatggagccattctttcctttttcactgtgtggacatttgcactgatggtgtaaaagcaatggcaggtgctttgacacaaatcaagaccatggcaccaaactctactgacagtcatcatactcttcactgtcacccactcgcatacaaaaagccaacaacatttaagaatgttcttgatgaagtcgtaggaatgattaattttattaaattttgacctgtgagtacatgtgtttttaatattctgtgagatggaattgaaagtttgcataatgtactttggcagatggaactacaatgattgtttgaggaaaagcacttgtgctttttttgggttaggagttaaactagctcctcttttaatggaacactgtttttactttaaagaacaactgacagacaaaccatggttattcagacttgtatttttggcataaaatgtctgaaaattgaactaactgagcctgttacttcaaaggaattaactgcctgtgtttgttgcaaatgataaaattgaattttcaggcaaaagttagaattgtggaaaacttgtatctgtcatggtgagcttgacagccttccaatataggcatcactcattttattgcactttacagaatttttttttttaaacaaatttaaggtttgtggcaaccctgcatcaagaaagtctttcagtgccatttttccaatagcattgcttacttcatgtctctgtgtcacattttagtacttctcatgatatttcaaacattttcattattattatatctgttatggttatctgtggtcagcgatctttgttactattgtaattattttgtggtgccatgaactttgcccatataagatgttctatgtgttctgactgctccacagccgaccattccatctgtctgcttctcttggggcctccgtatgccctgagacacaacaatattgaaattgggccaattaataacccttcagtggcctctacatgttcaggtgaaaggaagggttgcacatctctcattttatttattttttatttttatttttgagacagagtctcactctgttccccaggctggagtgcagtggtgtgatctcagttcactgcaacatctgcctcctgggttcaagctattcttgtgcctcagcctcccgagtagctgggattacagatgcatgccaccatgcctagctaattttttgtatttttagtagaggcggggtttcgctatgttggccaagctggtctccaactcttggcttcaagtgatccacctgcctcagcctcccaaagtgctgcgttagccactgcgcctggccacgtctcccactttaaatgaaaaactagaaatgattaagcttagtgaggaaggcatgttgaaatcccagacaggccgaaagctgggcctcttatgccaaacaaccaggttatgaatggaaaggaagttcttgaagtaaatgaaaaatgttactccagtgaacacacaaaggataagaaagcgaaacagccttgttgctgatatggagaaagtttgagtggtctggatagaaggtgcaactaaccacaacattgctttaagccaaagtccactccagagtaaggccctaatgtgcttcacttctatgaggctgaaatagatgaggaagatataggagaatttgaagctagtagaggttggttcatgggatttaagtaaagaagtctccgtaacataaaagtgcaaggtaaaacagcaagtgctgatgtagatgctgtaccttgttctccagaatatgtaagagaatagatgaaggtagctacactaaggaacagattttcaatgtagacaaaatagccttctattgaaagaccatgccatctaggacacccatagctagagaaaagaagtcaatgcctggcttcaaagctttaaaggacaggccgactcttttgttagggcctaatgcagctgatgactgtaagttgaagccagtgctcatttaccattccaaaactctaggatccttaagaatgatgctaaatctactcggcctgtgctctatacgggaacaacaaagcctagataacagcacatctttatagcatggtttactgaatcttttaagccttctcttgagacctgctgcccagaaaaaggttcctctcaaaatattactgcttatgaacaatgcacccggtcacccaagagctctgatagagatgtgcaaggagatgaatgctgttttcatgcccattaacaccgcatccattctgcaagccatgggtcaaggagtaattttgactttcaagtgttactacttaagaaacacattttgtggctgagcatggtggctcacgcctgtaatcccagcactttgggaggcagaggtgggaggatcacaaggtcaggagatcgagaccagcctggctaacacggtgaaaccccgtctctactaaaaatacaaaaaaattactcgggaggctgaggcaggagaatggcatgaacctgggaggcggagcttgcagtgagccgagatagtgccactgcactctagcctgggcgacagagcgagactccatctcaaaaaaaaaaaaaaataataataataaaataaataaatacattttgtaaggctatagctgccacagatggtgattcctctgatggatctgggcaaagtaaattgaaaaccttctgagaggcattcaccgttctcgatgtcattaagaacatttgtgactcatgggaggaggtcacaacatcaacaaagtttggaagaagttgattccaaccctcatggatgcctttaaggggttccatcctttattgaaggaagtcactgcagatgtggtgaaaacagcaagagaactagaattagaagtggagcctgaagatgtgactgaattgctgcaatctcatgatcaaacttgaatggataaggagttgcttcttatggatgagaagcagaaaagtggttacttgagatgcagtctactagtagtgaagatgctgtgaacattgttgagatgacaacaaagggtttagaatattaatattacataagcttagttgctaaagcagcagcagggtttgagaggactgactccaattttgaaagaagttataccatggtgaaaggctatcaaacagcatcacatgctacagagaaaactttcgtgaaaggaagagtccattgatgtggcaaactttagtgttgtcttattttcagaaattgccacagccaccccagcctttagcaactatcagcctgattgatcagcagccaccaacatccaggcaagaccccaccactaaaaagatgatgactcactgaaggctcagatgattgttagcattttttttttttttttttttttagcaataaactatttttacttttttctttgttgtttttttgagatggagtctctgttgcccaggctggagtgtgcagtggtgcaatctcggctcactgcaacctctgcctcctgggttcaagcgattgtcctgcctcagcctcctgagtagctgggattataggtgtgcaccaccacgcccagctaatttttatatttttagtagagacgaggtttcgccatgttggccaggctggtctcgaacttctgacctcaagtggtccactcacctcagcttcccaaagtgctgggattacaggtgtgagccaccacgcctggccgcaataaagtatttttaaaattaaggtatgtacattgtttttagacataatgctattgcacacaatagactacagtagggtgtaaacataaattttatatgccttgggaaatgaaaaaattcatgtgacttgctttaatttaatatttgctttattatggtacctgaaaaatgaacccacagtatttctgagatatacctatattctaatatgtgtcttttatcacatttgcaaatatgtctcccatcctgtatctgctcttaatcctcttaatcagggcttttgcagataaaatatttttaattttgatgaagtgcatattatcagttcttacgaatcatgtttggtgttaagtttagccgtagatcacaaagattccttctattctgtctaagttttatagttttacattttatatttgagtgtgcaatttattttcagttaatttttctgtaaggtgtgagacttagattgaagttcatgcttttgcctatggatatttgattgctcttacatcattttttggaaagtctatcctctcaccagttgcctttgcaattctccaaatcatttgagaaactcatttctccaaaatcatttgggcacctttctgtggttctctatagtattttccatactggatttcttatatcgttccattgattgccatgtccatccttctgacaatgtcacataatcttggctactgtggctgtaagtcttgaaattgggtagagatttctctcatttgctcttgtaaaaaatgtttcagttattctagtttctttgcttttccatatttattttagaaccaacttctctatatatacacacatttttgatgaaattttaatgaaagttgcattaaatttgtataataatttagggaaaattgatatctctactatgctgaatgttcttatccatgaacttagtatgtctccatttatttagatatatttgttttaattcttcagtgttttgtagttgtcagcataaaatttctacacgttttggtggatttacacctaagtgtgtgtttattttcagggattttattatatttttaatttgagtatccatgtgttcattgataatatacaaaaataaaatgaatttttgtgtgtttatctttagttttatgacattgctgaactcattgattctagaagcttttggtaggttccttgggatttttttagataatcaagtcacctgcagatttggacaatttagtttatcttttctgatctctaggtcttttatttatttccttattacacaggttagaatttccagcactacgtggaatataagtgagcaaccttgtcctgttcccgatgttaggggaaaatcattcactattttgctgtgaagtatgatgctagctgtagatttgtgtagatgatatttatcaagttaaatacctttttctctgtcctagtctatttgtactgctataacaaaatacctggacttagtaatttataaacaatagacatttacttcccatggtttgggaatctgggaagctcaagatcaaggtcccagcatttggtatttggtgagagccttcttgctgcattctcacatggcagaaggggcaaatgctgcgtccttacatggcggaaggcagagggcaaaaaagggcctaagctagtccccgccaccccttttataagacgttatttattagggcagagccctgatgagttaatcacttcccagaaggtgccactcttaacaccactacaatggggatttagtttcagcacattaattttaggggacattcagaccatagcagcctctatttctagttttctgagaggttttatcacaaatagatgttggattttgtcaaatgcttcactacattgagcaataggattacttgatttttcttctttagcctgtaaatatgaagtactacattaattgattttcaaatactggagcagttttccattcctggagtaaaccccatttggtcatgctgcacaattctttgtacagaggctccctgacttaggatggggttacatcctgataaacccattgtatattgaaagtgtcgtaagtgaaaaatgcaacctggtctttggtcaaggaatcactcttgctaaaagtctgaaacctcatggtttcatatgactttttcaccatcataaaataaaaaagtcataagctgaaccattgtaagtcagggaattgctgaattccattttttaatactttgctaaggatattttgcatctatattcatgagggatgtaggtctgtatttttatttcttttggtaatgtcttttttggttttggtgtcagggtaatactaactttgtaagatgaattcagaaatttttcctcttcttttgtcttctggaaaatatgataaccaaaataaaaaactcaatggatggatggagagatcagaggaaggaatcagtgaaatgaaagatagaacattagaaattatccaatttttatatccaattattatatctataataacagatataatatagaccaaaaaagaacaaaggctcagaaatctggggggctatgaaaaaaattgctaagaatcatgtcatcacatttcaagaagaagaggagaagaagagcaaagctgaaaaaagtacttgaagaaacaatagctaaaaatttctgtgggtttgtctggagtgagcagttattttgttaaagttttctgtcttgctaggctgtcccttttctggtcaaaactaggtaaaacatgcttttgttggggcttcttccccctcccacccaacatccattcatatttatggtactatgaacacccagggaattcactatcatgtcattccttgggtcgcacggtctctagctggtctgccttcctctagtcatctttcagagtctatgattgttttatatataatgtccagtgttttcaattatgcttagtgggaggaatacagaaagcacatctactccatcttcccagaagtggaagttaacctacagaaagatcattctgactagtatgggactgactgcctgtaaccaggcaaaaactgaagcaagaagacctattaaaaactgagtgcacttatccacgtgaagaataatggtggcatatggccatagagtgatagcagtggaggtggtaagaagtagctggaccctgaacataatgtgaagaaagtacaggtagaatttgctgatatatgaggtatgtagtatgagaggaagaaaagagtcccagggttttagactgacaagcaggagaatggcgtgccatcagttgatatagagaaagatgaggaggagcaggctagggggaacagaaggatgattgtattatgtttttcaaatgggaagtgaaacatgccaattatacagccaaatcaaggtgttaggtaggcatatggatagcagcctgaagtttagaggatggagtccaggctgaaaagataaactggagattcatcagcccataggagctatttagagtcatgaaaccaggtgaaatcactaaggaagtaagctagagaagagtaccaagaacctaaccctgggttttccagtgaggcctgggataggggaaggaatccgaaacaaaacaaaacaaaacaaaaatactgcgtgtcatcaatcagagagctaggagaaaagaggatagaggtatatcctagaagccaagtaaaaaaagtatttcaagaaggagggaacaatgacctggattcagatcctgctgataggtcaaataagataggattgagacttgatcactggatttagcaaagtcaaagaggcctttggtgatccccacaaagctgtttttggtggagtaatagggcaaaatccacattgcagtaggttaaagaaagaataggaaggaattgcagataataaatgtagatttaggtgagtcactaagttcacctataattgaggataatggtgatgcctttccttccttaaattaatctttacggaggacttactttgggttagacacagcaaagtaaggagatctaaggtgaaagagacttttagggttataggaagagatataaaaataacaagtacattggattgtaacaggagatcatagacaaatatgtataatactgcaatggaatggcagattctctacaaagtcaggatagagttttccagggatgtgacactataccttgaagaagtttatcacaggaatcaatacacgtgagtgttttaaaaataaggtgttgctgcgcctgtaatcccagcactttgggagactaaggcgggcagatcacgaggtcaggagatcgagaccatcctggctaacacgatgaaacccggtctctactaaaaatacaaaaaatgatcccggcgtggtagcaggcgcctgtagttccagctactcgggaggctgaggcaggagaatggcatgaacccgggaggcagagcttgcagtgagccgagatcgtgccactgcactccagcctgggcgacagcgagactccatctcaaaaaaaaaataaaaataaaaaataaggtgttgctgggcatggtggctcatacctgtaatctcagtgctttgggaggccatgacaggaggattgcttgagaccagcctggtcaacatagaacccatctctacaaaaaaaaaaaaaaaaaaaaaaaattgccgggtgtggtggcacatgcctgtagtcccagcttctctggaggttgaggcagaaggatcacttaagctcagaagttcaaggcagccatgagctatgatcacaccacttcactctagcctgggtgacagtgagaccctgtctctaaaaacaaaagcaaacaaacaaaaaagtaataaggtcctgtggaagtatatgttaaatcaagagggtattaagtatgaaatttatgcggttctgatggtgccattggtaaggaaggacctgagattaactcataagagagatagagaattactgattttactgcttgatatagtgtggatatttgtcctttccaaatctcatattgaaatgtgatccccagtgttggaggtggggcctagtgggaggtgtttggatcatgggggaagatccctcatcaatggcttggtgtcctccctgcagtaatgagagagttcttactctgttaattcacatgataactgtttaaagaagagcatggaacttccctgctccttgctttctttctgtttatgtgacatgcctgttcctctttcaccttccaccatgagtaaaagcttcctgaggcctcagcagaggccaagcagatgctggtgccatgattgtacagcccgcagagccatgagccaaaacacctcttttcttcataatcttcataaattgcccagtctcagatattcctttatagcaacgcaaaacagactaacacagtgctcataaaatgtctgttaaaccagagaaatatgaatgggcaatgctacagtttaattttccattcttagtgtttatagtgatttacatgaggtttgataaatgttaagctatggaataaaacacacagaagtctatcttccccacaccctgccccctgccactctgctacagaaaaccatcaatgtatatccctgtgactgtctaccatatcagcttgttggcttgaacattttgagtattacaaaccatcatcctaacattagatgcaaagaccaaatgttacacttcctttaaaaacaaagagaggtgaaataagccagtcataaaaggacaaataatatatgattccacttaagtgagataccaagagtagtcaaattcagagacagaaaataacatggggaatgggttttaaaggttgtggggaagggaaaaatggggaattattgtttaatggatacagagtttcagttttgcaagatgaaaacagttgtggagatagatggtggtgatagttgcacaaaagtgtgaatgtatttaatgccacttaactgtacacttgaaaatggttaagatggtgaattttatgtgtattttaccaccactaaaaaaaataaaaataagaaatacaaaaaggaaggagacctttgcctctgcccatggtggagtaaccaggataggacttatccttctgttgtgaacaaccagaaaactggaaaaatatataaaacaacttacttcagacactggacaacaggctgcacaagactgataaagataaaccctgtaattcccaactttcttagtaaaagtacttttcaaactgcatggcaatgagggggaatataagcagagccttacagcataactgagttggtgaaacataaaagctcaggcaggcttagttagttggagattgtgaagaggagatacatggaaagactctgaagagaagtaaaatcagccccaaaaatctgcactggggattccttcagtctgttgccaaacactaaccaataaccaacacatgagactccatgaggcaagacaagaaacaaaaacaaaacaaaacaaaacaaaaagcctgtaagatgaactttttttttttttttttttttgagatggagtcttactctgtcgctcaggctgtagtgcagtggcacaatcttggctcaccacaacctctgcctcctgggttcaagtgattctcctgcctcagcctcctgagtagctgggattacaggcatctgctaccaccttggctaatttttgtgtttttagtagagacagggtttcaccatattggccaggctggtctcaaactccagacctcaagtgattcgcctgccttggcctcccaaagtgctgggattacaggtgtgaaccaccgtgcctggcctaagatgaacaattcacattgctcaacagaggttcgggagacaattagagttttggccatccagaatggagcatccctcctgaaccaccaaggcaatcagtagaggtaacggaaaggtatacctcaagagtaggtctaaattagctgtagagtaaaagatactgtacatccaacctaacaaagcttaaaaaagctgatccacaagtaaattatctgcatgaaagaagacagtctactattcttttaaaaaataacgacaaaatccagacacttaatgtaattttcacagtgtctacagtcatctaaagctattggacctacaaagaagcaagaaaatatggccaaaaacaagaggaaaagcagtcaataggaacagaccctgaaaggtagagatgatgaactgtccaaacaaggatcttaaaacaagtattataaatatgtagaagtacttaaagggcaacatgaacatagtataagataaatagaagatatataaaaaagagtcagatggaactttgacagtgaaataaatatcagaaatgaaaactttaataaatgaaattaacagctgattagatgtgtagaagaaaaacagctgtataacatagaaatagaaaagacccaaactaaaacacaaggaggaaaaaagagcttcagtgacctgtggaacagtatcaggcagtgtgacataacctagaagtcccagaagaggaggagaagaaggtgtgaagaaaaaaaatatttgaagaaacaatggcaggcaatgccagaaaatacttcaaatgtggtaagagcaataaacccacaatttgaagatgcttaataaaactcaagaaagataaagaaaaccatattgaggccccaaagtgtaggaggagaaccttaagcacagaggcagaaatataagaatgaataggcatggatttctcatcagcaattagccaaaaaagaaaaaaacagtggacccacaactttaaagtgctaaaagaaagactgtcaacctataattctatttccagagtaaatattatttaaaattaaggagaaataaagactttccagaaaaacaaaagctgaatttgtcaccagcaaatttaggtaataagagaagttagagaaagttcttaaggaggaattaaaatgatataggtgagcatctatccatcaagaaaaagaaaaatccactatgatagatatggataatacagtgatgttgtcagggctggagaaatggaatgccaaaagagaaagaactaataaacaagaggaacaaagaacagatgaaataaacaacaaacaagtagtaagttagtaaatttaaacccaacagtatcaaaattatagtaaaagtaaatggtcaaaacattccaattataaggcaaagacaggataaaaaacaagacccaacaatatgaataaaactcacattaaatataaagatacaactaggttagaagaaaaaggatgaaaaagatataccatgcaaagactaatcggagataaagacatttcttttttgtttttttttttgagatggagtctcgctatgttgcccaggctggagttgcagtggcatgatctccactcactgcaagctccacccgccaggttcatgccattctcctgcctcagcctcccgagtagctgggactacaggcagccaccaccacacctggctaatttttttgtatttttagtagagacggggtttcacagtgttagccaggatggtcttcatctgctgacctcatgatctgcctgccttggcctcccaaagttctgggattacaggcatgagccaccgtgcctggtcaaagacatttcatagtgataaaatatcagtttatcaaaaaatataacaatcctactgtgtatgtacccaaaaacaagttttaaaatacatgaaacagaattaaaagtagaaataagacagcactctttttcctgtactaaagcaagtagacatgaaatcaataagagaatagaagagttgaacaacaccagcaaccaatttgttctactgaaacttatagaatatgccagccaacaactgaagaatacaaactaatttcaagaaaacatgaaaaagtgttaaataataaaatgttttctgactaccacaaaattaaattagaaatcaataataaggttattgataagaacatgagattcttcttatgatttttgcaacttctggtaagtctacaattatttccaaatataaaaagttcaaaaatatgtgagatacagctaaggcagtggttacgtagaagtgtacagatgtcagtgctgacatcagaagaggaaaaagatcccaaatcaattactttaacctttaccttaagaagctaataaaataacagtaaagtatatccaaaataaataggaagaaaataataaagttaagaataaagatcaataaaatgaaaaacagtaaaaagaatatgaaggcataatcattgtacttgaaaaaggcaataaaattaataaacctttggctcaactgatcaggagaagagaagaaatacaggttaaaaatatcagtagtgaaaaagaagacatcattacagatcttacaacactgaaaaggctaatgatgcaatattttatatcactgaacttgataacttagaaaaattcagtaccttaaaaaaaaaacaacaacaaaaacaaattactaaaattgactcatgacacaaaaatctgaaaagctttaaaaatccaagtccttaatttaaaattttaccactaagaaaacttgaggcccagacgaattctatcaaaagtttgagaaaaaaataatattcctacacaatttttttttcagaaaatggatgagggaatactgccgaatttatttaattaggccagctttatcctgtcatgaaacctggcaaaaatattccaagataaaaaacaccagaaaatttaactcaggatcatagatataaaagtccttaatcactgatataaaagatgacaagtatcagcaaatcaaactcaggaagataggtaggtaggtagataagccatcaggaccaaatggggttcaacctaggaatgcaaggttggtttaacatttagtaaactcaaaatattaacaataaaaaaatactctcctatgatcacctcaatacatgcaggtaaaacacttgacaaaattcaacacacattgatgataaaaaaaattttaggaaacaaaaaaagggaacttcttcaagctaacaggtggatttatgaaaatccgacaattaacattatacttcatggcgaatgactgaacgtttccccctaagataaagaacaaggcaagaagatccattctcactacttctattcaatattatactggaagtcctagacaataaagtgggaaaaataaataaaaggcatacatattggataggaattcacagatgatcagatcatagagaaaaggttattaaaactaataactttagctaaattgaggatacaagttcaatatataaagcaaactatttttgtatactagctaacattggaaatgaaaaaaattataaactgccatttataatagtaccccagaatatgaaacaggataaagttaataaaatatgtgtaagacttgtatactggaaatttcaaaacagtgctaggagaaatgaaagacttaatacatgaagagattatgatgtgcactgactggaagactcaatgttggtaaaatgtcaatttgaattgatctacagattgaaagctatctcaatcaaactctagcaggcttttttggaggaagttgagaagctgagtctaaatttttgtttttaaatgcaaaagacctaaaacagccacaactatttggaaaagaacaaagttggaggacttgatttatctggtttcaaatatccagtaatagcatatgatagcatagggataggcatgtagatggaacagaacacagagtctaaaaatagacccaagcttgtatgatcaattgatttttgacaagtgtcaaggcatttcagtggagaaagggaaatatttccaacaaactgtcagaagaactgaatatccatatataaaaaaaagaaccttgattcttgcctaacactgtattcaaaattaacctgaatataaaagctaagtccatgaaacttttagaagaaaacaaaggagaaaatctttctgaccttggggcttgctagattcttagatacatcaacaaatagataaaaataaaaataaagcaatacatcaacaaaagaaaaactaatttacatctcatcaaagttttaaaattctgttctttgcaagacaccatttacaaaatgaaaaggcaaatagaatggaaatttttttcctacatatatctgaaaaaaggactatttcagaatatacaaagaacttttgcagctcaataataaggaaacaacaactcaataaaaaataccaaaatatttctacagatacatcacagaagacatacaaatggctaataagcatatgaaaaagatgctcatcatcattagtcttcaggaaaatgaaagctaaaagcacaaggagatattaatatctatcattagtctttaggaaaataaaaactaaagttgtaaagagataccggtatacatctaatagaatggctaaaatgtaatgaaaataagtagtgatacaaatagtggtaaactggatccatcacacagggcaagggggagagtaaaccactcaaccactttggaaaacagtttgacagatccttataaagctaaataccgtagcacttaccgtataccacctaaccattccgctcccagataattacccacaaaaaaatgaaagtatattcttatgcaaagacatgtacaaaagtgttcacagtagctttatttataatagttaaaagctaggaacaattaaaaaatctatcaacaggcaagtaaacaaagagtacaatactaactaataaacaggaacaaaatacattcatacagtatggattcatcttaaaaatgatgaaagaagtaagccagacataacaaaagaagtcagtacatatcatatgattctatttacataagaatatcaataattgcccagactggaaggtgagagtggggaatattgaatgaaaaggggtaccagagccttttggggtgatgttctatatcttgtttgtgggggtagttatatatatatatatctcatatatatattatatatatataaaatatatatatcatatatatgtatgtatgtatgtgtgtgtgtgtgtgtgtgtatatacatcacaattcactaatctgtacacctcaaatagatgaatttgattgtacataaattaaacagagagagggagaattctgccctcaattagaatacagtgagtcagagcaggccaacattaccaatggaacaagtggatttataaaaaatggtaaattgcaaaaactgtatttctaaaatgatcaaagcaatgaagagtatatgagctataacaacccttctagataagctaaaaataagccagtaattccaaacattgcctaagaatcacatgtggttgaagctgagggattctatgggagaaaagaaaaaccagcagagtgtttctgcagtctcaaggtactactataattgactggaaactaaaggagtccccagcacaaggcttgttctgtccaccagattatctggcaagttctggaactgtgcaagaagccaggagatggaccagtgagatagaatggcaactctcccacgttctccaggtgtctaggggatagagtcaccctgaaggaaacaggcctgcaacaagtacacagtccgtcttcccctcaagtcatttttccagattttgaatccatagtatgtggcaggaagctgaaaagatcagctcagaagctttaactggctgaactttcaggactgaggagataaggacctggaagggtctcaataaagaatccaggaaggccactctcaagttcagggacaaactagaggtttctaaacagagaccttaggttgtaactcaaaaaactagaagaagaacagcaaaataatctaaagtaagttgaaggaaaaaaataagaatgtagaaatcaacaaaatttaaaacagacaaaaaattgagccaaaagctggttctttgaaaagatcaacagaatctatgagctcatagctagaatgatcaagataaaaaaaaaaagaaggcacaaaacatgaatatcaagaatgaaagaggaattatctccacagatcctacagataataaaaggataataagagaatatcctaaacaactttagccagcgtattaaacaactgggaataattggtcgaattccttgaaagactaaagctcattcaaaacaacgaagcaattaaagctcattcaaaaagaaataaataacctgaataggcccatatctactatataaattcaatttctagttaaaaactctaagctcagaaggctacactggttcattctaccagatgtttttaaaagaattaatactgattctacccagactcttccagaaaacagaagagaggaaaacacctctgaactcatcttatgaggccaagaatatccggataccaaaaccagatgaagatattacaagaaaaacctactgactaatattcctcatgtaactaggtactaaaatccttaaaacattatcaaatcaaatccagaaatattttaaatggataaaacatcacaaccaaatgaggtttatagcaagaacgcgaggttggtttactcattattcaatgtaatcatcatcattcaatgtaattcaccatattaacaataaaggagaaaaaccagacaattatttcaatagttgcagaaaaacatttgacaaaattcaacacccactaataataaaaattctcagtaaattaggaacatacaataatttcgtcaacctgataaagggcatctataaaaaacctacagctaacttcatactcaaaggtgaaatagtgaacacttacctcctaagactaccaacaaggcaaggatgtctactcttgccacttctcttcaacattgttctgatacccacaataacgtgggtgaatctcaaaattattatgttaactgaaagaagacagacataaaaagagtttatagtatatgattccattaatacaaaatacagactaatctaaaatgacaaaaagcatgtttttgtttttcttggacccagaggcagtggagggaatagcccataaaggaacacaagtaatcttttgggggtgatggaaatgccctgtcttaggatcatacacaactgttaaaactcatcaaattgtacactttaatagaatataatttttaaggtaaatcattccccaataaatttgatgagaacaaatatgattaatatgtttaaaaacaggaaaagaggaacaaatggataaaaagatgaagaatttcaatgctgacagaaaactgtcaatctagaattctatactcagtgaaaatatttttcaaaaatgaagggcaacataaatatgttctcagacaaagattgagacagtctgtcatagacagacctgcactataagaatacttttagcaagttctttaggttgaaaggaaatattcccaaatggaagcatagaagaaatgaagaacacaagaaagggtaaatatatgaacaaatattttaagatacttactgcttaaaacagaaataatgtcatattgaatctataacatgtaaaaatatatgactctgtcagtgcaggaggggataaagggagttaaactcttctgagatttttaaagcagtctgtaataaattatagtgtaattgaaatctcttagataactacgaaaatgataacactagaataaataaagaagctgagattaaaacaacggaataaaaaatacctcattattccaaacgaagatgggaaaggggaaataaagtaaccaaagaaccacaggacccaaaaaacaacaaaaacaacaaccaaccaaatagcaagatggtagaattaaaatgaacattttagaaatacaaattgaatgcaaatagattaaacactccaattaaaattctaaaggttgtctatagaataaaaactatgttttgtctaaaagaagcatattttaaaagcaaggatgtagttaggttgaaagtagacgagaaaaatctataccacttgaacattaaccaaaacaaactggaataactttattactgtagtcaaaattgacattaaggcaaaatatattaccagagaaaaagaaggtcattgcataattataaaagggctagtttagtgggaagatgtaacaccctgaataggcatgcatctaatattgtctccttaaaatacaaaaagcaaaaacagaactgaaaagaggaataaataaatacacaatcatagttgaaaactttacatggcattacactgaaatttgtaaataaatttagcaaggttgctggatagaaggtgaataaagaccactcaattatatttctatgtagcagcagcagtaaaatcaaaagaacttctagaaataaaaccagtgcctctatagtaaagacaacagaatatcattgagaaaaattaaagaatgcttaagtggaggaataaatcatattatttgaattgaaaaactcaatattataaaaatatcagttctttcccaaactgctctttgaaactaaaacaccacgatcgaaatttcagcaatttgttttttttaggtgtaaatcagcatgtttattctaaaacatataaagatgtgcaaaagacttcgaatagcacaggcagttgtaatgcagaatgccagtggaggatctccaccagccattatgaggatatactatcaagctatagtaatcagtacagagccttgacataagatggagaaattgaaatagaagagtcaagaaacagacccacccaaatggtgtgctgtgccagttatctgttattacctcttaactcctgatcccacctgtcttggccccgtttgttgaaattggtgctggaccctaagaaaattcctccttgaccagttggcatagtggtgggcttgtcagcagagggtgctggagggacacgggtagaggaaggggcttctcttccaggtttcagggcttttgttcttgtttgatggcatggcagccagtgggcagtttcttatcaagagtagccagcaccccaatagatgactgcccagagagtctcacaggcacctcagcactggctccagcctcaagtacctcagtgagtttctccagtgggtcacagccatgccctctgtaacaatgcctgaatctcagacttgttagagagaccctcttctgagtttcttccatttcttaggactttcctttactggcttttacatttgttattcctatattctttacagtggcctttaccctttacccatcttgatagttaatcccttttactagttattctttttattaaattttccctactcaaattacttctgtaattattgtctcctgactagaacctggtacataaggccacttgatttttagcaaaggcaccacctacaattaagcacgaaaagaatggtcttttccagccaggtgcgttggctcacgtgtgtaatcccagcactttgggaggccgaggcaggtgggtcacgaggtcaggagttcgagaccagcctggccaacatggtgaaatcccgtctctactaaaaatacaaaaattagcctgacgtggtggcacacacctgtaattccagccactcaggaggctgaggcaggagaatcacttgaacccaggaggcggaggttgcagtgagccgagatcgcgccactgcactccagcctgggtaactagagcaagactctgtctcaaaaaaaaaaaaaaaaaaaaaaaaaaaggtcttttcaataaatggaagtagagtaactggacatacatacggaaaacatgaacttggactccgtctcacaccagccacacttggattggacctaagtgttaaaggaatatagtaacgctgctagaggaaaatatggaagaatattttcttcatggcttcagggtaaacaaatttttcttaaaccagactcaataagccctacctataaaagaaacagttgagaagttggactttattaaaaataagaacttttgtttatcagaagaccattaagtgagagaaatgtgaaaaacggcatgcaccaagaaaagatgtttgcaatacatatattaaccaaaagatttgtctccagaatgtatgaaaacgactgcaagttaattttttaaaaaaggcaatcaacaggctgggtgcggtggttcatgcctgtaatcccagcactttgggaggcagaggtgggtggatcatgaggtcaagagatcgagaccatcctggccaacatcgtggaaccccatctctactgaaaatacaaaaattagctgggcatggtggcgcacgcctgtagtcccagctgcttgggaggctgaggcaggagaattgcttgaacccgggaggcagaggttgcagtgagccgagattgcgccattgcattccagcctggccacagagcaagactctgtctcaagaaaaaaaaaaaaggcaaccaacaaaaaatgggcaagagccttgagcagacacttcacaaaaggggacattgaaatgtccagtaacttataaagaagtactcagtgctgtcagtgatccagaaagtacagattaaaaccacagtgaggtaccacaatagcctttagaaaggcaggtgtgaaaaagacagaaaatggcaagtgctggtgaggatgtggaacaactgaattcttatatgctgctggttgattgtgacctgctttgaccactttgaaaatatgtctggcaagtatctacttaaaataaacctacaccaaccatatgacacactagtcttccttctggatatatgtgcaagagaaatatgcacatatgttggccaaatgatatctataagaaatttcctagaagctttatgcctaatagtgaaacactggaaacatcccgaatgcctgtcagcagttcaactgttttagttaaacaaacaagcaaattatggaacatatgtacattggaataccacatggcataaaaaattactctaaatactctaaatatctttctaaatttatgctccagcacaaacttgtggagaatacactcactaataatttaatttttaaaaacttttccatcttaatcatacaaaccacttaaaaaatatcacaaagttgccagatgctatggctcatacctgcagttccagcactttgggaggctgaggcaggaggattgcttgagtctgggagtttgagaccagcctagacaacatagtgagatatcacctctacaaaaaatttaagaattagccgggtgtaggtgtgcacacctgtggtccaagctactcggaaggctgagatgggaggattgctcgagcctggccggtgaaggctgcagtgagccatgatcatgacactgcactccactgcactccagcctgggcaacagagggagaccctgtctcaaaaaaaaaaaaaaaaattacaaaggaattattctcctacttatcttattaataagacagagacagaacatgtagccatggctcatttttgaatcagctgtgtcctactagtttccagaaagtccagaagacttctcctctgttgtgtgagcctcataagtggccaggggtagatatcacacaggctgaaacatctcagtcatcagacaccagatgctgagtccccatctggcccatccaccttccctacacactacttcccatgcaccttatcctgttgtctcacctgggcttcacaatttagtccctgggagatgtgaaaaacaacttttttctattttacaagttagaaaacaggagtctagggaataaaataataataactctcccttactgcaacatccctatgtgccaggcctgttccacagactctccaagattaggctgaggtaccatcctcttggggctccttccccttctccaaagtgcccacctctctgacactccacattgtttgtggagtgtgtgctcttctctgattatgcatacctgacactgtatggcattgaagacatttgtgttcatgcattagcctcccattatgggggacacatgcttcttgaggatgggggctgtcgcccaccaagcagctaccaggacagggcttttcaataaataatttgttgggctgaatttctagcatcacgtctcagagcctcagcctagcagggctctcttggggagaagggatctggggatcatctgatgaaagcaaggaccagcatgtgacatagaggaaaagaaagagcagtctacgtgaggtctctggtctggtgcagtgacagcactcattccagaagagctcttggccaggaatgtgggagccaaaaggctgattagctcattgctgcactgctggcaaacatgctggcctcttggcccagccccaaaagaatatgatgtgaacattatgcaccattaagctgactcagagaacaaatgactaagtttcccataatcaaggagattttggcttggcccttcttcattttgatgcaacctgagtttaatgcatcatgatgaatgattctggtccacaccaaaggaagtgtctttgctgtggggtgtgttcttagccagtcttgcttcacggcaggggcagggaacattttactgcctttctaatgttctcccagctattcagaatcctctgtgaacacttttctccaatagcaagctataaaacaggtgattctgtttattggagctgtgctatttaaagaccagcttgctcattaacgtcacctgccacatccctgagctttatgtagcaactcaaacatggctcacaaatggaggaaagtcttcataccccaaggtaatgaaagatgttagagggtaataaaagaaataaaatgggcatagacaacctaatccacacctctaagtccccagcgaggcatggcctagggctctcccaagtgacctagaagctaacaattccacatcactttctgcattttcattattccttcatcctggagaccttttgtggagggcactgactcctgcgattgattcttgaatagcaggagacgatggagattagaagataagccagagttcaatctgccctccctccactgcactccagtagagctttcaaccaacacccgcttcctgtttgttactaacagcaaacctcagtgccatccaatttagagaaagaggcagtaagagagtccagagtcacatatagcttgtcatatctggaactctagcccttacccagtgtattagtctgttctcacactgctaataaaaacatgcctgagaatggacaatttacaaaaggaagaggtttaattgaaggactcacagttccacatggctggggaggccctcacaatcatggcagaaggtgaaaggcatgtctcacatggcaacagacaagagaagagagcttgtgcagggaaactccctgtataaaaccatcagatcttaagagacttattcactgtcacaagaatagcatgggaaagacccacccgcgtgattcaattatctcccaccaggtccctcccacaacatgtgggagtttcgggacctacaattcaagatgagatttgggtggggacacagccaaaccatatcattccgccccagcccctctcaaatctcatgtcttcacatttcaaaaccaatcatgccttcccaacagttccccaaagtcttaactcatttcaccattagctcaaatgtccacagtcaaaagtctcatctgtcaggttttctgatttcatttctgtagtcaagaagctgagggacaggacccatgcatgccagtgacaatgtttgatgagtctggtgggaggctctgcaatagcaggaaaagctccctgggtgcttctgctctgagacaggagatctaaaccagatgatttctcaggacacttggattactaatattctgtggtcaatgatgcccttaggccctgaaaaatcctgtctttttagaaagacaatcatatttaatgtgttctagggaataaatcagaaacttagtcttacggtttaaggaattttctaataatgatctggaaactgaaagggaacgcattaatcagaattctctgttccctggattcccaatagaagagatgttcctgtatttccacaaggagccctggaagcagcccacagatggagaggactgaggccaagtgaggatgagtacacagcaccccctgtactgtgatcttgggcctgtgtcccacaccctccacagggacagttccttctgcaaggtgcccgcccagcaacaaccacctctccggtgctaacagaccttttttttctccactgcgcagtgtgccataggtatcccgtgcatgtgagtgagccagccagagagctccatgtcccgataccaggcagtgagatgtgaattcctgtctagggctgtaacctgccagactgcttccagcctacatgaaggctggtcactccctccttctcaggcactgcgtccctcagcccagagccttctgtagagagctgctgtggctccagctttcccatctcctccaccattttacatcttcttaggcagcctttcagtggagagcttgtcctaccaacattttctccctcctaaagtactgaaaaaaacccttaggagcgaaaaatcatctgcagtatccctgatccccttctcagaacagcacagtgtccccaccaagtgctaataaatgttgttggataacagaacaatttggtttaaatctcctctcacagagcagaatcgcctggagggattttgccttgaaaattaaattctgatatcaatttctaaaattatttacaatattaaagttgaaatgaatccatcacacagtttccttccaatgttagtctttcaagtgaacctactttcctattagcagtcacctaaaaacaaataagcaaacaaacaggtaactcagtcttccctctgactcagtgtgaggaaagggacaggcagcatctggtgacagcttacttcagtgggtctccatggttcttcaccaaaaccacttgtgtttcctcttcaagcaccacagtatcctatgacactaggccagtgggctctcaaacttttggaattcaggactcctttcctctcaacttcttaagttgggttctatctattgatagttacattacttgaaattaacacagatattttaaaattattcagaaattcatttacaataataatgaacccattatataataaaaacattttattatttatttattgagacagtttcattttctctttttgagacagactcttgctctgttgccaggctggagtgcagtggcacaatctcggctcactgcaacctctgcctcacaatctcaagcaattctcctgcctcagcctcctaattagctgggattacgggtgtgcgccaccacaccagcctaattttttatttttagtagagacgaggttttgccatgttggccaggctggccttgaactcctgacctcaaatgatctgcccaatttggcctcccaaagttctgggattacaggcatgagccacctcacccagccccaaaataacattttaataaaaagaactatattttataaaacaaaaataaattagtgaggagaatttctagaactctttaatgtcagaattactatgacagcttgattctcctatgtccttctgcattaatctgttgcgatacattgttctgattgaattatgtgaagaaaacccagcctcacatgaataggtggctagaaacaagaggagtattttcatagctttatcagattattgtagatgttcttgttagatagggcgtcaaaacttgacaggtggtagtttcttaaaggttagttgcaacatggagtctgaaacactatcagtaaacttgtagtattttattacagcccattgtctgtcagtcttgccctgcaaacaaatattttactatgcatgattttcataacatgcattagtcatttggaaatattattcactgagttatgaagattttcctaacgttaacacatttctgtatacagtgtcaaaaaaaatcacttgataatttcaccactaagctcatcagaaacatcaggtataggcaaatctcggagctattgcaggttatgttccagaccaccacaataaagcaaatatcaaagcaagtcacatgaattttttggtttctcaaggcaaacaaaagttatgtttacactctagtctattgtgtgcaatagcattatgtctaaaaacaatgtatgtgccttaattttaaaaatactttattgctaaaaaatgctaataatcatctgagccttcagtgagtcatcatcttctcactggtggagagtcttacctggatgttaatggccgctgactgatcagggtgatgatagttgctgaaggctggggtggctatggcaatttctgaaaataagacaacactaaagtttgccacatcaatggactcttcctttcacgaaagttttctctgtagcatgtgatgctgtttgatagcctttcaccacggtataacttctttcaaaattggagtcagtcctctcaaaccctgctgctgctttagcaactaagcttatgtaatattaatattctaaaccctttgttgtcatctcaacaatgttcacagcatcttcactactagtagactgcatctcaagtaaccacttttctgcttctcatccataagaagcaactccttatccattcaagtttgatcatgagattgcagcaattcagtcacatcttcaggctccacttctaattctagttctcttgctgttttcaccacatctgcagtgacttccttcaataaaggatggaaccccttaaaggcatccgtgagggttggaatcaacttcttccaaactctgttgatgttgtgacctcctcccatgagtcacaaatgttcttaatgacatcgagaacggtgaatgcctctcagaaggttttcaatttactttgcccagatccatcagaggaatcaccatctgtggcagctatagccttacaaaatgtatttcttaagtagtaacacttgaaagtcaaaattactccttgacccgtgtcttgcagaatggatgcggtgttaacgggcatgaaaacaacattcatctccttgcacatctccatcagagctcttgggtgcattgttcatgagcagtaatattttgagaggaacctttttctggggtacagtggctgggagagggtgagttggtcttgaagggccttggaggccgataggagaattagacttttactccgtgggaaatagggagccattgcagggtttagagcagagcaatgacatgaatagacttagcctgtaaaaggaggattgtgcctgctgtttcggggggcatgaacagaagaaggagcacattcatcaggtaggatggtggtggctgtgaccagggtggcagcagtggatatgcatggtggctgggttctgggtgtagtttggtgatacatctcctggggcttgctcatgaacatgcatgtgacatgaaaaggagaggcatcaagagtggctcttggcttgatagcctagcaaggtggctttgcagttgtcacatgaggttgcagtttggacatgtcctgtggtggatagcaatggaatgttacatgttagcaggggtttgggagagaggaccaggacatggagatggaggttgcgagtggttgatggatgaaattaccaagtagggagtacaaggagagacgaggatccaggatggaggctggccctctggctgatgtcaagaggtcagaagggaagacacgtttatcttgagttgggaagaacaaactggtcagctggaggaaagccaaggggcactgcccagccgctgagtgggtggtggtgaaggtcatatcagatgctggggatggctccaaggagactctggtggcaaccctgagcagtgtggagtcagtggtggctgggagaagggccatcactgctggggtggagcagagccctcaggaatgaggggagttgacatagtttgtctgcagaaaggagtaaggaaacatggtggttggtgggggaactgggaacaagagcaggaagttttaaaatgcaggacatgctatcctctgttgctgtggtctgcgggccagctgcagactgggaggccgcagcgtctgcccccattttcctgctctcccctggcagaggcgccccagggggctccaggggagtgctgtctgctgctggcggtggggggcggtgatcggatatgggaaggagggagacatggagacataaaacattgtctaagtgaagggcaatcgtatttgaagtaatttgaagattgacaggaaattcataaagggaatatggagttccgtttacaacagcaagagatgccttgtccatagcttcctgacctctggaagaacagaagttgctgctggcagagttccaaaacatgaaaatgtaaaatggaattgaataatctctcctaaatcaattttgtgagccaaatgacctagagagtgatgtgatacagtgcaggtagacgacacagggcgctgctgtctgctgaatacatgatggcagttgattctggagataaccaaataccagcttccctttggtctctggagcctggtttctaccattagcctccacagagcccatcttggggaggtgtgcctcttttttctggcttcggtgtgctgattccagagtctgttgtgagggtcaccttgctggctgtgaggagctctctctctgggcccagccggaaggcccttgcagcctcttttcaggagcactgggctgttgctttctgtgcagcatcgtgtggatgcatcctctgagtgaggctcatttgcttatgtgagttcccttgatcagccaggttcccagggaatctgtggagactggctgtgtcagccactgaggccaagtgagggctgttgctgtttgtacttatccagggacaccttcagcttgaggccccacccttgtgagcaggggcctcagtgagcatcttagggtctctgtgtgaggtcacagtaggacccagactggagatgtgggcacagtgggtaagtgacaccagggctgggacaagcagagcccctcctcggctgaagatgtcccctgtgcacatagagacaagggctcctgcagctccctggggagtctagcaattggtggctgtgttttctctggggattctttactgggcgtgcacttctacctggcttgacctgcttaaggcatgtcagggtgctcctgtctgtgaattggcagggaaagtgcctgtcagtgtggacccaaacagggaacctctgggcacctgtggttgccacaaatcagggatccgtggatgttttctgtcaagtcctggatagtaaatatttcaggcatgagggtcacatatggtctcttatagtctttttttttccccctctcagccttttaaaataataaaaatcatttttggttcataggttgtacagaaatggtctgtgggccatggcttactgacccctgctgtgagcccaggaggcaggaataaaatactgacttggccatggtgctcactaattcagtctccatagaggtgaaggaggcacagagcacgtcccttgttgggacagatcattcttttgcacatgtgtgtttatgtcagtgtgaaagtcagttttgaagaggaccctccatctttcttacagcctttcaccattcaagacactcagttgtcaaagagtcttttccacctttacattagcaatgttgtgttttagaaaatcctcctcattgctgcagtacatcaaaggtaatgaatttgaacaaactttctcctcctggagcagtcttctctactctgactacacattagtcatctggggggcttttgcaaaacagcagtgtccaggtcccctaaccaggaaagtcgaatctcttgggggccctgacatcactgtgtagccggaggaagagccctctgcccaggctcacagcatctagcagcaggttcattgattctgagtgtgctgcctggatgcccagtctggctgacgttacagtatgcagagtctcttacacattggggtgtgacaggagctcactattgctgctagtgcaggcttctcctttccctccctctgctctctccctcctttctctccctcccctctccctctgccatctctctctactgcccccctttccctacctatctctatttctctctctccctctgtatagctccctccccagtccccactgctgcccatgtactgtaaatgctctagaatttaggaaagatttttggcttaatcagcaagtgctggttcaattagcacaaatcccaaatgacatgaggaggtctttcagcatttaggttgagaagccctagccaggcagagggaggcaggctgatgtggagcatccaccatgtgcacttagggtgagcacgctgcctttcagatgtcagggacaccagtaagcccctgttctctctctgcttcagttgatactgtttcagttcccagtgggactgacatctaggaattaggtatttactttaaaaaatatttctctctgcaacttggatcaaacaaagttcaagaaactgcttagaaagaggttggtaaaaagatgacagaaaatctcttggttatgaggcttgtcagcaagtttattttgtccttttctgtaacttttatttctaggcccctaaggtcagcttctgcttgctcttcatgctgactgagtgtgcacgtacattattgatagcaggagcgggaaaggagtaatgctttctacttggaaatattccctgatagaagccttgaaattggaatacttttttgtctctggggatctaggtcagtgcttctgaaactttagcgtgcacgagtcacctgggtttttaaaatgcagattctggctgggtgcagtagcttatgcctgtaatcccggcactttgggaggctgaggcgggtggatcacctgaggtcaggagttcaagaccagcctggttaacatggtgaaaccccgtctctattaaaaatacaaaaattgtctgggcgtgatggtgggagcctgtaatcccagctactcggaaggctgaggcaggagaatcgcttgaacctgggaagcagaggttgcagtgagctgagatcatgccattgcactccagcctgggagacaaagtgagactccgtctcaaaaataaataaataataaataataaaataaataaaatgtagtttctgacccagtggatgtgaggcgtggggatctgcatttccagtgagcacctctgtccacacttggtgaggctttgggccatcattgcatgtgatccttgactgaggcataatcagaatgattccagaggacatttgccaaatacagaggtattattaggagcataatatccaaatagtggaggtgatagtcctgcttctctgtgtgctgcctgcctgaacttggactcctgggagaggcagggagagagtggggccatcactggcacgtgcagacaatggaagtgtcaagaccccacgctgaagcatcttctgaactgcagagctgagcaccccaggtgtcatcttgactgcacatgtagccccaggaagctggtcttcccaggtgaggaggatgacctgagaagcttgctcaaggtcactccactggtgtcaggatttagcccaggtatcttcagtggcaaagccgacgttctgcttcatcactgaataaaactatgggactgaggaagtttaattctactgagatagcctgactcagcataccctacttccctccttcctaggggttccacatgccgaaattgggaaaaagctttagactggttctatgtgaaaggaggatgtttgggatcaccatgtgggtactatgggggagggataggttgcagcttttcttctcaagggctagagtggtgctctggtctcctgaaggtattcctgcagagggtgggccactttatgggaggaggtgtggcaggagggtcagaatctgcatttctgcccaattccaaggtcaaattgctgctgtgagagttcagggatcctgtgaatccccatggtttctgaccccctgaacccttgaggaacactgttgatcaagaagccaaggagggcaacaccactgttttgctgcttaagtttggaaaccatagaaatcttggaagctgacaaaggattctcctaaaattcaggaaacaaagtgaaagggatcacttgtaaaacatagcttcatataagcaaacttcatgagataaagaaataaaaatcaatgtctcatttaaatagaaaaagaaaagctagcaaccgtagcttgcagcaggggtgggagttaatacaatgaggggttaatcccttcaaagattcagaaatacttttagggaattaatgtccaagatctaatggcatattggtgactgtgattcatgtgggttccgtagaggcttttagaccctggctctgtttcaagggcggaagaatcctttgttccccgtaggagcatttgcactgttcacacacatgtccagttgtccagaaagctctgcatatggctgggcgaggcccccactggcaggcccatgtgtgtgcagaggccaagggacccagcatggatgaagaagctggcctgagcttcagtgcctggtagatgtgatttcaaagactggtttccttgcttgctagcggcagaacttttggacaaatgcttagcctttctgggcctccgtttccccatttgtaaaacagaaacaacagtccatgtcttgctgagctggcatgaggagagcagccatgcagaggaagtgcctggcatgctgtaagttctcagcagaaggggctgctgttatggcagggtccaaaattgctagcctgtcttcggaacattcggcctcttaagctgagtattcactgtaagaattaagaaatattttggggcaaggctgacattttctgcttcagttgtgactaagtacatcacataccttagtcagaggagaaacactctatatcttagatacatggcatctaactgggtgcctcaaatgatgaaatattgagtacttcctgtaaacttggactttctaggttcctcttctaaagacaccatcaccgtgacctctgcaatgtcagtgtctgaagataggcgacgacttttcagaatttggcactgccgtgagagctgctgttttcccaacatgttcagactaagacggggaccttttttttttctttaattgctatttcttaatattttttctgattttagaatggtgttagatttacagaattatgatgaggatggtacagagaatctttgtaaaccccacatccagtttaacatcttacatcagtaagggacatttgtcatagttaatggaccaatatcagccattattattaactaaagtccatacttcagatttcttcagttttcccgtaatgtccttttctgttccaggatcctagccaagatcccacattatatttaatcattgtggttcctcaggctcctcttggctgtgacagcttctcagactttccttgtttttgatgactttgacaattttgaggaggactgggcaggtactttgtagaatgtgcctcatttgggatctgctgggatctggtgttttctggtgattagttatgggttttggggatgaagacactgagataaactgccagttctatcactgtcagtttatgtcaaggaagctcactgtcagcatgactcatcactgttcatggtgaccttgatcacctggctgaggtgtgtttgtcagatttcttcactgtaaagtgactcttcttttttattattattattagtgttatactttaagttttagggtacctgtgcacaacgtgcaggtttgttacatatgtatacatgtgccatgttggtgtgctgcacccattaactcgtcatttaccattaggtatatatctcctaatgctatccctcctgcctcccccaaccccacaacagtccctggtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctagaaaggacatgaactcatcattttttatggctgcatagtattccatggtgtatatgtgccacattttcttaatccagtctatcattgttggacacatgctgctataacgacacatgcacacgtatgtttattgcggcactattcacaatagcaaagacttggaaccaacccaaataactcttctttttttctctgtctttccatactgtactgtttggaaggaagtcatcttgtgtagtgcacacttaaagggtggagagttgtgctctgcctcactgaggatggagtgtctgtataaattatttagactagtattatcttgggagatttatctgctctcacacttatttatttttccaatcatttatttatttaagcatgaacgcatggatttaaaaacaattcttgggtttatagttccatgttgcattttttttctctcaaattgctccagctttgcccattgggggcactttcagttggttcctgtgtccctttgacatacccacatcattgtgtgtgtgtgttttgtttttaagcacctctttcctttctggtactactgaaagtgatgatgctccaggctcattttgtgtatagtatttcctgcccttgtgctaggatcagccatttatccaaggagtcctggttccttttattggagaataatataagaaaccaatatctaggtgctgaatgtatttgttgctctgggagttttgttgcttttaggccattttagctgacagagcaaaggagatatatgtttgtatactaactaacctgtatatatgcacatgtctatagatatttctatatgtaaccatctgtatctttcttgagctaacctgtgtgtatatacatctatagatatttctatatgtaatcatctgtacatttcttgagcattagttcatactgacatttgtaacttgaatccattgccacacggattattctagccttctccccttgctggcttctcactccaacagtgagaaactggtttgcaccatccactattgatttacttaattgttcacctttagtatacatgtatagcagtatgaggattgttatcttgtactccttggtaaacaactttatcaattagagtacagtgcttatgtacttcagtgcttacagttcctttttccttcaaccttagagattctactcatttctaaaatgacttaggtcagcaccttattctccaacccctttgttaaggttgtttaatatatttttaatacagttagattgttttgtcactttccgcatcctgtcttgagattggacatcctaaatgacgttttaaaataaagtacatacattaaggtttaatttttgtgttgtaaagttctatggtttttgagaactgcttaatgtcttgtagttatcattagagtatcatacagggtagtttcactgacctaaaaatcccctgtgcttcatctctttatctctgcccctgaatccctgataatcactgatctgtcaaccatctctataattttgccttttccagaatgtcatatagttggagtgatacagtatgtagctttagtggtatgcatttaaagttagtctgtcttcatatcttgatagttcatttctttttatcactgaataatattctgttgtataaatataccttgatttgtttatccattcacttattgaaagatgtcttggttgcttccagtttttggcggttatgaataaagctgctataaacatttgtgtgcaggtttttgtgtggatataagttttcaattcatttgggcaaataccagggagcacaattgctggatcatattgtaaaagtatgtgtaatttataagaaactagcaaactcttttccaaagtggctgtactattttgcatttccaccagccgtgaatgagatttcttgctgttctacatccttgcaaacatttagtattttcagattttttgatattaataattctaacaggtgtgaggtagtatcttgttttaatatgcagtttcctaattttgatgtgtttaatgtggtgagccagttttgaaaactgactcttctgtacctctttcaagtaaatttttacttttccaaatgacttgtctccgaatctttactgacactgtacacgttggtttgtggtcagcatcttattagcctgagctattatatactaattatgatgatgattattatacatttcttgtgagggttgctctttctttcatttttttttttttcctattgagacagggcctcactctgtcacccaggctggagtgcagtggtgcaatcatggctcactgcagcctttgacttcctggactgaagtgatccccctgccacagcctcctgagtagttgggaccacctgtacacaccaccatgcccagctaattaaagaaaattatttgtagaggtgtggtctcactgtgttgcccacacatttgccactgtggtgttgtggtctcaaacttctgggctcaagtgatcctcctgctttggcctcccaaagtgttgggattacaggtgtgagccaccttacctggccgagggttgctctttccatgagtcatttacactgaactattaatgcctttgcaggaagctacagaggccagcttctaggaccacgtgggaattttgggataaaatgtattatctagactttaggaaattacttccagtagtaatgaattccagatttcaacatgccactactgctaaaaagttgtgcttggtgtccgtttatcttccagataaagcaccgccagcaagccccttccttggcctcgcattccagatcttctcgcattggcttgtaggctctctctctagcttgacctaccatttctcccttttagttggtttatgctccagacaaaccgggatgagccgctggccttgctcttgctttccacctgctaggactgcccttctgcagactgcataagcagtcctgcccacacagccccatacagacacacctcgtctgtccatgcggagttcttacctacccagggcctgcttttgaatgttgtccctcactaacgaccacctcatgaaggcagagtgagatttcttccttactttgcacatggttatgcatgtacctgaccctcttcttgagacagtgtgggctccctgaagatgtgcctgcacctgctgacgccatgctccgctacttgcatggtgcacgagggagcacaggacaggctgcacgcactccttagagcacctgccattccagcagcctctcgatggtgctggtgctgatgagaatgacgctgcagatgtgcagccatgtgagtctgcttcattgtctcctcccagaactttcccaaaggaggagccagtgctgttgtcttggccctgcttctgatttctgttttcttcatttgcatgcaatattttattgttgtcttatgaaaggggcctgttgccaggacagctaggggtggggtatgtgcagagccacttggtcacactccagttgtgttcttcctttatttcagttttggggatgggagaatataaacgttgtacacttctgtcctcttgttttgtctttcctctaagggctagtagttcccacacactcttctgaatgtactgcctatgctctgtgttttcgttctcttcagcgtggttggttgcgcctccatttccctcactcctttggggtctcatctcttctctcgactttaaatactggctgtgctctgatgactcttgctctgggactctcccatcaactccagactaatttgtctcagtgcttatttgacatttccatttgcaagtctaataagcatttgagactgaatatgtccaaaactgaactcttgaccattccaggacagctcctttttctggttgcttaggccaaaagccttggtgccacactgggttctacgtctcttaacccttagtcccatcctctaggaaacctgtttcagggaacacacacacacacacatgcatatgcagagtcacaatgatgaagctcacattacaaggtattcatagacttaaaggaaaaactacagataagattatacatttgaaaatcatataacttgaaagggattaatatcaaagatctagaaagaataagcatataatagataaaaggctgtaaaatgacaagtcaaattgaagaagccagaaaggatataagtatatgaaaacttcatttttgagacgaatccatgaaatgtgaattaaaacagtgagataccatttcacattcatcagcttggcaggcatgaagtcagttaatatgtactggtgagatgtggggaccttgctcttgggagtgcacatttttataaccactttggagactattttggaggcacgttttcaggtaaagttgaaaatgtgcacataatatgacccaccgatgccattttcaggcatttgctctagaagaactagtggatgcccatggatatgggcctatggtgtttgtaagagcaaaacacggtttaactgttctcaggaaggggaactggacatttgttttattcacatagtcaaaaactattcaacattaaaatgaatgaattaaatctatgggtatcaaaatggataaatctcagtaacagtgttaacaaagcaggttgcaaaaggataagtgcagtttggtattgtttttggatatgcacgtggctggtgaagatatgtacacgtgaatgtgagtactgatttgccatctctagattatatggtttccttcctatacagaggggtatcagtggagtatagggcttcggtggtatctgcaagcatttttaaaagagatccaaagcaaatcaaaatgttgacaactttttaatcttcctggtaagtatatcgatgtctattatgtttattttttgaattgaggtataatttgcataccataaaatctacccattaaagcgtacaagtgagtagtttttggtattaatatatttacagagttgtgtaagtattatcactaatttcagaacattctttataccctgaaaataatcccatgtacattatcagtcactctccattctttccttccctgagaaatgggaatgaaaatgccagagtgttttccaaattggctgcatcattttgcattcctgccagcaatttatgagtgttaacaattttgcatgtcttcaccagcacttgttattgtctgtctttttgattattaccgttctagtgaatgtgaagtagtatatcagtgttattttgattggcatttatttccctgatgactgatgatgttggaaagcttttcatgtgcttactggccatttgcatatattttctggggaaatgtgtattcaaatcattttcccattttttaagtgagtcatgtttttattgttctaggaattcttttttatattctggatactagttccttattagatttgccaaattttccccttgttctgtgggttgactttttacttttttgatcatgtccttgcaagcataaaagtttttaattttaagcccaatttatttattttttctttcattgcttatacttttggtatcatatctaggaaaccactgcctaatccaaggtcacattttcatatttttcacgttttattctaagagcttcaataggtttagtccttaggtctttgattcattttgaattaattttcgtatatagtatgaaatagggttccagattcattctttagcatgtggatattcaattgtcccagcacactgggacaattattaaaatgaatagtgtttctccattgaattgtcttggcagtcttagtcaaaaccagttgactataaatgtaagggttaatttgttgatttccatatctatatatggggagggagagagaatatatctacatcattataccctgaattagtctgctagggctgccataacaacatactacactgaatggtttaaacagcagaaatgtattttctcatagttttagaagccagaggtctaaaatcaaagtgttggcagctttggtttcttctggggactctctccttggtttggagatgacatcttcttgctgtgtcttcactgttcttttgctgtaaggataccagtcctcttcttgtaaggacactagttcttttggattagggccccacccttatgatctcatttaatcctaattattaatacctctttaaaatccctgtgtttaaatatagtgatttgggggattaggtcttcaacacatgggttttgtggggatacagttcagtccagaacatgcccatatgacaatgtattgagtgctgtagctttgtagtaagttttcaaattgggaaatgtgagtcttctgactttgtttttcttttttaagattgttttggctattctgagtcccttgagttttcatatgaattttagaatcagcttgtcaatttctgtcagaaagttggctgggatttttatagagattgcattgaatttgtagattagtttaggacatattgccatcttaataatattacattgaacataggatgtttttctatttatttaggttttgtttaattcctttccctttcttgtagtttttggtgtataagtcttgcatttttaaaaaattaaatctattcctaagttttttattatttttgctgctattacgaatggattttttaaaattttatttttggattgttcattgctagtgtacagaaatacaattactttttgtatattgatccctgccaccttgttgaactttattatactagttttttagtggatttcttagtattttctatatacaatatcatgtcatctccaaatagagatatttgtatttttccttttcagtctggatgccctgtatttctttttcttgcctaattgtcctggctaaaacctccaatacagcgttgattgtactggcaagggcaggcatccttgtcctgtttctcatcttaggggaaaagctttcaatcttttactattgttcatgatgttagctgcgagtttttcatagatatccattattaagttaataaagcttccttttattcctagtttttttgagtgtttttatcattagatatattgaaatttgtcaaatgctttttctgtgtctactgagatgatcatgtggtttttgtcctttattccattaatatgatgtattgcattgatcgatttttggatattaagccaactttgcattttggggataaaccccacttgattatagtgtgtaatcttttttatatattgttagatttggtttgctaatatttttgttgtgatgttttacatgtgtattcataagagacattggtctttggttttctcttgatgtctttgtttgggtttggtattgggctaatactggcctcataaaatgagttgggaagtatccttttcttgtctgtaattttgaaagagtttgtgaggggttgttgttaattcttacttaaatgtttggcagaatacggtagtaatgccatctgatcctggacttttccttgtggaaagttttttggttactaaacctcttcacttgttttaggtttgttcagatttctcttttatctagagtcagtttctgtagtttctgtgtgtttctaggaatttgttcatctaggctttttgttgatataaaattgtttatagtattttcttataatcctttttatttctgcaaggttggttgtgatgtctcctctttcattcctaattttaataatttgagtcttctctccttttttttttttgctagtctaggtgaagatttgtcaattttttgatcttttcaagaaactaacttttggttttgttttctattctgtttaatttctatttaatttctatttctatttagtttcttgttgccatagtatttgttgtttccttccttctgcttgctttgggtttagttttctcttgttttactaatttcttaagatggaagtttaggttatcgaattgagatcttgcctcttttttaaaggtaggtgtttacagcttcgaaagactcctgtcctgttctgccgcttccatgccagccaggctgctggttctcattgattgctgggctcttggttttcaaggcttggatgcagctcgggggaaggggatggaagtagggtaagttaaaatgccacaatgctcactgttcttaccaaggtccagttgtttttcttgaatcagtgatccttggattgctgcaagcctttgatgaatttccagagctcttaaaaagttaattgtgacaattttgccagggttctcattgcttttatggagaggtaagctgttagtggttattactctgccattctcacagatgccatctgcgtcctatgttttataatgaacacttttcaaaaaatgaatgtgattgccacaggatattttatgaaaattgatgaatggcttctaaatgtcacaaggggataaaagcataagactggccaacagtttggaaaagaacagcagtggagagctgcctattcatctgatatcaagatgctctgtaaaataaaggagtggaaacagtgtgggacttgtgctaagcagggccaagcagcaaatctagagcccagctaatgggacgggaggtcagtgtgtgagaaatttccgtcttgggttaaccctggcctggctgaattcggggaacaagccatgttgtgtgattagctcagctgtatctggctgaccgttcgtaatcctcaccctgcaataaggttggctttacctcagaattagagctgaggcagtttgggaaggggcttctcagtggatgcgagtgacttggggccgctcttggggatgaaggacagaacagcaagtgttctcagggaggctagaggggccatcactgagagagttaaaagaagacaactgaggaactgagaagtgagaacaagccatacccggtggcaggaaatgtgtgcagagggtttttagtgtgtcttctccaagacatactgatatggttaggctttgtgtcctcactcagatctcatcttgaattgtaatctccattacccaaaatccacacatgtcaagggcaggaccaggtggaggtaactggatcatgggggtgattttccccatgctgttctcgtgatagtgagtgagtctcacgagatctgatggttttataagcatctggcacttctccatcctgccactctgttaagaaggtgcctgcttctcctttgccttctgccgtgattgtaagtttcctgaggcctccccagcattgtggaactgtgagtcaattaaacttcttttctttataaattacccagtctcaggtatttcttcatagcagtgtgagaatggactaatacacatactaagtcatgaacaccaaatctggaaactaaaagattgccagatttttgaacctctataggcaaaatcattacccaccaaattccagggtcagtaagaggaagtggaaacctgttctggcctgagggacaagtagagaaggcacctccagatgacttgccagagataagccagcaggacaattgcaaaggtctttaacatccaccagtcctttatgcctaaagaggaatactcagtgctgcttgtactttatttagggctcaatatgttaaaaatattatactcgagttctgggatacatgtgcagaacatgcaggtttgttacataggtatacgtctgccatggtggtttgctgcacccatcaacctgtcatctacatcaggtatttctcctaatgctatccctccccttacccccgaccccctgacaggccccagtgtgtgatgttcccctccctgtgcctatatgttctcattgttcaactcccacttatgagtgagaacatgcagtgtttggttttctgttcctgtgttagtttgctgagaatgatggtttccagcttcatccatgtccctgcaaaggacatgaactcattcttttttatggctgcatagtattccatggtatatatgtgccacattttctttatccagtctatcaaacctgcatgttctgcacatatatctcagaacttgagtataataaaaaagtaataaaaaaagaatcaatttttaaaaacaatttaagcagtgtgagtaaattattcttttaaatgccttagcagtaaaagtattcacaaatacaataattgtaaaatttattactacatttggagttttgaaaacaccttcactgtagtttaattctccatcacctctgtacctttactcttgtagggttgcaatggttttgacagatgcttctcttacctctctggtgcagataacgtccagcagctcagcacttgcacactgaccaggagggtgcaggcttcatgttttagaccagttagtctgggacaggtgacttggttgcatgttctaagatgatttggaccttgacttcaacgtgagctcctgcttcaaacttaaacaagaatattacttattctctccaatgccaggatggccatagcttggctgggtgtgggggccctttcagctgccactttgtgctgccctgtgctgccccagatgtttgaaggtaccttgctttctggtcagaacattctgtgtgtcaggccctctgattttttcttgcctcaagttgcggaagcagctacttggccaaaaatttttgcatgtttagaaagttgtatttgaggccaggtgcagtggctcatgcctgtaatcccagcactttgggaggccaaggcagtaggatcacttgaggccaggagtttgagaccagcctggccaatgtggcgaaaccccatctctactaaaaatacaaaaattagccaggcatggtggcgggtgcctgtagtcccagctactcgggaggctgaggcataagaatcgcttgaacccaggaggtggaggttacagtgagccaagatcgcgccactgcactccagcctaggcgacggagtaagactccatctcaaaaaaaaaaaaaaaaaaacaactcttggctgcagggctgaccgtgagtatttgaggagaccacttttggtgagagaattggaaataaaccttttgtggcctcgagttcacaatgatttccacagctcctgaccccaatttaattattattaaatgacttattattaggttcattttaaagttattctaatattaaagacaccagaatttcttatctaaatgtatttgcttaaatttgttgagctttggccagaagctactggtaccactttattttcattctccgtgtgctccatttggtccactttgtcactttcctgtcgaatttcacagaggtccatagacagggaggggactgagtcttactgttgatgaagcaaatgtatgtgcattgttctttgacgatctcatctgcatgtattttgagaaggctgataagatagaattttggcaagaaatcacagaaactggagtcactttgcgtgtctcagaggactactgtagggaagcaagcttctgggggctctttgttcaagtatatgagaagctctaaaaatatttatgcactttggctgaaaattctgttcttacggctttatcttcaggagataatcggataagcactaaatttatgtacagagtatgttcactacagcagtaatttaaataattaacaattggaagcaacccaaatacccagtaataaaggatttagtaaatcagttattgtacttcacaacacaatgagatattagaaagcaattagcgtttataggaatgatccatgacatgaaaaaaatgtacccagtatactggcacctaagtcagtaatgtatgtaaaaatggcctatgtgacataaaatgtaagtggatatatgtttgcatgtgtatgtgtgtgtagaagtacaaccaaaggcttacagcacctgtctctgagagctgaggtcactctgctatttgttttcacacatttctgaattttctaagttttcctaaatgaatgtatatcacttttatgctcataggataaataatatctatttttattgttggagaagaattatgtgaatattaacctgatctttgaaatgcagaagtttttttttaagcataaaagcaatccatacaatcttaaataatagagattttcatagacaaatttctttgactattaacaaatattgttaaaaggctaaaaacaagctgttataaatattttctacaaatactacagatacagatttactacactttcttagcaaaaatgtgatctcatttttgttttaaaaatgtatataggtaaatgtagccgggcacagtggctcacgtctgtaatcccagcactttgggaggccaagtgggggtggatcatgaggtcaggagattgagaccatcctggctaacaacggtgaaacatcgtctctactgaaaatattaaaaaaaaacaaaaattagctgggcgtggtggcgttcacctgtagtcccaagctgcttgggaggctgaggcaggagaatcacttgaacccgggaggtggaggttgcagtgagctgatagcgcaccactgcactccagcctggatgacccagcaagacccgtctcaaaaaaaaaaaatgtatataggtaaatgtaataatgagaaagtactagaagaaaatacactctactgctatcattgtttctatctgggaagtgcaggtgcttttacagatgttttttgcacttttctgttctttccagctttctgcacagagagctggcatgtgtttggcaaccaggggacacataggcatcctagagagtggctctgagcacatggcctgccgtctgcggcctagtggcctgctctcgagggaggctctggggcaggcctctgaagaactaattctccatcagggattggtgatcatatgggcagttgtctagagagtctagcagatatattttaggcaacttcactaccctggtgagaggccagacagacttcctatgtctagttctgataatgagagtgacccattcagaaaagggttaagtaaaaatagtgaattttaaaattttaataagttcatgtactaactgacattgaaacaaaaatcatttcgtaaatcattacaagttgatagtgagtaaagcccatcagtgtaattttgtaagattgaaacatgggtatatgtatctatattgacacatacctgaagtatgatctatcttagatatgaaagtgaaatgaaaagtacacattgtgggcagatactgagtgtctggaaggagggaaggggctgctgtcccagcaagggagcacagcccgcacaacacgcaggttggatgccaggcccggggtcgagctcagggtctgtgggatctgcattccctggccttgtcagtcatgtcatggccatgccacttttgaggtggaggagtaaagaagttcacctgctgactgcttccttctttttccgctgagaccatcaccgagagtggtaattatttataatagaaatggtgattactggtggattctgtgataggaattaagttgaatcttccttgcccgtcctcctccagcataagctgttttaaattctagctcccccacatcctgcttcttgttggcactgtaaaactctcaattcactcacctggagggggtaagttaatgagacactctctcccccagatctggagaaattcagagtcaaggctgtccccctcctgaagtcagatccttcctgtggcctatttaggttttaggtaaaaacatagcatttgctcattttcctttattgagatctgttgaagtctgagctcctattaacacatttatcgaaaatggaacctatgagcaaattcctaggagctgcatttccaggggtgtccagctgtgacccaccccgccccctcccggtgttaccctgagttatgagaatgcagtctttggaagtggtgggctaaaacactccacagggtggtgcatgggggctgcccacactccctgctgctttctgctctctgcttgttcatcctctcccaacggggcagccccagaagccaacactgcatgttggaaggagtcccagccctgcccctgccaagcgaggtggggacagctgggaatctcgctgccttcatggtggcgggccaggctgctctgtaacacgaacattaaaactgatttgaggtgttagcggtgtcactgtaagtgtgagaatgagaagcggtgtgagacgtgtagatttgtgggcagtgatggggaacagcaagggtggggtgcctcggtgggatctgaaagagaacccgcccccctcagctggagtggcactctgtaacccgccccccctcagctggagtggcactctgttggctgttgttttcaggctgttgggccgtgaggctgctctggtctgagaaagtgggtggcaggaggacaggacggcctctctgtgagggaggcactgactctcaggagatgctgtcattgggatactacagtattccatgaacttcctctataacttaaatgatgaaagttacagataatagctcaaataaactgttgtgagccgttaagtatggcagtttgtatcatggttaaatctgcagaaggtgtaacattttgcttgggtttttttttgccttattactggccgtgttttaaaaatatctttcttatgaagaaattctgtcgtggctgtgtgatttcccctgcgatgctaggatgtgtttgcaaaccagtggcaatgccagagcctgggccctgggctgcggtgcgttggctgggtgtggtctgtggtagcttccacctgctgcctgcgcttgggaagtgccctgacctctgagcagatgacctctgagcagatgacctctgagcagatggtttctgatggtggttttttttctgattaattgaattacaagtatcctgtggtaggtacagggttttccctttcccttgtccaataaatcttaacttcattctgtgatttttagaaaaggaagaatgcccacagatgtggaggcacagatgccctgggcctcgcagcaagcttatccttaacaacccattctccttcaggccctgccacttagggagaagactgtgggggcagtgcctgcctgtcctctctccattaagcctctgctgggggcctgcctccacagtgctcttcccggtctcagagtggcaggggacacacaggcagggttcttaccaccatggagcttatttctggtgggtggagggagggcccacaaccaaagaaagtgacttacaaacacagcaggcacatgctacatggagagcagggaggctgagcaggagtggctgaggggctgcctggagggtgggcaagggaggactttcggaggaggaggtgttggaactgggtggcaggggggagccaggcatgtgtctaggcaggaggcgtgcatggagcaaagacctgatggaggaaaggaaggggtggggggcagctggggtgaggaagccagtgcaggagatgaggtcaggagagcaggccccctctaggaggtcaggtgtcaccctcagggcagtggacagcatggccccaggccccactgcagaggctcgccctggctgtcgggaaggcactggggtgcaggtttggtacggaggctgcaggtgcccaggcagtgtggttaggcctgctgagatgtggtgcgtgccgaggctgccaatgggactggaaggaggactcagacctgactccgaggggcctgagcaactcaggcaggatgacgtggggagggtcaggtccaaggtaggaggggttaaggatttggtcttggacttcaggtaacagatgtccaagtggcttggccaggtaggcagtggatatgggagttcatgggggagagcaggggcaaggagattaatttaggaaattatcagcagagaaagagagcatggctatggactgggtgggctcatctaggggagaggagcagaggtccaggcccaacacccaggggcctgtggctggagcccagaagagactggtgtggttggaactccaggtggggcttgctccactctatcctgggtgctcatgccccagatctctgtgtgctcaaggagcgttggcagcatcctgacccgccctgctcacatgccccatccctgctttcccctgtcagtgggttgcaggcccatgatcccgccaggcctgtccatctgtccctgtgtcgcagacagtgccaaccttccctgatgtttgtgtctcccgcctgaggcctgcctgtgtttccagtgtcttccaccacggcattcaggatgtggaggacagtgacccgcgtgtggctcccatggctggcctggctggtctggaaagcatgcgttctgctttcctggccagatcgtcttttcatgtgcttatttgccatctgtatattttctttgaagtacctgatcaaatattttgctcattttaaaaactgggttgtttattttcttattgagctttgagaattttttctgtatatattctggatacagtcttttatggggtatgtgttttgcaaatattttctctcagtctgtagcctgacttttcatttttataacagtgacttgaagatgaaaagttttaaaatttggtaacctccaacatcagttttttcttttgtagttcatgccttttgtatcatgcttaagaattctttgttaaattgaaggtctttaagattttatcttattcattcttctataagctttatagttttgactattacatttaagtctatgatccattttgaattaactctatattggatgcaaagaaaatgtcaaggttcttatttttcttgtttttaaaaatacaatgtccagttgttccagcaccatttcttgaaaagattatctgttcctcattaagttgcctgggaagctttgtcaaaatcacttgttcatatgtgtgtgttttcaggatatctgggatttgttttaatacagtgtgctaagacatgagacatagaaatgactgtcatgaaggaagaaagtgtttgtacccacagctccctggaagcaggagcacggctgccaggcagggccacatgggaagcaccgggtaggtcaagaggcagagagagcaaggggacaatgtgggcagggaaagcctcactgtggtctccacaggaggaatgggtgaggcagggggagcaggcttaggagtggcactttgaatcatttcagcaggcccttgggtgtagggtctgtccctagttgtctggtgcctggccttgggtgattggggcaggtggggagtggccccatgtgagaggaggtggttggggtgtgggctctggattggtgggtttgtatttgaaaggtacactccaggatgggttgtttgctatttctaggaattggctaacgctgggagggcagtccctccaggtcagcaagccctggatgtcaaagcatcagacacagaaaaggaaaaacatggttaatactgtgtgcagactatttctggactgtattctattccatgggtcaatttatttatctttataactagctttataataaatcttgaaatcgggcagtataagccctcccattttgttctctttttcaaagttctttggctggtttatttcctcggtatcttcatacaaattctagaattagattagttcagcttttggttggggttgcactgaattgatagatcacttgtggaggttggtatcttgttaaaggaagtgcttggagggtacggtctaactttgttcctgaatttaggggtaaacattcagttttcacccttgtgtatactgctagctgtatgtttcaactggaggtcctttatcaggttcagaaagagtccttaaattcccaggttgctgaggatttttatcatgagttaatactgaattttgtcaaatgttttctctgtatctattgagatgatcatatggtgtttcttttttgtttatatggtgaattacattgatagctttaaaaaacaatagtaagccagttgcatttctgggttaaaacccactttatctgcatgtatttattttatattgttggatttttatatgctaaaatttaagaattttggcatctatatttctgaggaatattgatgtcttttcttatgtgtatttttctgattttttatcatgttaatgcttgccttatagaatgaattgggaagtattctctcatcttcagttttctagatgagttagtaagaaattgatattatttcttccttgtatattttattttatagaattcacctgcaaagtcatctcggtcagcacttttctttgtgggaaggttttatcttgaatgcagtttctttggtatgtatataggattatttaattctccttaagtgagttttgattatttgattcttgtaagaacttgctccatctaagttagcagatttactgacatgcagtagttcatagcatccgcttattgtatttatttatttattgaggtgaaattcacttaaaatgcaattaaagtgcacttaaaatgcaattaaagtacaccaaattaaagtgtacaatttggtgcattcagaatgttgtacaaccagtacccagtttcaagactttttcaaaacttttttgttaccacgaaggaatacctcccacccattaagtaatcactcctggtctccccctgtccttatgccctggaaaccactaacctgctttttgtctctatggacttgcctgttctagatatttcatctgaagaaataatgcaatatataaccttttacgtctgggttctttcacttagccccgcttggaggttcatctgtaacacgtgctgtacttcattccttttgatgtctgcagaatactccactgatgcctgtaccagatgtgtttatccattcatttgctgatggacatttgggttgtttccccgtgttggctattatgaatagcactgttatgaacaagtatctgcttacatgtgtatttttaattcttttgggtctgtacctaggaggggagttgctgtcctatggtgattctatgtttaactttttgaggaactgccagactgttttccaccctagcagcaccatttttcatttccaccagcgatgtatgaggttgcctgtttctccaggtcctcaccaacacttctgttagacttttttgattatagccattctggtgtgaagtggtatcacattgtggtttgacctaattgtcttcataatatcttttgtgtctgtataatgttctatttctcattcttgatattggtaatttgggccttctaccttttttcttggtcagtgcaactagatatttatcaatattatgtgccttattaaagaaccaactttcggttttattaattttctgtattttttacttctatttatatatttttagagacagaggcttgctctgtaaccttgaacttcttggctcacgtgatcttcctgcctctgcctctcaagtagctaggattacagggatgttccaccatctaccatgcctggttaatgtaaaaaaatttttttgtagagagtaggtcttgctatgttgcccaggctggtctcaaactcctggcttcaagtgatcttcccactttagtctcctgaagcaagtatttttaaaatggcttttcagcttatagatttttattctttatttcctttcttctgcttgttttgctctgttttagtaagcttaggtaatggatttgagaccttttatttccctaatataatcatttagtgctgttgatttccctcttggtactgcttttactgcctcccacatattttgatatgtagtgttttcatttttattcaggtcaaaatgctttcttatttccattgtgttttttctttgacccatatgttatttagacatgtgctgtttattttccaagtatttggaaaacttcccaaatacttttttgttcctgttttctaatttaattgatttctaatttaattccattgtggtcaggaaacattttttttattcctttacagttttattgaaatttaaaaaaaattttcagaatattacctttgaaaatatctcatgaccacttgaaaagaaggcatattctgttataattgtgtggagtgttctataaatgtcagttaaataatgttggatgataatgttatttgagtctcctatatcccgtactgatcttctgtgtaggtttttacaaaatcagttattgaaagagaagtgtagaaagcttccattataattgtggatttatctatttggtggggggttgctttatatatttttaagctctttattaggtgtgtgaacgtttagggttattattttctcttgataaactgaccccttaattattatataatgtccttatttacttgtggtaatattatgtaccctgaaatctactttttctgatattaagatagtcactccaccttttttttattagagttaacatgtcacattttttcccatcctttttcttttaacctctgtgtatgtttatatttaaagtgggtttcttacaaatagcttatagcgtggtcttgtttttttatcaagtcttaaaaggtacattttaattgggatgttgagaccattcatatttaatgtgattattgatatggttgggtataaatctgtcattttgctgttggatttctatttttcccacttgttattagagtccccttttttctctcattctcctttattttggattgagtactttctatgatcagttttattacctttactagctttgttgcccacacaatgggtgggttcaattgcttggccaccaatagtacaatgagctcaaccaaggaggatttaacaagggaatctaaaattgcagcaagtaaggaggacaccagggataaatctccaaagcaacgcctccctgaacaacgctgaaaacaccgtttttaggctcgttagctgaatcattgtgtgtagaaggtacagtcaaggcagcacaggcacagttgtcagtcatgcttctacatacatcacaggtatacaagatggcaaataagctcttctctgggcggagtttttagtgtggtaatgaggagagtttgccaaagttcatctccaactgaggcctctctggatctaactggcttttgtttcaccagcactgggcttcttcctggaacttttcttaaacaacaactcaagatgcaacagttaaagtggatactttttacagtatatgcctgaaaacctgaggacattgggttgcagcttattagctttatctctgtgttttcagaggttgctttaggatttgttgtatatttccttaagctaccatagtcatctgcaagtaatatcataccagttcacatataatgtaagaacattaccaaagtataccctctcacttctggctattacattatgcccttatctcctcacttcgatattgtcataagccccacaatgcattgccttttttttttcttttgctttacatagtctattatctttgaaagcaatcttaaaaaattaagaacaaaaggcttttatattttacatattttctgtttcaatggttttcacttctttttgtagatccagatttccttctggtattattttccttttgtgttttgtacttcttttaatattatttgcagttcaggtatgttggataatgaattattttagcttttgtttgttagaaaaaatcttctttttacttttatatttgaaagttatttttactatgtatagtattccaggttggtagccttttctttcattactttagagatagaattcaattggctcctgacttgcactgtttctgaaaagttctctgttcaccctgtctgtgcttgtctctttgtacatagtttcctattttaaaaaattaattatattgtgtatatctaaggtacacaatataatgttataaaatacagataataaaaaggttcctgtagtgaagcaaattaacatacccatcatctcacataggtacccagttttgatttgttttgtttttctgtggcaagagcagcaaatgagtagattttagctgctcttgccataatgtttcttttttactggctgcctttacgattttttttttttttacataatttgattatgacgtgccttggtttagtttaatgttatttatttatttatttatttgtggttggggattgttgacctttctgaatctatgtatgggcttaaattttcatccatttttgaaaactttttgtaattttttttgtctgttttagagacaaggcctcgttctgtcacccaggctggagtgcagtgatgcaatcacagttcagagtagacttgaattcctgggctcaggtaatcctccaacctcagcctcctgagtagctggactacaggtgtgtgccaccatgcctggctgattttaaaaatgtttttgtatagatggagtctcactgtgttgtccaggctggtctcaaactcctgggctctcagagtgctgggattacaggcttgagccactctgccctgccttttgtcattattttttaaaatatgtttttggcttgtcccatcccctgcttctgggtctccaattacacatatatttttgtcttttgggagtagagaatctttatctgtgttttattttaggtagtttctgtctgcacagattattctgtctgtacattgactgatcttttcttttgtggtctaatatggtgttaatcccagtcagtatatttttttaaatctcagatgtatttttcatctctgcatgcttgatttgtgtgttttaaaaatacttttcttgtctctccttagcattttatgctttcctgtatcatcttctacatatacaatgtatttatgatagatgttttatttatttatgtatttattttttgagatggattcgctctgtcgcccaggctggagtgcagtggtgccatctcggctcactgcaagctccacctcctgggttcacgccattctcctgcctcagcctcccaagtagctgggactacaggcgcccgccatcatgcctggctaatttttttgtgtgtatttttggtacagacggggtttcactgtgttagccaggatggtctcgatctcctgacctcatgatctgcccgcctcggcctcccaaagtgctgggattacaggcatgagccaccgtgcctggcctatttatttatttatgtatttatttattcaaatggagtctagctctgtcacccaggctgcagtgcagtggtgcgatcttggctcactgaagcctctacttcctgggtttaagcaattctcctgcttcagcctcccaagtagttgggattacaggtgcccaccaccacgcctggttaatttttgtatttttaatagagatgggatttcatcatgttgctcaggctggtcttgaactcctgacctcgagtgatctgcctgcctctgcctcctaaagtgtataatagctgttttaatgtctttgtgtactaatgatctctgtgtgtataatttctgagtttgtatcttactgatcaaccaatctcattatgagatatatttttgtgcttctttgcatgcctcgtcagttttggacggatgaaagacatcgtaaactttgtattgttggactctgcattcttttaaaatattttgaactatgttttggaatgcatttaagttacttggaaagttcagattttttggcagcttgttgctgactttgttaagcattgcctagtgtagtaccccagcttagtctgctgccagtgcagtcatttgagtgctcagtgtggtgtcccctgtactgcaaggctcctgcagcctagttgttgggagtaggaactcttcccagatctgtgtgagccatagctattgtctgtactttttcttttcattggttcttcccccgacctcctgtagtccactcactcacatgtgcccatccatgtccaggcagagactagagaatccaccacagacctctgggatgtttctctgtgcagggcattcctttctggtactctgccctctaattctagcttttgcctcctgtgctgtggggtcctgagtgcagtgcatcctgatgagacggtgctgcaggcccagcccaccgacttccagagatgtcagttgcatctctcccctttcctctctgcctttgcctccctgaattctcaactccgtttccaactcccctggccttgcctgggttcccccttcctgtgctgtggcccaggcactctccccaggctgtaggctgcagcaattgtaggatgcaacccatttgcttcccttctctggggatcgttgtcctgtgctgcctgctgctccatgtctgaacaccctcgtctcatatcttttgtctgacttttaagtgaggtgggagagtcatcccagtctcactctttctctgtcacagctgaccatggtccaggctttcttatgtttctgtagtctttggacatcactggacagaggccggctgtctgtctgtaggagtctctgcgcggtgttcacctgctaattcagtctgcacagggagaacccttggcctgtggtccaggtgaaggcccttcagggtggagccgagactgtgggtgttctgggctgtcccgtcccgtatactctccctgtgttcttaccttcccctatagattcagagggatttgagaatcagctgtgccccagacgtcagtcaggccgaggactgtgggtcaaggttcagggaccctggggttctgagtctttatcagtgtcgtgtatgttccagactcagtttagaattgaatcactttttatggaattctttctctgggaaactgtctttgaccttcccaataactgatttataaacatgtctttttaatagatgactttggtttgataaaatttggtatctaaggtgatagattgtgatttctgtctctctttggaaagcctatgatttccaattttaattgttttttccttcaactgtttacaggactgtctacaagagagaagctccccacgtggttccgtgtaagtagtgcttcttatgatgctgtcacaggcgatatttttagactaaacgactctttcggtgtcagcagagttgaaagtcttgctctcaagggaagctgtgtgtctctgctgaccctctggatcctggttttatgtctcatggggaacctgcctcaggtcacactactgccaagagcatgtagtgtgagtgacacgcgttttcccttcttgcttctgtggaaccaaaattttaaaagaggcagtttcctccctctctggtaacctttctccacagttaacctgaccatgtagaccagcaggagctggagggccagttgttagtgcacttggagcctactgcacgagcctaccgcacaagcctaccgcacgcctttgttcttgtgccaacagtgcccactgcccggtagtgcctgtgtgtgcggtggccatgatggcaccacaatgtctgaagccacacagtgcatgggtgacatctgtggaaaggacctggcaccggccagcacacagaggcactcacctgtctcacacaatgcactgtggtcccaattctagttttgtaaaactaccttgagatgactccttttaaaattatccttaagatgtctttctttttctaaagcttattaaaggtcattttcaaaacgttttcagcaggaacttggtgtatatttgcagttctgcatggaaaactaatggagtcatgatggctgctgatgctgatgaagtagtaccagccagcctgatttcataacttccatagaatcactcccttcttcctcccagtgcccctttgagatagggattgttattccctgaggcttggcgaggtgaagtaactcactcaggttatcttggtgccagtggtggggctgggatttgagccaagtcttccaacttcacaatagcagagtaagaagagctgccttgttgatgggacgtgggtcggagctcccagtgtgtcttgccttcctggtgtgcttgatggcagccctgggctgctgtgaggtcctgagcacagtgcatcctgaggagacagtgctgcgggccccgcctactaacttccagagatgtcagctgcagcagggcagcgccctggttagagagacggcatggggagttggcagggggaggccctcggagagatggcatggggagttggcagggggaggctctcggagagatggcatggaggggttggggcctgtgctcctaggtgcttaggcttgcaggtgactggaatcctgactaatatcataagaggagagttcttactaacaaattacttgaacaaagactttgtttgttccttcattcgttcagcacatgtttacagtgtgcctgtgatgtcccaggcgcactgccagaatcctgacatccttgtggggggatcgaaaacataaatctagtcagtgagttcatcctgtggcatgtcagggggtgacagtggctgtggaggaaacagggaagggcagggtgtgggagtcctggtgctgtgtgaataggccgtcaggtcagccctgagacacggggcatctgcgcgagtcttgctggaggtgcacgtgtgagccccttggtgcaggaggtgaggagctgcagggccaagggggtttggagcagaagctcgggtctgacatgcctggtgcatccatggggcagtgaggaggctgcggggcaggaggtgagagtgccgcgggttaggaggtgagggtgcagctggggcacatcaggggtctcacaggtcatcccgaggctgctctcagtccacgtggcgtcggggctgagaggagcccacagcagggtgggtgtgggagcagggagccagccagtctcttctctgtgctaggttattgttgtggctttagctaaagctgctgtaatacctgtttcttagaggaatccaaatccctgttgccttggggccaactttgtaatcttacaaatctggatctaattttcaccaaactctcaagggaagagcctctgggactcagacagataaacaacacctgttatgtgctgttcccattttctcttcgactttggtgttgtccaaattcttctgagcctaactgtaggctcttcagacccagcctacagttctggaaataaaccagcgtgctggggtggggcgagcccgaccatgcaagccatgccccggcagccaggctgagaggcagagcaagcagtgcaggtggacccatcgcctgccagcatgtgggttctggaggctgcagcaggcagattctggaaattccctgaggccttcgttcagtacagacagggaacttttataggtacctgtggcctcttctgctggtgggaatggaggtgccatgagcactgagctggttggaacagaagggctctcctctcgtgggctgtgtcgagtgagtcctgcagcttctcgctgtgagattctggggtgccatgatgaagcagagcggagctcatctgagtggatgtttcccaggggagccagtagttttggaagcacttggtttttccattcccatgtcttggaggactcttcccccttcctgagagagagcgatgaatgtaggcctccatggagaagcacaggtgccttccctgggctgtgtgtggtccgtgcagacctctcaggtccacttcattttgcaggtaaggacccatctcccatagctggttagtgccagagcccactcctagccccatgtaggggctgtttttcagctacagcaagatcaggaaataagaagtagtaatgaatacttcattgaagatttttatttactttgaggtcttttatttcttgtaatactgaattggttatttgcttcttagagtttttttttttttttttgagacagtctagctctgtcgcccaggctggagtgcagtggtgccatcttggctcacttcaagctccgcctcccgggttcacgccattctcctacctcagcctcctgagtagctgggactacagacgcccgccaccacgcccagctaattttttgtattcttagtagagacggggtttcaccgtgttcgccaggatggtctcgatctcctgacctcgtgatccacacgcctcggcctcccaaagtgctgggattccagtcgtgagccactgcgcctggcctagagttttttgctttccgtaagataacaattttccttatagaactgaaaaatatgaaaaacaatttaaaaattcacctatgcttagccttagtgcagagagcagctgaagggtatcaggggattgtcctcaccccttcctgtccatggccccctgggtagcccccccatcttcatcagcccaccccttcctgtccattgtcttctgcgtggcccctcccatcttcatcagcccaccccttcttgtccatggtcctctgggtggctcccccatcttcatcagcccaccccttcctgtccacggtcctctgggtagcccccctatcttcatcagcccaccccttcctgtccacgatcctctgggtggcccccccatcttcatcagcccaccccttcctgtccacggtcctctgggtagcccccccatcttcagcccaccccttcctgtccacggtcctctgggtggccccaccatcttcatcagcccaccccttcctgtccacggtcctctgggtagccccccatcttcatcagcccaccccttcctgtccgcggtcctctgggtggcccccccatcttcatcagcccaccccttcctgtccattgtcctctgggtggccctcccccatcttcatcagcccaccccttcctgcccattgtcctctgggtggcaccccccatcttcatcagcccaccccttcctgtccatggccccctggatggcccccccatcttcatcagcccaccccttcctgtgcattgtcctctgggtggcccctcccatcttcaacagcccaccccttcctgtccacggtcctctgggtagcccccccatcttcatcagcccaccacttcctgtttgtccatggccccctggatggcccccccatcttcatcagcccaccacttcctgtttgtccatggcctcctgggtggccccccgatcttcagcccaccccttcccgtccatggtcttctgggtggcccctcccttcttcatcagcccatccttcctgtccattgtcctctgggtgcccccccccatcttcatcagcccaccccttcctgtccattgtcctctgggtggcccctcccatcttcatcagcccaccccttcctatccattgtcctctgggtggcccccccatcttcatcagcccacccttcctgtccattgtgctctgggtggaccccccatcttcatcagcccaccccttcctgcccatggccctctgggtggcctccccatcttcatcagcccacagcacctggtgctgcattgtagtcactgtcacacacactctcttcgctttgcctctgtgtcctcccagtgtccatgtggtagaacaagatcacagcattgatggagaccacatagctgtgcagactagtctcgtctaatttcacagccaagggcttggatccaccctcacttgcctagtcccagcagcacccccttgaagaattgcttttgcctgagtccattctgttctgtctgcttccccttcctcagatctctgatctaatcagatgtgagtctcagctggcgtctatgcctcagagttaaggagaagagagttgcttctctgccccatcctccgacccaaggggctaagtcgcgtttcctcccttggcctttcctgcccctcaagtgcaaggagccctcgctgttagctcaggacaagcccaccctcttgtttcctcagggacttgccccgctgtgtggtctgtggtgccatctctctgcgtgcccgcctcactggcaggtcacttctgttagcatccgggatgacttagtagctcccatgttaaaattaaaaaaaattattcccttgatccttgattttcagccagattggcaaattgatttcacagtgacctctgcttcctcttaaaagcccactaaaatgacaggcaagatgtttttaaagggcaaaagtcaccaagaaattgagaaagaagatgacagaactttgaaagttggaaggcaaatggtcagagcagatctgaacctagaaagctgagaggtgcgtgtgtgtgtgcatgtgagtgtgtgtgtggtgtgtgtagtgtgtgtgtgtgtgtgaagtgtgtgtgcatgtgtatttacccacacaggtctgtgtgtacacatgcgtgtgtgtatgtgtgtgcaggtgagtgtgtatataggtgtgcacgcatgcgtgtgtgtgtggaaggtgtgtgcatgtgtgtgtggtatgtgtgcatctgttatatgtgtgtgtgttgaggggactgagaagtgagtttcttgtgttgcagacagtgcccccacgtcttgggaatggcgttactgtgcagctgaacatggggaggcagtagagatacggttgacataggaaagctgtggaaagcttgtctgagaaggagtcagcctctcagccctctcctacccagtctggttcctccctggaaggtgacttgggagcctgccctgcggtgggggactgtcctaaacggaaagcagggcacgggatggcttcactccagctcctccttatttggccccagagcactgggaacctaggaacagacacaggagggagggaaaggagccacttggtgggtgaggaagctggacgctggggccctggggcgtggctccaagaagggctggagggtgatgtcgggatgagtgggtctgcagtggtcggccccatggctaggagtttggaaagaaatcaacctaagttcatagaacaccaaagaaagcagtggggaggcccttattcactgtgagaagcagaaacattgtgcaagaagggagctgcagcatcaggtgtgggtaccaggtgcacagccagcgaggggagtcctggaaagtggggaggagggcgaggtaggggctcaggagagtcagtgctcatcttttatagcaggaagctaacagctgatacataaagttgtaagatcaagaatagcaatacaaactcagtaattagaaatatggagataaagaaatgccaaaagaggctaagagctcagggaaggattgtgatgtagggggcaagggaggggtagggccactgcttttcataagctttatcgaattatttgcttttaaaaactgtgtatatttatagttttattaaaaataaaaaattttaaaggttatatggcaaatattattttataaaaaattgatgaacctcaggccctgagctcccttgcttgccctgctcctgccagggcagacttccactgcccttgccctctggtcctctccacttcagaggcccggcctctggcttggtgaatctgaggcagatctttctcctcaggttgcttgagctctgcagcgttaggcctggtgagcgcctcttgcccagtgccctgggggcggtggggaaattccagtccagactgtctgcctcaggcattcagtacacactttcgtgccctgctttttaactgaatagtattctgcaaagtgttcgaccttacctagtttgagaacattatttttagaaggttgcatggtttcccatgttgtggatctaggtatcatttattggattattccctttttgtttattttttctgattttccactaatatccataatacgaggtaaacacccttgtgcataaatccacagcagcttcctctcttttgtaggcagtgttcacacctacagaattcctgggtcagaggacatggacatttaaaagaggcataatgtgtaattgccaggttgatctcaaaagtgcaagtttgtacttgaacaaggctgtaccagagtgcctgtgctgttgtatcctgacacaccaggtactgcatacgtctccatctcgaaatgcagaagcacactgaacacacatggcttagctctttaacaataatgtcgttttcccccatgctcataagcattcttgcattattgaagatactctgcttttatgtctgtgggaggaattttccccagttgagtcgtgcactttttcatctgatctgtagcattttgggtagctcgctcagtattttccgttgtgatgtcgtctcttattgtgtttacatttagaaaatccttttcttgggatttaattaggtgtatgttcttaggtgaagatctaagttattttttcttatattagaaacaccatttattcaaaatacttcatttttctaatgattcatgctgcaactttttatgtatgtgtaccacatatgaaaatattgtgtattttagtgtctgtttctgaattctctaattgacctctttgttctagtgctggtacactgttttaattattttagtttcacgatatatttccatatctgataaaggtaaccaatatttcaaaaaatattttggttattcttggctacctactttctaaatgaactttagaatgattttcaagtttaaaaagttaatcatattgaggtttcttttcaaatggatcagatctataatttaaattataaacagctgacattttaacaatatttaaatagtttcctatatagaaagggaatctgtctttccatttattctgttattagccttcagttacatttcatagctttcttgctgtaggttttatctttcaaatttttttccaactaatttgtgttatttggttattgtaattgggatttttcccattgcatttatcaaatatttaacattatataggaaaactatcagtttttatatatttgaatgtggtcacatgttaaaatggttttatttgcaaaagggttttcaggtgaaatttgacttatttttaccttgacccaacattcaccatgaagtatgctccctgtagctctctggtatatattcttcattaagctacagaagttttcttttattgctatttattaagttacgtgttttttaaaatcaaaaaagttgcatttcactaaatgtgttcattgctactatttaggtggttgtatgattcctgcttttgtctctcaatggagtgaattctgttcctgacattccaagtgttgattcttggaataaaccccgttaggccatagctcttccaattataatatgctcccagtatcttattgggactagaataagggttaataatagggttagggctagagttaaggctagcataagggttggagttaccgttagtgttcgagttattgtaaaggttaggattagggttactgttagggttatcgtgagggttatggctagggtgatagtgctctataaggttcttttttttctaatttttatatgattttggcaataaatgatagcttgctttcataacatgatttgagaattgtcccatgtttttctatcctttaaataacaaatttttctgtcttctgtttagaaatgcaaatgttatcagccttcgatagaattctacctttaatagaattcgtctatcaaagctgctaagcctggagcctattttggagactgattttttagtgtctatataatttctaccatggttattgattttatacacattttcttatacaccaatggttttttgcttaggaaacagtcagttttaagcaagtttttaggtatataggtaaaaatgtgtatatgttttatatatatatatacatatgtatgtatataacatatatatgttgtgctcgtcatttttcagtctttaaaaatttttaacttaatttaatttttctttttattatttttttagagacagagccacactctgttggatgttgatcccagctcaccgcagccttgaactcctgggctcaagcgatccttccacctcagtctcccacgtagctgggactacaggcatgtgccaacgcatccagctaatttttaaaatttttttaggcactggggtcttgcttagatgctcaggctagtctcaaactccttggcctcaagtgatcttcctgccacgtcctctcaaagtgctaggattacaggtgtaggccaccatgccgggcctagtttttcagtcattttatctgttactgtgttccctttatttctagtacttacttcagcattttagtcacatttgtctaattttttctccaaaatagctttcatttatattgatcatttataattttactattaatttctcattttagcatacattataattataattctctttttcttcaagttaatgctattattttaatagtttcctgagtgcttctttgaacattttcatttattttctgactaatgcatttgactctcagtcttctaagacacttttaactctgttctactggctttatatgtactgacctgttgtccctcatgtttttattatttaatttaaaagattaatttcttggtagtcctgtctaggaggactattcttttgttgttaagtttctactttttaagtatcatgtttgccctgtgtgggtcagagagggactgggccctttgtgactgtgggtgttttgtaggagatggctgtggggcttggggatggaagagtggcacccactgtaggcatgtcacaggctgtcacggagcagcagggtacagtgtgagcagtggagaaggtgcccagagggaccccatggggttgtatgctgcctgtggtcctgggagatggagtgatcgctctggaagaaaaacattctggagtttgtggggagcagacagacttctgtgtgagacccataggagacatgccatggaggcttttggaatcctggctcacagctgaggggacggtgtggggcatacagagagccacgtgccaagaggaagagttgaacccaggggaaagggtaagctgtggaaatacagagcttcccagacccaccagctttatttaataaggtcagatgctctcgttgacatcagcgttcctggatgggagggctgggctctgtgaggccctccccggcctggactctgggtggcctgccattctcgatgtgtggtttctgtctcttgctatgttgtcatgactgcagagttggaaggaacccagatgcacctcgtgtgttctagcctgtggatgcaacaggggacaacttcattttaagaactggaggcccaagttatgctgacgtgtatcatggtatctgagaccaggtgtgtctaacatgtgccaggtgaccctctctgcagaggagctgggcaatgcattctcccgctgggcagccttgggctcagccaaagctctgtcttcacggagaaagggaggaagggacaggggaagagcttctgcctccataggcgaggatgaggacataggaggcactgaatagtggccaggagaggagtgagtgaggacctgggggtcacccacacttcagagtgaggcgcacttgcaagagtgttggcatcgtgtgaaggcagacagcgccacacggtgttgtgtcagcatcgctgtgtcagtccattgacgtagcgccacacggtgttgtgtcagcatcgctgtgtcagtccattgacgtagcgcacacggtgttgtgtcagcatcgctgtcagtccattgacgtagcacacacggtgttgtgtcagcatcgccgtgtcagtccactgacgtagcgcacacggtgttgtcagcatcgctgtgtcagtccactgacgtagcgcacacggtgttgtgtcagcatcgctgtcagtccattgacgtagcgccacacggtgttgtcagcatcaccgtgtcagtccattgacgtagcgcacacggtgttgtcagcatcgccgtgtcagtccattgacgtagcgcacacggtgttgtcagcatcgccgtgtcagtccattgacgtagcgcacacggtgttgtcagcatcgccgtgtcagtccattgacgtagcgcacacggtgttgtcagcatcgccgtgtcagtccattgacgtagcgcacacggtggtgtcagcatcgccgtgtcagtccattgacgtagcgcacacggtggtgtcagcatcgccgtgtcagtccattgacgtagcgcacacggtggtgtcagcatcgccgtgtcagtccattgacgtagcgcacacggtggtgtcagcatcgccgtgtcagtccattgacgtagcgcacacggtggtgtcagcatcgccgtgtcagtccattgacgtagcgcacacggtggtgtcagcatcgccgtgtcagtccactgacgtagcgccacatggtggtgtcagcatcgccgtgtcagtccactgacgtagcgcacacggtgttgtgtcagcatcgccgtgtcagtccactgacgtagcgcacacggtgttgtgtcagcatcgccgtgtcagtccactgacgtagcgcacacggtgttgtgtcagcatcgccgtgtcagtccactgacgtagcgcacacggtgttgtgtcagcatcgccgtgtcagtccactgacgtagcgcacacggtgttgtgtcagcatcgccgtgtcagtccattgacgtagcgcacacggtgttgtcagcatcgctgtgtcagtccattgacgtagcgcacacggtgttgtcagcatcgctgtgtcagtccattttcatactgttatgaagagatacccgagactgggtaatttataaagaaaaagaggtttaggggactcagttccacatggctggggaggcctcacaatcatggccaaagacaaaggaggatcaaaggtgcatcttacatggtggcaggcaagagagcatgtgcgagggaactgcctttttataaaaccatcagtctggtgagatttattcactaccatgagaacatgagaaaaacccacccccatgattcaattacctcccactgggtacctcccacgacacgtggggattatgggagctacaattcaaaatgagatttgggtgcagacacaggcaagccatatcaattgcaaagcccaccgggcatccttgttctgagaggagcaccaggccgcggggtgagctctgggcctgctgagcctcctggactctggccagcacaagccctaacatccataggtgctgctgcagtgacagtggggcggttccagcccctcccagccaagacccagggcctgcggggatgggcagcactatttcactgtggaaatgcgggccccagaaccaggagggccagggaagacctggaggtcttggccggctggggcagggcgttttcacatgctctcagtcacagaggctgcggtcttgcccttaccccgctcctcgccagccagcagaagctctgcagcctcatcgaatctcaggttctttatttggaaatggtgcagcacacctctcgagggaggacagactgccatgggcccagcggaggtctcatggcactggtgtccttctttcctccctcctctgagttttctccttggctaggtagcgttccttctggaccttctctgctttgcttttttccctctcaccgggatttggagagtgctgccctcccggaggttgagatcagattgcagcctggcacggagggatgatcatttttcgtgatgactcatccctcctccgtgccgtgctgccaggctgtctggcggccctgcgtgcagagacagtgatagatctggagagctgttgctgctggtccgtggtgactggggatggcatgtcaggtggagaagaatttcctctgtgtgcgcatttagacaggtgggagtcagcatttctgtgtgcttttattttacaaatgcaccatccattcattggagatgcagtctatctactcttgctcgtcagcgtgcatggtgagctgcgtccatcccagtctcctgctccacccaggcctctgtcgtcttcctctggatctgcagggacacttgacagcttacttcattctgtgtagggttcatgcctttgcgccataggccctgtgtgaatggtgtcacagaggccaccctgtctttggcgatgaagggcagtcagtgatagactccgggagcactgagctaggctgaggcttttggtgtgggtgtgagctttgctccaagtgctctggccattttgctcttctgaggtacaggctgacagccctgcagctttgttcaccctggtagtgagtaaatgggtttgactttacccacctgtttcccagcctctgcccttgcagcaaacccaagataggactcctctgaacacggctgcatccacatgtaccttctttgctgagcttgtgcctctggccacatccagcagggctggttgcagttgggggcaggtgttaggagcacagcggtgagctgttgtcatcgttcccttgtgttaagctggcagagtctgagcacaagtcacgggaagagaagtgtccggtaggaacccagctgggctggtggagcaggactagctgagaatccagagactgtgttctgcttcctgcttctctcccagatcaccacgtgacctcggctaggttccttccctctctgtgctgcttttccatctgtgagactgggtctcctgacctgttcctgccctgacccttgggggaaggttgcttcagcttttacaaagagggcaagaaccaccagtgtctttctaggaacaaacatatgacctatgagaagatggtttccataatcattattatgttccctgcaaaagttcctcacttaattcctgtaattctccaaggtctttgattaaccctttttatcagtaaagaaacagagactaaagatgagccagcattggagcagaatccagcccatagttgcccgttttcagaaccttctctccttcactttattgctattagattgtaagaagttcagatctcaagtactcatggtcaaattaccatccagagtcacggatgttttacacgttcaccagcatttcatgagagtgtctgtgtgagcgcccttcagtcacactgcgtcttttctttgttccagcttcagaagggaggaaaacacagaagacgagggctgaaagatggcattggacttggcacagggatggtcaggaggtcctgagtcactttgagaaggtacaaaggaagccagattgagccagcttgaagagtcagggagagggaggggtggagatggctgtggaaaatgtttgactctgaaaacttggggtctagaagggaggtgtttgggttgcatctttagtatgagctacttggttatatttaaagcctgaaaatgagttagtagagaaactttgaaaattaagagacagagagcacgtggatgctgctagacattggtccctgaggagtcaagagggtgattcagaggatggagaggtgctgtttcctgggaatgggggtgtcctctcatcaccacagcaccattgtcagcttacaaaacccgtctagatgctgcaccccagtatttccagtccccccagtaatgtcttttatattattttccctccagcacaggatgtggtctgggatcaggtgttgcatctgcttgttgtgtgtctgtcatctctgtcaatcaggaacattttccacagcctttctgtcactttcatgacattgatgttttgaagaacagtctcttttaataagtagatgtttccccctttggggcgtgtccagggactcctgtgataggattcactcgggcactcttggctggcgcctgcctgcgtgggattgtgcttcctcagggcctcacctcgccaggtgcggagcaacgctctgcccccacgttgggatgtgaggttgccgactcagtgcagagctgtttggcttctcccgactttggttaccactcacgactaataaaccatctgcaagaagcccctggaagaccatgcggaaatcctgcatcttgtgacgtttccccaggacttagccgtggttggtttctgccttgacccgtctttactgtgatggctgtaagtggtgcttgtgcagctcccatgcagacttggccacctgctgggagcagaccccccccccccccccttcttcctggactcctgtgtcttcattcaccgctgtcctagtgtctaattcatcactgtcctcgaggattttgtgctcaaattctcctagatttgatcagtgggagcccaccaggccaattcccagctccttccctctttcgttcccacctccttccctctttcgttccccaccttcctttctcttcctgctaccctctgcctcatttaaagaaacagtttcctaacttttccatataatgtttcacacccatcttgtacctaacctacccagccctggagtccaccagatgtttgaagggctctagtttttgtagtgtgaaaatgttaccaaggaacaatatctgggtacaaggtaggcttattgctgtcgagtgtctttgcttctaaccctgttaggggtcagagctgggaaatacgtgcatgtacacatacacacctctgtgtaagcatacatacatgtaagtgtgtgtgtgtgtgtgtgtgtatatatatatatgcacatatacatgcatatatgtgcgtgtataaaacagacaagtcccacaatgtcctttctcttcctgttatccccaccccttgtacatgacagtgatgttctaaggtggtctctcaccagctcctggagccacttctgcacatctcttcccagctctgtgtttagtgacatcatgcggtaggttggaagtcgcccacggtgggagggtttgcacatggaaggaaactggcaaacactacaggccgggtcctccctcccacctcaggagctgtttgttaaacgtttgctggcatacctctaggcaaacacatttttacaattagccttccatatgtatgttttctgtttctcttcttttttctttctcacctaaaatatactaatgtatcttgctacatatgttctctttttactatttttattgtaaacatatataacattacatttgctatttaagctgtttttaagcgtataattcagtggcatttattacattcacagtgccgtgccaccatctacatctccctttttgtactttgtgttttctattaaacagcatccctggagtcgctctgtaccagggtggagtgatcgtcctcattcttccttttgcttcctctgctgcccagtgctgcgtcctcgtctgggtttcatgatggtgggatgatgacgtagtttacgatattttgcagttacacccagtgcagtggtgaatagccttgtgcacttgtgtttgtgtgtgactgtatctcccggaaaggccttagcggggtgattgctgggttcagtggcagtgctcagtgctcctccttcagttagacagttgcaaatcaccttcaaggggtggccaccgccctccatgaccaccacagccacaccatggggtctgttcttcagctcatgactttttgctaaagtgatgcctgaacagcgtagctcagcgtggttttaatttgcatttctcttcttgtgagtgaagtagagcaccttttcatatgtttaaggacattttttatgtctcttttcatgtattttgtacatttttctatagggtttttggtcttttttgtcccctcaatttaaacatttatttatttattggtatcttagagatattatttcttttcctgtggaatatgctgcaaatattttcttccatttagtatttctgtcatattttctcatgtcattttgctatgccaaagattttttatttttatagtcaaatttatcttttatctagatttttaattcacaattagaaagcctttttctacacccagattaaagaggaaattactcatgttttattctagtacttgtgtagtttaattttttattagtttattttaatgaatttttcaattgttgatttttttctatgggatgtttatttttctatttcattaatctaagtttttatttcttccttttttttccagtttatgtttctgttctttttcaaatttatattggatgtttgctcattgatattcagctttttaaaaatatagatcagcgtttaaagttgtacatttccctcaaagtacagcttgttgcagtgcatagatttagatatatagtacttttattatccttaacttataaatgttgtcttgtttctactgtgactccttttttggcttatgagttatttagaagtatttctcaattccaaatacacagagctttaaaaatcatgtaaaaatatacatttatatttatatatacataattttaagtattttagtttctaagttcactgcattgtggaccaggtgatctctgtgtttgcagtcaaagggcggctcacacatggtcaagtattataaatgtcctgtgtatctgacaatggaatctattctacaattttgagtatacgctttctgtatatggccattaagtgaagcttaataatcttgtcttttctgtcctcatagatatttttatctgtggcatcctcctgtagtctcagcattttgggaggctgaagatgagagggttgcttgaggccaggagttcaagacaaacctaggcaacatagcaaccctgtctctccaaaaaaaaaaaaaaaaaaaaaaattagctgagcatggtggtgtgcacctgtagtcctagctactcaagaggatccttgagcccaggaggttgaggctgtagtgaattatgattgtaccactgcatgacagcctgggtgacagagcaagaccccgtctccaaaaaaaaaaaaaaaaaaaaaaaaaaaaagatgtttctccaactgatacatcagtcactatgacagttgtgttcaaatatgctggtatgattggattaatagatttgcctattttcttatatttctgttcatttctgctcttaggtctacgtaagtttagaattattatggtatcttgctaataaattgaaccttttaatctttatgtaatgtagtctatcctgataatgctttttgctttaaagcaaattttgtctgatgtatttatctagtatatatttttctttcccctttttcagtatctctgtatccgagtgttttagtgaatcttttaaaatgggatgtaatggatttttgttttatcctccctgacaatctttgccttttaaagactagaacatttactttactttcatttattttaattacttataatttggactccattctaccatcttattttggactttctatttagctcaactttcttattttttcttccttcccttcttttgattgacagatgactgttttactcattagttttctccttcactatgtaatttcggtttctcttatttttgtgtttgtcttatatgtatgcttaatttatcaaggtccagaattaattagtactctgtccacattccagagaatgaaggagtctcacagtgctcacctctgattattctctcctgacttgaatggcattttcattctcaactgttgtatttttaatattgtgcagctttctccatcattttatacactggtgcctgtttagatttactcatatctcaccacattcattactatttgtttccacttttaccacagataatgcctcttctaaaatgcatcgtggtgagaatgtgggtaaaaaactatttttaactgaaactttctaccttctttttttcaaaacctgtattttatttttaatttttaataggtaaaatgtattttacttattaggtcattctgaaattgttttacccaagactgctttccaaaattaaattttaatggaaaaatattggcatgtggcatagaaaaagctcggactacaagtttaggagtagtgatgagtctttgttcaacctgtatataatattataatgaaaatagttatgataagaatagttcaagtacccagtaaaaaaattaatgctgaaaaaacaagaaaacttttaaattatgtcctggaaatctaaggtattgacgtatttgttgtatctttgccagtacagtttttttgattttggtgattaatctcagcgtctcgtttcttttgcttcggttgtttaaattaggcctgctaacctacccaaatctgctggtgtgtctatttgtgactaccagaaattatctcaggttttcagcagcatttaaaaaatattccctgttgatatagctagaaaacagctagaaaatattcgtgagttttaaatttagcatgacaccttgtatcttctcacagccacataaagacttaaatgctaattgcctgtgtatcccacattagagtttagtagagaggttgaaaatctagtaacagagaagctaatactagctcctgctcctctgggttgaaattctgggtagaagattattttcttagagcatggaagagattttattctactgtctttggcttccattgctattgagaagccatctttcaatttaaataatactcagttcaaggaatttctattaaaattttggttacttttaagattttccctatgtctttggtgttttacaattttactatgatgtatttaggtgtagatttcttgtatttatcttgcttgggattgttcttggtatcttttttaacatcaagtatattgagatataatttatatagtataaaattcacccttttaaggatacagttttatgagtttcaacaaatttatgcagatattagctatcaacacaatcatattataaatagaatattttcaccagctcaaagttccctcatgacccttctgaagcccctgacaatcgctgatctgtttaactgcagctctgcctttctcagaatgtggaatcatgcagcatgtgacattttgactctgctttatcccttgcccatgatacttctgagatgcattcatattgttgctgaataatttttgataaatatgccacaatttgtacatccattcacctattgatagaaatttggagatttacagttttagagattatgaataaatctgctataaactttcttgtaccggtctttatgtggatgtatgttttcatttttcataggtaaatacctaggagtgggcttttctagatcacatggtaagtgtgtgtttaattttgtaagaaactcccaaggaacgcattgtcccaagttgctgcaccagtcagtgtacattcccacaaacagtgcatgagagttcctgttgcttgtgaaataaatggtcagcattcagtgttgtcagcttttaaaattttctcctttctagtgggcatgtaatggtgtcacattatagttttaatttgcattttcctggtgacatgtgatacggaaccttcctcccatgcttgtttcccatctgtatgtcttctttggcaaagtgtctgttcatacattttgcccattaaaattaaaacattttatattgtttgttttcttattgttgatttgtgagggtttgttatatgctatgaataccagtcatttatcagatatgtatttttcaaatgttttctcctaaagtatgccttgaatttttattttcttaatgtctttaaagaaacggaattgtttaatctcggtaaagtaaaatttgtcattttttgtcttttatggttgtatttcctgtgtcctaagaattctgcacattcccaaggtcacaaagattatctcctgttttctcctagaaattatatagttttaggtctttaaattaggtctctgatctattccccatcccccatccattttgagccactttaagaatatatagtgcaagattagagttgaggttcactttcccccagggatgtacatttctttgagcattgtttgttcagagatctgttatcttcttcactggtcatctttgctctttcaccagacagcgatctgtgctggcatctgtctggactctgtattccagtccactgcactccattcctgtcttctcactggcaccaaagtgttctgtttactgtagctttataataagtcttgaaatcaggtacaatgagtcctctaatgtaggtctttttcaaaattgtttttcctatgaagtcctttgctttgattctaaaatacaaattttagaatcagctgtcaatttctacaaaaaaagaccactgagattttgattgagatagtgttggatctgcagaacaatttggggagaatatgcatgtttttaaaacttttatttccattttatcttgtttgtattaagatataattcacacaccatagacttcagtggtttttagtatattcgctagcgtgtacagccattatcactatcaccacccgtaaaacaaccccaggagcagtcactccccactccttcttcctcctttctgttcctatggatttgcctactctgaagttttgtattaatggaatcatacaacatgtggcttttggtgtctgatttctttcactcagcatattttcaaagtttatgcatgttatggtatgtattagtactttattcctttttatggctgaataatattccattgtatggatggaccacattttgtttatccattatagttgacgggtatttagttcgtttacactttttgggtatttagtttgtttacactttttggctattatgaataatgcttctacaaacattcctgtacaagttttttatatggacatatattttaacttagcttgagtttatatgtagaagtagaagtgtagtgtcatatcttaactctgtgtttacctttttgagaagatgccaagtggtttttcacagatgctgtaccattcgacattcccacccacatgtgtgagcgttccggtttccacacatccttgtcaacacccatcttctatttctttatggtacagctatccaagtaggcctgaagtagtatcgtgctgtggtattgattagcatttcccaagtcactagtgatgtggaacatcttttcttgtgcttattggccatttgtatatcttctttggaaaaatgtctattcaagttttttgcctacttttaaattgtttgttctttattgttgagttgtaggttttttaaatatatatattctggatactagacactttcagagataagattgctatcagttttctttcatttagtaggttgtcttttcattttcttggtagtaccttttgacaaacaaaagtttttaatttcagtgaagttcactttacctgttttttctttggttgtgtgcagttaagtcatagctaagaaactactggctaatccgaggttatggagatgtacactggtgttttcctctaagaagtttgtagtcttagctcttacatttaggtctttggcccattttcaattaatttttgtctgtggtgtgaagtaggggtccagagtcattcttttgcatggggatattcagttgtcacagcactccatatttaaaaagatgattattttcctatggaatggtcttagtattctagtcagaaatcatttcaccatagatgggagggtttatttctggattctcaattctaacccattggtctatatatattcttttttttttttttgagacagagtctcactctgtagcccaagctgaggtacagtggtgcgatctcggctcactgcaacctccacctccagggctcagctgattcttgtgcctctcagcctcccgagtagctgggattacaggcgtgcaccaccatgcccagctaattttttgtattttagtagagacggggtttcaccatgttgcccagggtggtctcgaactcgtgagctcaggcaatctgcccgccttggcctcccaaagtggcgtgagccaccgtgcctggccagtctatgtatattcttaagtcagtactatgttttggatcctggagatttataggttttgaaattgacaagggtgagtcttcttagttcttcttttccgaaattttgactatttttttttgtcattgttgcattccatgtgaattttaggatcagcttgccatttcaataaataatggcagatctgacagtgattgccttgaatctgtagatacatttggggagtattgccatgacaacaatatgaagtctttcagtcaggaacatgagatggctttgtgtttatttagcccctctgtgatttctttcaacatgtttgatagttttcacagtgcaagtcttgcatttttgttaaacttattctaagtattttttgcttttccatgctattataaatgtaattgttttcttaattttattttgggtttttcttggctagtgtatataataaatataactcatttttatatattgatctcgtatcttgcaatcttactaaacttgttttgtagctctaattatttttttacagtttctaacccacaggctctttatttcttttacttctcttagggtacttactgggatccccagtgggatgttgattagagatggtgagaagggacatctttgtcttgtttctgctcttgggggaagcatctggtttctcaccttaagtatgatgatagctttttatcaggttaaggaatttgctgaaaatttttatcatgaatgctagttgaattttgtcacatattttatctacatcaattaaaataatgtatggtttttcatttttaatctatataatggcaaattactttgatttttgattgttgagcgaaggtttccaagttaaatcctactaagttatgatgtgttacagtaaagggattttgttaagaatttgtgcatctatattcatgggggatttgggtttgtagtgttctttccttgaagtggctttgtataggtttgctgttaagataaatttgacctcataaaatgatttgggaaggatttcctccttttctgttttcaggagtttgtgtgaagtcatgttttatctttcttaaattgtttattagaatttgccattaaagcaatttgggcctggagtttcttgttgttgttgttggagagtttttaaactgtgaattcagtttctttaattgttataagatttttttctgtgtggatctgagtttttgtttgatatcatccggaacagcttccgctaacattccatgttttttatcttgtcaaatatcacctctgccgcattatttttctcttctttggaaacctcagttacattatgtcagacgttcttactctgtacttctcatcatttcttttcatattcaccttccttctctggtttttactgtaatccacagtagacagacagaacacagcccagagggacaaagagatataaactattcaagagaagatttcagacatggagagacatggacaagttataacatataattcattggttttccagaaagagaaggggggacaatggagtaaaagtaacatttggaataatggttaacagttttctagggtgtgtgaaagccaccaatctacagtttcaaaaactctaacaaataccagcctggtgaaatgaagtctatatttagacatatcatggtgaaactctggaacaccaaagacaagtacaagatcttaacagagagaaaagacattgccttcaaagaagcaacattaaggctgacatggcttcttactggcaccagtggaaaggagaagatagctggataatatctaacgtgctgagagaaaagaactgacattctattaggttggtgcaaaagtaattgcagtttttgccattaacctgcaattacttttgcactaactgatatacttaatatatctttcaggaattatagaaaaataaatacattttatacaaacacaagtggagataatttgatacctataggactttattaaaagtatttctgtttttctagagacagggtctcaccacgttgcccaggctggagtgcagtggctactcataggcatgatcacagtgcaccacagcctcgaactcctgggctcagtccactctcctgcctcagcctcctgagcacctggaatacaggcatgcaccactatgcctggctactaaaagcatttctaaaggacctatttcaggaggagagaaggttgtcttctatggaaagtccgagctctaagaaggcattataaacaaagttgtatgcatgtgagtaaattgaacaggcttgaggcagatgtctcctgggctaaaccacaaatggtagaactaaaataattgactccaaggtcatgtcagcaggaagggaatggaattaaagagttttaaggtcctgggattgcgtgggtagagtgtggggacattaggctttgataagttatgtaattaagtttagagtaaaaagaaaaaaatgtataatggggagaaaaatccaaaagaaggcaaaagaggatagttgaacacagaaagatgagaaaagtagaaaacacaacataaaatagtaaataaatccagacatattggaaatgtctaaaatattgatgggctagatgatttaaaagttccattgaggccgggcgcggtggctcatgcctgtaatcccagcactttgggaggctgaggtggggcggatcacttgcagtcaggagttcgagaccagcctagccaacatggtgaaaccccgtctctactaaaaacataaaaattagcctggcatggtggcgggtgcctgtaatcccagttactcgggacgctgaggcaggagaatcgcttgaacctgggaggcggaggtttctgtgagccaagattgcgccattgcactccagagagcgagactccatctcaaaaaaaaaaaaaaagttccgtgggaagagctgctcctcagaactccactgtcttttagcacagtgttgccacgtggagcctttcagggctctctcctcagccttggattttctgaacttaagcaggacattgttccttgggtcctttcactctgaagacttatttcttcagcccggggaattctattctgtcgcctttttgaatgctgttttctttctttccgctccatggtcattccttctggacctctttggatctgttactgtctctttttcccgtcacctgcattctggagagtgccttggcttcatcttctcactgtctctttgctcgcaagctgtgtccattttactcctaggttcacatattaggtttttattttgacaacatttttccttctcagggtgtccacttgcctctcttgcctggacagagcatgtgacggtcaccttggacgtgtaaactagcgcttgccacttgctttgtatgttctcagatgaccgtccctccttccagtctggcgtctctctttcatcacattggctttcctcaaatactgtttctttgttactcagtgaggtttgtgtttccagaatgcctcttggcctttctgtgggtgtggttggtctctggtgaggacagtaggtgagccgcgggatgcttgtcctgtggacgtgagtgtcctgggccttgagggtgcagtgactgcctgaggcgctggccctcccttcccctctctgccagccttgacctggagcagacaccaccactgccaccgcaaccagggaggatgtcggaaggcccagctgcccagcgcagctcccgttatcctgatggcatcttgtaactggtctctctctgtgcaactcttccgtggaatgcactgtcattcctgacacaggctcgtgcattgtgtattctgttttcgttgcaattgtttctccatcaatttcatctgcctcctttattttctattgctgtgtaaccaatgcaaaactgagtgggttaaaacaacaaatatgtattatctaagagattttatgagtccagaattcaggggtacctttcgtgggtgggtctggcttggggtctcttttgaggctgcacatcagctggacagcccacttccagggtgctctcacagggcaagggcaggaggcctcagcccagcaccttgcggcctccccacagggctgcgtgcgtgtctgtgggattgccattcacttttcctgagcaggcgattggagagagagagagagagagcaaggaggggtcacggggcctgcatgtcccagtctcgggtgttacaccctgtcccttctgccacactatgttctttccatgtgcgttaccaagtcagtcctgtcttaagggagggtaattgtgcttcacctttttcttttcttttcttctcttttttttttttttttgagacagagtctcactctgtcacccaggctggagtgcagtggcatgatcttggctcaaccttgcaacttctgcctcctgggtttgggcgattctcctgagtagctgggattacaggcgcccaccagcacacccggctaacttttttgtattttattatttttagtagaggcagggtttctcagtgttggcccggctggtctcctgacctcaagtgatctacctgccccagcctcccaaactgccgggattacaggcgtgagccaccacgcccggcctgtgctctgcctttttaagagagatgtatccaacaatctgtgggcattttctcaaaccacctcactctcattgaggacttcttggattttccacgttcgccttgtaggtaaggccagcagcaacccttccagggggtcatgtgagccatggcttttctgtctcatcacttttgtggttactttcattgccttttcttttaggataggttttctctaggtaatttaacttaaagggacagtaagtatccacatcttccttgctgcttgtttaggattgaggttgacacatacctcttagaaggccggacgtttggtcactggagcagcagtgctcggcgactctccggaggtgccccctctggctttccgctcggtcagctgagccgcacaagcagcagtggcgctgcccctacatggggcatgctttgcagggctgaggttttgcagttcccaccattgagggctgtaacatttctctatttctggcttagaatgtgtgtaggatgataattatttattcagcattcattccgctcacgctgtgctccgaccacacaccaggctctgcgtgcggtgctggcacagtctcaggactccgcttctcagctgtagggctcagggtgcagtggagaaggcgcgaaggggctgcccgcggatggatttgttcccttggcctttcactgttgctcctctcactctcttctcctaaactcggcgtagaggagcatcctcaggagaaacaggaagaggcaaagttcactgcaaagttttttttgggttgaacgcctgtaggataagaatagcagagggcacccccagatgagatgcggccgtggtcgagcatcaggatcgtctgcctgcgcccaccagtgtggtccgggagcagggaggtggcagagccagggccgcgccctccccgcgggtctcccgtgctgctcgctggcggttggtttcatcagtgccctggcgagtgtcgctggttgcacgtgggcactgcccacacagagcgaattctcaggcaggcccccttcctctctctccccggaagctgcttcatggcactccctccctttgcccttggccgtgggaacctctaggttgatcactgggtcattggatctgcttttagttagccttgatttttgtctgcattaaacaattaaatgagcttctaataatacggtgttttgaatgtcatacatggcttttcctgttgaaacatctgcagaaaaaaaatagctttattatttgtgagtgaagctgtctagctcctcccttttgttcttagtgagataattgcttttgtaatacaaagtttctcattcttttttttttcttttttttttttttgtttttgagatgaagttttgctcttgttgcctgggctggagtgcaatggcgcaatcttggctcaccgcaacctccgcctcccgggttcaagcgattctcctgcctcagccttccgagtagctgggattacaggcatgcgccaccacgcccggctaattatgtatttttagtagaaatggggtttctccatgttggccaggctggtctcgaactcccgacctcaggcagtctacccgcctccgcctcccaaagtgctgggattacaggcgtgagccaccgtggtcggccagtaatacaaagtttcttgaattcaacaattgtgctatagcaaaacaagctggctgtgtattagttaacccgccaagtgaggggtgctgcatgttctgaccctatttctgaccacttccgttaaccctgctgcccaccatggagcctctctcagaaacttcagctgcaggctgaaggcagggggcttgcagagaagcttttgctgcagttttctggacggtgggcaggcagctgtgcttaggagtacacctggggtacatggagtcagccagctcaagagtgttttcaagcttttaatttaaaacaaatcacagaatgtaaaaaatagctttataatgttagttttccatttaccacattctagcaagggaaagagtggtgccatcgtctgtgtgcttgctaagtgataattataagcgtggagacagatgtgcgcttcctgggaacgggctggggctatgccggagaagctttgctcttggaaggggggaggtctgggagtttggctgcagagccttggagctggacaggaaggatcagtggtcgaggccccgggtgggccatggggcctgggccagcctgtggcgagacgtggacttgctgctgtccatgtgtgagtacagcccatagaatggacacctgctggtgtgtgtgcagagggcatgggtgtgcctgaaacagcatggtgcagggtcagtgggcagctgctgagttggggatggtgccctttaggggaaggtggggatagacagagaggcatgagcagatatccctgtggacttgggtgactgggcaccagggtgaccctccaggggtgccaggatatctgtgctgagaggagagggtggccaggctggggcctgggaaacccttcccacagcaccatctgcatcatcaggttggggcgggcattggccagatgaaaacaggtgaggtaatcagattttttgtttcataaaaattatggtcctgaagtgaagttggtagaaacaacaagttaaataggaggacagctcaaatagagaaaacccctcagtcacaccaagtcagcagctacagtgaggagctgcgaatgtgctctcccggcgggctgggcctgccagaccccagggtgcgcgctgcccctccccgtggggctcctgggactggtgagggcaccgaggacagtgccatgctggtcctgggagggtttgccagcgcggctcttccattgtctgccttcctgaggggtcgggggcttgtctcctggctcctgcctcctggatggtccctaggaggcccctcatgtccagacatcggcttcagtttagggctatggggacttccacagggacgactgttctctggagtaactgtggatgatgttgataagaaaatacagaaacaagtcattcctcctgaataagcactggcgatgtgcttccttcatgttcctgagaacggggaaggctcaaattttgttcagtctcataattgtgctgaaaaataatgtattcaagtggacgccttcagaagtctcctggagcctggaaggatgagtgcagtaacgttaatggtcagtgatgttggatgtgggctactgtgccttttaaatgtggaaatgttggcacagttaaagcagcattttctcccatggtcttgtctcctgtgggactgacgtgggtccgtacaacatcgtcatccacggcttcacagtcccaggctgaggatgtagggagcagcggcattgaccagccatccttagtgaggcgcctgccctgcagactggccgctggagtggctggccacgctttgatgtgttgctgtgcctcacatgactttctcctcctcagataccaccagcgatggaccggattgtgcccccaagttcacgtgttgaagcccaaacccctagtatgactgcttttggagtcggggcccttgggaggtgattaaggttactgaggtcataagggtgggcccgaatttgagaggactatggccttgtaagaggaggaagggatgcgagagctgtctctctctctgcacccatgtgaggacacagcagggaggcagccatctgcaaaaccgaggaagaacaccggcaccagattccaacccagccagcaccctgatctccatttccagcttccgtggaagcccccagtctgtggtgttctgttatggcagctgagcagatgaaagcactttttacctcacggttacacttttgggaaagcagcctgcagttggcctgtgtgagcacaggccccagcagatgcccacagatgtccccgtcactcattggtcattgaaaagactggagggaagaggccgatttcctctcaacaggaaaggtgtgtagctgccaggactctgcctatcctgagagtctcctttctcccttagggcttcatagccagttaacttgtgcattatttagagctttttctttctttctttaaaaaaagaaaaaaccaaatgagaaagccaacacaatcaacaacaacaacaagagtggtatcattacagtctgtcagacactgactagaaacatgttcactttcacacacacactcactcactaacacagtactcagttttgaccctgacagcagctctgtgaggggtcactcccctccccccttttaattgaggcataattcacataacataaactgtgccgttttcaagtgtataagtcagtggcattgagcacagtcttcatgctacgcagccaccacgtctgcctacttccagaacattctcacccccccaaagtaaagccctgtgcccgttaagcagtccctcccaatcccccctttccccagcccctggcagccactagtctaatttctgtctacagatttgcccatgctgggtatttaatataaatggaaccacacagcgtctggcttctttcacttgcatcctgtttttgaggtttatctgcatcatcgtagcatgtgtcagaatttcattcctttttatggctgaatcatgttctgttgtatgaatataccacatccacttattgattagtgacattggtttttttcctgctcttcggctattgtgaatagtaccaccatgaacattcttttacaagtttttgtttgacacctcttttcagttccttaggagtggacctgggggacacgtagagactctgtgttaactgactgaggaaccaccagaccgttttccacagcagccgcactgcactgttttgccttcttgaggtggcacttttttatccccattttaagaaatggggcatggggaggtaaaaggacttgctcaggataggacagaccttcgtggtgaggcagctctgtgctggccagtcgggaggccatggcagggtctctgctcctgctccggtgctcatgtcaggccccaggcccctgcaggtggtgccctagagggcactgacaggctctcagagaggagggggcctgtgctggtcctgagcaggcagagggagggctgttagaggggcaggcagtgtgagcaagggcacagatcctgctgttgtttagtgaactctagcaggtttgtttttgcttgattgtttgagaaggatgcctgtagttttaggaccagtgtcactacccacgttggccacaggccatggtgccagtgtccttgctgccacgatgcaccagcttctgtcttgcaggtggctggctgcttccctcccagctgcactggggcacacactgtggggcagttgccttctcaccctttggtggggagagcctgggctgtggggtgcctctgtgtgtggccgtgtggtgcctgctgaggcctagccctgcgtgggcctttgctgatgctccctgcgtgggtggcagtgagccaccctcacgtttctcagcgaaagcacttggacaagatgaaggtttccagcactgcgagactctcacgtctgttatattgtgttatacttggctgtggttttgcttacagtaaattcctgaaggcgtttctgttgctcagtggaaatcactggcagaattcttgttactgagcatcagactgtggggcaccgtcatggtgtcttaggggtgtcaaagcagatgcatttgaggggagatgtattcacattttccagtatatcattaccacattcttgtgtgatagcttcctggtaattcaacttgatttagtgtagtacagcagcacaacttttcctttctgagttgtggagatttaaatttgttgagcaaaggaaacactgaagaggactcagaacactccagttgagtgcacacactgcatgaagctgatggctctgcctcctgctacttttaccccattgcactggtgtgctttgccctccccatggtggcagcaggctttcccagggcgccatctgcagttggaggcctggctgaggacgtgctgtgcctgccctgtgagcagggagccaggcacccctggcctgcagtgctatcgtcccctcgtctccacgacaggcacctctgcctgttccgtctgactcggggatgccagagctccaaggcgcaatcagggcatgatgaccgatggcaggaggtgagcacgtgtcaggacttccaggaggacggtgtctctgcttctctgttcagggctgtttggggattgttaccagaagtaaggttcaggctttgtgtggcactggctacagactgcattgcctgtgctgacttagctcagcctcagcccctctttcatttgtttctccactgaatccttgtcttcttgcattcactgggcattggctaaggcccagctcagttccagggccccacaagacactgtgggtggcatgagatgggtgggttttcccacagtgctctcccatggttattctgttatttgaattgagtgtacacaggtttctacagttgagggagtgttggacgacccattcctcagggtaaaactcgccctcccaaacctgtccctgagtgcaggtgacagtgcgtgctcaccattagaagacgcgggtgctcacgcagggctgtctgctgcctgtgctgggactgtgggcgcatcgcctgtgcgtgcagctggagcacctgcgtctctgaaatgaaagggatcttcaaatgggcggcccctactgtgctttgttcagtttaattcttagaaccgcctatccaggccggtcttgtgttccccctacagaggagagaactggtgtctggaccttttaggtgccttctctgaaactctgggttggcgtgcaggccagcctgcctctgccccacccatggttgcaggttctctctggggtcctaaagtcctgcatttctgccttgccaggtcttcactctggctggccgtctctcgtaggcaggcctctggagtgtaactagtgtgtgatattcagggagggaaaatgggccgctcgtttcacaagtgatagaaatgtgacgtgacatatttcagagaaagcttaacagtacggcagctctgtgactcagcccagcagaaactgcatctcttgttaggaaaaatacactttattattgagtctgtgggaagacaaaatggaagaagaacttttctggacattgtttagcctgcaggaggttttgtttagccctgaggcacacagtgggccgtggagatggtagtgctcaccaccacaggacatggtgaacgccggggggttggcaggtggcggcctcgtgttggacatggtgcataatcgacggcgacccggcctccctccttgtgtccgtctgaacggcgcccctgaactccgccgaaggggcgcctcctctcccctgaagtcaaattagcgaacagaagattaagaatatggaaagtaaatgaaattttgatcatttcttctcatgattacagttcctctagactttatctaaagctattttgaagccaaatataattttttattcatatttccttttctttttagactatcgttttacaatttttaatctcttgtttcattgagtttttcttttccttcttgtctctgaaagcacatagcaggccattgactaaaataacctgtttctttttgtgcatatttctgaacatgcattcttctaccttctgctgtgttgttgtgtttttcttcatgtggcagagatttttttatggcttctgtgtttctttctttctgtttgctgctccctgaaggagaagtcagtgctggtcttgccttcttcccagcgtgcatgtatggacattttctgctgtgagccctcatttttcaccgggatctcctttaaggttattcggaccctgagctggatgtgaaagtagcaggaggcagagccatcagcttcatgcaatgtgtgcacaccagttctgggtcccccccagccttgtggggtgctgaaagggggcttggtggcctctggtcccatgtggcaccctgtgtggctggggccagcctctgcagccatgtatccccagcatctccctcacccactgcctccatggcacactgcttttcaggaagggcaggagaggggcctctagaacccgctgcccatgccgtcacatgggagcttgcggagggccctgcatctgtgctttccagtggtttgttttcctgatttcttcaatcaattcagtggaaatttgggaaagatggagtgtaaacatgtgtgcctgaatcacctgtctcccttagccagtcctcatgtcctggccggaaggcctgctcttccttccccctggctcagccaggggtctgcattgctgtccattgatagaattgttggtgctttatgatccagctgctcttgttgccttgaaccaggatttgaatattgtaacattaagttttttgcatgtttatgtccagtagattatgtattttgagactagacagtgggctaattaatattccacacggggtcccatgggacgcatgttcatgatgaggtcactaaagttctgtctcaagcacatggtgggcgttcagtaaagacttagagatttcggttgaccagacatttagcattaattagcagtttagtgtggtgggtgactgaaaagtaaatgtaagctttgagcattttcagagcatcattttgtctaaaattaatcagtatatttcaccgtcttaacaaactaaaaacgaaaaacagtatcattttagaatatgcagtgagatcatttgacaaaatgcaacactcctttcagatacaaacgttcaagaaactgacaatagaaggaatcttcctcagatgcatggtatttatgaaaaatctagagctaacctcgtatttgatggcgcaagactgaatactttcccctaagatgaggagtaaggcaaggaaacctgctctcatctcttctattcagtattttactggaggttctagcaagttcaatagtcaagaaagaggcattggaattgaaaaagaagaagtaaaactgtctttcctctcagtcagcatgtttgaccctatagtacctactgcagaatcaaaacaaagctcctgaactaatgagtaagtttatcaaggctgcaggatgtaagatcagcatacaaaaatcaattgtatatctgtataccagcaacaaataattaaatattaaagtaaattattagttttttgttaacctatttatttaattatacaaatttatgggacacgtgaaattttgttacatgtgtataatgtgtagtgatcaagtcaggatatttaaggtgtccatcacctgaatacaatatagttttgttaaatacattcaccctactctgatattattgggtttattccatctatcttactgaaggtttgtaatccacttcctttcctcttcatcctctcccctaacccccattcacccttcctagtctctagtatttatctttccattgtgtacctccatgtgatcaaattttttagcttctacatataggtgagaacataagatatttgtctttttgtgcctggcttatttcacttaaggtaatgactttgagttccatccttgttgctgcaactgacatggttttattcttttttaaggctgcatagtattcctttgtgtatatatactacatcttctctatccattcaccctttgatcaatacttaggttgattccatatcttattattgtgaatagtactgcaataaacataggagtgcaggtactactttgatatactgattttatttcctttgggtagatacccagtagtgggattgcttgatttaatggtaattttatttttagtttttttgaaaaatctctgtactgttttccatagtggctgtactcgtttacattcccaccaatgatatataagtattttctttttcctgcatcctcaccaacacctgttatttttttattatggccattctatttttaataacagccattctgaatggttcaagatgacatctcattgtggttttgatttgcgtttctctggtgattaattatgttgaacatttttttcacatacttcttggctgtttgtgtgtcttcttttaagaaatgtctattaaggtcctttgttcactttttagtgggactatttgtttttttcccttttgattgagttccctttatattctggatgttagtcctctgtcagaagaataatttgcaaatattttctccctattcaacaggttgtcttttcactctgctgattgttttctttgctgtgcagaagctttttaatttaatatagttccatttgtctatttttgtttttgttgcctatgcttttgcggtcttagtcataaattctttgcctagaccaatgtccgggagagttttccctaggttttcttctagtatttttatagttccatgtcttacatttaagtatttttatagtttcaggtcttacagttaagtatttttatagtttcaggtcttacattttaagtatttaatccattttgaattgatttttgtgtatggtgagagataaggtcgaattttattcttctgcatgtggctatccaattttttccaccaccgtttattgaagagggtgtccttttcccccagtgtaagttcttgtcagctttgttgaagattatgttgaacattttttcacatacttcttggctgtttgtgtgtcttcttttaagaaatgtctattcatgtcctttgttcactttttaatgggactattaaaccagaagctttgtggttttatttctgggttctctattctgctccagtgacctctgtgtctatttttatataagtgccatactgttctggttactgtacccttgttatatattttgaagtcagataatgtaatgcctccagctttgttctttttgctcaggattgctttagctatttgtgcccttttttggttccatatggattttagaatttttttttctaattctgtgaatgaggttggtattttgatagggcttgcattgaatctgtagattgctttgggcaatatggtcattttaatgatattaattcttcgtatccacgaacatgggatgcttttccatttgtgtcatcttcaatttctttcatcagcactttgtagttttccttatagaaatctttcctttccttggttaaatttattcctaggtattttgtgtagctgttgtaaatgtgattgtcttcttgatttctttcttgactagatcactattggtgtgtggaaatgctgctgattttgtatgttgattttgtatcctgcaacttactgaattcatttatcgcatctaaaagttttatggggccgggcgtggtggctcacacctgtaatcctagcactttgggaagctgaagtgggcagatcacaaggtcaagagattgagatcatcctggccaacatggtgaaactccatatctactaaaaaaaaatgcaaaaattagctgggcgtggtggtgcgtgcctgtaatcccagctactcgggaggctgaggcaggagagtcccttgaacctgtgaaccgagattgcgccactgcactccagcctggcgacagagcaagactccatctcaaaaaaaaaaaaaagaaaaaaaagtctttttggtggagactttagttttttctggataaaattatatcatcagcaaagaaggacaatttgacttcctctttttcaacttggtttccttttatttatttctctttcctggctgctctggctaggacttccagtattatgttgaataggagtggtgaaagtacgtatctttatcttcttctaattcttagagagaacactcttagcttttctctagtattatgttggttgtggctttgtcatatatggcttcattattttgaggtatgttaccactatgcttagtttgttgagagtttttatcatgaggagatgttgaattttatcaaatgcatttttgcatttattgagatggccatatggtttttatcactcactctgttatgtgatatatcatgtttattgatttctgtatgttaaaccatacttgtattcctggtataaatctcacttgattatggtgtattatttttctgatgtgctgttggatttggtttgctaacattttgttgagcattattgtgtctgtgttcatcagggatattggcctgtagttttattttgttgtattcttgtctggttttggtgtcagggtaatgctgcccttgtagaatgaattaggaagatttcccttctctttgatattttggagtagtttctggaggattagtattagtttttctttgtacttttggtagaattctgctgtgaattcacctggacctggacttttctgtattgggaggcttttactactgattcagtctcactattccttattagtctgttcaggatttttatttcctcctgactcagtcttggcaggttgtatacttccaggagtttatccatttcttccaggttttctagtttgtgagtatatagcttttttttttataatagtctctgatgatcttttgtatttctgtggtatcagtttaatttaaatgcctccttattcatttctgattttgttttctttggttcttctctcttcttttttatttaaaaaaatttttagaaacagggtctcactctgttacccaggctggagtgcagtggcatgatcacagctcactgcagcctcaaacccctgggtcaagcagtccaccagcctcagcttcccaagtagctaggactacagatgggtaccaccactcctggctaactttttaaatttttctttagagataaggtcttgctatgttgcccagactggtcttgaactcctggccttaagcagtcttcccacactgcagctctcaaagtgctgggattataggcatgaaccactgtgcccagccttcttcttttcttggttagtctagctagtggtttatcaattttgtttatctttttgaaaagccaagtttttgtttcattcatcctttgtattatttttctggtctgtatgccatttagttctcctctgatttttattatttcttctcttctgctaatttggggttcagtttgtttttgcacttccagttccttgagatgcattattagactgttaatttgtaagctgtctgcttttttcaggtaggcatttattgctataaaattccctcttagctctgcttttgctgtatcacacaggttttcgtatgttgtgttattttcatttgtttcaaggattttttttattttcattttttctttattgacccaggaacatactgaatttccatctatttgtgtagtttccaaagttcctgttggtattgatttctggttttattctgttgtggtctaagaagatagttgatatatgatttttaaaaattttttgagacttgttttgtagtctgtcctggagaatgttcctttcatgtgctgatgaaaatgaatattctgaagttgttgggtagagtgttctgtaaatgtctgttaggtctatttggtctgaagtccaatttaaatctaatgtttctttgttgattttctctctagagtgaaaatcagtctctgagagtggggtgttgaagtcccccactgtttttgtacttgagtctctctctctcccactgtttttgtacttgagtctctctttctctctctctctctctctctctgtctgtctccctctttagatctagtaatgtttgctttatgaatcttgatgctctggtgttgggtatatatatatatatttagaattgttatatcctcttcctggattgatccatttatcattatttaatgactttgtcttttacctttcttgacttaaagtctattttatctgatataactgtagcttctggtcacttttggtttccaatttgtacaaaatatttttttccatccctttaatttcggttcatatgtgtctttactgacaaggctagtttctcgtaagcagcatttagttggatcatgtttttaaaatatattcagccgttctgtttctggagcatttaacctgtttgcatttgaggcgattatatgacaggtttgtttctgtcgtatggttgttttcttgctttatgtattctttgtttctttttctcttattaatttgggtggatttttctagtggtaccatttaagccatttctgttccttctttgtgtgatgctttaccactgagttatgttttcatgtattttcatgttggtaaatgtcatctttgtacttccaggtttaggactcccttgagcatttcgtgtagggatgatgtagtggtaacaaattccctcagcatttgcttgtcttgaaaggactttatttacaaagcataattttgctggatatagtcttcttggatggcaggtttttttgttttttgtttttttcccccattactttgaatatatcatcccattctcttctggcctgtaaggtttctgcccagaaatttgctgtcagtctgaagggatttcctttatagatgactagatgcttttctcttgatgtttttaggatttgctctttatctttggctttagagattttgacataatatgctacagagaagacctttttgcattgcgtctgcctgggaatcactgaacattctttatctaaatgtctaaatcttctgctagacttgaaaagttttcatctattatttcattaaataggttttctagttctgcctttatctcttcacccttggggatactgatatttagaatattctatcactttatgttgttccaaatgtcataaaggatttccatattcttttttatctttatttttatctgactggattatttccaaggacttgtcttcaagtacagagattctttcttctgcctgatttagcctattgttgaagctttcaaatgtattttgtatctccttcaatgaatcttcagttctagaatttgttttttttttaagtatttgtccctttcataaatttcccatttatataatgaattctttttctgatttctttgtattatttttcagaattctcttgtatctcactgagcttccttaaaatcaatattttgaattctttatttgggatttcaaaaatttctttttgattaagatctattattgatggagaattattgtgttcctttggggagggccttttttttttttttggtttctcatgtttcttgtgttcatactttgatgtctgttctgcacttctagtataatagttgcttcttcctatttttgaattcacttcatagggaggactttttcctgaagatgaatctgtcatgttggttgggatattctgggtttgattctgggtgcatgcagtagtgaagtctctgtatgatatctttgtctgtaaacagcattggtggtgtctgtgatttcttcagtaggttagggtgcagttagtagtggagctgtgctgaagttgtgctggggactgggatgccaggtgagccagacttaaggccccactagaggcagcattggattgagcgtgcccatctttatgtcccagggtggcatatcctggcacctatgctggtggttaccagtaggccgattattgggcctccatgtgtcttgcttggatactggtaatagcagcagtggaccaagctggtgggtgggttcttgcgcccctgggaaactggcatgggcgatgacaatagcagtggtgggatgatactctgggtcctaggcaatgtacatttatgttggtggtggctgtgatgagcagggagggccagtcgtcagatccacaggtggtacttgcaggtaggtgccagctgaggtgatagcagctgggagatgagacccaaactcaagcccctggaaggagtgctaaggcacccacaatggtggattgggttgggcaatgcctgggaccctgggctacatgctctgtcttggaatagggtaagagggtgaaattgggctgggtgggcttgtgttcaagcaagaccccccagtagtgagggcaggtaccagctttggttggcaggggtgggtcgatcctcaggccccaggtggagtgctgggtgaagagtgggagcagctgcactgatccctgccactggagcaggtgggtccatccttggtggccaaagcctgggttgatggatagggaatgcacacccctctcagctcccagtccccacagggcttgccccccagccctggtggcagtaggctgtgcctcacttggttcttatcctcagctgtgggagcactcccagcttgttccccagtcccagcagcgacagcctgagtttccataatgcctcagtagctgttgggccctaggacatcacgcagtctgccaaaggctaggtttgaaaatggtgccttgctgtagccactgaggtctcagggagttgtaggacccagcatgagctccctccctgaagcagctctgtcccacagtctcctggcatctcctgatgttattttcagggctggtgagggttgagggagtctcccatggccagaattgcatgatttcttggtggggatgtgggccactggaagtttctcactcagcctttccttgtgttgggaagtcactcttggctcctgaccaatcccagccaggcaggctccccctcttccttttccttaactcgcttttggtatttcctgttacttctctgttgaattcacattctctcttgggtaatgtattcagaaagtgaccgtacattcttttggttcttcaaagtggaggaggtgggcataaattgcatctcgtcatccatcttgaagctcctctccatgaaaaaaatattatttttaataacattagaaatctaaattggacaagagatgttcaacacttgaacacgtaaaactacaaaatattgccaacagaaattgttgaagataaatacattgagagatataccatgttcgttgttaagatgactcaatattgttaagatgttaattctccccatgttgatctatagaatcaatgaactcccaatcaaagtcccagaaggcttttcatagacatttgactataacagtacttggttttatgacttattataggctgcaatagtcaatgcagtgtggtattgctgttaagatagacaagtagatcagtggatcagaatagaaagtctggaaataggcctgcacaaacgtggccaattaattttcaacaacagcgcccaggcaaattagtgggaaaaggcatagctttttaaacaaatggtcctggaataattgtatatccatgtgaaaaaaaaatcctatactttttgtcatttataaaaattacagtagatcaggaatttcaatctctaaaactcaaaaatatataatttcttggagaaaacgtgaggcgttctttgtgaccgtgtgatcttgcgtgaggcaatgttttcctagttatgactttcaaagcattcgtctcaaaatacacacatttatacactgggcttcataaaattaaaaaatttctgctcttcaagatacactgttgtgattttttcctctgatttgatattgaagtctctctctggaaagaggttataaattctagttatgatctgatggggctccaaggtcatagatgtttacagtatactttaatgggattcttctttatcctgacaggcagtctaatgcctacttaggcacctggtccaacctgtgacgaggtgtccctttcacgtgaaacttgtttatgctggctgatgtccttgtggcccttgtctgactgtgtctagtttattcttgccagggtggccactctctaagagaggcctgatcaggacaggagagttgggtctgggtgtgtggctcgggtgaaacacacaggagacagcacagcagagcatgaagcaatggaagcatttgtattaagtaatatgatctcagagagaagaggacagccatgcagggccagtaggcagtggaaagccatgtgggacatgtgcactcaaccagcaggtggggagcaagagagagagagagccagggaccgatgcgccaacacttttattggagtctagggcattactcaagctggtttcctgcagggaattttagtttgtgggtttagatcaagcagccacaagctccgtgggatcacactgactgagaaggtgtcagtggggtacatctgggcagtcatttgggctgtgggggtaagtgggggaatcaagtaggttgtgtctagctgtcccacaggaaggtgatcaccaggaggctgtggtgtaaggcagatatctgatcaaccaccttgaggacccgggaggaggtagagaactggaaagtttgtcaaggatgaccaagccctgctcctggtataagaaagtccaacctatattcagaatggattctgaggcaacataatattataaaaattcactacattctcttacatgggtaagagaatggaaaaacaagccacagactgggaaaaacatttgcaaatcacatatctaatgtatctaacatgtgtaaagaactcttaaaatgcagtactaaggaaataaagaacaaacaaaaatggctgcaagatttgaacatccatttcacaaacgaagacatgtgactggcatataagtacataaatagatgctcagcgtcattgtcatcaaggaaatgtgaatgagaaccacgatgagaaaccactcggtgtaactgaccatactaagtatgggcaaggatgggaagcatctttcatatactgttggtgggaatgggaaatggtacagttactttggaaacattttggcaatcaaaccaagagcttattaaatacgtacctaccaacatcccactagaaggtatttccccaagagtagtgaaagcatatttccatacacctttgaacaggaacatctgtagcaatttgttcatattgcaaatgtctatccatacttgaatggctatacaaattgttgtacatctatataatggaatactgagtgaagtgtatccatataggtgtgtacatatgttaaaacatttcaatttgcatatttacaatatgtacattttattatatgtcagttacctggcaaccactcacttgccttctgacgctacagaatttactttcactgaaagtttatataaatggaaatgcacaatatatatacttacgatttttggtctggctattcttactcatcataactctcaagattcgtcagtgccgttatgtgtatcagtagttcattcagtattccattatatatctcaaagctgattttttttttcccccaaagaaagcagcattcctttttggagcaagataacattgtccatagtctcaattattttttaaccatgatgttcagtactcagtaaaaaattttaaagcatgctaaaacaagaacagtaagtgaaagacgagataaaaacgtgagaaatagacccagagatgatttgtataattgcattaccagataagaactttgaaatatctaagattagtatgttttttaaaaaagagaaacagacagaaaaatatatgaaaagatggagaatttcaagtggaatcatctataataagaatcaaatggacattttagaattgaaacatataggatctgaaattaataatttactagacatgcctaacagaagactgaacacagtagaaaacaggcacagtgcattgggaggcagttcagtgcagtcagtctgtgttgaagcacaacagaaaaaaggatggagtcattcaaggtagaatgcaagaggcctgcaggatggagtcaatggtcaaatgtcatgtaatgagcatcccaggaagtaggggatcagaaaaatatttgaagacataaagatcagagatttttctaaagcatcaaaagacatttatattcaaattcatgaaacagcctaccctgaaatgaacaaattaaaaaagcaagcaaacaagcaagcaaacttttcacatctgggcatatcattatttgttgcaaaccaaagacaaaaaaaatcttaaaagcaaccagattttaaaatggtccattgctctccaaggagcccagccggcatacggcacaatctcgtggtgggcacagcatacacttctctgtgaggcatgtcgctgagtggaactgctgtgtcgcaggttacacggagcttcagctttgctgactgatgccattctggctttctcatgtagtttgtactcccactagcagaatacagactgatctcatataatgaccattcaggcaaccactttcctccataattgctcttcaaaagctataccaagttttggaaagcaacatcttccccctttctcgcccagataatgacatttttgcccaaaaatatgctaaataaactatatggagtaatattgcagaaatatggttttggttttaatttgtaaatcttaatttacaatccgtcactaatgaggctgagcatctttccatgtgcgattggccatttggagctcctctttcatgaagtgcttttcttggttttcagccatttttctattgatgtctgtgttatgtatcagggatgatcaggctggtccgagttgttttcaccacaattttcatggtagaaaaaagtgtagcaaagtatacaaaaatctttagagaaagaaatgatattctcaacagtacatttgcaacctgtaagaacttgggaaaagtgattctcacaagcattgttgaaagagctcctggagatagaaccagaggccaaaagaggaatggagaaggggggaaggtcacagagagtggcggtggcctcccagaggcacagcgcacagcggagtgagaagttagggtgaggacgggattttaacgttgcaagcttcacaaggtagccatggtgatggaggaggtcagtgcacggcctgagctgcagaggccagggctggaaagatggccctgtgctcttggggccaactgatgagctagtagggatttaagaacatagttcagtgattaccagtaaaagaaccaaaaccagctggataacctactcacgccagcagtggtgagggtgtgaagatggcagtttcctcctcacccttggggagccatcagttattctccttcctggaccaggccgtgagcaggactttcacacacacaaagcacggaattcagtgagcatagaaaagaactcagactcactgaaaatggttgcagttttatagttttaaaacagtaaaatgatgaggtaacatttttgtgcttttcagtttgtcaaaggttaaaacattggagagtgaatagtgtaagcagtggtgtgaaagagccccttgtctaccttgacagggatgtaatttgcagagtccagtgtggagaagattctggctaacacctctgaaataaaaaatgtacaatatttcactttttgtgccaaggtagctctgaatgtgctgattcaaaaaaaatttaaggtgttttgattgtaaagaataacatggcaggtatagaaaaggcatgaacatttcactcctacctgtgtagaaaattcctggatggaccaccagggaatgttaatagtgacagctctacctctacctctacctctacctctacctctacctctacctctacctctacctctaccgctacctctaccgctaccgctacccctacctcctacctcctacctcctacctcctacctcctacctcctacctcctacctctaccctctttccactgtctccctctgatgccgagccgaagctggactgtactgctgccatctcggctcactgcaacctccctgcctgattctcctgcctcagcctgccgagtgcctgcaattgcaggcgcgcgccgccacgcctgactggttttcgtattttttgggtggagacggggtttcgctgtgttggccaggctggtctccagctcctgaccgcgagtgatccgccagcctcggcctcccgaggtgccgggattgcagacggagtctccttcactcagtgctcaatggtgcccgggctggagtgcagtggcgtgatctcggctcgctacaacatccacctcccagcagcctgccttggcctcccaaagtgccgagattgcagcctctgcccggccgccaccccgtctgggaagtgatgagtgtctctgcctggccgcccatcgtctgggatgtgaggagcccctctgcctggctgcccagtctggaaagtgaggagcgtctctgcccggccgccatcccatctaggaagtgaggagcgtctctgcccggccgcccatcatctgagatgtggggagcgcctctgccctgtcgccccgtccgggatgtgaggagcatctctgcccggccgccccgtctgaaaagtgaggagaccctctgcctggcaaccgccctgtctgagaagtgaggatcccctccgcccagcagccgccccgtctgagaagtgaggagcccctccgcccggcagccaccccgtctgggaagtgaggagcatctccgcccggcagccaccccgtccaggagggagatgtgggggtcagccccccgcccggccagccgccccgtccgggagggaggtgggggggtcagccccccgcccggccagccgccccatccgggaggtgaggggcgcctctgcccggccacccctactgggaagtgaggagcccctctgcctggccagccgccccgtctgggaggaggtgggggggtcagccccccgcctggccagccgccccgtccgggaggggggggggtcagccccccgcccggccagccgccccatccgggaggtgaggggcgcctctgcccggccgcccctactgggaagtgaggagcccctctgcccggccaccaccccgtctgggaggtgtacccaacagctcattgagaatgggccatgatgacagtggtggttttgtggaatagaaaagggggaaaggtggggaaaagattgagaaatcggatggttgccgtgtctgtgtagaaagaggtagacatgggagacttttcattttgttctgtactagaaaaattcttctgccttgggatcctgttgatctgtgaccttacccccaaccctgtgctctctgaaacatgtgctgtgtccactcagggttaaatggattaagggcggtgcaagatgtgctttgttaaacagacgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctgtgaccctgccaaatccccctctgcgagaaacacccaagaatgatcaataaaaaaataaataaataaataaataaatcatatcaaagtaaaaagtttccaaaaaaaataaaaagtttcaaaaaaaaaaaatagtgccagtgagctctgcataacaggagagagtcttgttttccattgttgacatttttactctttatatttaagtatcttttttttttttctttttgagatggagttttgctcttgttgcccaggctggagtgcaatggcacaatctcagctcattgcagcctctacctcctgggttcaagcgattctcctccctcagcctcccgagtagctgggattataggcgcccaccaatgtgcctggctaatttttgtatttttagtagagatggggtttcaccacgtttcccaggctggtctcgaactcctgatctcgggtaatctgcctgctttggcctcccaaagtgctgggattataggtgtgaggcaccgcgcctggtcttaagtatcattttgaagagttatgaaaaccacctaagccacaaataattttaagtcattattgttagtaagagaattacatatattgctacgttcgttccaactcatggtatgttcctgttgtttagtaattgggaaacctgagacatgatgtgaagtaattcacctgcaatttgggggtgcctgcacagcaggaatgttctggcaccatgactgctcctaggaacacagaataatagtcattaaaatgctgtaaatagcagtgtgtcctgaattcacccacaccctctgaagaaattattagaacctgtctcctgcctccttccatgagagtccgtgggtcccctagcggcgtgcagcctgctgggatggaaagggcccgtgctgcaactctgcataaagaatttccagctgttgacccttcccaactgcttccctctctgagcctgatcctcatctataaaaatcataatagtgcctgctttttaatctggtaaatactaggtatattgtaataagcctgaacgttcttggaaatcataaaatgcttgaaaatagtttcgcctcctttttaagattttgcatgtgttcataatcagtgcctgtttctggaacgtaattcattaggataacagctggatcttgacgtttcatctgagtttcgttttgtttgagacagggtcttgctctgttgcccaggctggagtgcaatggcgtgatcatagctcactgcatcctcaacttcctgggcccaagtgatccttccaccccagcctcctgagtagctgggactacaggcgcgtgtcaccacacctggctaatttttttttttttttaaatagagactaggtctccctgtgttgcccatgctggtctcaaactccagaccagccgtagctcaagtgatccttccgccctggccccccacagtgctgggattacaggtgtaagccgctgtgcctggcctcatccgagttttttggaagtgtttccttgctgcctaaattatatggtggggcctccagggaacaaagcgagtccccctgcttgggccctggtggtcactggcattcctgcccacacagcagtgggggacatcccaggctagggctaatggctgtccacagggtagggccttgcttctccgtcactttgctccactagacagtagagtttggttggggtctgtagcatgccaggcacctttgacgcttcacaaatgtgttaccagatttttaaaaaggtatttctgctataactgaggatgtggactgttgcaacaggaaaagttgaaagccttactaaagagatcaggctttgaggtatagctcaggtaatgctacctgcaagtaaagggtaactttttagcagactatagcaaaggcggggagagactggggagacctacgggggaagatgggggcacctacagttgcaaggtgggcaccagttgtcaggagttgacaggagggcatagccaggaacagctggtgtctccttactgggacatgctgtgacctgtagaatcgtgtctgaccatttctggaggatgcagtactgaattcaagtaacaaggtgtcctgtgaaccccccacagtcagatgggtgagggatggggagggtcacgcagggtgtgggcggcgtgcctggcatgggtcctgccaagttcgtcaggtaacgtgatacttctcccttgctttttggtagatggacagtgtgtcaccctcggggagcaggtgggctggcaggacaggcggccccaggccgggagaaggagacactcccaggtactctcgtctacccctgctggtgacctgcctgcccggccccgttctgttccagatgatggctcacctgtgaccctgcctgccctgcccagcttcgcccccatgtctgcctgtccccaacctcagtgctgtcggctgacctacctcagcccacgccctgccctcttttttcccaccccacggggccgatcctgacttctggttgctccctttgcttgaccgttctcttgaggttcttaaccctgaactgcacccgactcccattgacctcactcactgtgggccgccacgagggcccctcagagacgatgctaacggcctctcagatgctgacctgcttcatgtctatttccttttacagggtaatttgtagtggaatgagaaaaaaaagttgtatttcttaaacaacatgatctggagtatgtggtgactgtcaacttttcatctatgcagaatgttaatgactcaccagtcacagggcagttctcctcaggttagaaacacagtggagctaatgacacatttcagaattagaaatggttttagcaataattctaaatgaggctggaagaattgaattgctgtccagatccaacagacttattcagccaacagtaaccaaatacatgctctgtgccctgctctgtcctgggcttagaacacagtgagtgcacatcaatggctgtgtccccagagctggccgtcctgtgtgtacttcatacctgagaaaatgagatggcatgctcagcagatcaaggaagggggcatgaagcagaggtcaggagtgaatgtgtgtgcacacgtgcgtgtgcatgtgtgtgtctgcacatgcaaatgtgcatgcatgtttgtgcatacatagtgtgtgcacgtgtgtgtgtgattgcatgtatgtgtgtgattgtgcacgtagtgtacccgcatgtgtgcgagggtgagtgtgtgcatgtgagttcatgtgtgcatgagtgggtgcatgtgtacatgtgcttgtgtgcctatgagtgcacgagtgtgtgcatgtgtttgtgatcgtgtcttttcatgtgtgtatgtgtacacatgtgtgcatacatacatgcagttgggggttgccagtgttcaatagggccgtcaaggttggccttattaagaaggtgatgttaaaggaaagatgagggtgtgagccatggatgaggagcaatccgggcagaggagtccccagcacgaaggctttaaggtggaggacaacccggggccagtgtggccggagcagagcgagcaagggagagcatcaggggctgagttccaggaggtgaggagcaggtcatttgtggtcctgtggcgtcctaagagcttttgctgtgagtgggagccagtgcttcttgtcttaagcagaggtgggacatgccagtgcttcttgtcttaagcaggggagggacctgggccgagttaggttctcgccaaatcgctctggtgtctgggtagagaatagtctctcggccgggcgcagtggctcacgcctgtaatcccaccactttgggaggccgagacgggcggatcacgaggtcaggagatggagaccatcctggctgacacggtgaaaccccgtctctactaaaaatacaaaaaaaatagccaggtgtggtggcgtgcgcctgtaatcccagctacgcgggaggctgaggcaggagaatggcgtgaacccgggaggcggagcttgcagtgagccgagatctcgccactgcactccagcttgggcgactgagtgagactccgtctcaaaaaaaaagaaaaagaatagtctctcaggggatccagtggggaagcagagactggtgaggaggcttcacctggacccaggtgagaggtggtcccgaggacgtcatgagagggtcagattcaggatccgttttgaaggtaggaccttcaaacagagtggaggaagtacttgtgggacaggggaggtgaggtgactgcggggctctaggcccgattagcaggaaggacgaagttgtgtccagcacttgcatcgagggcagccaaggtgggacgccgtgccattcaggcagagcagtgagcacacagttggatagagagacccaggagaggtggacttgtgcctgtggacttgtgcctgattggtccctccatgatgttttatgccggaaatggcatgggtcatccgggggcgtctgtggagagaagaggagcaaggacccaggcctggggcgcccctgccttggcaggctgggatgcagtggaggaacaagcagagtctgagcctaagtggccagcgagggacccaggagacgcaaaagctgagggcagtgcctcatcaggagaggagagatagtctcaatcctgtggacaggtggggtaaggggagagccaggaatgagccaccagagctcacacaggtccttgggggtcttgagcagttttagacttggcgggcaacaaaagcaaaagtggggtgctctggagagggagaaggacagcagaggggctggggcagcaaggtggagttttgaagagttttactacaaaggaaaagagagtagtagggggaaggaagccagttttgagagtggaagaaacagtaggttgtttctgtgtaggtcacagcaaccagcagagctctcacaagggcaggagaaccactggggcagccttgggatgcccaggatgggggtgggctcagtagaggggctggctggcccaccgaggccagcatcttgcagtggcgaaggtgcagagatggtggggtccatcccaggaagcccctcacaacaaggctgtgttggtcgtcagcccagcgtgggaagggggagttttgaagacaggaatcggtatgagatatgcatatttatatgtttttgatgtacgataaaaggcagtttcatatgggtcagtgtaaggtttgtgcggtagaatttggaaggctgggagcatggccagcccagggagtgagtgtggtcactggtgtgtgtggcctgcctgtggtctggtctggtgtacactgagtcgtttgtgttctccagttgtgtgcagctccagagtctaggcacggaattgacagagagtgagactttaatagggtgtggcttttgtcaagcaaggacaaggaaccaagcgggtagccagacacaaaggcagagaggagacgatggtctcgcggcgtgatctgggctagggaaggagagaagctcgcgagggaggtgtgcaacagccggaaggcaggtggccgccaacaactttctttttccagttggtggcagtcataagttaatttctgtcgaagtagaatacaactaagaaaaaattttaaaatacaactacctcttcagcttagagaatagtactacttggtttccctggtaactgccaaccgcttgactgactgcacagcaagtgttaggtcgtggcacagggtaattacagacaacagagaaattgcagggtaaggcttaaataatcctaaagcaactatgtagttaggtcctgctcctgaaagcaaggatgcagttcatttccagccctgagctgcactcaggagctgggcctcatgcccagtccccatccttagggcagtgcccgccctcaggctgacagcctttcctttccttgctccagtcgcttgggtgtgagtcctgcttctcccattttctctgtgctgggacctcaaggcaagccgactgcaagcccacctggcccaggccactgcagggccacccttcgcagggccaggctgtgaagcagttggaggcgaggcccggggctccaggctactgtgttgagattaatcttaccaactagaactttaaaaattgtgtttccagcctttatttgaaagtgggagaaacagtagcttgtctctgtgcaggtggcagcaacccgcagagctgcggcaagggcaagagaaccgctggggcagccttgggatgccaggaggggcgggctcagtggagggtctggctggcccaccgaggccagcgtctggcagtgatgaaggtgcagagaaggtgggggccctcccaggaagcccctctgggataagaggttagcttatctattgtctgtggaaagaaaacttaaatagagttttcttttttaaaaaagacagcacaagtcagtcttctggtgattgtaacaggatggtcacctgagaacagtcatctactgacaccctgaaccagaatctccagaaaagacagaaattttgaaacagcagcaacaacagaaattcatgatgtgctaggagacagggatgactgcagtcagaggaccagatgtcttgattgattattaagagagagaaacaggcgatgtttgtggaatcacatcaccacagaagacatgcagacaggcctaatgcagagaagagtggaagttaggacgctcagcgcagattaatggactcagggagttggagagggctggctggcagcacttactcagaggagcagagccaggtatccccctcaaaccccccggctttgggcccaggcagtcagaagttgtgtcggggccagccaccaactccagtgagggacagggagccacttccaggagatgaaacattgtcacatgcagtccaaagacacccctccttctccctgctgcaacacccgaggctgaccaaagtagacaggaacagtatccaggatgagcaaaccaagcctctctaaagcaaaactgccaacaagctgggaaccacagcacgctggagggaaaccagcagcaggagaaagcagcagcaagcacagcagaaagaagacgtggggccgccttccggacggagactcggtcagacacacggctccttcaaagggagtgccaaaggccttgaagagtagacggtcaaagtggcacagccaggaaagcaggactcacagaatgggcagcatgaagagttgcatagccacggactattgagaacgcagacccagaactgttaccgcactcagacgtcaaaaaccgagagctattcccgagcacagaccgaggaccagcgagtccaggactcgctgatgcagagctccaggactgacaggcggggagagcgagaggaaaagctgaggccaagcgcgatgctgagaagctccatattctgtttaacaggagtctgaggaccaggaaagagagaatattgaggggaagataatggagacatcctagaagatcgtctccccgagcacagagcgcatcacaggactgaccagtattgagtgggcgcggggaaaacatggctgccaggacctgtgaggaccgagtttcagatactgtggacagcggagactccacaggggctctgcaggaggagacgggaggcgatagcccctgcaaagctctggctggtgattggcatcagacttctcaatgagaaactgtactctagatttaattagaacagtatcttcaaaatactcgggaaaaatgatttcaaacctggaattgtagacacagacagactagaattcaaattgaagggcaaaggaaaagtgtcttcagatagtgaaggactcagaggttaccagcctcatccctaataccctgacaaaactaaaaaaaagacaactatctatgaaagaaaacaagttttgattccacaaataatggagaggaaagcatccagtgtaacatgtactagtctaaatcactgttggtgtatattggtatgcaaattaaaatactatttgaaataaaaatctcaagcatatgtatctgtataatgatgagaaggagaaaaatgaaagcttactaaacttcagggtttttttcaggggaaatttatagatgctactcacgcccgtagtatagaaatgaaggcttaaatggattaatgatttacaaggaaccattgtaaatgatttacaaggaaccctggctctacagaaaatttacaaattagctggatgtagtggtgcgtgcatgtagtcccagctactccagaggctgaggtgggattatcgcttgagccgaggagtttggggctatagcaagccaagaccgtgcctctgcactccagcccaggtgacagaatgagaccccacctctaaaattaagtaaataggagctccctgaggaatagggacagatgcatgacttcacatcttgaacaggaaaattttcagaacgaagaaaacctcatcaattcaccaaaaggtggagtagaatggaaaacatttgaaatcatagaaaatatataaggcaagacattaattcaaatatgaggttagatttctctattaaaaggcagacctcagattgtcttaaaaatgacccagaggccgggtgcaatggctcacgcctgtaatcccagcactttgggaggccgaggtgggcggatcacaaggttaggagttcgagaccagcctggctaacacagtgaaaccccatctctactaaaaatacacagaatgagccgggcgtggtggcaggtgcctgtagtcccagctacttgggaggctgaggcaggagaatggcgtgaacccgggaggcggagcttgcagtgagccgagattgcgccactgcactccagcccgggcgacagagccagactctgtctcaaaaaaaaaaaaaaggacctagaaacagagaatttgttaatgggaagggcactgagcaatgccagccactagaaagcagaccagcaacgacattttcgtgaaaaagatgaaaggcattaaatgggacaaagatacttcacgtttataatcctctaagaagatacgatcattgtgaacttttatgtacataattacatagctgtgaaatttatgtagaaagaaattctaagaataagagatggattaattcagtaccataatgggaaatttcaattgacaaatcaaagggaccagaatgtccgtatgtttacgaggaatttgaatagcattcataacccactctctttttggaaggggacacagaggacacttgtcttcttctttttctttttttttttttcccctttcctttcttttctttaccttctctctctctctccaggaccattcacaaatatctctgccatgtatttgattttatagaaaatcttaattttcaaaagcagaaatcataaagtgcagtaaaagtggaaaaaaacacaaaatgatagccaaaagtaacccaggcgtcattatatacttgggaattttggaatgcctttaaataaagcatactgattaaaaagtaatgaaagtgagagaatgttgcacgtcaaacatgagggatgccacaaaagcaattctcagaagaaaatgtcagaaaaccagaaacatttacaatgaatgaactggccatatgactctaaaggttagagaaagacttaaaaccaattcaagataaagtaggaaaaatgaatgaagataaaatagaggttaatacagtagagcatggaaacttattgcttggtgcaataaattctgaaaaagaatcaataaaatacttaaactgttagccacttcgatcaagaaagagaaggtgtgaaaccttaaaacttgggaaacaggaaaatagataccactgcaggtaggaagctgttaacactctaagagactgctgtttacagcctctgtgcaaagaaatttggaaatctaagtgaacagttttctacaaagatgtaaatcaacgaaactgcctcaatgtatgtaatgagtctgaaaagacccgtaattgtgagagtgattgaaaacgccagtcagagggctgcactctcacaccacctgacgatcccctctgcaggtgggtttcagcatgtcccaaagggagggtcatgtgtgaggtctataaaccatgctggtgtacagaaacaacaaaacttctccaagtcatctgatgagctcagcaatattgtcatgtagaaattgtgcaagaattgttaaaaaaaaatctataggtaactgtaccctcagaaaacagatgtgcaatcataagtaaagtgttagaaaattaaatccaacctgcacttagttttaactgtttttattttcatttaggaagagctttttacaatttggtttggaggttttgctgtgtctcctgcctcagtttcctctttgggatgctgttcacatgtgtttgcacttccttgtctgtcttctgtatgtatcacttctcttgaattcttttcattgcttttttaaaaattttttaaagtttccattttttgtctgttgtgtttatttggtctttttgtgtcttctaatttcatctttatttttgaaatatttttctttctattcccacatattttctagttctgtgacctcagttgtttagtttttctaattctgatttgtattttttcaccttttgcaccattaatgccttttaggcaattaacaaatacttgattatggtttttgtcttttttgttagcatgtttttatggtgtgtttattgtcagtaaagatgttatttagtttcttattttcttttgtcttttaaaaaactttgtatggggtttgaattgtgtgaaatttgtttcccaaacctcttagaatggaagcatgatttataatagcatttctaattacatagctcttgaaggccctcttgtgttatttttatataaagtttaaatacgagggcttaatcaatgaatttgtaatgtgtctggggacaggccatggagaatcagccgagaattaggtggtaatactggctcagtgctcatgttctgattttgatcattgcactgtggttatctggatgttgttttggggaaacacatggtacagtatttggggtgaaagagcgtggtgtatgggcctacagagatagtaaatatgtggatggacagatgtatggatccgtagagaaagtgaatgtgaatgctagatggatggatgcatgaatccataaagaaagtgaatgtgtgcatggatggatgaatgcatggatggacgaatgcatggatccacagagagtgaatgcgtggatggacgagtgcataggtccatagagagagtgaatgcatggatggacaagtgcatggatccacagagagtgaatgcatggatagttgagtgcgtggatctgtagagagagtgaatgcgtggatggacgagtgcatggatccacagagagtgaatgcatggatagacgagtgcatggatccatagagagagtgtaatgcatggatagatgagtacatggatccgtagagactgaatgcatggatggacagatgcatggatccatagagagagtgattgtgtgcatggatggatgaatgcatggatggatgaatgcatgaatccacagagagtgaatgcatggatggataagtgcatggatccatagggagagtgaatgcatagatggacgagtgcatggatccacagagagtgaatgcatggatggacgagtgcgtggatccatagagagagtgaatggatgtgcatgtggatgaatgcatggatccttagagagagtgaatacgtggatggacagatgcatgtatccatagagagtgaatgcatggatggacgaatgcatggatccatagagagagtgaatgcatggatggatgagtgcatggatccatagagagagtgaatggatgcctacatggatgaatgcatggatccatagagagagtgaatggatgtgtacatggatgaacgcatggatctgtagagagagtgaatggatgcgtacatggatgaatgcatggatccgtagagagagtgaatggatgtgcatgtggatgaatgcatggatccttagagagagtgaatacgtggatggacagatgcatgtatccatagagagtgaatgcatggatggacgaatgcatggatccatagagagagtgaatgcatggatggatgaatgcatggatccatagagagagtgaatggatgtgtacatggatgaatgcatggatccatagagagagtgaatggatgcgtacatggatgaatgcatggatccatagagtgaatgtatgcgtacatggatgaatgcatggatccatagagagagtgaatggatgtgtacatggatgaatgcatggatccgtagagagagtgaatggatgggtacatggatgaatgcatggatccatagagagagtgaatggatgcatacatggatgaatgcatggatctgtagagagagtgaatgcatggatggatgaatgcatggatccatagagagagtgaatggatgcgtacatggatgaatgcatggatccatagagagagtgaatggatgtgtacatggatgaatgcatggatccatagagagagcgaatggatgtgtacatggatgaatgcatggatccatagagagagtgaatggatgtgtacatggatgaatgcatggatctgtagagagagtgaatggatgtgtacatggatgaatgcatggatccatagagagagtgaatggatgtgtacatggatgaatgcatggatctgtagagagagtgaatgcgtacatggatgaatacatggatccgtagagagagtgaatggatgtgtacatggatgaatgcatggatctgtagagagagtgaatgcgtacatggatgaatgcatggatccatagagagagtgaatggatgtgtacatggatgaatgcatggatctgtagagagagtgaatgcgtacatggatgaatgcatggatccatagagagagtgaatggatgtgtacatggatgaatgcatggatctgtagagagggtgaatgcgtacatggatgaatgcatggatccatagagagagtgaatggatgtgtacatggttgaatgcgtggatctgtagagagagtgaaagtgtgcatggacgaattcatgacacacagatgggccggaatataagtaattggataaatgaggtaaaggatatgtagatgttctttttaatgcttgtacacttttttcaaggtttgaaattatatcacaataacaagttgtccgatgagtacagtagtccccctttgtccacagtttcactttctgtgatttcagtcacccatggtacagtatagtgagatatcttgagagagagagaccatatttacataacttttattatggcatattgataaaattgttctgttttattattgttaatcttcctctgtacctaatttatacattaaaatttatcataggacagtttataacagggtttggtatagtccatggttccaggtagccactgagagtcttggaacgtacccctcttggataaggggggagggctgcagaatgaattcttcagccttctcctcagaacagatcttctgcaagactttggcagatgatgctgtgaccccggtgtcacaggccaggtggacggccaggccaaggtatccgtgcctggtcctgaggggccaggcacgcgtccacggcagggccacccagagcctggggtgctgggaactgggctttgttttagtttctcaaatgcttttctcaaactggaattttaattacaacaaaattaatgccgcagaatatgattaaaaaataatgagctgagaacaagcagcctcttgaggtgatgtccctgtggctgagcccaggaggccttgatgcgggcagaggctgtgctagcttcaccaggttggcaccgggctctccaatgcctggttgctggtggcttggacagctgtcggggagggtcctctcagctcccgcgccctctgcccacagcttgttctctcactgtgagaaccacccagtgatggttcttgtgctgttctctcttcatgaatcatggcctggcttccgtgcagctgcctttttggaggaggctgcaggagcacagagtaatggctgcaggtggggccttccagaggcacaggctgaggggccaggcagcagttcctctcttgcagctttttcttgggagcaccgggccaagccagaggctcctggcagatccacccacagagacagcaggtccaggtcagggctacccctcgcacagcccagcaggatgtgggagcaagcctgtgcgccctgagccaggccttctgtgaagtgcagatgatgtcgcctttgtagacaaaggaagagaccttggaacctgagggtaaatggagaggctctttaccagcactgaactctgagcccaactggctccaaacaggcgtgttgtgggcgtgtcctgaggtgtgtgcctgacctgaccctgaggccccctccctgccatgcctctaacccacccaacaccaccagccttgctggtgcctcctgccctgccctctgctctcagctgcctgccctggtcacctgccaccccttcgtgctgggcccttgggccaagcaccgcatgcagcctggtgcacacctgtgccctcctgagcctgggtgaggtggccctcccacctgggccatgtgcctcactatgcctaggccacagcccgggagggaggatgtctttccctgacctcgtttgtgtggccctggtgcccaatgactgactttccttctgctcccagccctgcatcctcctgggagatggggtgtttgagcatggggttcccgcctcctcctccaagtgactttccttctgctcccagccctgcatcctcccaggagatggggtgcctgagcatggggttcccgcctcctccaggacttgttgcccgttctgcgtggccacccgttcttgccagcatgcccactcgctctgaccttggaacgtgctctgctatggccactctccaactctggcaatggcaccagccatcattctatcacctgtgacttccccactcacccgtcctgtcgtgccacctgcagcacccacagcctggctctcactgccactgcgtcctgtgggagaaggtcacatccacttccctgtgtggatgggggtgtcatgaggaccctggagtgttctgatggccagccttgtggggaccctggctgctagccttgccttagctgctcctctgtccccactcacagccccggtggccagtctgtctgagtcctgcccttgtctacccacctcctacaagacagccagtgtctgggctggcccctccctgctggctgcagggcccctgggtgcacaaggagctgcagaggagcagatggcggcagctgaggcagccacagggacagggccacagacacactcaggttccatggccttggtacatttgctcttcttgacatgggtttcagagaggggccaccatgccatgcccacagcgtctggccaggtgctggtcactgacccatcttcacagcatctggccaggtgctggtcactgacccgccttcacagccgcacttgttgtgacatacttgattcagtagatcctcctggatgcactctgcttatatgccttttgctcattttctgcctttagctgcagtattctttggaaggaattctgggcagtatgtgctgttcagatcctgtcactgcatttgctaatttgttgcattagcaagtatttggcttgtgcatgcaagacaaggttaaataatccagtgtggaaatagaaaaacagtatgtggagatccaaacccatataattactccccatgatctactcagtttaatcagattctgcaggttaatcatgtttgtgatctcatggtgcacatccctcccgaacatctcagcgtcatcagtggagccgctcggttgtcctgtgacactgactgtccctctgtggctctcggggtctcccctcctcttccttgagggcatcgtcatgattcagcagtgacttctgggctgggtggttagcggggctccctcctttaccctcagaccccttggatgccatcctgggcagaggccttggcccagtgcaagctctttctgcccacattctcctggtagcggctctgcagctgggcgctgtttctgccctgtcatgcaagtgggctgggtgcagaggctcacagctgggtgctggggctgggggtgagctagctgtccggcccctgcgtcagcaccaccccttgctgtgttcctgaagcgtcctgtcttccatggtcaggatgctctttcaagacagccctgatggcatcacctcccttcactcgcctcttcttagcttgttcattaaaaacaattgtacttactgagtgcctacgttgtcctgtgcccgggctgcccaaggtggtgtgagtgtcagggcacgtggcccagagggctctgcagagacggctctgagagcaaaagtgagccatgctggagaagggacaggagcccctgggagacgtaagagatggggacaggctgacggaggaggaggaccgggctgggggaggatggtggggctctaagcagggcaggaggtcagattgtgtgtttgggatgttcctctccttcatggggaggagaggccctgagggaggcaggagcaggaggggcatcgtgtccccaaggaccccaggcagggcctccagggctggtgctgggaggaggcagggatgggaagggtccccgagggccctgagcagggctaaccctagggaaaccacacacaggccacggagggaaaagcttttaacccttgtcgtgtataaacgactcactaggtcttggtgcatttttcattgatactcatatatttactgttgaatctctttgagttctttttaatgatttttcttgttttcaataaaaaataacatttcccgtctgcattgtacagtcataatttgaaaacaaaaattgttttgttgtgcaaacacttgttctgattctttatctattcgttggaagtcagtcacaaagcaacttgagaaaacagcctgtctctgcctccagcctggtgtgcctgcagctgtgtgggtgcgtcccctcctcactttctcagcagaggcagaggctacagtctgagtggcagagcccacctttctgctgggggtagtggccatgcaagggtattggtgtgttttttgcacatgcagctggccatgctttaaaataagcagattgacctttgtttacctttcacccccagaatggtttggtcaatgacagcagccatttttattgtttttattgtttcttttctgtggtggtgaaggtggcatcccctcctagcagctgcacactggggtggtcctgaggaaaggagggcgagagcagagcttgggggcgggccatgaggggaagtccaggcctctccacccaaggatgaccctttctccaagaatcctgcagtctgttgttaggtcgggaaaaagccgtggtggttttatactgccagtgccgggagctttcccatgaagtttaaatgcaaacaggacactgagggcaggaaggtgtgctgagctgccctgcacagtgcttggctctgatgcccaccccagggtccctgggcactgccaagctgggcatgaacctggggtaacccagaggaacctggagcagtatgggctccaagaggcccctgagcttctccaggacccagatggtgacagcctggaacatggcttccccgtggcctcgctgccatagtcaggcctcgggaggtgaccctgtgccagggcaccggatggcccaggtcctgctggggtgggctgctgagtcccttcccatgaatgttgttactgtgctgtatctcacttgtgccctcgctgagatgaaggacgcctagaccttagtgcaggtgccttgggggcgtcctggcactgaacatccttgagacatctgtggtgcttctcttcctcatctgtggtgttgtgggcctccaggggaggtggctgtctgcctggaacaggaggcccagcccacaggtgcccactgcctgctgccgcgcctccctctctgctgcccgcgtggctgtagtgttttttaccccattgctgtttcgcttggcacctacacgttggttccctcctgtgcaccgggctttgtgctgcaggctctggcgtgttcacagtactcctttggagggattctgtttttagaattagtggtacaatatcttgtcatcttggtaacttattattaataaaaatggtataaaatgttttgcctcctagtgcccacaccatccatgtagattatattgatttactccagctatttgaaaggctttgaggtggtgtacaatatcaaaccatgtgaaacagcacgattaactggcaaaaccaaaagccatggaaatgagccggggagcttactgaagatcctagtcttgggggagatgtttggtgaaaatgtgtgcatttgcttatgaaagacttgtatttattctgcacccccctgaccctgagtgtcccttggtccattgcctgggctctgttgtccttaccaggactgctgcttccccagtccctgctgtcctgctgatgtgtccacgcaccaggcattcggctcctgaaatcacagtgactttcaggagtcacttgggttgtagtgttggccagttttagccacatgaagatagtttctgaaacctcctgtgtgtgaatgacggttttcaccttgggcctgtccttctgctgccaccacaagcaggaggggtgggaaggaaggattgcccccgagagaggcagcacaggaaggccaggccgtgttcctgggagtcaggcttaccagctcagagctgggcatggttgaaattctaaccctgccgtggcaggccctgtgcttttgtgaaatgggcctcacgggagggtgtcagtgacgtagataaaggcttcccactgcctggatgctgtgaccgcctgatcccgtggtgatggcacagccctgctgtggggagagccgtgcagccccaggccgtgtgtgggaaggcctgtgccactctgggcatcgtcatcttgggccatggctaccacatatggcgcttcctagccgggcactatgccacagccacacccctgtggcctggcccccatggcagggtctaaggctgttccccggaagcctaccttctataggaagaggcattcttgtgtgactctctggtcatttgcttgggggagctgaaaaccccccaggtggtgtctgggggggaaagtaattggaagattatgggtgggtgtgactggtaacaagcaggggtttggcaccccccttgcccacctgccctgtgtgctgggccgtgcggaggtggccatgggcagcccttccttctggagccccctgtcttcccttatccactgcctcaaggttcccaccagcagagtggggccacctgggttggtgccaacgaggtgctcagaggccttgtgggcagtgtggcagaacggcacatacaggtgcctaaaatcgagctaggggaccttgaagataatgcttcctgtctgcttttgtgtcaacagttggggcaagcacattttcacagggagagtgtgactggaaggaccagccgttgctgctggcagctcatccctgcacctgagcttgcaggcatgctcctgtctttctgtggtggtaaaggtgacatcccctcctagcagctgcacactggagtggtcctgaggaaagcgcgctcctgtctttctgtggcagcgaaggtggcattccctcctagcacctgcacactcggatggtcctgaggaaaggagggcgagagcagagctgggggggcgggccatgaggggaagtccaggcctctccacccaggagtctgtgaggttcccattgcatgagaagatggaggagcctccttgtgctgctgtgtctcagcattagagagggcggtccacacgaatgtcatgttgggatgttttttcttcagcttctgagtcattgctgcctccagggttatcactgggcagagagcaggtgtgatgtgtctgaggaccagcagctctgcacagagtgtggaagaccccagcaaagccacccggctgcagaatcgcagaatcaccctcgtggcaggcttggtgcggacaagtggctgtactcccgtgctggatggaacggcggcctttccgccctttggccaagtgcatgcagagactcgagcagggtgggagctgagggctgctgccagctacccctcactgcacagaaagggaagtggaggtgaggccaggagacgtgttcttcctggagtacagggccaagtcctcctttcttctcagatccactggcacataaccgcaccctggctcaatgtggccctggatgccttcagaacaatatggccaatgcagtcctcctacttttctctgtccccttttcttatctcgtatttttactctagaattatgctgggaaaataaggcttgaagttctctcatttgtgtagcactttgcaaattacagagtacttttcacaaccttgaaaggtgggtatttcatcgttcttttttagaatgaggagctgagtcatggggaccagccagggcctctctagtgaagagtcctccacaaagcagaccccaaagggccagggacccaggccgcagagtccccacaccccacggaacatctctttggggccaaggagcagcctgcattcagaattccacttctggtcccctcacccagagcactgaggcactgggctctgccctctccagatgccggcctccctgccttgctcttgttctttctcatcagatgctccgagctccttgtcattggctcctgtatgcagcactcactctctgtggacactgcacactccaggatttagaaaaacccttgtggcttttcattaattttatatttgtgttgcattgcccattttcctttcaagaaagtcagctttaaaacaaaactgatttctgctatttatgacaaacccacagccaatatcacacgaatgggcaaaagctggaagcattccctttgaaaactggcacaagacaaggatgccctctctcaccactcctattcaacatagtattggaagttctagccagggcaatcaggcaagagaaggaaataaaggatattcaaataggaagaaaggaagtcaaattgtctctgtttgcagatgacatgattgtatatttagaaaaccccattatctcagcccaaaatctccttaagctgataagcaacttcagcaaagtctcaggatacaaaatcaaagtgcaaaaatcacaagcattcctctacactaataatagacaaacagccaaatcatgagtgaactcccattcacaattgctacaaagagaataaaatacctaggaatacaacttacaggggaagtgaaggacctcttcaaggagaactacaaaccactgctcaaggaaataagagaggacacaaataaatgaaaaaacattccatgctcatggataggaagaatcaatatcatgaaagtggccatactgcccaaagtaatttatagattcagtgttagctccatgaagctaccattgacttacttcacagaattagaaaaaactactctaaatttcatatggaaccaaaaaagagcctgtatagctaagacaattctaagcaaaaaaaacaaaaacaaaacaaaaaaaaaacctggaggcatcatgctacctgacttcaaactatactacaaggctacagtaaccaaaacagcatggtaccaaaacagatagatagaccaaaggaacagaacagaggcctccgatataatgccagacatccacaaccatctgatctttgatacacctgacaaaaacaagcagtggggaaaggattccctatttaataaatggtgttgggaaaactggctagccatatgcagaaaactgaaactggaccccttccttacaccttatacaaaaattaactcaagatggattaaagacttacatataagacctaaaaccataaaaaccctagaagaaaacctaggcaataccattcaggacataggcatgggcaaagacttatgactaaaaccaaaagcaatggcaacaaaagccaaaattgacaaatgggatctaattaaactaaagagcttctgcacagcaaaagaaactatcatcagagtgatcaggcagcctacataatgggagaaaatttttgcaatctatccatctgacaaagggttaatatccagaatctacaaggaacttaaacaagtttacaagaaaaaaacaaccccatcaaaaagtgggcaaaggatatgaacagtcacttctcaaaagaagacatttatgcggccaaaaaacgtgaaaaaaagctaatcatcactggtcattagagaaatgcatatcaaaaccacagtgagataccatctcacatcagttagaatggcgatcattaaaaagtcaggaaacagcagatgctagaggggatgtggagaaataggaatgcttttacactgttggtgggagtgtaaattagttcaaccattgtggaagacagtatggcgattcctcaaggatctagaaccagaaataccatttgacccagcaatcccattactgagtatatacccaaaggattataagtcattctactataaagacacatgcatgtgtatatttattacagcactgttcacaatagcaaagacttggaaccaacccaaatttccaccaatgataggctggataaagaaaacgtggcacatatataccacggaatactatgcagccataaaaaaggatgagttcatgtcctttgcagggacatgggtgaagctggaaatcatcattctcagcaaactaacgcaagaacagaaaaccaaacaccacatgttctcactcataagtgggagttgaacaatgagaacacatggacacagggagaagaacatcacacaccagggcctgttggggggtggggggctaggcaagggatagcattaggagaactacctaatgtagataatgggttgatgggtgcagcaaaccaccatggcatgtgtatacctgtgtaacaaacctgcatgttctgcacttgtgtcccagaacttaaagtataaaaaaagtgatttctaagagcgcttttcatttgtgactttctgcctgtatcatttcacaattatataaatattggacgacttattgtagtaattatctttctgcatttccatctctatctagaatttatttcgatgactctatacatcagggttcagttaggaaaaccatttccactccacgcatttaaagagagcatgttgagtacagagagttgattagaaaggtgatgtagggctgaggagtacgggagataaagagggggtgtgcgagcaagaggaggaaggggctcactggggctggagttgctggtggttctgggctggggcctgtcagcctgggccggctgctgcgtggggagcacaatcgtgctcggctctggatccacgtggaggagctgatctgagcagggcttgactctcctaaaaggagctgccccgcttcccccctgccgctgccactacagcagctgctaagtgcggcagatgccagcagctgctatgctgcgatccgggtcggggcaaggccctctgtcctgctgcctcttccctgcatcatctcccatcagagaccctcacaggaagccaactgatgaggtttggggggcagaattctagggggtcctaaggcttctgctctctggtgtacaagccttgcatacacacatcctcttgagagtgagtgggacctgctggtaaggtgggacatcacccctgtgattatgccatgttacttggccaaggggttttgcagatggtatcagggtttctaactagttgactctgaaggatcaagcacatcaataatcagggtgatgtcactggaaagcaaattttagcctaatagaaaaaagatttattgtgaagttttatgcacagtattgaattttgtcaaatgcatttttctgcatctattgaaataataatttactgccttatcatgttaatatggtaaattacatattgccagattttgcaatatataaccaattttgcattcctggtgtaaaccctacttggtcgtgattcgattctgtgtgtgtgtgtgtgtgtgtgtgtgtgagagagtgtgtgtgacagagtctcgctctgtggcccaggctggagtgcagtggcacgatctcagctcacggcagtctcagtctcctgtgctcaagcagtcttcacaccccagcctcccgagtagctgggagtacaggtgtacagggagtacagggagtacagtacaccatcatgcctggctaattttttttttttttaatagagatgaggttttgccacatttctcaggctggtctcaaactcctgggctcaagcgatcttcccacctcggtctcccaaagtgctgggattataggcgtgagccatctgtgcccggccaatttttggacttttttcactaatattttggtaatgattttttatagctatggtcatgagagacactttcatttttctcatctctgtgtcagattttaaaaccagagttatgcttggtttacgcaatgactttggaattattccctcttccctgttttctgaaagggtttgtgtaagattggtgttgttatgtctctatgtgtttgacagaatttgccggtgccttgagtcttcttgtcgggaaggtatttgacaacaactttcattttttagtttctatagagatattcaaatttccttttacagtttgtatcaattttggaagctgtagttttaaaatggccccacttcatctaaactgatacatatgttggtgtgaagttggtcatcataataatctcacattatcattttaatatctaccggatcagtactgacaacttgtctttcatatcttttgtgatttttgttttctttttctcttggtctaggtgtttttccatttttttgtatttttatattaaccttcttttctttattttgtttactgtttgttcgctgtgctttcatcagtctccattcctatttgttatttcctgctgcatttgctacatgtggccaccttccaacatcaccacagactccatggcttacagcacaagctcatcacctttcagttctgctgatgagagccccgacagcaggaggccccactgggctctccgcagcagtgctgcatcccttctggaggctcacggggaggactcacctccttgcctcttccagattctagaagtgctcccgttcatctgctcctgagtcctcctccacctgctgtgtcagccacaggacccagtttggaaagattctccacttttaagaactcaagtgattagagtggccccacctggataatccaggataatctcgccattgcaaggcctgtgaccttcatcacatctgcacagtccctttgccacagaaacagcaaacacatttaggactgttacatcttcttgataaactgacccttttttattgtgaaacatttccctttctacctgctaatattcattgtccttacaccagctttgtctggtattgagacatgttggcttgctaggatcagtatttgcatgccatattttttctcattgttttacttttaactgtctgtgcctttgtatttaaagtgtttctctaaaagtagcacgtgctttgagtcgtgcttttgttatcttgtctggcagtacatttttaactggagtgttaaatctgtttacacctattgtaataactgatttggttgagtttattcttccttcttcttatatgttttttaattgtccctctcttcttttatagcttttccttttcctgccttaatatttatcagttattccttagaatttcattttatttcctctttatcttttagctctgctttgtatttttgttgttttaaaaattttaatatacaattttatcattgttcactcaaacttatattacaccttttcacatttactatgaggaccttacaacaatatacttccatttaactgctcctttttggggaggtcgtgttgccatataattaacttctgcacatgctatcataagccagaaggtatctggtacaggtctcagtcaatttagaggtttattttgctaaggttaaagaccatgggctatgacacagcctcgagaggtcctgagaacatgtgcccaaagtgtgggttttatactgttttctgtttttgacactctgtactctttctcacggatctgagtttccatctggcatcattttcttcagtctgaaaattttcccttaacattgtgttgttgtcgtttttgagatggagtcttgctctgttgtgcaggctggagtgcagtggtgccatctcggctcactgtaatctctgcctcccgagttcaagcgattctcctgcctcagcctcccgagtagctgggatgacgcccaccaacacacccggctaatttttgtatttttagtacaaaccgggtttcaccgtgttggccagaactgctggcctcaggtgatccgcccgcttcggcctcccaaagtgctgggattacaggcgtgagccaccatgcccggctgtgaacattttttgtagtgcagttctgctaggtatgaattctctccatttttattgattgataattttgatgatgtctttattttgccttcattttgaaattctctctaaaattttaggttagaggttttgggattttttgcccatatgtaatatgtcattcctttgcctctggcttccactgtttttgatgagaggtcattccttaccctgttcattctctttgtgcaatgtatttttttcctattgctttgaaaattttctctgtctctgattttcagcagtttgactagaatgtgtgtgtatatggttttcttctcttctgtttttttatgggagtttgttgagcatctttatatgtgtgattgacactagccatcaaatttagaaaatggttagccatcatatttaactttttcccatttcagtctttcttctcttctgggactccagttaaacatattttagaccactcactattgtcacgcaggtctctcaggttctgttgttttatttttaagcttttttttatctatctgtgcgtagtttgaatagcgtctgttgatctgtagttccctggttgctttgtatgcagtatgtgttctgctgctaagtccatccagtgaattgtcttctccgaaatttttatttttcatttcttgatttctagttggctcatttttatagtttcccttttcttccttagatcttctgatgagttcactcattatgttcagtttgttcagtctgcctttcattttcttttttggaaatggagtctccctctgttgcccaggctggagtgcagtggcacgatctcagctcactgcaacctctgcctcccaggttcaagcgattctcctgcctcagcctcctgaggagctgggattacaggcatgcgccacaacgcccggctattttttgtattttttaaatagagatggggtttcaccatgttggccaggctggtctcaaactcctggcctcaagtgatccacctgccttggcctcccaaagtgctggtattgcaagcgtgagccaccacacccagccttcctttaattttctaacaaatttataatagctcctttaaaagtacctgcccaataaccccaatgtgtctgccatctctttatttttatggactaaatttgttttctgatattggaccatgtttttctgcatctacatatgtgcagtattttttgtttgtatgatgttcattggatagtcgtgcatcgcttaatgacagggacacatgctgagaaatgtgttgttaggcaatttcctccctgtgtgaacatcatggtgtggacttacacaaacctagctggtgcagcccactacacacctaggctgtatggtacagcctattggtcttaggctacaaagctgtgtagtgcatgactgtgctgaatactgtacgcagttgtgacacagtggcaattgtgtgtttaaacacttcgaaacatagaaaaggtgaagtaaaaatacagtataaaacataaagaatggcacacctgggtagggcatttatgaatggagctggcaggactggaggttgctctgggtgagtgagtggtgggtgagtggtgagtgagctagtgagtggtgagtggtgagtgagctggtgagtggtgagctagtgagtggtgagtgagtggtgaatagtgagtagtgagtggtgggtgagtggtgagtgatgagtggtaagtggtgagtgagtggtgagtggtgactgagtgatgagtggtgagtggtgagtggtgagtgatgagtggtgagtgagtgatgagtggtgagtgagtggtgagtggtgagtgatgagtggtgagtgagtgatgagtggtgagtgagtggtgagtgatgagtgatgagtggtgagtggtgagtgatgagtggtgagtgagtgatgagtggtgagtggtgagtgatgagtggtgagtggtgagtgagtggtgagtgagtggtgagtgatgagtggtgagtggtgagtgagtggtgagtgatgagtggtgagtgatgagtgagtggtgagtggtgagtgagtggtgagtgatgagtgagtggtgagtggtgagtggtgagtgatgagtggtgagtgagtggtgagtggtgagtgagtggtgagtggtgagtgagtggtgaatgatgagtgagtggtgagtgatgagtggtgactggtgagtgagtggtgagtgatgagtggtgagtgagtggtgagtgatgagtgagtggtgagtagtgagtgatgagtggtgagtgagtggtgagtggtgagtgatgagtgagtggtgagtgagtggtgagtgagtggtgagtgatgagtgagtggtgagtgagtgatgagtggtgagtggtgagtgttgagtgagtgatgagtgatgggtgagtggtgagtgatgagtgagtggtgagtggtgagtgagtggtgagtggtgagtgagtggtgagtggtgagtgagtggtgagtagtgagtggtgagtggtgagtgagtggtgagtggtgagtgagtgatgagtgagtggtgagtgatgagtggtgagtgatgagtgagtggtgagtgagtggtgagtgagtggtgagtagtgagtgatgagtggtgagtggtgagtgagtggtgagtggtgagtgagtgatgagtgagtggtgagtgatgagtggtgagtggtgagtgatgagtgagtggtgagtgagtggtgagtggtgagtgagtggtgagtgatgagtgagtggtgagtggtgagtcagtggtgagtggtgagtggtgagtgagtgatgagtgatgggtgagtggtgagtgatgagtgagtggtgagtgagtggtgagtgatgagtgagtggtgagtagtgagtgatgagtggtgagtggtgagtgagtggtgagtggtgagtgagtggtgagtgatgagtgagtggtgagtagtgagtgatgagtggtgagtggtgagtgagtggtgagtggtgagtggtgagtgatgagtgagtggtgagtgagtggtgagtgagtggtgagtagtgagtgatgagtggtgagtggtgagtgagtggtgagtggtgagtgagtgatgagtgagtggtgagtgatgagtggtgagtggtgagtgatgagtgagtggtgagtgagtggtgagtggtgagtgagtggtgagtgatgagtgagtggtgagtggtgagtcagtggtgagtggtgagtgagtgatgagtgatgggtgagtggtgagtgatgagtgagtggtgagtgagtggtgagtgatgagtgagtggtgagtagtgagtgatgagtggtgagtggtgagtgagtggtgagtggtgagtgagtggtgagtagtgagtggtgagtggtgagtgagtggtgagtggtgagtgagtgatgagtgagtggtgagtgatgagtggtgagtggtgagtgagtggtgagtggtgagtgagtggtgagtggtgggtgagtgagtgatgagtgaatctgaaggccaggacattactgtgcactgctgtagacttcataagtactgtacacttgggatatgctaaatttatgatataacaaaatttatttcttcaataataaattaaccttagcttactctaacttttttgctttataaacctttagatttattttttaacttttgactcttttgtaataacgcttagcttaaaacacaaacacattgtatgcagctacgccaaaatattttctttgtttttataagaatttttcatgtttaagatccccttccccttccccctccccgtcccctgcccctcccctccctctccctcctccccctcctcctccccttccccctcccctcccctcccctcccctcccctccccttttgttaaaaactgagacacacacacacactttagcctaggcctgcacagggtcagaatcgtgcatgccactgtcttccacctccacgccttgtcccgctggaaggtcctcaggggcagtaacaggcgtggagctgtcctctgctgtgatcacagtgcctgcttcttgacacctcctgagagacctgactgaggctgttctatgttaacttttttttttttaataaatagaaggagtacactagaataatggtaaaaatatagtatagtaaatacacaaaccagtaacaccatcgtttattatcatcgtcaggtattactattgtaagtaattgtacgagttacgctctgatgtgactggcagggcagcaggtgagtttacaccagtatcaccacaggcgtggggggagccagctgcactccttcctaaggaggccacagcgttgcagggtgatgggacttttcagctccattctaattttaagggacggctgtggtatatggcacgtctgttgttgcctgaaatgccgttgtgtggcacgtgactatatatgctacgctgttaagaatttggggtgttgtgtttgttgtttttggtttttatttctgcaggcatctaatttaccgaaacttcatgtcatggctcggtcgaactttgtcaaggaaagtcttcactatcccttcctctagaacttaacgttgtcctcctcctaaggtgtagcctttcatgggtctcaagtgaacaccctggatgctgagtgaggggcctccactgtggctgtgagcagtccccgcctcgtggtaccacatgacatttagcgtgtctgttcacctcatactccccagtagttctgtctctctctgccattcctcatggagtccttgcgtgcacagcatagtatttggccaacatcttcctgcagtttgggggccccgtctcctcttagctcttgcctctgctgtccccatctcccatattccagctgctgccgcagcccccatgcttgccttttgtcctcagccccccagcgaggcagcagcttgtgtgtgtgctgcactgccgtgagcagcaacttgacagtggacgcagctagaaagcagccggcgaggagctcagcgtgtgtctccgccgggtgaaagatcacagtcctgcaccctgctgtgcaatgctcgaacacacttgcttcttatttctgtccaattcttaaggtttttactgtgggatcataagtccttactccttcatggttggaatcaaaatccaaaaccttgtggtttccattttcagttgatgatatccttatgaactcaggatttatttcacttttgaaaagttaatagtctttatgttttagggcaattgtattctacaatacagaaaaattattggaaagtatagagcgtgccacctcctcccctcatacagagcttctcctgttacgtacatcttgcctcaagtgtggtacagtcaatgaaccaatattggtacattattattattattttttgagacagagtctcgcactgtcgcccaggctggagtgcagtggtgcgatcttggctcactgcaacctccacctcccgggttcacaccattctcctgcctcagcctcccgagtagctgggactacaggtgcgtgccaccaagcctggctgattttttgtattttaatagagacggggtttcaccttgttagccaggatggtctcgatctcctgacctcatgatctgcccgcctcggcctcctaaagtgctgggataacaggtgtgagccaccgcgccggcctggttcattgttattcacggatggtcatagtttgcattggggctcactgtgttgaacacaggttttgacaagtgtccagtgacacgtgtccctgtcattactgtgtcatacagaagagctccactgcccccatgcgcttcacgtactcactcctcccgtccctgaagcccctggcaaccactcatgtttttattgtcactatagttttgccatttgcagaatgttttgtaagaaactgccacagttttgtaagaaactgccaaactaccttcccaagtggttgcatcactttgcaaactaaaatctctctaaccgtgagatctattagtcatgctccttggtatttactcaaaggatttgaaaacttcagcctacacaacaacctgcacacagatgtttatagcagctttgtttatcattgccaacacttggaagcaaccaagacatcctttagtaggcaaatgaatacaccagtggtgcatccagacagtggaatatgattcagcactacaaagaaatgagctgtcaaaccatgaagtgatgcggaggaaccttgaatgcgtgttacttagtgaaagaggccagcctgaaaaggctgcatgctatacgattccaactatatgacattctggaaaagacaaaactataaaaatagtataaagatcagtggttgccaagagttgggcggagagatggatgtgtaggtggatcacagagtacttttactacagggaaaatactccgggtgatgctgtaatggtggatgcgtgtcattacacatttgcccaaaccacagagtacagcaccgagcgtgagccctgctgtgaactctggacctggggggtggtgatgtgcccacatgggtttggttgtgactcatgtactgctctggtggcgggctgtgggggatgggccgtgggggatgggggtatataggaaatctctgtgttttgtgctcagtttgctgctctaaaaaataaaacctaaacaaagcagtcggagtccctgaagactgtcctgtgacagagcaggaagggctcccttagctctgagggaaagcgctggttatgtatttgctcttctcccaagaacacacagtctaattttgatcctctttacagacgggatgaagggcatgttcatcaagtaagcggatgcaggtgcagagaccacacctggcacgacactgccgttgggcaccccaaggccgaggccggcagccactgttgtccccagagtccatctggtttctagagtggaaaatggaaaggggtcaaaccgcccacgcagccctgaagtccttgatggtagtgtagattctacagtcttccccaggtgctatcttggctgaggtggggaaggctcctggggactgtacttggccttttctgccttaatatcctgctcaaggccggggccagagggcttgtctggcagctgctgggcgcctctgtccagtgctgtaccagaacgtctagcagatgggtgtgcgggcacagggcctctgccagatggactcgggccaagctccgtctgtcatgttaattgtgggtccatgatggtgtctgagtcccctggagtgggcaggagctcaggccccagacccagccattgtctgaaggtccagggcctggccactcactctgcccatcatgctgtcactccaggcagttactcaggcccgctggggaaggtggggtgaatgtttgctctacaccgcaggactgttgcgggtcttccctggagactgggtctccgtttcagccactggctctgacccatggaccagctcagacctcatctcctctgaagggagtggcgctggccttttcctggctctcggctatgtgtgggatgatgctggccttctcccggctgtcaggtgtttttggtgtgtccatgtcaagtgtatccgtcctgggaacacccagtccggctgccatggcagtgggcaccacgggccagcacacctttgctgcctgtgaggtcgttgcgcctacctggccccatgggccccattttatctcgtcgctttgctgtctgggaactttgtcacccacggataggagtgccaggcccaggaggatgtcacgcagtgttggcacttcagcttggctgctgttctcccacaatccttgtgagggcctgtgatgacccaggtcaggataggacaggtggcttgggttctgcgggccacacggtctgcagtgtgcgtggccttgacctggtgctggaaggcagctgcagaccacgagtcaaggagggggtgagactgtgctccggggaaacgtggattgtggatatgggcagccagcggggcctgcagacccctgggttagagccaagccccagaggcaccttggtttctgagaagccagaggagggagttcctgggacctgggggatgaccatggacctctgctgccacctcgtggcagggctgacgtatctgagccacgtccttttctcccggtttagaaatatcctggtgggaggcgctttttcatccttgcagcagacaggcagctctgttggccacacgatctgggctgtgtgccccgccttcagcagaggccctcaggaccctgcgggatacagcctcgagaggacagagcctcagactctgaaggccacagcagtgatagcacacctgtgtctgaggagtgcgttctgagaggagacccggcccctcgtccttgtccatccatgtggcttctgcaaagcacccttgtcttgcagagccagcgagcctggcgttgtgacctgggctaacttggtaccttttctctttttagaggcagaatcctttcttgagaacagcatctttcaactcttgacctgctcccccttcccggttcccactttttgcctggcaggctgggagggaccccctctcctgtgcagcctctccctaatcctggattccgcaggggctccaagaccctcagggtcgccagtgactcctgggtcacactggcccagcacacactgagctccagcctgatgtccagcccaggaggtcctcaactgaggtccagtacccccctgcaccacgctgtgggccccgcaccctcccccaactcttttctacaacactcttccccctgcaccgtgctgtgggccccgcaccttcccccaactcttttctagaacactcttccccctgcaccacgctgtgggccctgtgccttcccctaactcatttctagaatactcttccctgcctgcaccctgctgtgggccccgccccctcccctaactcatttctagaactctcttcctcacctgtctccctggttcttgttctggcttctccacgggaccctcctgtcctcccgtgtgatgctgactgctcgtgacatgttgcagcctgtctctgctcccttccctgctcttgtcacttcttgctggtgctctgtggctgtcatgcagactggggttggggttctgttccctctactgtactggagctccaggtcatgggaggcagcagagcccagccctggcccttcgagcttccgtcctgcaagcaccggcagtgtcagggaggcaccgcccaggggaggctcctccttagggtgcattgtcactcggcgtttccgacacctgctctcatcattttcctaccttctctttcctgacaacttagctatttatcagaccccaaaatcatgagccttgagaaatgatattccacatgctcatcctctggaggacacctggaactgagcttgcttccctgctcaccctgggaagtggtttcacaatgtccctcaacgtgtgactatcacccatagcctccggtatctctctgtgttcagtgtgaggccatttgctcgtttgacccttttgaaggtcaggagaagctggcaggactcctgcaggcacaggcaccggcaccgtcatcctgggagccatcggggtcctcagcccccactgcagcctgagcctttcctctggccgcactgtccatttctttagctcctcttttgccttttctggggccttctccggtgttctgcgttcttttaaatgtttcatggttaaaactggacacatcccccaagaagctataaatcaaccatagcaagaactgatctctttccaggtgactataaaaatgattttttaaaaatggttctttaaaaattgtcagttaagcagataacagacccaagacagggccaggagagtgaggggcggatatggcatgggacagggttaggagagcaaggggtggacctggcatgggacaggattaggagagcaaggggcggacccagcacaggatagggccaggagagcaaggggcggacccggcatgggacagggttaggagagtgaggggcggacccagcaggggacagggttaggagagtgagggacagggttaggtgcacgaggggcagacctggcacaggacacacccatcttggttgtgagtttctgactcttcttggttttggtgaccttgactgtcctgagcaggactaatcaggcatttttcaggctatccctctgctgggatctgtctgatgcttttctcatgggtacaggaaggggctatgagtttgaggaggaagcccccagaggtgaagtaccactgtcaccccatggtatcgggcacaccctgtcactgtgactcacatgtgaggctgacctgggccctagcggggggtaaggtcttccccctccatgctgtcctcttataggacatcggtctgtgcaacctaagggtgagataagattgtagttttattcaactcttacttttaaaattttacaaggactcacattgacgtagtgggtgagattagaattagactttttaactttctggcctaaaactgattgtactggcaccttttgtgaaatgacctctgcagtccccatgacccctcaggtcagtcacctctgttccctgcatgtcgtcctccccagcgcccgctggcatggctgctctgctgtgccaggaacacagggtttcagagtttcagaaaacgtcggccttaattccttcaggggaccttccacactgtgcagctccaggagaagtcctgctggggattcggttgaggtggtgtctggtctcttcatgagtggaaagtgcagccatttaacccccttgacctcccaccccaggcgtggactttccgctgtgcagattccctttcatgtcccgcagaaccacgcgtgtccgttcttctgagagttttttcctggtcctcacacagtgtgtgggcttggcatgggctgcgatctttggctctgtgattcactgactcacccaaaggggtggccgacgggttcctgcagggcagctgtggcaattcagggcccatgggcctgggttcagggatgctcctcaaagagtgtggcaaaggaccccaggcaaagtaggtgttttttttttattttttaatttttatttatttattttgagatggagtccctttctgtcgcccagtttggagtgcaatagcatgatctcgactcactgcaacctccatctcccgggttccagcaattctcctgcctcagcctcctgagtagctgggattacaggcacccaccaccacgcccagctaatttttttatttttagtagagatggggtttcaccatgttgtccaggctggtctcaaactcctgacctcacgtaattcacccgccttggcctcccaaagtgctgggattacaggcatgagccactaggctcggcctgtttgtttcttttaaataaatgcttctcaatttataatgtgtctttagttgatttccagcatcctaaagtggctatttttgatggtttcatcccatttgtcattgtcttgggcaggggatgtgctgagcccctcactctgcctcctgggagtcctgcctcctgcatcatttctctcggacactcaggacaagtctaaggatcacatcactgccctcaggtgcaagtccctttccagagcacatgtgcttttagaacactccgagttttgctgtgttttagatctcattcccttctttttctacatttgttccattgtctaactaagagactcagggcatcaggcaagtcatgtcagaaaggttggctttagaagccacatcccagaattcctaaacttaatcatggaaggagggggcagactgacaacgcattccctatgtcctctaaagagatttctcccgttgggattgctttatccccagaggtgtgctgtagaaccagcctgtgttcacagtaaatctctgcttccgcaacagcggtgagctctcagccctccctgccctggtcttgtctctagggcctgtgggtctttgtggactgatggtgtgggtgggtttctgagggtctgcatggactcatggtgtggatgggtttctgagggtgttggtagcagtaacggttccacatgatgaaacccagatggctgctccccactgtgcatccacccggattcacccgctgctttgctggctgatgtctacaaggacatagatggcctgcatctggcgggggctgcaggaaagctggcaggacatggggccattagaagaggtgtgagactgtcatcagcagtaaaaagtggaacagcccagggagccctcttgtgagtttatggcttaaagtccaagtacaacttcgtttgaaagaaatgccttcctcctgagaaaacattgacaagcctgcaagccctgcaccctgcaggtgggcagctgcagagaaggggcaccctggtacctggcagggggcctcagccctggcctgcatacagcaggtgtccctgcattggctctgagcttgtgccacacaggaggtagctgtgatgccaagcccttgctctgaggttctaattgctgtggtcttggtggttcagggatgtttgcgagctcctgagtgactccgaagtaaaagcaaggctaggtcaccacagaatctagatgacattctcagcgccttcctgggagtaagtggctgcctcggccactgctgcctgtctgcatggctgctctgtggagcctggccctcctccctgatcgtcatctcttaggaaatgaggcaagggagagtgtccccgccgccgtggagagcccaggacctgagcgctcagctggccctcctgtgtgacccgtgtcctgcctgccgcccagcacccttctgtcttgtccctcaacccatggctggtgattttgggaggggtctgccactcctggcggctcaacaggctcctccctcccagttggcagatcagtgtcaccgtggatgagtttccttcagattgtttttctgtattagacggaggaaaccctttcttatttttcagggctcatatagatcattatttctttttgcatctcagtaggaattctgcaattcagtagggaaatgctggaaactgggaggagggaagactcctcactttgtctggggaggggaagttctctcaggcagggcatcgaggttgccccagcagaggtggggttggtggtgggacgtgggggcgcatgtggaatctttcacagggagggattcagtgcatacagtgacatggaaataaatccaaatgactttttccttattttaactattagtattaaaatacatttacttccaagttactacctatgaaagaaaaaaatatataactaaagaggaaagaaaaaagcagtgagggcggggtgcagtggctcacgcctgtaatcccagcattttgggaggccaaggcaaggttgggagtttgagaccagcatggccaacatggagaaaccctgtctctactaaaaatacaaaattagccaggcgtggtggcacatgcctgtaatcccagctactcgggaggctgaggcaggagaactgctggaacccgggaggtggaggttgtggtgagccgagattgcggcattgcactccagcctgggcaacaagagtgaaactctgtctcaaaaaaaaaaaaaaattaaattaaataaagcagtgagaatgagacaagtccaggtgtcatgttacctcaatgcatttgaacggttcaactttcctgttaaaagacaggcacaagagctgctctgatccacataacgcaggtgaatgtgaggataactacactcagtgaaagaagcttgacatgaatgagtctaaactctgatttcacgcatgcaaaattctaggtgtgtgaagtactctgtggtgacgtgaagcagatgcgtggccttcagcttttaggaggatggagtcagggtgccttccctgtcctccccaccaggcatgacaaaggtgctgggtattttatataaaacatgcataaaagattctgaaaggtgggaagaagaaggccagccagccacatacctcaggacccatgggacgacatggtggtgagttccctgggtcatttgttccagatggggcactggacaagtcagaaaactggaaacgccagtgggtacaggcaaaaagcaaacaagaaaataaaattctaacaaactctgttctctctaaccagaggaggaggaaaggggcagcctagccggacagaacaaaacgtgctctgccttggccagacctccccaaaactgtggccacagcctcccccgagtcaggaaaggccaagtggagagttgaggcttctgcttgtacccacccgtgtcaaggtgctccagtccacaccatgggggcatcaaggaggctgacagggacacgtactcccagctgagccagggagcatcagggaggctgatggggacatgtactcccagctgagccaggctctcaagagcgctccccactcccgcgtccctggggaccacacggggactggagctccctacctgctcaggatctccttcccatttgggcatcagctgagggacaaggagcccttcccatctgggcatcagctgaggccaggggcggaacctagatgcctcttctaacctggcggcaatgaggcagcacacctctgcccccgctgcgatggtgtcggaggaggccggtgaaaatgagataaaagaagatctggacatgatcatcacgtcacatcacatggccaggtttcaactgcaggtcctcacacacgccaagaaccaggaagactccagttcagctgacaaaaggcaatcgacagacaccaacaccaacacccagatgacatgggcaccgaagttacccaacagggcttttaaaaaagacatcataaagatgcttcagtgagccgtcaccagctctacacagtgaggaagtggaaagtctcagccaagcgaagacggagggccaaccaagtcgaggtttcagaactgaaagtacagccaccagaatttagaaattcacattgtacactgtgatgtatgcagttttatgtacatcagttacatctcagccaagctgttaataagcagaactcagggtcccagggaagtccaaggactcactcttcatgagacctcaattaaaagacccagaaagtttaaaatgaaagagatggaggagttgccagattcataccaacaggagaaagaaaatttggaactaacctggccaggaaagtgggctgagactttgtgctgctggtgctgctgtctgggaaggaggcagagcagctctgaggggcttggggaggctgtagtaatgaaaggtcctcagatgccagtggctgatacatagacaagtttatttcctgttcacctgtgtcagctgtggctcttgtcttcaaccccttcccaagcaactagtgcagtccccatctggagtgtcgttggtgttggagcagagcagtgagagcacagacaaccacccgcaggacgggagttattcttcccacaagagacgccaactggccaagacttcagggggtgggaagtgtaggcctctcccagggacaggcagtgaatatgcatgagcagtaattcagtcaccatcatttgcccttctggtcacaaatatttgcttcccagctttccccatgcaaaataaaccctacccaaggaagatggccccaaagtctggtcccttcatggcaccaggcttaatgcccagactcttaatacggtgagttactctcgctctggatctgccccctcgtgctctggaaacctgagccgagaagctgcccactgccctcccaccccagtatacatgggtgggatcagttcgcaacaacttgaaccagccgcactttccagtggagctgaaatgggaaatgctgggcactcctgcagcccagccctgctgaaagtctgctgggcacatgcaggagcctccccgcaggctgggagtccctcccgtcctccatccctgtcattcctgtatcctctggagcaggtgccggcatttccatgaaaggcggatggtaaatactcaggctgggtgggctctgtgctgtgtgtccgttgtgtgcaactcaaaggtgcctgctcggctttcctccttggccacagggaagtgggcctgggagagtgtgtgtccctggaggcagagtggcctctccgccccgcagcccgtcgcacgcttgacttctggtccctcaggaggcagcctgctctgagtacccacggtcatgcccaggctcctttgggggctggatggaggagctccacctctgtccccgtgccccctagcagctctgcccaactggaagccttgtgccagcggtgtggacagaaggtgttgtgtctgacttgtgtcttcccacatttcacaggtcgaacttaccaggtgaagctggattacttcccggcctccttataatggaaagagctagtgtaggagctgggacagggatggaagggccattggccgagtttgagatggcatttcacaactccagggtgccacggtttcacaactccagagcaggggtataagcctgtcctctgctgctctgggccagggctctggatgggccccacgtggtgggggccttcagattctctgagattcaaagctctttggagagaggacactttgctggggagaaggtgcgtggtccatttctccaggagtccgtggcttctgcaattgtgagctgctgtcctcatcgaacaccctcagcacactggcatagctccctgcacagggagcccgggaccaggcagagggtgctgggcagaaccccttcccgctgggcctctctttggcattcctcctctctctcctcggcattccttctctgggcctggctttagagtgtcccagtgtctcttgcagtgttttctgaacattttgtggcctagcggtaccaggacggttcttttagacactcgtaagaagccaagccacaggaagctactttccttgtgcaaatcctgggttactgggtttcctcaccccagaccccacctgaagagcaaagttctgaaggacaagtggctgttaatgccgtgcagctggctacacccggtgcgaagggaatccccgctgttcctccacaggctgcccaggcaccctgcagggccctccccacctgccccccaggctcatacatttgtcccacttgaagcggggaggcctggttcccctgacattctgctgccaggaagatgcagctctagggcagtgcaggcatgttcttcaagtgggccctcatcctggcaatctcaccatgccatggcaactgccagtaacctcagctttcacccaccagcctgagaccagcttctgctgccctgctgcgatcgctgtggtctccaccttagtttggggcctgcctgctcagcagggtagtggcctccctgggcctccaagagccatgtttccctaggcaagtaggaggctgtggccccaaggggatggaggaagccttcccctgacccttttgggggcatgcagtacatgtgggccctgcaaccctagaccagtctccaggcagggcaaatggcccctctgtgccccatagcctcgtcctaacatacgtgcaaatgtgcactgtggagaccactcctgcccctaccctgggagcctgagccccaccaacggcactggctctgcagggagcccctctttcctgcacagtgcaggcatctcctcttaggccgctcctctgagcccctccatgggaggatcgtgaacacatagcctttcagaggcctctataatgcgccgagcagttgtgtcactgaacgtgaagaggagacctgccagactatggacagcaggctcgctgggagagcagggtggagtgaggccactgacgcgggagccctgctgtggggggtgtgtgcgcatgctcagcacagcctagggcagggcttctagtgcaggcagcgcagcacctggctctggaggccagtgaagggagggaagaaagcctggaccaggaggacaccaaggactgcccctgggacagcagccgcccctttccaccccttccccactgcctgggttggtgaaatggtagaagctcttctctaattaaatgctcatccttacgtaaatcatagctttaataaattaatcaatggtttgggaattgggtatacgaacatttataagccagtattatgatgccgaaaatgtttcatgatgaggccttcccagaaaggcggggaatcgagagtgacgtagtcaccctccacctttgtccctgctgtctatgaagaaggagtgctgtgccctctgccctcctctcccgggctcttggcagcttcccggccggcagcagtccccacgctgcccaggcggagcagcccctctgccccccactctggagctgaagccagttttctcaacgagtgtctctggagtctgtcctgccctcctgctggcttgttcttctctcctggcctcaaggaaaggcctcctgacttgcctccctgcagctggctctgctccgagggccctgatcacaggctcactgaggtgtctgtccaggccatgaggctggctagctccaggcagatcctccgctcactcctcggggcggcgccggctgtctctacaaaaaaatataaaaattagctgggtgtgtggcatgcgcctgtaatccagactacctagcaggctgaggtgggaggatcgcttgagcccaggaggtgcaggttggagtgagccaagatcacgccactgctgtccagccagggcaacagagttagatgctgtctcaaaaaaaaaaaaaaaaaaaaaatcaaaactgataaacaacttagggaattaatggaagaaaacatgaaaatttgatgtgcatatagatggtgaggtctgttgttgaaagtttggttctcagcaggattttctaaagaatttcatagcttttcaacctgaattgtgctgtattccatacactggaaagcactgcactggtcatgttactggaagggggtcccgatccagactccgagagaggggtcttgaatctcacacaagaaagaattcagggcaagtccataaagtgaaagcaagttagttagttagtttgtttattttagacagagtttcgctctgtcgcccaggctggagtgcagtggcgcaaatgtggctcactgcaacttccacctcccgggttcaagtgattctcctgcctcagcctcctgagtagctgggattacaggcatgtgccaggatgcctggctaatttttgtatttttagtagagacaggatttcataatgttggccaggatggtctcgaattcctgacctcatgtgatcctaccacctcggcctcccaaagtgctggaattacaggtgtgagccaccgcagccagccaaagcaagtagattaagaaggtaaagggataaagaatggctacttcatacgcagagcagccccgagggctgctggtgcccatttttatggttcttgattgtatactaaacaaaggggggattattcatgagtgttctgggaaaggcatgcgcaattcctggagctgaggggattttacaccatacggtaacttcctgatgttgccatggcatttgtaaactgttatggtgctggtgagagtgtagcagtgaggacgaccagaggtcacgctcatctccatcttagttttggtggggtttggccaacttttttactgcaacctgttttatcagcagggtctttatgaccctgtatcttgtgctgacctcctatctcatcccaagacttagaatgcttaaccatctgggaatgcagcccaacaggtctcagccttattttacccagcccttactcaagatgtagtcactctgccaaacgcctctgagtgtcagaacttcagctttgggaaattgaccattctcagctgtgcagccaccccgggaccccacacctacatcatgttgacaataagtcccacccccgtggccccgtgctgacctcgtgttctccagtgagtgagtcgtggcttcctcctgacattgagcactcctgggagcaagagaagaaacaaatttggcagatggagcttaacaaatgcagctgtattagttcgttttcacactgctataaagacatacccaagattgggtaatttataaaggaaagaggtttaattgactcatagttccacatggctggggaggcctcaggaaacttagaatcatgacagaagccaaaggggaagcaagcaccttcttcacaaggcggcaggagagagaagtgtgggcgaaggaggaacttgccagacaaaaccatcagatctcgtgagaactcgctatcatgagaacggtatggtggaaactgcccccatgatccaatcacctcccgccaggtccctcaacacgtggggattgtgggaattacaattcaagatgagatttgggtggagacacagccaaaccatatcagcagccagcgaggctctctgtgggcagctgtgggcacacccaagggaaggagtgggcacccccatccagcagacggagacacggcctcaggccatgggcaggcaggagatacccccacctcgcggttattaaataactatgttacatagtaactgtggggcagtagggctttcattcatcaatatgtagcatttttatgttcacagttttggactttgcttgcgggttacttaatgccatcagatggaaagctgagagaaagcctgtggccccccaggcatctctgtaaagaaggcaatgccaagctgagggttgcttcccaggcctcacaacagcacaaccttagaacctaaaaaatccagcatgctacttgtgcatgccaggctcagaactttcccacgttggcccctggcagcttattcacaaagactgtctggttccagccaactgccgaggtgctgcccatgtcaggagagtgggtggaggaggggagaagggcttctcaggacagagggtgtttctgcttcaccaggattccagacacgggccacccccctgagcacgactggatggtgcccaggcctagtgtatgcgcccatgaatgtgagtggccagtgccagtggcagaggccaggcctaaggggctaagagctctggaaggattgtctgtttctgggcagaccacaggtggctgctgtggccccatgcagggcagggtcacggagggaccaccttgctgggaggagcttgcagtcctgcctgcctgggcaggagctcagggaacacctgactcccttttaaagtcataaaatcatatttgaatatgaaatcttctgtttttttaaatgttggaaacaaatttggaccatgttggcgattgactcacctgtgcttgtcaccacctctgaggatggcgtggatgttatctggtcaccagaaggaaagccaagcacagggaaggctgggggctgagccaggacatgtcctgggtagggaagggaggagctgggctggccagcacccccacaggctgagactgccaccgattcacgagtccacggggcccaggagtctgggtctacgtggaagttgtcaagggcccagactccaagcaaggccaggccaagcaggcctctcaggaagatgccgcacagtgcctggagcccggctggcagcttcttttcctggcagtgtcgtgtcctgtcaccagccgtcagagcgccctccgaccagggcgcgtgttagagcagggactggaagttgtgaatgaatgactaaatgctttcctagaggctgaccgaaatttgtgattagctaggatgtccatttccaaggcacagcatgtgctgtgactgtctaggggtggcgtccccatgcagcttgtgctttgggaggggccagctgcctcctcgccactgcccagcatagcttgtccccgtgcccgccaaagaggtcctcgtgctggcctcacaacagaagacggccacagccctgctctccccaggccaccacgtccacgagtgctgcactgtgagggtgcagcccagcgcctcagaggcagcagcacctgtgagatggcgtgcagatggaagtaggccaatagactccaaaggaagcaccactgaaaaatcagaggcgtctctcagagggggcccacgagggaggtggtatgaaaggtttttaaaaggacaaagcagacttcggagctgcctctagaggagagcagcaggtgagttccgagttcacctggcacgcttttcggcagagcccaggaatgcccacttctgagcgctgagtgcacaacccagctcgggaggcctgcggcagcaggaatggggaggcaccgtgagtccctcaaagcgctgctggaaatgtcactctgcgcggtgtccacccgtgctcggggtgggcagcgccactgaatgacgcgggcagcttgggaggccggttcgcgaacgccgcagcagcctctgctgacacgggggctgctccccactcacagagccacaggttcctgtgggttcatttatgaggatgtaggaatcataggagttaggtacatcttttcctgaggtgagagccagatgaggggagccaagacagagaatagcccacgtctgccctgggccccgggggcggggcctacacaggctcccaggagtgtgggtggggcctgtttaaacttcatgccccgggacctgcctgggagcctcctgcacaagactcgccccactccggaggcttagcagcaccggagctgctctgtggcctgttggcagagaggagtctggtgctcctgtgcacgggggtcacagcaaagccaagtggccgtagcacctttaacactggccccgggtctctacacctccctgccggccgtcagctcctggccgcagccggcactgacctggagcaccttaaggagcccctctgcaagtccctgtgcatctgagaggtcagagaggcagaaacacagttccagggttcaaacctaatatgcctcagcattctgggcactcacatggtgtgctgggcctgtcctgccacatggcccctgcgtgaggaagacagagcctgggcgtggccccacatccctgtgagctgcccatgggcctggaccctggctctggcagactaggctgcatagcagatcagcttctcctgagccattttcatccaggccacacctgccagcttgggccagggacaggcagaccctgggcccagggtcttgagcttgacccgcaggaggtctgggccttatgccctggggagaggagagcgcagaaagccagtgtcacggcagccccaggggaacaggccccaggcctggcggggtctggatctcagttccacaggggaagctgtggccgcaggcatggtaacctcaccaaacaaaaagctgcccatctttcagaatatgagcaagaagtttgtgagtccttgatcaccagaggggcaacgtggggcccgagatgacaaggagtccaggccacccacagtagctcctccttcagccttacagaggggctgcctggtctgctttcctggccgtgggttgcccctctctgggggccgatgtcagcagacctgtgggggatacaaacagaaggaaccttggaccccttcctggtacctccttactcatctgattcaaaccctcccaattctgcctccaaagtggaccctgactctccccagtccttaccgtccagtctccaagaccagtccacccagggagcggccagaagacagcccacctgcgccaggcctgtgtgtgcctttcctggcatctggaatggggtttggtgcttgctgcctgtagccaggcctgctggtcatgccttcctgccctgctgggcctcatctccgtgacaacgtcttggccttcctgccatcctttgtaagtgctgcctggtctgggatcacgtgtgccggctcctctgcttgcagtacttggctgcacttcccagtatattcgttaaaatgttgtgacatgagaattagcatatgacacgtacgtaacgtgagctgcggagcatagctttctcatgaacagccgtgaccccaggaccaggctaagcgagatgacccatgctgccgtgggtgcttcctcttctttaccgtgatcctgcattttgttttctcatctcttctctttaaaataattttattttattacacatgattgcttgtttctgaactcttagaaagtgacatcagtccctacatagacttcccaaacctgttctgtttagtcacacacaaggtgtcttaggttggtatgtgtttctgggcagagctgcagtttgtgtgcctggctgcatagtgttccagtgtgtgaataggcatcatttatttgtttttccagcagggtcatgcggctcgcttgccattgtgagtgatgcttccgtggacattcctgtgtgtttcttttggtgcacacatgaggtgtttttggtttaaggaagtggaattgctgcatcataaagtctgtgaaaggtgaactttcaggaactttcaggaccatgtcagtttttgtttcaaagcgcgggtaccaattcccatcccccagcagcgtgttagcgccacggatgatctacagtccaccaacattctgaatgtttgccaatgcagtgaatgtaaataacgtttcactgtggtctgtatctcccgttccacatgctcttgtgctgtgactttgatgcacctcccgccagggaggggatcgtgaccctccctttaatctgggcaggcatgtgcctccagcggaaatgatgttatgtgacatctgtgtgcaagccacaggcagcagcacagcgctgcagagctcccaggatgctggctcttggagcctagggatggcgctgtgagaacaggccacggcgccctagcttcaggttatagggcatggctacgtgcctgtggaaattctcctgcgggcggtttcatgtcgaaggcctacctgtagccctgggttgtctgcctcttgggggtagcggctgtgtggaatgcctgcgttctggatttggctggctgcctcctctggcatggtgcagagcccacctgcaaccccatatttgccctggtaggtctgaggtgcgattccactcagatttatttttcctgtgaggcgagcgagcttcctaggtggcactgcacgttgcaccgcatggcatgatgaggcgtgtggtctggccgctccttcactggtgctgagactgaggattgagcttagggggtcagcctgatccgccactgctgggttccccaccagccttgcagcttgctgtcaatattcattgatggtcattgcctggatgcagtacacattaggggctgcagaacggtgattttctaattgtgttgttctttctgtacttattagttgggattcatctatgtggaataacgtttgcctcatccactagggctgtttggttacctaaactatggttcatgccagaaaggcaggatagatgcttcattctttgcactcagttgttctcactgcgatgagttggtttctggaagccccagtgttgtcctgtgaatttgtgtctttccctgcttttctctccctgtgaagcatcattgttaactggtggatgttatacacacagtggagtttggccagtgcagctgccatttctttactcaaactgttctgtagtttttgggctcccctcgctttctgatgtaaccacatcagtcttggatggctttattgccttctgtcgtatgtgttcccaccttaccttttatattttcttccacagaccacctggaatcaaactcttttgggagacctgtttttgttctaataataataataataatactatttgggaagtagtatttagagaccacagcgtgagtattaggagtgcttattgcaattgggttgtcattgattttttataatttagtgaacagaaataagaaatgtttgtaattttaaaagaagagaaaattaagataaatatttttaaatcatatttaagattacattattttaacttaaaaatttaaaacttatactagtttttcttttctctcatcattaccatgattacttatttgttttagcctaagtaaatatataacaggtttggagaataataccaatattatgattaatgactaaatttagagcaatatatttctttgcacttttttctgtctgtataatatattcccttgaggatatgcagtcagattcctgtgttttaaggtcagtgcctacagtccttctctctgtggttatagcttcaactgaaattcctgcatttgattatgtaaaatacaaacatttacatgattctaaagtcaaaattattgcaagggctattcacaaaagtctcactttcctccctttctctccattcagttcccttccttctcctgtaagtagcttttaagttttttaatctttccattttttcttttcgaaaacatgaacaaatgtgtgcatacatgaattcttcaacttagtaaacttttcctccatgttcatatttcttttcacttttaggaaggtttgtattttttttcttggctttatattatcactctctatataattcacataaacccctctttttacataatttctattgacttactgttataagcagtattaaaattagccagaagtctcttcttcctcctctcccactcctaatttttgtttgttctcccacctcttcctcccatttcattagtgtattaactttattttaagcacatttaatggttacatattatcctgtcacccttaactccatcatttagtcctagttcagtagttaaatgtgtttgacacttaccaccataccttatgacaaagcttctccaattatttcgtggttggcccaaccccattttatattatgttcttcaggatgggctcatcagaaaaatatttcctgtgttcttgtggagtcatatctttttatctgtagccttcacaggagaaaggtaatttggcttcataaaatccttggttcacatttttctctttagtatcttaaatatgttgctttacgccatggtgattctgactgtgtataggcctacgctaatgtgtgtgtttatgtcttagtgttgttgttgttgtttttgagatggagtctctctcactttgttgcccaggctggagggcagtggtacgaactcggctcactgcagcctccgcttcccaggttcaagcagttctcctgcctcagcctcccgagtagctgggattgcaggcgcccgccaccacacctggctaatttttgtactttcagtagagacggggtttcaccatgttggtcagcctggtctcaaactcctgacctcaagtgatccacctgcctcggcctcccaaagtgctgggattacagacatgagccaccacgcctacccctgtgtcttagttttcaaccaaaagtttaaaaataaaagtataacaattttaagaatagaaagaagcttataaaataaagatataaagaaaatattttgtggtgctgtacaatttgtgtgtgtgtgttttaagctaagtactataaaaaaatttaaaagtttatagagtaaaaatgttacagtaggctgggcacggtggctcactcctgtaatcccagcactttgggaggccgaggtgggcagatcacaaggtcaggagatcaagaccatcgtggctaacatggtgaaaccctgtctctactaaaaaaaaattttaaaaaattagccaggcatggtggcgggcgcctgtagtcccagctactcaggaggctgaggcaggagaatggtgtgaacccgggaggcggagctcgcagtgagctgagattgcgccactgcactccagcctgggtgacagagcgggaccctgtctcaaaaaaaaaaaaaaaaaaaagttacagtaaactaatttaatttattgaagaaagaaaaatattttcataaaattaggataacttaagtgtacagtatctctaaagtctacagtagtcatcctgtcccaagccttcatatttactcaccactcactcatggactcaccagagcaacttccagtcctgtgagctccattcataataagtgccctagacaggtgtgccattttattatcggctcactgcagccttgacctcctgagctcaagtggtcttcccaccttagcttcctgaatagctggcatgtgccaccatgcctggctaattttaaatttttttgtagcgctgaggtctccctacattccctaggctggtctcaaactcctaggctcagctgatcctcctgcctcagctttccaaagtgctgggattacagatgtgagccactgcacccggccttttaaaatctcttataccatatttcactgtaccttttctatgttgtttaggtatgtttagatacacaaatacatagaactgtgtcacagttgcctacagtattcagtacagtcatgtgttgtgtaccgctttgtagcctaggagcaataggctataccatctagcctgggtgtgtcagctctctcacctaggtttgggtaagtatattctacgatatttgcacagtgatgaaatcacctaaaagtgcatttctcagaacgtattctcgtcattaacgcaggactgtgtgtctccccacgctcttggaagatgcagcaggaatcgcggttgtatgtatgttggatctcttttgcctgtctttttgtctgtcatgttctcctgaaccttttttacctctctttctgtttaattattttcattctcttctttctgttttattcctgtgccttctgtgatgtctccttactcttacatttcttctacttttcatttctgaaaaaaaaaatctagttggttcgtgagttctgtcaatagtaaaatgtcttcctgttttcttgccattccacttctgagatgttctaatactattttaaattatgttcttctaaaatgatggttattttctcaatttttagttcagtttcacatattacgctatgagtttcgttttctttgtgtccatagttttttggtatattttcattatctgctagtgtgttatttatcatacttttacttctttttggtagtgttctcatacgggatttgatcataattctttgtgtcccatttttaaataagagtcttcctggactattaggagaaagttttctgtagaggaattgggaatgagccaaagtagcattcctagcctcagcaaccaagaggtctctctgttattacggtgaaatatgtttgaggcctgtgtgtgtggacacttctgtctctagaaatcacttccaactcaggagggctcccttccctgactctgttgtctagagacgcacagcctctcactctccacgctgagctgtttgttgccttcaatcactgccctttgtcaccagtatgtgctggggctcacctcctctggatctctctttctctagcactttcaatacaaaaatacctcgtgttccaggctagctgaatttgtgttttgctttgggcagttttcttccaggcgattctctgtgcagaagtgaatcttcattgtgtatttctgagatacttgaggacttaggcccttcagtatggcttaaatttccagtgaactccttaatagttcttttttgttgtgttgtgttgtgttttcttgttgctttcctggaacttggagactacaagtacgatttggagtttctccatttgctctcaggatattcacctagattcccacttggtgtgagaaatcataaattcaattgctttaattgttgtagggatattgagattgtctgtttcattttttattttgtttgtttgtttgtttgttcgttctccatatcgcctacttatttgttcaggcttttttggaaacttggtttgagcctgtctatagaaagctcagtgaagctgctttaaaatcctggtaagggaattctagcatctctgttatctcagtgttggcctctgttgattttcttttctctttcatgttgaggtatgcctaatgtttggcacgacacataatttttgtttgtgtcctggaagtataggttattatgttatgatagtctgaatcttacatcaatcttctgtttcggcctctgttgacaccatggggaagggatgtcttgttaccagcaagctagggtggagatccaggctcctccctggatcctggggacaccaccggtggggagaagggtgcttggtactgctgggtgggagtggaagccgaggctctcagctcagcccctctgaccgggcagggtgctgtgtgcgtcctgtcctgtgcatggagcagggcaggtattctcagatgctttctgacctaataggttcctcctttcccatccctttccctagagagaattttcttgagactgtttttttccagtgtgtatcctttggcatttttcagttgcttttccagtgccctgtctgaaatatagaggaggaagcacaaacaaaacgaacaaacaaataagaaacccaaagaatagcgaactcaccgctgtgtcattctccaaatcccaagggcccagccagtcccccttcttccctccagctttcagggttctcttctgtttgttccacatgtaatgtccagagttgttggctgtgctcagcaggaagaatagggagagaggtgtctattccatcctgtccagaaccagaaggcatggcttcctttacgtgactactatcccctgtgccttcgcagttgtttttcttgattaatctcatcagagggttgtatattatttagactttaagaaccaaattttatatttactgatcttctcagttgcctttgtttctttgcttaacttctgaacttttctttattattacctttccactttctgtggatactttctgttctttttctaactttttaaatgggattcgtgactcactaattttgtgtttctttactccttttaaaagctataaactttactgtgagttctgttgcagctgtttgctacaaattttggcatgcaataattttattattgttgaggtctgttttctgatctcatctatttcttatctggaaacatttaaaaagtgttttgtccaagggaattgtaaagttatcttttgctaatgatatttaattgcctactgagtaggagatatgttctgtggactccatgttttcaacatttgttgaaacctgcaatatgaactaaaacgttatcaatttttgttttgttctctgagagccttaggagaatgtgttacctctgcttgtcaggtacagggttttatatacacacagacacacatacgcactatcatgttgtttgtgctgttaatatattctgcatctttattacttttgtggggtatacttgtgtgaactgtaaaggagagaggtatgttggcatctcccaccagttgggcgatttggggcctgtgacctctgacctcactgctccttcttgtagcattcttcctccattaatgctcgtctctctccttgaccttctttcagtctttcttctcagtgtttctacccaaaattgcaggccccagctccagcagtctggttgcggacaaggccgtgcttgtttttcattgggctggtctgtccagctccaaggctgccctttgagccggacgattgacccactgcattaggaaatgctttgccgtcttggtgagagccccactttagggaggtcttgcacactgctgcatggagcatagacacgttgggtgggaggtgccccagcacctaaggactcttatgattgggtggcaggggtgggtggtgctgccctgccctccagagcccttcacatggtccagatgtcacccagcgcaaggtgagggagccctggggtcacattctccaccctccctccagcattgttgcagccgcaggacacctgccagggtagaattcagcgtggctggaggattttgtgtggcagaagtaatggagatggtaggcaggctggtctccccgctcctctgtgagcactgtgtgttggtgctccctgccaatggtgctccccgcggcatggttccacgcgcaccacaagggcagcgtggcttcctcatcttagatgtgacagaatggagatagttctgggtgttagcccacaaaagtggcaacgttagggtccaaactctggtacatatgaaaccatggttcttctttcttcctctccaggcagattcataagaagaagactgggtctgagtttatatacatatatataaagttatatataaacttcatatacgtatataaagttataactttatatacgtatatgaagtttatatacgtatataaagtttatatatatgctttatttatatatatagtttacatatatatatgctttatttaaggttgaacaaaattttgcattcatcagaagcttccttttatgaattcttagacttttttactgggtaccccagagatttaaggtatcagcttgaatatcttctaaactgttctccctaaaaggaccatacctggattctcaaggagtccacctccggaggggtcactgacagttctgctctcttatgccttttgttcatcttaaccagccttggttagcaaggggcacctgccaccagatgatctcttaccaagtcatggtttcctgtctgaagcggtttccctgatgctgagaggcatgaggagaatgttacagagagacagcatgctgccttgtgattgtctgaggtttgaaaccttctggtgaagctgaaaccatttcttaagagcctggctaatgctgtgagctgcttaagcacccgtgtgcacatgtgtgtaagtgtgtgcctttgccatgtgtatgcatgtgagctgcttaagcacctgtgtccacacgtgtgagtgtgtgccttcacctgtgtatgtgtgtgtgtgagctgcttaagcacccgcgtgtacacgtttgtgagtgtgtgcctttgctgtgtgtatgcatgtgtgtgagctgcttaagcacccgtgtgcacacgtgtgagtgtgtgcctttgccgtgtgtatgcatgtgtgtgaactgcttaagcacccgtgtgcacatgtgtgagtgtgtgcctttgccatgtgcatgcatgtgtgtgagctgcttaagcacccgtttgcacatgtatgtgagtgtgtgcctttgccatgtgtatgcatgtgtgtagtttgcagctgagtgcactgcttttgtctggactgtgcccaggagggaatgtgacacccttggggtccttgcctttgaagctgatctgttgtggcagccagttcagcatgttcagcaagatgttaaagccattgctctgctgttactcccggggtctcacagccagagcaggccagaggtgaggaaggggatcccatgcctccttcatctcctctgtctccttgccttcctaaacagctgtgtttcccactgaaaagggagctgcagagcatttccacgtggagattccatctcgtttgtatccagctccatcaggggcctgctctcaggctcccctgggcgtgtgcgtgaggttggaagaggcgggtcactgcaggaatgtgtcgttctgtcatgtcactctctcgatgtctggtctcatggggttccttaccaatttagggacttgttagggagatatctagaactatattgatagatatacatcatgaaccagttccccttaggtgtttctaaaatgatataaattaccaaggaaatagcctttggttaaagttcattattttctggtcttgcattgttagcatagactgctgtctgctgtctgtgccatttctatttcatgtaacttactgaggttttctttgtgccctaatacaagctagttttttgtttgttttttttttttaacgaatgtttcaagtatgtttaagaagaaagtataatctctattattggagtacaaagtttgatgtaatgtccctaagacctacctcctgttactagctctctgtcatgctgagttatttttgaccccttaccttgccatggctgacagtcatgtgttaatgattgctgttcttaggtttctgtttctttccccaacatctatagtttctgcattataaagccagcttccgtgtttggggttctagcagattcttaactcatatggcttcgccgcgcactgggtcctccggcatcaagaagtgcccttcttggtcttgcttcctgctttgaggtgaggctggaccttgtcccacagggagattgcaatccctgctcttcagcctggtgcgctggcctcacgtgcttctgctcattccttgacactgagccttttcaaatcacttggcaattgtcatgtctcttgtgtaaagcagagctggctttgtgagccaagtggaaatttttcacagggccaaaaccatttacatttactcatgtgttgctaggaccagtatgtccagtcccaactgccacataacttgctcctgtatttaatgtgtgtgttgtgttttatttattgtgcatctttttattttttacatgtggtttgtgtctttgctttttttttctgttgtttttggcatttaggaaggtctgtgttttgttctgctggctactgttataaataacacctctcattgcacccttagtcccttgtttcttcctctgacctctttattttggcttgtctggtgggattcttttctcccacctatttttcatgcttcagtctatgagcttattctacattcctttttttctgattcatctacctctgatttatttgctgtatttttacttttgcagaacagcatgcttcccgataagaagctgtttcacagcccacctccatccttaccctcactttctcttttagtctgtgctcaacagatttgttatttttgtttatgtcaaatttcccagtggtctcttggcttgaggaagattcttttgtagtgggtttgggcctggaaacacagtgttcattgagttcttagctatttaaaactatttctctagagctttaattttgaaggacagtttggctgacataaaatcctttggtcacactttatttttacttgagtttatgaaaataattgctccactgttcacttaccttgtacattgcagtcaggaagtccgatccccatctgattttcttccctttgtgaataagctggtctttttgcctggagtcccaaagaattttctctcagttgtaatcattactggggagtgccttcagggccaccgttctgggtcagtttgttcaagtacatgatgagcctttcaacttgtcgattatttttttcctaagaacatttctaggattttaagtattaggtctgtttcgtagttttgcttttctgttttgggaactccagtctttgtttcttgggtctttgttggcctgggctctgtatctggcagcttctctgcgcgtctctcacctcttggtcagcctcatgttctctttgatgttctcagtcctcctgcagtgttccttatgcagtcattaccagtagagggtgtccaggtggcatctcgaacaaaggattggacaaaacgcacaaacaaagcaaggaaagcaaaagcagggatttattgagaacgaaagtacacgccatggtgtgggagcagcctgaccatcgggactcaggagcttacagaattttctggggtttcgatactctagaggtttcccctggttacttggcgaatattctatgaaaatgaagagaatgaagtgaagtcagagtcatttactcagaatgcaccctactgtaaatggagaggatgctacttggagtgtgtggtctgtataaatggagaggatgcatatgaagttacaaagggtaaatgccgtgaacggagagggtgaagtgcagttgcaaagctgttcacatccctgtcattgctgaggagctttcatttgatttagttctagggagtcagcctggatggatcagccttctgttccctgcctccttctgttgtcctgcctcacactcagctgaatctctctcttttggtaccttgtaacttagtctcatttctaggctaattgtgtcattctctttcatttctgtcctgggttaaattaattctcatttcacagttttttgttttaactgtacatttgtgttcctggtgtttttagtgtttcatttctgtttctcagcttttactcattttgctttggactgcagcgctgggtgggagttctcagttccattagctgaagaagttttagtgcccacaccccgttttcctctctcagagccatgaaggacttcaggagtgtctgcgacttggagaacatcatttacccaaagggattttgcatgccttttttctatttattttaaaagcacttggattttcctgcactagcagtaacaggtgtttctagctgggaatggacatgccaagggacacaggtggtttaccaggtttctttgtccaatagcatccttttttgttggtcagcaaaaatgtaggttctttttagaaaaaaactgaatggtgcatttggagatggattaaatctgtgtcttcttatgccttgctatgcttttatttctgtaggaaactgaatttctactctttccatccttccttccctttttctcccaaggttccaaatatgcctttttttttttttcttttttgagacggagtctcactcactctgtcacactcaggctgcagtgcagtggcgcaatctcagctcactgcaacccccgcctcctgggttcaagcaattctcctgcctcagcctccggagtagctgggattacaggtgcccgccaccaccctggctaattttttgtattttggtagagatgggggtttcaccatgttgcccaggctggcctcaaactcctgaccttaagtgatcctcccgtcttggcctcccaaagtgctgggattacaggcatgagccaccacatccaacctcaaatgtgccttttttttccaagtctctcctctaagaccatgctgaaattgaagaaattagatgaaatttgttcactatcagtgaaattagaaaaccagcaatgtatttaaattaatatataatttaataaatattgttttaaaatcagtgtagatataaggaaatacgtaagtaagtgcaattttatcaaaacatttcatgtagacgtctcacttgtgaagtggaagcctgcctttgggttgagtcacctcatttggggtgttggggggaagagccccaggggggagcgcttgctggcactctgtctccacactcacactgtgccttgtactcgaatgctgaagaggtgttgactgctgtgttgaaggcaagaggcagttccgttgaagcccagtgctggcggagaggccctgcactggtgcgctcacacagccctgtgtttttgtgttttaggtcggtaggctccacgacaaaagtcaacccttctgtaaatcacctgctgtggttatgatgctctgagttcaatacgtctgaacctttgctgtctatggatctgctctaaaccttatagcctgcttatgggggaaggtgagttactgtcttttgtttccatgtttgtttgtttaccaagagtgtatataacaaagtcagacttacccttgacaaatgaaatctgtttgaagtgacacagtgctgtatttcaccctgcttcagtccacaatgtgccctgaagactattctgtatatgactttgggaaattggggatccctgcttttgatagcagtgagctggttgtggttgaacacctttgggtccagtgccaggccaggtggttctcgcacagccttccagctctcccctggagccagccccgagaagccaaggaggcacaggtttcaggaatgaaggacaagaaggctgtgctgggggctgaagatcgtcctgaggtgtttggaaagagtaggtaatgagagcatcaggagtgggggtgctgttttggtggtctggtgataccctgcagacattagtgccgtggcttgagctgctaccatgaacttctgttgatacaattgcaaggaacgttggatgaatgagcagttgtgtttggagcttttaacatatcccttcaagaagtaggtcaccaaaaaataaacgggagtattaatatcttaagcaatataataaataagtttgagctgttaggtatattttgaactctacatgttactttctaagcatacagagagcatgtacagtactaggatgtgtacaggtgaagtctgtctgtaacatagggatgtatgtgtacaggtgaaatctgtctataacacagcatgtggagagcataaggcaattatactggaaattaatagtaaaggaatagcttacataaataatatgctataaaaaactcttgttagaaataaaatcataaaagaaataaaagaactttagggctgagtgattatgaggcagtatatgtccaaattagcatgacacagctaaagcagtgcttagaaggacatttgtagctataaacacgtgttaagaaacatgaaaaattaactcaagaggctgaaaaaagagcaagagagaaagcccaaggatccataaggcagaaatcagtgaaatagagagcacagaaaaacagaaaattcacagccctgaaagctgttttgtgttttagagtcaatagttagatctttggttaaagaaagtggaagggccgggcgtggtggctcacgcctgtaatcccagcactttgggaggccgaggtgggtagatcaagaggtcaggagtttgagaccagcctggccaacatggtgaaaccctgtctctactaaaatacaaaaattagccaggtgtggtggtgtgtgcctttaatcccagctactcgggaggctgaggcaggagaattgcttgaacccgggaggagaaggttgtagtgagccaagattgtgcccttgcactccagcctgggccatggagtgagattgtcttaaaaaaaagaaagaaagtgaagggatgatactggtgacagtcgatggaacagaatatagaaaggagtgaatgagtgaataaataaataaaaataaatatagatggatggatagatagatagatagatagataggtaaagaaataaccatagatacagccaagaagaaaagttgagtactgtgggaaaccatatgctaacacatttgaaaacataggtgaaattgataacttcctgggaaaataggaagtgccaaaatagacttgagaagaaatagagaacttggataagccaataatactaaagaaatttaagtgacaatcaaagacttccattcaaaaaaagttctcagacacatttttatgggtgaattatacctaactttaaggaacacttgatttctaacttacacagattgtttcagaaaatagataataaagctccccagccctgaggctaggaagaagagaggctggtccacaggtacaaagttaaagttagacaggaggagtaaattctggtgttctgttaacaatagggtgactatagctaataataatatgtctgtccagatagctggaagacaggattttgaatgttatcacaaaatcataaatgtttacagtgatggatatgctaatttccctggtttgatcattaaataatgtatacgtgtattgcaacatcatactgtatcctgtaaatatgtacaactattatgcgtcaattataaataaagcttaaaaaaagctgacggcttcgaaggtcgaggcaaggaacgtggcctggaaaagacaagggaaaatttccccaaagccttcagaaggaacacagccctgcagccaccctgacttttgttcagaaggaacacagccctgtagccaccctgacttttgttcagaaggaacacagccctgcagccaccctgacttctgttcggaaggaacacagccctgtagccaccctgacttttgttcagaaggaacacagccctgtagccaccctgacttttgttcagaaggaacacagccctgcagccaccctgacttttgttcagaaggaacacagccctgcagccatgctgatttttgttcagaaggaacacagccctgcggccaccctgacttctgttcggaaggaacacagccctgcagccatgctgatttttgttcagaaggaacacagccctgcagccacactgatttttgttcagaaggaacacagccctgcagccaccgtgacttttgttcagaaggaacacagccctgtaaacaccgtgacttgtctagtgagatctgattcagacctctgacttctggaaatagaagataataaatttgtgatgtaatttgtaacatcagcaatagtaaactaatacagtaacttttatagaaaaatgggtgaaggatcggaaagacagtttacagaagaagaagtacaaaaggctggtgaagagatgtgcaaactcacttcttgtctgagagatgcagagtgacatggcgtgtacacttcccacagctgagaccagcaggagcgggcagtggactcgcaccaggcattgggagcagatgcggaaagtgcacatgccgctggccagagggggtgggctggcatgtcttctctggagcctgctgtgacctggcatgctgtcctgcatctctgtggtgacaaaatctccacgggttcatggagacagatgcacacagcatctccttgttgtgctccgtggatgtcggggtggaaggtgacctcagtgcccctgcctagaagagtgaaaacctaactgtggcagaagccagatgccgtgggttgggtgtgccaatggcccttaaaggcagggctggcgttactggtggagggtgtccaggttcttggcgttttgaaaaaataattggacaaaacacacaaacaaagcaaggaaagaatgaagcagtgagagcagagatttactgaaaatgagagcacagtccacagggtgggagcagcccgagcaagcagctcacgggccccagcgacagaattttctggggtttcaataccctctgcaggtttccattggttacttggtgtacacccctgtgaatggagagggtgttcctgtcatggctgaagtgtttgcatttgatttagttctaggaagaccttaggtttcttccctgcaggccctcttctcctgcctcactgggttaaaaagctaagaaacatgagtggtgttaaaccattctgcctgtgtgagtacagacgcgtgcataggaaattaaatacacacatactttgcaagagcatatgtgagtaagagtcaggcactcggtgttttagaatgggctcctgcgtggtggcagtggcaggtggtggtgataagggccggtgagaataaaaaggagccgatggtacggggcaggagccgctcccaggaagcggtggtgccgacgtgtcataaactgatatccgcatctcagcctctgtgcacgaggctaggaagagaagagatttccaaaaaggtaagagtggggcgggggggacaaaaacgcaaagaaacacaaagagcagcatccgtgtgaagttgggcctgggagagagatggaaggggtgggatgaggcctctacgtttcacagctcagtaacctgggccctgagaggctgtgcggtttgttccatgcaagggccagcctggacttgcaggctcaaatacgactcctcctgccctgcatgtgtgtcagctaccacacatgcttttttaaaatttatttttgtttttatttttagttgttgtaaaatgtacataacatagaattttccatcttaactattttttagcatacagttcagggatatgctgggcagccatcaccaccattatctccagaactttctcaactttttgaactgaatctctgtccccattaaaccctccctcccccagcctctggcacccaggatcctactctctgtctctaggaatctgactgctctagggaccgctacacgtggaattatatggcatttgtctgtttgtatctggcttctttcttttagtctgctgtcttcagggttcatctacactgtggcatgtgtgagaatgtccttccttttgaaagctgaccgatatcctgttgtatgtaaagactgcagccatcagtggacaggaaggcttcacccgtttggctgttaggagcggtgcccttgtgtgtgcctatctcaagtgttttattctttgtgatgctattgtaaatagaagtgttttcttaatttccctcttggattgttcactgtgaggagaagatgctctttgatgagactgaaatgaagctgggtgtgggctctgggtgggtggagcaagcactccgagcctctgccccgcggaatgcagtggtctgagaagtaagtagcaggagtgctggaggaaatggaaacttacgatctctcctgcctgagttcacagcaggctgaaacccagaagatggcagaaagctgacagagagctccaggaggagcctctcggaacagctcgaagagcaggaaaggggaccctaggcagccttatggcgacaatagtggtgccaggaatggccaagggggtccgcaggggcccccaggctccaccacggagggagggagccttcctctccaagtctggcagcgatgcccaagtgccttctctctctctgcgctttcccacagctgatcctggaggagtgcacctgggaagccagtgcacagagctggagcttcccgactgcaggagggaaaagaggaatcctgggatctgggaggcacagggaggccagcacagacgcaggctccggaagcccacggagagggctgggcattctcccacactcatccccagcttcacatacacacatccgccctcaaacagcccatcacagaccttgagaaccgcaccatggggtggactgctgcccagttcccagaccccacaccccaccagcacagaggggggcatgcgtgggaaggcctggagagccctgcaaagaccgaaacaaccaacgtgggaaccacatacagagccccttagagttgaagcctgaacccaaccaggccggttgcctcctacatctgagatataaatgctctctctgggatttaaatgagacccaaggctgcctccgtaccccgccaccctaggtctgtgctgcaggccatgcagtgtgtggggtcaggcccacgtgtctgtctgccttctgcccgggatccaagtgcccgatggcctgagggccggaccccacacaggcacagaacgcgctgcagaggtgacaggcgggtggaacccagggagacagaaaacctcctgccagggaagttgctcggcttggagagaggactaaactctgacctttttcctctcttgcccaaattcctatctaaggagcctggggagtcacaccgtacaaaccgtaacatctcatgagacaggttttatttaacccaatataacgtggcttttcaatctgactgtggcttcacatcacatgacagataaagtaggaaacagaaatattttaccccaaaatatgtttatttgccatattttgaaatgggcctccaaagccatcttttatgggggaaagtttgcatctgtaaagaacctgtattaacataactggatctttccccttccagaccctcccaatcctgaggagcctggctgagagtctagtgccttgtgaaggtctgaataggaaacatttgccatgtattgcctctaagggtggacacctatgagatttcatccacataataaggaccttggtctccacagccccttctcttaacccagacactcctttctattgattccaggccttcagatagtaacttaactcattcaaccaagtacccatcagaacatcttttaattcatctgatagagcttggatatttgccctacccacatctcacatggaaatgtgatcccgagtgttggaggtgggtctggtgggaggtgtttgggtcatgggtgcggcttccccatgaacggcctgggccatcccctggtgatgaccgagctcttgtccttgagttcacaggagacctagttgtgtaaaagtgtgtggcacgccccccccacccccgctctgccccggtgacgtgcctgctcctctgcctcccgccatgatcgcaagtttcctgatgtcaaagaaaaaagtccaactctgtaaaatatttgaagagatttattctgagccaaatctgcatgaccatggcctgtgacgcagccctcaggaggtcctgagaacatgtacccaaggcggtcgggtacagcctggttttattcactttagggaggcatgagacatcaatcaaatacatttaacaaatacattggtttggtccagaaaggtgggacaactcaaagtgagggcttccaggctatcagtaaatttaaacattttcttgctgacggttgagtttgtctaaagacctgggatcatagaaaggaaatgctcaggttaagataaagcattgtggagaccaaggttcttctgaagtctcatagtggctgtccttagagacagtcgatgacaaatgcttcctgttcagacctttaaaagctgctggactctcagttaatctcttcaggattgggagggcctgggagaaaaagatcaagctatgttaatagagattctttacagatgcaaatgttcccccacaaaggacggctttgtaggaccatctcaagatatggcaaagaaacatgttttggggtaaattattttgtattctttgtctcataatgttatgccaggttggaaagtaagtcacaatatagggttaaataaaacccatctgatgagaatttatggtttgtagagcatgactccccagaacccttagataggaatataggcaagaaaaaaaatcagaattgagtcctcacggaggcccctctccagaagccaaacagatgccaatgctgagcctcctgtatggcctgcagaaccctgagccagctgaaatcctttctttataaattacccagcctcaggcattcctttatgacaatgcaagaacagcctaatacaccacctataaccccccacctttgagctgtcctgcctttctggacctcaaagcagagcacacctcactatatctccctaaaccatataaaaccaggctgcaccccagccaccctgggcacaagttcttaggttctcctgaggctgtgcctcagccatggtcactcacatttggctcagagtaaatctcttcaaatattattttgtagagtttagctcttcttgttgacaggagccagcatgtaccagtgaccagaaagcctcaagccctggtgctggcttctctgccactcttggacccatgagccctggatgggatggggaaacagggctgccccccagggccttgctctccagtgttgacggaggtgtcgtgggagaggctcgcagagggcaggggtgttgcctccccccacagccaagccaggcctcccccattcccacacccttcccactgaccgtgctcctcagacccaccctgcactcctgccttgcgggccatgccccagggagcctcatggacctcccttacctccctccagtctctgacctgtcaaccaaaatgggattgtggcagatcttaatccgctcagaggtttattttgccaaggttgaggactcgccagggagagagacagaagttactgtaggacctgttgcctgggatttttccgaagagacttttaggactttcgtatttgaaggggaaagagctggcgggaggcggtagaggacctgtcatctacgcacggtctctccaagaatctgcatttcccataaggtgaagtaaacctggagcagaggaagacatgcatgtgtctcgggctgggcggaggaggaacggcttctcgtcttgtcttagtcctgtacctgtgaagataagctgtttattgacactgtcagggtgagagtcagcaggacactgccttagggtacagactggggcccagagggcatttccgtgtgggcagctggtgagggaggcccctggggagcctcgcagccttctatctgcagctgtctgcttaggaccaaaaggaaggccacctttgcatgactctgttcccaaactgaactcctcgtcatagtgggtttggggtcctgagattttattttccttccacagttcccaggtcccccttcagtgaggtcttcctgatggatgctgatatggtctggctgtgtccccacccaaatctcatcttgaattgtagctcccacaattcctacaggtcatgggagggactcagtgggaggtaagtgaatcatgggggcgggtctttcccgtgctgttctcgtgatagtgagtaagtctcatgagatctgatggttttctaaagcatagttcctctgcacgtgccctctcttgccggccaccatgtaagacgtccctttgctcttcctgcatcttccaccatgattgtgaggcctccccagccatgtggaactgtgagtccatgaaacctctttcctttataaattacacagtctcgggtatgtctgtattaccagcgtgagaacagatgaatacagacgccatataaaaccccaatccagcctttccagccttgtctgctgccaccaactcctgctgcttgtccactcctttgctggtgtcaccgtccttgggatgtgagctctgtgaatgcccggcactgtgctgtggtatcagcaggtccccgaccaggaacagctgagccaggaggggccgtgctgcagaggtggccagcgggtcagccgggccgggaggcgctgtgcagcagaggtggccagcgagtcagggtacaaggccagagagggttctctgagagagaattgcatcatatgggggttcccctgcatggctatgcatcagaagcagggatgaatccatttcacactctccccatttactgcttcagagcccctggggaggaaaactcccaggttgcccaggaaactccaaggtggcccttgggaccctggacagctggccttccactggctgccagcctcaccctggctccctgcctctgctcagggaaggccagtcctaacacgcgacatctcccctcttggagaaaccactaggggcagccgtcagtgtgatgggtgggcgcctggccccagagcgggctccacactcggctgggcacctccctctccagggcctgttccagcactgagtgcgcctttggggatcgtgcaccgtgagcagcacagctggaccccaggtgagggcacttcacctcccaggcctggtctccacacccgggtcacagagagacatgtcagctgaggaagcagggcaggcggcctcttccttcaacacctttaacttcctttaaatggagaagggaggctgctcctggggaacacagagggccgctccactgtaaaaccacagcagctgtgcaccaggatgggcctcagggaccagccagcccagggatggccggtgcccccaccctctgacaaatgcacccaggagtcaagcatgggggtgtcctcggcacctggattggaaggttcttgccattgtggatggggtctaacctcctggacttcagtgggtaaccgaaggctccagcacgcagcttcagaaagaccagagccaggcccaggtgccctctccagccgacatccgggctgtggcctctgggctgcttctccttcctgtggcttccaagtcccagggtacatcggtgcccttctgtgtcctggcagttttagagaaaaggaatgaagcagctgtattcacatacatgtagtaaatgtgaaattttcacagcagcaccattaggtctctaattttattacgtcgaaagttgcatgttggcaggagtgatatggctaacagcagttaggactgtgcagctgacttggttgacattttacaccatgttgctgtctgtgttgaacacgcagttggggctgcaacttacatggccttttatcctctttctaccgaaatggttggaaaacagaagggttccatggagaaatggcagattctgggtggggaagcacaaatgagcctgagcacatgacagccccaaggtagaaaacccatcgccctggagggacaccgaagcccacctgaaagagcctctcatggccaacagcaaagatcgtgcgaggctgcgtgacagcgcagagtaaaacaggcacaatgcagactgcgggggagatggacagcccttccttacacaggcagttacacacacgtgatgcagctgtgcccctccggccggcagcgacccctcccctgagcgtggccctgggagcaggattggtagaggaaacagtgtggcgaggagcagcccttggcagcgacccccgtggaggtgcagtgctcgccttgggtgcaaatgactgtgttcggcctccactccgaggctgctggcagtgacccctccgagcagggccgctctgtacctcccctcgccctcactgggctcttggcggcactgagccagcggctcctcctgcccatcctgggccctgtggaggcccctgccccagttcccctcctgcctctgggctgctccttcccagtcacaccctcagctcctcccttcacaagcgctgtggcttggtgtgcagccgcctccatgccttctcacctctgccagcaccccctctcagctgctgcctggtcagcttccttctccccaccgcacacagcaggtgagaaggccacttacccacagcacccacctgggcctcacatctgctggtagccacccaccttccaccccactggcaaccaggccctgcctgcctgttctgctttgccttccagcaggctgtttgtgaacaccacaggcccacccacaccagcctcaacgctcagtgtccagtcctgccccagccagctggggcaacagcctgggcccttgccagcctgggtgccagccccaccacccaagctttagggccagagcacgccttgagtgattctgccattgttctccccatccgtaacaggaaccccacaccgagagctgctcaagattaaattagtcagcagtgccagatgcagagcgagagttgtcttaatgtggccaccgtatcctcctcctcttcttccctgacccctccgtgttcataagctcagtgcttgcagaccgcaccgagggcagagcctgcccagtggagaggaatggactggatggcgccagctgggcctgcttctcgccctgcacttcagcttgtgcctcctttggccccaaaattataggtacagactacaaggaaataagagagagacagaacgggatccactcaaaggtcatggttttagtccgtttctgctgctagaacaagatacccaacactgggcaatttataaacagaatcaatgtatcactcaccattacggaggctggcaatccaggatcaagactctagcaggttttgcgcctgggaagggtcggcctgtctgagacagcaccttgaacgctgcttcccctggaggccacgaacgctgtgtccccatggtggatgggatgtaagggtaaaaaggaccctgctagttttcttgagcctttttatgaggcactggtccatttctgagagcggagtctcatggcctaatcacctcctgataccatcacactgggtcttaagtttcaacataggaattggggcgggtggggggacacgtacatttaaatcatagcaacaaacattacattattagttactgtaacaattcaaaatacctggaattgtcagtcactgcagatttttatgcatcagaataaatgcataaaaatgcacaaaatgcaataccgtggggaatctgctcccttttatgcagacttcaatatagtaacatagaaaaatatttcatgtataatagcaagaaaaacaaacatggttggttactatttttgctaaaaagatataaaaacacaggcctactagaccaaagtctgaataggcagatctcaagataacacatatcaaccgtggtccttctgggtaatgatcagtgacaggtttttcttttgcatgtacacatattctatttttttctgtatgaacctccgatactcgttattttagcttctttctttaataagcaatcgactgactttgcttggtcagtaagacatgcaggacaccacacactgtctctgtgccttgtctggcatcagaaagctgcaagcacattgtgtgggccccagcaggagccagctcagcctgtccccgacgaaaccgggccctcttcacagcccagtggcttctctttgcattcacatttcacttctgcctgttgtgtgtgcttttcccattaccgcccctgagtcttgtgtaacatggtgggatcaaggtaagaagcctgtaacagaacagagggtgactttctcctactctgtggcagaagtgcctagtttgatgggtggagcagtgtgcatcctgtacctcctctcttggccccgagtgtctgggctgtggggtcctgggctaggcctttccaccccacctacctggggcacagctggcatcaggaccacatttgaggctgcagctcgtccactcagctttgcatgggtctttcttgtggggcagacctggaacatctcagtcacaacaaagaagaaaacagggaaaggagggaatttccagttcatgctgtttcaggtacctcctcctggtgaggaatagcctcatcctgcagtccatgaggacctgcaagagcgtcaccagccaagcccaggtcagccccgctgtccgggtagggacctgctttatgcctacgccacccatggcagactggcggcagcagcagcaaaagctcgtgtcttaggagctgtgttgggattaatgctgggtcctggggtttctgcccccacccaccccttcctattccaggggcttagctgctgcggccgtgtgtcctacaggctcgccgggctgttgagtcgcccctgttgggggaagggggtattgaaatgacagcgcatgagtgctgggtccaccctccaagggcatgaggggagctgggcaaaaagtgggtcacatgtgcctggcccatgtcacgcggctcccgcccgaggccaatggggtgggcagcctccctcggtggagagcgaagcaccactctcctttttctccggtagcatctcatcttgtctaaacggggagagtggccatctgtccgatacccacatcaaacctgatcgttcccagcctcacagagctgctttgttccaaggtaagggattgagggccctgggtgagcggtccgcgggcaggacggttggctgagattggcttcgacgggagtcccaggcaatgtggcaggcagagtttgtgcttggttgactgtcggggaaatgcctagaggaaccgcatagccgtgcacgatgcgttacgatgaaaaagcggaaattgtgttaggtttaagcccgctcagatgatgaggctcccgtcaggccggctgttccactaacagggttccttctgaggacccatagcaagtgtcaataatcttctttactagtcgagtgttattatttatggaaacataaacgtggctttacggatgtttatcaatcagagatactggatgtggtatgggagtgtgactctcacctgtgcaaacactggtcacccttgtggggccagacttttctgtctgatgagtgccttccatcactgcttctgtgggtgaacgctggcctctgaactgaacaggtgattacatccccgccactagcgtggggtactgaagtccaacatccgagtgaggcggggtcatgggtgctgccgatggatggagagcatgcacttttgcagcttggtgcttaaaatggggaagaacatgattctcttaacctcaggaaggccagtgagcaggatttctgtgtgatgaagccatcagggaatgcataatacttcaaaatgttgagaaaatgatgctgagtttttcagttcataagttacaacaaaattttatattttcacctattgtaaatgaactaaagtgttcccttagctcaggatccttctggtgaacgtattttggcagttgtgagtacaatagagagggtttgcagtgtctgtgtggtgtgtcgaccatcgctgccatgtttagtcacatttcctgctcctgcttgcatttgctgggaaaaatgttcccagaaatagcttgccagagccaaagtcataacggagtttgatttgaatgtgtcctatcagtttttcctttcagagataaatattttaaatttgtgttttaactcgctttccaggcaagtgggtctgtgaccaagttcatagaaataaatatgaacactttagatttttaaattcttctacattttagttgtatcgaatagcagttgtacccttgataacaaaaagaagcttttctctgcgtgaaagtaatgccttttgaaaacattctgcatttaggctaatacccagttcccaccaactacagccttcaaatgaatttcatgtaatatttctaaaggactgtttcttacccactgccaatcttgaggaaagggaatttttctctcatttcattaagatggggtagaagaatttaatgtttttcatatttatgattataaatgcttcttttacgcttggggaaagtcccacttattttgatgcagtttttaacattatctccattcttctgctccacctgacgtgtatcccagaacttggcttaatgggagcaattagtcatcgtatgtggtcagaagacagggagatgccgctgtaatgagcatgcctgctcatgtttaaaaaattacaaaatcgtagcccacccccagtcgcctttaggggagaatgcgtaccgctatctccaggaacaaagcatgccctgcgcggccggtgctactggatggatattccttcgcttctatcagtggaagatatcgctgttcctgcagaaataacgaaatggaacaatgcagaagcaacaaggtgatgtcccctttgtacttctcagaagaacctccgtgcctcccgccccatccgccactgagtatctcatgcagcggcgtgtcctctggcaccaggcagggactgatgttctccctcacattggcctcattcctctgggtcctgactcatttgggaactgaaagggctgctcggtggagctgggtttgaggatggtcttccacaaggccctgcagacgccacacagccttctccatgtgtggggtgtgtgttatcacccggagctgtgggctctgctcggaaagcggggactggtgctgcttctgcacggccaggacctcggcagggcaggcggctgtcctgcagaggcctcaggcgggctcagggtgtgcaccccccacagccggagcctcccaaagaaacattttcaccccagctgaggtgactgaagggactcagggccacaggccggatgctatgacagggtctccaggacccccgcatggactggaccatctgtgggcagagccagcaggcttggcctgtcctgccgcactccagccagcagaatagcagtgggcttccttctccaagcatgggctgcggtgtttcaatgaaataggacaagtcagtggctctccacgtgtgacccctggaccccccttgccatcacctgagaaccttctggaccttctggatctgtaaattctcagctttcctccccaccagactatgtcagaagcactgaggtagggcccagctgagtgtccacaccttgcacccagggccaggggcacagcctgtgctgttcagtgagccatcaggtcagatatgaaccagacagacctgtggcccagtgacaggaattccaggtgcacaggccagggttcttatcgcaaggaaatgacacagggcctgccccatctgccctgatgccgagcaaaagagaggctcatggaacgtgagaggagaaggggctgtggagaaaatgtggtcctgctcgctcatggttaaggttaacaggaacccaagacagaggctgggtgggagggacgttgtggcagaggctgtgaggcctccaggggctcaggagaaatgaagggtctgtgtctctggggcaggaaccagccacagatggccttaggggaggagaggacctggggaggggtctggtgggaggcgggggtggctggagcaatcccagagaggctgaggtgttcaggctggccccagatgcacacgagcgtgaagcctgttcagaagccagctcctcacaccctctcccctgccagaggctccagcaccccctcccctctcctctcccctcccttccctgtggtcctcctgcccaccccacccccgtctgcatgtgcaccgtcacggagatgcgtgtactagggcggaggtcggggacagtcgtcagaaggacacaggaaagaagggaacaggaatcccataacagaacattatccggcaggagtaattaacacaggcaggactggaggctttgttttgttttgcttaaaaaacagtggtatttaaattaatgggcatgggaagactattcagtgaaagacatcggtcattgaggtatctattcaaaaacacggtttagtactctgccacacaccgaacgcaacgccacagcagccatagaagcgtgtgtggctgtttaacgtggtctttttggggagggcatcctaggcagagcaggcgtggaagggaaggcggcggacggaacaaaacgcgggcacgcaacggctgctgcgccggatctgaggcagggccagcctgtgggagcagcaacatcgctcgcaggacagcgatggagcccccacgaatccgcgtgaaagcagcaaccacctagaaatgaacgtacagctgcttagaaacagaatacggatgacccgaaagacttcccgatggtagtcaccagcatacaggacctgacacgggcgtgcgggcagggtgtgccgctacggggtccctggcgcacctgctacccctgctacccgcattcaccgcacgcggagggtgcgggccgtgaaggttatacatgcaaatatccttccaccagccagttctccttccaggaatctgccacccgacccttgtgttgtgcacagacatggtccaggtgtttgcgacgtgattgtttatcagagagagagaagggaaatctccaggctcgctgtagctgcaggagctctgggggctgcgcccatcgtggagacggatagctgtctctcatgaacacaggacagcaagtccggctgcggccacagaagactcgccctcctggacgcagcgtcttccttcctcagccccacactggaggtggccagtgccatccacagcagaaggggccagccgggaccaggctcacgccgtggaattctgctctgtggtaagaggaagagcgatagctggaacccagcgccgtcgcacacacagcggggaagagtctcagaaatgttactttgagtcaaaaagctggacaaaaaaaggcgcaagccagatggtgctgaagaggccacaggaggctggcagccagggggtctggcacctcactcggaggcgcagtgggcccgtccggaattagtggccatacggcaagtgccgagtggacatcaaaccgtcacttcagactcctgcgcttcactgcctgtcggttatgcctgggttttgaaatcaagtcacagaacacctggaatgtggtgtttacgcagaacaaagcgggtgcctcggaggagagagcctagggacaggggcacctcccggtgtgggtgcccagggttgcagggtggcttcctctgtctgcgcggttttcagagccccagggtcctgcctgcccggctgcctggaggcggcccacatcctgctctgcgccgccgaatctcagcctgaacagcttcgctggtgtttgtgttgacttatttgttctttttttttttttttttttttaaataaaggattccgatgctgttacagtcaataaaagccacaggtctgggtgacctacaaatgtgtgtgtctgactttctgcagtttaaatcgccactgagccttaaggcgtctggcccgcgcattgaggaatccacgtgggtctcggggtccccatgcctgcccagctccctgcttcagcctgggcgggtctggcgggcatttctgcgagcctgtccctgggcccgcctcctggccagacttccagaaacattgtccacatccccgttgcacgtccccccgtcaccggaaactgcagcccacagcactgggaagaacccgggaggcaggcgttaggacggggtggccgagacagggaagggagccatggcggacgtcctcacccaagccagggcttcctgcccctgtggtactgacaggagccccgcaggacgtggggttggctttgggcagctcggtggacacttctctttcagatcctgccacagcaaagctcacgagactcacttcttcccattggaattcactaagaacaaattcaacaattcagacgccccagctggaggtttattttatggattttacctgtgcggtatttagggttgtgtttatgaataaaggtgtgcgttctggcaagtagaaatacagagcttgtctttcacccaagtatctgtaactttctccaatgcagacactaaaatgcaataaaaacaaaccaaacccattaaacatgaattagatgaggcaggctgatgggaggttgtgggattaacaggccgtcagcggattgaagctgcgcacatcgctgggatgctgctgcgggaggattcggtctaatccgggagcatctggctgggcagtgggcagcgtctgcagtcgtggctgcttgaaggtatgaaggttgtggcctttgcttccccccatcaggctgccccaccctggaccccacccagacccctcgggcaccctggggtcatcttcagctcccccttctcttccttccttctcttccgcctgggcccctactgtgacccgaggtcagcagaggaccctggcaggtggctgctccctgggactcgactgtgcaggtgaggcttggggtgaccgctgctcctgctcctgctcctctcgccgtccccaccctcctccatcatgctgtcaacatgcatgtgggctgcagccctcagcctgcaggacgctgtcagtgcagctcctcagtggccagggcagctccaccactgggaggagatgggtgtggagacctcggtggacagaagggcagtggggcctggggagtgtgaccccagggccccagggcctgtcccctcgccaccaacgttgcatgccaccacacctggcacctctttggatccctgcagccctgatcacagagctgcgtatgcattccctcgcaggcagggcccaccaaggtgctgtggccgcactggggtttagcaccagtgccttcaaaccagtggtgcctggcccaaccactgactcacactgtgcttagctttttagtcggatttttttagctgttagtcacacttcagactttaattttttgtgtatgtttcttatctaagttatctttatttttattgaatttatttttgttcatttattttttagttgtaatgttatcgctttatcttaatcttcataaatctattttaactacttttatcatttatttatcttgtatcactcattttattccctttaaagttttactcaacatttattatcttctgggtttttcttagtgattttttttcttttgggaagattcttaatggttttagttgctttagcttatatcttttttaaggagatatttttagcagataccatttgtcatattcttaaaatattaagacgctgaaagaaatgatttgctaatctaattttagcttattttcctgtcataatagagtggtctatcatcttacctgtgatgacgaatgagtctcctaaaaacattaattcatgcatccacgggacctgccagccccatgcacacccttcctagggcagcagggaggccgggagctgcgtctcctgcttccctcctccccagccctccatggagacactcatgaccaccgcctgcagccttgtgcggccagacccggttgggagcagctctggttggctggaagctcctggggtctgaagtgatgaggcctggccctgcaccccgggctcttcctgtgcacagcagggttgactgggaggaccagagggtccaaaccctactgccactgcccaccgcctgccacgcgaccgtgggccaagccactcagtgcctctggcctctggcctctttccccagctgcgtgtgtccagctagcaagtttgtgagtagtgttaccctgtttctgttcccaccacactcatcctgttctgaaggcagaggggatggtgagtcttcttaggacagggaagtcagccctctcatgcgcagaacccctgtggcacctggccggccttcacaccaggtcttcacacccctcatgagaccagccaggaaatgggggcccccaggggaggctgtatagcccagtgccagggagagcccagcacccgctggggaaggccatgcagcccagtgcccgggagagacaggaaccccctacaggaaggcagtgcagcccagtgcccaggagagatgggaaccccccagggaaggccgtgcagcccagtgcccaggagagatgggaaccccccagggaaggccgtgcagcccagtgcctgggagagacaggcaccccccagggaaggccgtgcagtccagtgcccgggagagacaggcaccccccagggaaggccgtgcagtccagtgcccgggagagacgggcacccccttgggaaggccgtgcagcccagtaacccccaggaaggccatgcagcccagtgccctggagagctggtgccctgtgactggggtggggaaggggctacgcggggcttgcctgagtcctcctccctccacccgcacccagagaccttcatgggagacacctcctctccaggaccccaggggcaggggtgatactgcagaggtggctctgggcttcctccccctcccctgccaggttctgcttcactcttgcagcctgggcaggggcgtggggtgtggaaggagaagcgagtggccccttatcttcaatccttgctggaagctgcagtccctgagcctaaccgggccacaagaatgcagaaccagctgaaaagaggccagggccactgccctctccccgcccttggcgccagcatggcggccacgatctttctggtgccgcggtctctgactctgtgggaagaagcatccccggacttgcctctctcctcagagccccagttccatggagggaaggtggcttccatgcctgtctctgggagttttccttaagcagctcctggaagggtgcagtggcgtctcctgctgcggtgacagttcccctgggatgtggaaggtcccaggctttggagaactctcccggagcagaggcctccgtccccccaggggacgggctgggctccgatttgggggcccacatgcatgagtgagcaaacaccccagagggttgggagagcgtccgttcgtgctggcggcagctgtgtgctgatgctccaacatgctccgcctgggcatccagcacgccttaagtgagctggagaggggtgtggacgaggatgagggctctcctggggtgagggtccctcttcagtgccacatccatgcagacccgtgtagacccaggctttttctccatagccaggtgggctttatttttccttaaacatcttaggtggttctcaagtaatcggaggctcgtctgcttttcatgctagcggtgcaatgccccattttatcgtgtgtctaaaaggcgtccctggtcccgcatttttcctagtttcctcagttacctcctgtgaccatttgctgtaatgaaagctggaaggagagctccgtgctgtacccacccacttctgtgaaaagtgggaacaagaacacagatttggaaccagtgctgtgcttttgtgttttggtaaattgtctttaccttccctgagctgttttcttccattcctgcgggattggattcaattctatttgatggtgatggctgtggacagtactaagtgccctccgagcttctacagtggagcagcctgctcagtgtccaggccccggagcccgcgttggggctgcggtcccagtgcccctgccactgtgtggctgtcggcatggtccagctggcctgtggcttcggtgcttggagggctgtggcaagggctgtctgtgcctggcgcgtggtaaacattctatcagtgtgttgtttattattatttgtatggttattggggttctcctttaatttatcaattatgttgacagaatttgtgatataacgatgcccatccattcctaaaatgaatcccattaagatattgtctgattagtcttcatatatactgctgattgcatttgttcatatttgatttggaacatgagttggaatttctgtctaggtagaagctggaattgctgggtcacagcatgcgcccaccatcaaccttcctgggtggcaccgagtggctttcctcggtgatacgggcgagcggggcgggtcatctggtgtcatgtgctctcccacgcttcctggagcaatttttgttgggctgtgtctttacctctgggggctgtggggtgtgtgctgcgactttctcctgcctctacctcctggctgatgcgctcactccactgccctttggatcacggattggccatgagggtgtccctctgggatgtgccttttcaagacctctgcccactcctctgtgagcaacccagaaatattctctgcataggaaccccttgtcattaaacaactgcatgtaccttgtctcacttgtggcctgtatttctgtcccctcacagtgtcagttgacccaaacaaaatcttaattctaacgtggtttatcatttcagcctttttcttaacagtcagagctttctggtgtctgaaaactctgcccttctcccccgcctcccagctctgtgtaaatctcccctgcctcccagctctgtgtaaatggtgtcctgtgctgtctttcagacgctgtgtcgtttatgcttccccttgagacgcacagcacccaagtccccgtgagggtggattgatgagggggttcaggtttcattttattcacctgcccgtgcaggggaccacgcgctgggtactgaaaggccttccgctctgcccatgtctgtgcgcacctgtttttcatgaccttctgttgaattattccatggtctacatgtctggtttttgttgttgttgtcgttgggttttcttgtttgtttgttttttgagacagggtctcgctctgtcacctaggctgcaaagcagtggtgcaacctcagctcactataccctccacctcccaggcagctgggactacaagcgtgcgccatcgtgcctggctaatcttcaaatattttgtagaaacaaggtctcccgatattgcccagcctgggctcaagtgatccacccgcctcagcctgcctaagtgctgggatcacaggcgtgagccaccacgcccggcccaggctgggctcaagtgatccacccgcctcagcctccctaagtgctgggatcacaggcgtgagccaccgcgcccggcccgcttgtctattcttatgccactgtcaaatgagctacattgctgcagcttcatgtctagatctctagtaaaataaatcggctcactttgacctttttcctcaggatattcttgaactgattaatttttcctgtacattttaaaatcagcttgtctatggaattaatctgtagatcaaaattgggagaattaacattttaaattatggagagttcgagtcaatgaaaaatatgttttctaattctcggatcttctttaattgctctttatgatgctttataatttctacatagaggtttcacacatcttttgttgggtctatcccaactctttgccttctttctgatggccttatacatggtatcttcttcttcttttctttttttttttttttttgagacagagtcttgctctgtcgtcccgggctggagtgcagtggcgcgatctcggcttactgcaacctcgggctcccaggttcaaacgattctcctgcttcagcctcccggagtagctgggattacaggcacttgccaccacgcccggctacttttttgtatttttagtagagagggttttgccatgttggccaggctggtctccaatgctgtcttcttttaagatttgattttccgttgctggctggtgtggggatgtggagcgccctcaccctgtgaaggcatcccttcccgtcactgtgtcggtccctgtggttttcgctgcccgtgtcccctgtgctgctgctccttgctgctggcctctggctgtgtcaccagctctggagtggccctagactcacgagagagcatgcaggtcccaaaccgagagtggctggaggcaggagtgctgcaggagtgcctgggccagccccctgtccaagtagggagctctgcccagctcccaaaagagcctcctcacaaagccagtcactgagcccgagcagcgcggtcgcccctgacgcggcaccttccttccaggctcctacctggctcagggcgtccagcggcagccagacaggctgggggcccctccatgttgcgcgctccggctgactcaccggggctgggggcccttccacgcggcgcgctccagctgactcaccgggcctgggggcccctccgtgctgcgcgctccggctgactcactggggctgggggcccctccgtgctgcgtgctgcggctgactctctgctgcacatgtgctggcagctgttccaggttgccacatcctgggattatcttttccagtaaactgtggggtcagcaggcccagtactcgccttgctgctgcttttcaccccctgcaccatggggatgcattgggtcaagtcacacaacgtcagaaaactcaaattcgattaaaaactcaggtctgctactgggctcctgggaaagtgcagagtcagttggggccactctggcaggctgcagtgcctctgcttccccctggctcagcctgcccacaccagcttcccccaggggtcttgggacatctaccagcaatggccagggtgacgtccctccctgtccagggcgagagcaggacagatactgtctctgatgccctcccagtgagctgggaagtaccgctcattcgcagcctctcctcctcatgcccactgaccctgaggctacagggaggttgacctttgcttccttccaagagggttaaacttctactgttcacttctggatctttcacctatataggacacacatttgagggcgaggtgggatccgatgttgattttcggctgtctggatcccccactgctccagcccacagccaatttctccaccagactgtgagccacttgcagacaatggctgtgcccatggccccgcatccccggtgccgtgtgggaactgaggaaaggtgtggggtgaggaatgttcccgctggaccctttttcatgggccagtaggatgtccctgctgcgttcagcttcccactaagactagagggcccgtggagcctgagatgttgtgtgcagcaccagggcaccgatggagcggtcaggggccagaacctgcccttaggcaggcgagtccacgtgcatccatcacagccaggacagtgtcagagcccagacttgactcagctctcagggtggcctaccctgtctctcatcagagatattacgaatcccgaaatgagcatttgaaagaattggaacatttgtaggaggcacactcttacgtggttcccaaaggtgggactaaggaacactggcaccatgagggagcctggctatggtcaggaaaattcagcatcttccagacatgagaccagtgtggctgggccgctggagcaggggaaggtgagcggtcactgttccccactggcacctttgtctgccttgacgctgagtagcaggggagcaggctgttcagaatgctcgccgaggccaggctgtgtaagccctggatggcctccgaatgccgcctgtgacaggcaggagcatgaaattccagaagcctcccctgccctgggtagcctcagggacatgaagtgcatgtgaggctctcaaggagaatgtggcagctaatctgccctgtcatttccgccgtcctggcctcgtgcagcctgatgcaggcactgagctgttaaacaggataaatcaagtaggggctgctgccacccaccccgcactgtgttccctcccacagtcacatcccccagacagctgaggccgtgagtgcagccctggacagagcacagctaacgggggtatggccagagccgctggctgcgacagcgctcgctgcggctgcgaggaccccagatggcgctttgctggcaaggcttctcccgccttctcggggcaagcagtggcacacaggagagagctcaaggcgcctgctgccagccgcactcacagctgtgtgaccgcccttctacactccaaggcatctctatgttaatatccaaacctattcatccatcccccagcaaacaagccttacaacttgggcctcacatgacactttcaaacgtgggtctcttcctttcgggtctgacgggatgtcattcactgttatttttggcatgaaaatagatgatggattacctctctggtggtcgggaacctaggcctggagccagctggtcacagttcagggtcatcgcactgtgtcacctcgtgtaaaacggaggaagagctcgccctactgtgttaggacagcctggatttatatatggaaaaacatggggctgtggccctgtgtggccgctgtttcattacacatcacttcttactagggcagtattcattttactagcattctgttgatttgaatatttttttaaaaaaagagtaactggcaaatttatcagaatttatagtggtaccagttttaaacagattttgccaatttaatcaatataaagatgaaatggccaggtgcaatggctcacgcctgtaatcccaacactttgggaggccgaagcagccaaatcacctgaggtcaggagtttgagacccgcctggccaacgtgatgaaaccccatctctactaaaaatacaaaaaattagccgggtgtgatggtggcacgcctgtagtcccagccactcaggaggctgaggcggaggaattgcttgaacctgggaggtggaggttgcagtgagctgctgtactccaacctgggcaacaggagtgaaactccgtcttaaaaaaaaaaaattaaatgaggctttgattctggtcaaatggagtgggggtacacccccctgcccctcccactgagcacagctgggacttctgcacagagtgctggagcagctcccttgggaccgggaggcggcagtgggagcaggctggaaaggagtccagcccagcagggagcttcctgtgtcctcactgcccttgccacatggcctggactccaggcagccacatacccagaagtgcagccacagagaagctccgcatttctgtctgaggatggagagggagctcctgctggttggcatttgctccaccttccagtctctcccatcctcacccccaggcgatcctgtggcagcagtggctttgagggcacagcagcctgacaggctggcaacgcacaggggcagaacttttctctcccaccagaggacctgtggtctcagagaatgaaggggccctcccagggccatttcccatccctgccctccggggtgggggggtcctcccggggctgtttcgtgtctctgcccttctgcctcttggccttagacaggatgcaagtgcagtaagtttctggcactgtggcaaaagccaggccctggtcagaaagccctggagatcacagagaggggcgagtttgaaaaggggatttcatgaagttgtgtgtgcattcctgggcactgcctgccctctctacgtctgggtctgaccacagacagtacagcaaaggctttgacaaggggactgcagggttgatggcccccaggtcccagccgggcactgggtggcacacacgtggcacagagctaaacagcggtgcagaagctctcagaacagaacagacattggagccacagcccacagaggctttggaactaactagaaccactgcccgataaaataaaaatgtcgtggttctgcataagatttaagtgataactggagtgttacgacaatattcaaacagaccagaggacaactcgacgtccgtactcagcataggaagaaataggaaccctcagcctctccagctgggaaatgagcaacacacaccaacctgggatccttcctggtggaggatccacaagatcttcagagcagctgcgccaccgtgctccaggaggaagggtgagccctctcaaaatgaatggaaaaataggaactctacgcagggaaagcgaaggttttgtttgtttgtttgtttgagtgagacagggtctcactctgtcacccaggctggagtgcagtggtgcaatctcagctcactgcagcctccatctcccaggctcaagcgatcctcccatctcagcctcccagcagctgcaaccacaggtgcagccaccacacctggctaatttttaaaatttttcgtagagatgaggtctctctgtgttgcccgggctggtcctaaactcctacactcaagcgatctgcctacctcagcctcccaaagtaccgggtttacaagcgttagccactgcgcctggccaaggaaatagatttaaagaataaaatggaaattttagaactaaaaaatctaataaccagaatgaaaaattcatgatgtagactcaataacaatggaagtgacagggcacagcgtcagcaaacacgaggacagctcagtacaaatgatccatgccgagtgatagaaaaaggactgggagaaatgaatggagcttccgagacctgcagacaatgcagacaccacagtacacgtggtttttatgtgcacatgggatgttccccaaggcaggtcatattccatgtaaaaaactaaagcctaacaaatttaaaataatttaaatcatataaaatgtattttctggccacagtagaattaaactataaatcaataaccagagataactggaaattttccaaatacttgaaaatcaaaacacacacctctaaataatgccctagtcaaagaggaagtataaaaaaattagaaaatactttgaagtaagagaaaatgaaaaaaaacctataggatactagtaaatcagtgcctctagagaaatttatagcatgacagcatccattagaaaagaagaaaggtcttcaaacaataatgtaagcttccacttgaagaaactttaaaaaaagaaaacaaaacaagcagaagggagtaaataatcaagacccaaacccaatgaaattaaaaacagaactaagcctcttcacattggagtagttcaaataaaggaaggacagaaacaatcatgggtttcaagagcttgcaaaacggtggcagttctctgctgtctgcgtttgttgtgtggcgtgagagtccatcctggtttcgtggcatttttctctgcatcctttttattgacaagacgttcctgtcgtgagtggttttcctctggcctcttctgggagctggtggatttgcaagtcacggccagccttcgaaagcaggactgttgcctggttccccagttgccctcctggaaagctctaccctgctggccctgggcctcggaggggaggggagcgcctggggcgccgcggtcctgaccccacacaacttcttctgccatggcccaaacccagccctgtgccgcctctgtgggccacagggacccccacagcagacccccagcaaaccctcagtgactgtctgaatgaaaaacgcaggagtgggtggtgtgggagaaaataggattacggtgcttctgagtattgagtttagaaatcgctgaatttcagaacgttccacgaggccgtggaaattgagctgggctcagtgctcatggtgtgaatctgtctaatccttaaatacatactgcgcccccttgtgggccaagagtggtgctgggaactggggattcagtggtgaacggaggagacacgtgtgccctctgccctctcggtgccagggtggccccaggtgactgcagcagggccaggagagacggggttgtaggtacagcctggtaggcaataccctccagaagaaggtcctgataagtgggtgggagaactcaccctgtccctgccacggaagccagggagccagcgggagggcagggagcagtgacaaacaagaccaagggggtaggtgctgggctctggacgggaggctcagggccggggttaaacagcacagcagtgggaaggtacccaggggcttcagcacggggtgagtccaagcttagaagctcactggcagcgtcaggcagctcatgcccagccaagtgctcctgagtggacatgcctgggccagctgcgggccacagctgtggctgctttcctggctggccttcatcaagctgagcgagttcccctctattcctgtttttttctgagcattttaatttttatcgtgagttggtatggagttttgtgacaggcttttctgcatgcattgatatgattgtgtgctttctttagtctgttaataaggtagattacacagacagattttccaactctgagccagccttgcatcacaggaagaatggttatagcatgtaattcttgtggtatattgctgaattctatgtgttcatgttttttgtgtgtgaaattattaaatcaagctaattaacatatccatcacctcacatacctttgtttgtggtgaggttcgagtgatcctcccacctgtctcccaggagttgagaccacaggtgcactccaccacacccaactaattttttcaacattttgtagagatggggtctattttgcccaggctggtcttgaactcctagactccagtgacctgcctacctcaggcaacagcctaggcaacatagagagaccccatctctataaagaatttaaaatcactctcagcaattttcaagtatacattgttcttacccatagtcactgtgccacacagcagctccccagcctgtttgactcccgtctaactgaacttgtgccagtgaccaacagctcccatttcccccaaccccccgcagtccccgacagccacctcccaccctctgcttctgtgagatgcacttttttagattccacatgtgagatcatgcagtatttgtctttctgtgcccagttcattttacttgttataatgtcctccaggttcatccgcagtgacacagatgacatggcttctttctgtgtgtatgtctgtgtgtgacattttctttatccgttcgtctctctatgaacacttaggctgattccaccatatctaggctgttgtgagttgtgccacaatcaacacgggcctgcatgtgtctcctcactatagtgactttgggtatatgccctgaagtgagactgctggatcctgtggtggttctatttctagttttttgaggaacttccgtaccgttctccataatgactgtactaagtttcccatcagcactgtacaagggttcccttttgtccacctcctcaccaacacttagcttttgtctttttgataatagccattctaacaggtatgagccgatatcccattgtggtttgaatttgcatttttctggtgattagtgatgttgtgcactttttcatatacctgttagccatttgtatgtctccttctgagaagcttccattccgtttctttgccatttttttaaaatctggtatttgttttcttgctattgagttgtttgagttccttacacattttgagtattaactccttatcagatgttgtatggtttgcagttttttttccagttccctaggttgtctcttcactctgttgtttgctgtgcagaagcttttcagtttgatataatcccatttctctactttctgcttttgttgcctgtactttgagggccatatttaaaaaaaaatcattaactaaaccagtgtcgtggaatttttccctgtgttttttcttagtggttttgcagttgcagatcttacatttaagtctttaacccattttgagttgatttttatagatggtgtgagatgagggtctaatttcattcttctgcacagggacatccagtttccccaacaccgtttattgaagaaactgtccttccccgtgtgtgttcctggtgtctttattgtagatggattggctgcagctgcggggtttcctgccaggctctccgctctcctccaccggcctgcatgtcgttcttacaccagcgccaagttctggtctttagtatttcattcctctgcttacttggatttattttgttcttcttttattagattcttaaaatgagtgcttagattattgattggaagcttttctctcttcaaatgtgtgtgtttcgtgccacaggtttccctctcagcactgctgtagttgtgtcctgcgatttttgatatgctgtgtttttattttcattcaggtcaatgtgttttttgatgttccttgagattccctctttgacccttggattgttcatatatgtgtttcatttccaagtgcttggaacttttcttgttatctttccatgattgattctggtttgagtcagctgtggtcagagaacatacactacggtttcaattctgttaaatttgctgaggtttcttttatggccaagggtatggtctatcctggtatagattctgtacatgcaggaagagagtgtggattctgctgatgctggacagagtgttccggaagtgttcgttaggccccgttggttgatggtgttgagtccttccaaatcctttgctaattctctgcccagtggttctttcagttgttgacagtaataaagtcttcagctgtcgttgtggatttttatatttttcttttcactactattagtttctgcttcacatattttacagctctgttatttgattcatacacatttaggattgctattgcttatttagactcttttatcattatgtaatgtccttctctgtctctgatcattttcattgctctgacgtctattttttccgatattaatatagccattcctgctttcttttgattaatggttgcacgatacgccttttcccattagtttatcttcagtttgcttatattgttctatttgaagtgagttttctgtagacagcatatgatggggtcatatttttaaatccactctgcccatctgtgcttcaattggtgtatttggaccatttatacttaaagttattacggtattgagatgttagggcttaaatctgccatttcaccttttatttatcttttgtatttatttattttgagatagggccctactctgtcatccaggctggagtgcagtagtgtgatcatggctcactgcagcctcttctgggctgaagtgatccccccaccccagcctctcaagcagctgggaccacaggcatgcaccaccatgcccagccaatttatttttatattttgtagagactaggtattcctgtgttgcccaggctggccttgaactcctgggctcaagtgatcctcccaccttgaccgcccaaagtgctgggattacaggcgtgagccatcgcacccagcctcatttttaattttgttggctttgttttttgtttctctggttttagttttttctttcttcctgtgagtcagtgtacatttttttggaattttattttatcagtagcattttagagtatatatctgtatggctttcttttttagtgcttgctgtaggtagtatatcatatatatacacacatactgaatactaagtatatagcatatatatacacacacaaatatatatatgtagcacatgtatatacacatgtatacatacacatatataacatacacatatgcaacatgcatgcacatctaaatatacatatatgtcacgtgtgtgtgcatgtataatgtttgagacaggatcttgctctgttgcccaggctggagtgcagtgacacgatcatggctcactgcagcctcgactaaccaggctccagccgtcctcccacctcagcctccccagtagctgggaccacagacaggcaccaccacacccagctaattttttaaatttttttgtagagacagggttttgccatgttgcccaggcatatatgtgttaccaattctactgctgtcaacatttcaccagttggagggaagaaactgtaacttcctttataatttttttactgtccctcatttatgatgtagttgctttaaatatttcctaagcattctgtacatatcagacaatgctgtaatttttgcatcagtcatcaatcatagtttagaggactcgagagtgaagcctttctatgcactcacatgtttgcctactatgttctttcttccttcctgatattccaagatttcatcattatttcatttctgtttagaggacttaggccttctcccagcgtaggcacgctggcagcaacttctcttcattttccttcatcccataatgtctttattcctgattattttcactggatatatcattccagttggcacttctgtccttttcagcactgagcagttcggggccacgtcctcctggcctccgtgcttctcgcctgaaatccacgccatccattgtctccctcctgtagcatggggtcatgtccctcttgctgcttgcaagaattattctttgcctttggtttttagactcttgactacaatgtgtgtttgtgtggatttccttggatttatcctgtttggggtttactcagcttctcaaatatgtaggtttttactttttgccaaatttgggaagttttagccattattttttcaagagcctttatccccatcccctttgttctctttttctggtaccctaaggacatgaatgttaggtcctccccatgtcccacaggtctcaggggccccatctgtgtgtcttcggtctgtgttctccctcttgttgggacggggtactttctgttgttttttctcacagctccctgcttctctcccctgactctttcactctgttatggttctttctagttctgtcgttccctttcagttgcctgcatctcccattagcttggtgggaactggcttctctgtggaggtattctattctgttttctcatttgtttaaagagtgttcctgcttgtttgctgaagcatttttatgaaggctgctttcacttctttgtcagaggattccgacagctctgtcatcctggggctgacactgtctttcattcagtttgagatcttttgggttctttgtataacaggtgattttctttttgaaatctggaccttctggatattacgttatgagactctggttatataaaccttctgtttagctggctgcctctgatacttctccagcaggggaaacaagaagtgaaagtccaggctttccactcggcctctgctggtaccaagggcagaggacgtggtgaggtgtggaggaggcctcattgccgctggtaccaaggacagaggacatggtgaggtgtggaggaggcctcgttgccgcgggtgccaagggcagaggacgtggtgaggtgtggaggcctcattgctgcgggtgccaagggcagaggatgtggtgaggtgtggaggaggcctcattgccgcgggtgccaagggcagaggatgtggtgaggtgtggaggaggcctcattgccgctggtgccaaggacagaggacgtggtgaggtgtggaggcctcattgccgcgggtgccaagggcagaggatgtggtgaggtgtggaggcctcattgctgcgggtgccaagggcagaggatgtggtgaggtgtggaggaggcctcattgccgcgggtgccaagggcagaggacgtggtaaggtgtggaggaggcctcattgcctctggtaccaagggcagaggatgtggtgaggtgtggaggaggcctcattgccgctggtaccaagggcagaggacgtggtgaggtgtggaggaggcctcattgccccgggtaccaagggcagaggatgtggtgaggtgtggaggaggcctcattgccgctgggcaagggtgggagctctggggccctggaggcctgtgcagaaacctccctgctcagaggagggggctccctcattactgaccccgcattgcctccactgacaccagggggcaaggactcaccacctgtggagatgagagcctctgtccctgctcagcctgctctgaagccacccccgcatggggttcgggagcctcttgacagcctggtgagggcggaggtctaggctctgtacgcggcctttgctgcgtgggtggggaggggcaccgtgtcctccgtggtgcctggtggaataaaggagctgctgctcaacatttccagcctcactgtgctgtcccttcactgacccttcggctgcagaaagcagacttttgttgaggcccttttcttgtctgtgcctgttggcatttccggcttgccagcttttccacttccaagtctgagagacatagagaaagcccaggggttcaccaccacgctgttccctgtgtgccctggtccctggctagtctgcctttcctacgcatttcagtcttcttgtgtttgttgtggatacaatatccaggctgttttgttgtttttagcaggaaggattgggaagcactgtgtgctccatttcccagaagcagcagccttgccactccttttgtgcatgtggcatctgagagcacagatgccggagctgctggggctgcgccagctttgccctgctcagctgcgtcaccagagcaggccctccagcctctccagcatcagtccttccatctgtaagacagggtgatggtggctccacacctcattcagttggagggacaagtaaaggcatcagcagacaccagctgctgaggacaggcccagccagaagcagacaggagctctgtggcatgggggacactgtcaccagtggcctcgttccccagctgtgcacacgttggtgttggtttccactgggcacccaggcaaacagcgtcgccattccgggcacctactttttgaatgtctgtgccttttgtgggagaagagatttctgcaaacgtaatttctagtttaaagttggcaagcattttaggctattggtgcatcctgccaggtcgccctttatagaggctgcaactactacgcactccctaagcttcccggagagccctggcttcgtgacgacctcactgttgtcacagctgctcttatcaatagatgtctagtaccagcccacggcgaagagagacgagccagactctggaaggttgggccgcctttccctgacctgcccttgcagctgtgcttgcagctctgtcctccggggatggccctgcatcgctgctgacccatgggcatttccggagggggctaacggttctcagggtctctcctcaggagcactggggtcctcacactctgctgggtacctgtcctggccgtgtacgaatcccagggaggccgcacagggcaggggggtctgccctagctgagccctgctctgagccgggccctcctcctgctcctgcagctcttgagtgtcacctgtttctgttactgtaataatgacatctcctttcttgggaaggcaccttgcttacctgtttttcttcaaggatagcacagagcctaaagcttagtgactgcctaggaaatatttgttaaaataatcaagttattaattaataactggcgttacctccagagtggatttcagtctgctccttgcatttatgggtgcccgcgggtgggaaccggggctagagcagctcaccctgctcctgtagtcccacctcccacgccacagcagggtgaactggcccctcactcacctgggtctcccagccggggccacccacacgccaccgcacacagcaccttccccacggcagatgcctgctccggggcagggccctgctccacagcgacacagcacgtgataccacaggcagctttcctcccgccagcctcctgtgtgcagcttcagtgcttttagacccgcaattggagctgaattcttaaatccctggtgggttttgagtgaagctgaaatgaataaacatgttccacacgtggacagtatctatacatggaatgattataaagtttgcacatcaaatcacacgtggacagtatctacatggaatgattgtaaggtttccaccttaaacacacgtggacagtatctatacatggaacgattataaagtttgcacattaaatcacacatggacagtatctacatggaatgattgtaaggtttgcacattaaacacacgtggacagtatctatacatggaattattagaaagtttgcacattaaatagcccttgtatgttagcttcctaaatacacctttatgggctcaataccactttgccataagcaagtaagtaaagaaaggaatctttcgttctggcccgtgcactgttgcatgactggagctgtgttgatgccctcatcctgggtctgtttcgtctgtggagacaaagagcgatgtgtgtgggagtgggggttcaggcaggagcgctcacaggggcttcagagacggtggagtggagagaggagctgttaaatgtaagtgccccgagctgccgtcagcagctgcatgcgggccagcagcctctgatttgccttcctccgactgcaaaagtcgttaaatcacatcaagcctggggcctgcttagaagctgtcaggaccgtcttctctactgttcccctgatgcctccattgtgaagacccagcccagctctgaatgcagggacagcacctgtgcttcctggcagatgcagctcagagcaggaaacctggtctccaccttgggcagacagcaacggtgcaggcagtgtggttgcctggcaccccttcctcccctcctcatggccagggccacggccagcctcctcctcccttcttctgcagcccgcccttgggaaaggatgctgtggagttagaggcggggagcttcaggcctggctgcgtctttccctagcttggggacctttgaacaattcctgagtctccctgccatggctcttgtggcagtacattgcggtggctacagatgtttgttgccgtgagtgctgctcagccctcacgtgcttgtccatctgcctgtggcactggcatccagggaacagctttcaagtacatggagatttcacctgcagcttctgatccccccagattctctccagtgtgactttaaggaaaagatacttatgaaaaccaaagggagcttttagaagtcagcgtagctccgagacggaggcctgtttctgctctgtcttggagctgacagtggctccagccaatgaccccattcctccagtagccctcagtaaggagtgctgtgtccctgacctcagtacttggcccatgccaggggctgggactgcgtctgtcactgccagggtgggagacgtggcctcgcagctgtctaaggggcagtttccagcagctactctgctgcgggagagaatggagcagacaggtcatgaggccagcatgagagcatggggaggggttctgcctggccacaccctgcaactagacaacactgcacgcccgctgggcagcacagaaaaggctgaacagaccagctgttggcggggccgtggaggagctgcagctctgtgcgcagctgagggaaatgtggataacagaacctggaactcggtgcacttagggggatgtggataatacaacctgaaaccctgcgctgctgaggggaatgtagataatagaacctggaactctgtgcactgctcaggggaatgtggataatagaacctggaactctgcacagctgaggggaatgtagataatagaacctggaactctgcactgctgaggggaatgtagataacagaacctggaactccgcattgctgaggggaatgtagataatagaacctggaactctgtgcactgctgaggggaatatagataatagaacctggaactctgtgcactgctgaggggaatgtagataatagaacctagaactctgcattgctgaggggaatatagataatagaacctggaactctgtgcactgctgaggggaaggtagataatagaacctggaactctgtgcattactgatgggaatgtagataatagaacctggaactctgtgtgctgctgagaggaatgtagataatagaacctggaactctgcactgctgcggggaatgtagataatagaacttggaactctgtgcactgctgaggggaatgtagataatagaacctggaactctgtgcactcctgaggggaatgtagataatagaacctggaactctgcactgctgaggggaatggagataatagaacctggaactctgtgcattgctgaggggaatgtagataatagaaccaggaactctgcattgctgaggggaatgtagataatagaacctggaactttgtttactgctgaagggaatgtagataatagaacctggaactctgtgcactgctgaggggaatgtagatagtggaaccgccgtgccgcagtcttgaacagtttcttaggaagttccacgtgctgcttccgcaggatccaaccgttgtgctcctaggtggtacctgcaggaaatggaagtgcttccatgagaagaactgtgcacaaatgtctaaagcagctttactcgtgtatcccgccttgcatacagctcgaatgttcttcactggttgagtggaagagccagtggtggttttttcccacggtggaattctaaacagaaaagaactgtttatatgctcagcagcgtggatacatcttctataaatactaagagaagccagacacaaaagaatacttacgacatgattccctttgtgtcgacttctgaaagtccaggagtctatagtgaccgcaagtgggcacctgtcggcgggcagtggcgggtggagtgggagcacggaccacaggggaccaaggactgcaggttcctgtgagccactgtgggacaccccaggggtatacacgggcaagattgtcacactgtagacttgaagtatgtgcagcctattaaccatcaatgatacctttaaaaggccatgacaccacattacacacgcaaggttaaacggtgagtcggtctgtgccactgcacggggccatcagagctctctctgagcgcctcctcccctggcccggccccttctcctgcacagccccggggcctctgcgcccctttgacctcagcctcctgggctgtctcaattgccctgtgcctgtcacccagtgggagcagcccctgagtcaggacgtccacacagcctgccttccacagagcaccaccggcctaaaatcaccacagggtcagaatctaatgtaaggggggtttattcaaaggcagctggaggctggcccacccagaaacaccagctccagagaaatggagtccaccctcgggagtagggaggggaagggtgccctcgggcaggcagaggcggaggcttttagcaggaccgcggcgtccttcctacgaggtgggcgctgtcacagcgtttgatggacgacgggcagtgcctgcttcagggaagggtgcatttaacctgtcagagggtgcggcagtcaccgtttcctgtcttctggtccttgcttatcaggacaaaggggaagttcctctacaagggtcatgaactaagaaggcaggaggtttctgcccctggcattggttaattccctccagtcatcgtgcagaacaaggaaacagagtgcattagtccctggcctgagaaaggggagctgcaagtgcacgtgaggggcgcagtcccgtctctgacggggcgtgggggggggggcggtcccgtctctcacggggcgtggagggcgcagtcccgtctctcgcggggcttcatgtaccagaccgtgttcatgttcacacctgggaggaggggaagcaggcatggtctgtgcggcaggtccagccaacccacagggccttggatgagtctctgcagctgaggctggcactgccagggctgaccccaaggctgtggctaaattgggctcccagcactggccctgtgtcctccgtgaggagatctgcaccccaggtctatgcatggactgtccccacccccaggccccaagctcagctcccttcaacctgtgtgtcctcagggcaccttcactccatccacctgggtctccccatcttagtgaccgtctccactgtgggtgccaggaccctctctacttccatggctgtgcgtcagggccactgtgtgagctggaaatcagcgcagggaactctggagaggggagggagtcctggggaggggagggagtgctggagaggggagggagtcctggagaggggagccgataataacagggaagccccatgaggagggaccatgatggagcgaggactgagtgcaggaaggagggtgttctaggcccgggcagagaggggagtctctagggaggagaagtgccgggggcttttaccctcagggcctatggcagttgtggggtgatggatgaggccttagactaaactctgagagaatgggatgtggagagttgtcttgagcagggagggagtggggaggagggagggggctctgtgttgctggttggaggcatccctggcacctgtcacagcaggggctggagggtggggcaggagctgggggcagtgggggtggaagaggatgcagaaaagctcagattgtgcctcacatggtgggtggggctgctgggcttgttaatgcatgggatggggtgggtcaggagtcgtgctggtcacatatgtcagatgtgggtgtctgaaatccccgtggccacagctgtaggctgcatcccctgggagctggggtgcagagtgtgttctggcctgaggcacatctgcagatggtggtccacagaccccctgggcaagtgcagacagtggggaggcaggtgagggccccgggtgcagacggggggtggggatgaggtgggtggggacccaggccctcacggatgactgtgcctgtcccttctccctgtcccattgcatgggctaaaatgtgctaaatctccagcactggacgggacagagggagggacctggatggaccagagctctgcctgtttctggaacacagtgtggggaggggcgggcaagcctcagaacgggctccattctgagaaacggccagtcccatggggccttggatgccagtggtccgagcatgggctgctgcaggctctacttcagcccttcatttcctggtagccactgagctgccccatggacactgggcagatggccagtgttagctgggaaggacagcagcagccgcagaggtggcagcaaggccagggcactttgcagacggcatggacgggtaggtgcctagggagagccagagagtggttgatgcctcgtccaccctggccttccgagtggtctgcagctctgggagctgctgactggagcagggtaggtcctctggggctctgggcactgagtcccaggtgacccgcacggcacaggatggcctctcactcatgctgcccttgcaatgaagagaggcacaggctgcagctcgctggcctgtgtgactgatagaggctgacagcctggagccccaagcacccctggcaggagctgacccactttcccttccctgggctggaaaccttgacataacagatggctgcagggccctgctgtccctctgatggggaggagagtttttaattaaaagggaggcacagagctccagaccagccacaccgagatgcagtccatgtgtgcgggtccgtcggcacccacaggtgaaagggtacagccaggcttatctcagggtgcccatgtgcacacagaggtgcttctcaggggccacgccatgcatttgaactgatactctgctctcctttctgagatctgtctacacgaatgcactacttagaatgagtcactgaagcaatggtgtgagctgtgctgtccagcagagctgtccgcgctgccagaaatggcctctctctgtgcttttcccccagtagctgccgccgcccacacgaggctgtttggcactttaaatgtgcttgtggatgtttagttttaaactgaaaaaggcacatgtggctgtcctgctgcacagtgcagcgagagcattcttatgcaagggtgatcttcggagccctttgtgctacgtgaagtcctccttaaatgcaacgtgaaaatccttgtccttcaaagtgtcattttattacaaataataatgtaataaaattacaaattaatacaaatactattacagataacaatttgtaataaaattacaataattttgtgatagtctgagtgtgttgatgaagtgacctatacatgtgtttttaagcacaggtgtagacagcgtaagcgcgggtgtagacagcgtgtcactttgtcagtgcagaggtgcatccctggctgtggctcccgtccaccccctgacacctgtggctgctctttgtagatcctccttacacaccacaaaggcagttggaacgggctttacgtctgtgttatctttgtgtttttcttttagcatattcttttaacagaactattttattgagaaaaaagccctctgccctgacttttaacccatagccgcctcttctgtgtgaaccggttgaatcaaagggcagtgtccaggcagctcgattatggtggggggtgcagcttcacaggtttctgttcctggtgggttttacgagccagccccctcggtgaggtgttgcccttcagggaaggactcgggatgaggctgactctgcagagcccagtacctcggagcagggtccccaccgtgccacacaaagtcaccctgactgttgcacgagtccctcacttccactaccatcattctttgctggtcagtcataaaatgaggccttaattttgcccagtgggctccgtcaactcactgaatgatggcacacagtagtgacacgatgactgcagacagcactgtgtgcttggaaggcacttgccgagaactgccaaggacaccagccgtttggcagcttggttgatggagactaagtcatatgagagcatgaggggatgaggatggcaggcttgggacgtgaagggccggctcccacaccctggtcaggggactctggcaccccgtgactgtgtgttgaggccacagcagaagcagggggcaaagccccagggcgctgggcctgtgagctgcaagtcccctgggcctcacaggggtagctcctgccagtctccggctgctgagagaggtgcttccgtgaccctgggcagatgcagacctcggccaggggctgcggtggcctgcccagcgtcaggagggaggcagccgtggggcctccctggagacctctcccaaggccctcccctgaactcccgtgcaccctgtgcccagcaggcgaggcctggtcagcacatggtgggtgggcaaccccattctcctgccacccgggaggccggagtgggagcggcccaggacacccctggatgtgcgtggtccgtgagactcttctctagcagcagctgtgccttctctctccaggtgacgccttctgggccccatctgtccttcctcacagcaccctcagcaccttaagccaccaccctcagccacaatttggcagaaggatggagtccaaggtctcagaaggtggcctgaatgtgaccctcaccatccgcctgctgatgcatggaaaggtaagaggagccgccattgtctctgtaggaaaggcggccgcggcagacagaaccagagatgcactgcccgggccattggcactgtaggaaaggcagacatggcacatagaaccggagatgcactgcccgggccattgtctctgtaggaaaggcagacatggcacatagaaccggagatgcactgcccgggccattgtctctgtaggaaaggcggccgcggcacatagaactggagacgcactgcccgggccattgtctctgtaggaaaggcagacatggcacatagaaccggagatgcactgcccgggccattggcactgtaggaaaggcggccgcggcacatagaaccagagatgcactgcccgggccattgtctctgtaggaaaggcagacatggcacatagaaccggagacgcactgcctgggccattgtctctgtaggaaaggcagacatggcacatagaaccagagatgcactgcccgggccattgtctctgtaggaaaggcggccgcggcacatagaaccggagatgcactgcctgggccattgtctctgtaggaaaggcggacatggcacatagaaccggagatgcactgcccgggccattgtctctgtaggaaaggcggacatggcacatagaaccggagatgcactgcccgggccattgtctctgtaggaaaggcggacatggcacgcagaacctgacactgcctgggtcattggatcattttttaatcttattttaagcaatctcaaacttacaaggcagttataggtacagcccctttgagacagtgccaacctgatatcttctgcgtgtttcctacaaacagggaccttctccagcacaaccacacacagccatcagtgtcagggcacccacacggatgcgttcccaccactggcctcccttcacagcggccgcaaagcatcccctggtcccctgtctcaagtcccttccacctggagtaggtcgtcggctttgactgtgcagtcggcactttctgcacagcgtgtgtggagcacccatgccttggtctaggtctcctggccgttggcaggaacgtggcagcagctctgtcccggggtgtgcctgtcagccgctcccaggaacctgtcctcagactttcagagcatgtgtttctatcctctgggagtcaggttgctatgttgttccccggcttttccttccatgaccacgtgatttgctccgatgccctcgctgcccctgctttggccagaaccccaaggcccgacgagtccctgttcctatagccccatcctgctctttgctcatcttgtcttccttgtcccagtcctggaaccagccactgccccagcagctcctgtgtgtggtggcatgttctggaagccaggatgcatggtgctcctgggctgctgtgggtcctgggctgctgtgggtcccgagctgctgtgggtcctgggctgcacccctgcagaacacttccttccatgttcagctccctatatggaaccccagttccagccccacagcacagggtcccccagttcttcctgcctcaggtgtgcaccacgaggaatccaactgccagtatctgtgcgtggcctcccgccgggaggaggctgccggaggctctgagctctagccccacagcactggcacatcctagatttccgggaagacacggcctcctccccaggggaaggtggtggtgcccacacccagagcattcattcctgcagtggagacagagggacctgcctctccaactgtgggtgtcaggagccaaggcgcatggtaaatggggctctctgtgaggccaggtgcacggccccatctccagcagcagcggccatgccacccagctgcactctgtgggggaggtgccatgattgacgggggcccctccctgtgtccagtgtcctcctccctccacgggcccctctgcacaccgtcctcacagtctccctctgcacaccgtcctcacagcctccctctgcacaccatcctcatggtctccctctgcacaccgtcctcacagcctccctctgcacaccgtcctcacagcctccctctgcacaccgtcctcacagcctccctctgcacaccatcctcatggtctccctctccttccacagacccctctgctcgccatcctgacggcctccctctccctccacggacccctctacacactgtcctcccagcctccctctacacgccatcctcacagcctccctctccctccacgggcccctctacacaccgtcctcacggcctccctctccctccacgggcccctctgcacaccgtcctcacagcctccctctccctccacgggcccctctgcacgccgtcctcacggcctccctctgcctccacgggcccctctgcacgccgtcctcacggcctccctctgcctccacgggcccctctgcatgccgtcctcacggcctccctctctctccacgggcccctctgcacgccgtcctcacggcctccctctctctccacgggcccctctgcacgccgtcctcacagccttcctctttttccacagacccctctgcacgccgtcctcacggcctccctctccctccacgggcccctctgcatgccgtcctcacagcctcaccgacgtcaccattgctggccccgcttcaggtgacaggccacagtagcacctgtcagctctgtcccgctgctggacagggagatactgggccactcagcccagcggggaacgtgtgtcccgaaactgccttgggctcgccatcagaactgtggcagcatcttccagcgttccttttaacaggctgccgttggaataggagtcacggagcaattgcagtgctaagttttctttaagtcacacaattgaaggaggctttatttttcacacatttcttccagagtttcctggtagcctgagtgcatgggtgatgccccctgagttatttatcaggggcagccagctgccctcccccggggcacttacagtcagcccatctctgtcctggtcaggtgggcgccaaggaagacccggctcagggcctctgtatgggcagcctggcttgtacacacacccctccccaccagcagattctgaattctcccttcttcatgcacaccgggaaggtcccttctgcactcataccgggaaggtaggcaggtttcggtagtgtctgcctccagtgttttcctcctcctgctctatgacatcatctttctgtgattttttttttcttgcaggaagttggaagcatcatcgggaaggtaattattgattgaatctctgcctctcctggggtctctgtaaggggatggtgaggatggcagcctccctgggtactaggtggcacccagtaggtgcgcctttcccagttggtgggtggtctgtgttccatgaagacaggaccccagaggtgtcgcctttatgctgtatgacattgaagctggtccctggctctgcgtggcctgaggggaaggggttcactccagctggtcacctcgctgccccctgcccgtggccttggtggccagtccttctttcccggttgaagaccccacgaagaatgatttctcacgccttcttcagccggctgtgtagtctgggtggtctccaggagtgccagtggaggcagcagcccccagacaattcctttccaaatcagggctggcccgggggaagtaaggcccagtttggaagcctgctgccccgggaggccgagcagtgagggccacctccctgtcttcatcacattttcaccgcttccgggggtccttcccctcagtcccaccatgggggcgcctctagtagctcattgtcccggcttcctcccaaacgcttgagagggcgcgtctctgagagtcaccacctccgggaggctgagccagagtgtagccggcaatgcggggcgcctgagggcacgcacactgccatgtgccatgagtgagctgccatggggagtcaggtcagacctgcgccacccttgccagctgtgtgcctgtaggtgggtgcacttgcattcctgggcctcagtttcccatctgaaatgtctgccagggtgtggtgggcatggagcctggccttcttagtggagaggctggtttgctcctccagcacaggcaggaggctctgctgtgtgggcgtatgggccaggctgctccccacccaccatgggccgcgccgtcctcagagccagagggataccttttccttattgtctaaatctttattccagaaaggagaaactgtgaagaagatgcgtgaggaggtgagtgtggtgggtccccacctgtccgcagccattcccgggtgggcggggtgggtccccaggctctgcccctgccgacgtcctgcctgtgctcttggccagccggggtgtgtggggagtgcagtgcggggcctcttttcccctactcaggcctcctgtgctcccctgtggggaaggaatctgttggattccttttgctagttaaaatttcattgtaaaggagattgttgagaagcattttactgttcattcatggtttccgtcagcggacagaggcatgtgtttgtgtcaattgtcaacggacttgcggcccccgacccactggcccaagggttttaatcaggtcgctggggtttctctgctctcaccttagagtggtgcaaggatcaacatctcagagggaaactgcccagagaggattgtgaccatcacaggccccacagacgccatcttcaaggcctttgccatgatcgcatacaagtttgaggaggtaacctgcaccccaggcacctctgccagcctggcgggggcaggcctggtcccagctggctccctgggtcctctcccctacacctggactaggggatgccccagcccgcccaggcaaccccataactacgctcacctcctttgcctcccagggcctctccgcagctctggttcacccagtcaggggccagtgtctctccatccttctgaagccagctactcccggctgtatgccttaggtccacctccctcagcttccccagaccctgccctggggcaccgagcacggcctcagaacaccccacccttcccctggggcgtgcagcctggctgacccttgggccacaccagcacctccagcctccagccagctctgccacatggctctcgatgaagccctggctggcacagccctggtcctcagccacacagcaccatgcctctggggcccccgtgacagctgatgtagccttgctgagatacggacggtaaaggtagaggccatccgtgatagtggatatgagacagagacagagagagagacagagagagagaggaagacagagagagacagagagatgagagagagagaggaagacagagagagagagatgagagagagagagacagaaagagagagagacagagacagagagagagcgagggggagagagcagcacttctgtgtattctgtcattgaatgaaattttaatgtctttatgtgtttctaattttcttgaaattgctggaagttagagatgcatttagtgtctttgaggagtgaccattaagtaatgaggtgcactttgtgggaataaacaaagacccctccaagggagaatgggcagaggctctttattatccaaagctggccatggtgggggtcggcgccatcttctgtgcttggcagagactcaaaggcaggcaggagggggagcttgggagtgggagagaagaggagagatgtgccctggggccagcagtagggctagaagtggggcatcccatgtgactggttggaggagtgtgcgaggccttttccagtgggtcctgagttggaactggggatgcacatgagggaagctgactgcccagagccgactgcagcagagcctgtggcctggcctccaaggctggacactgcagacactggggccagtgttcccctatcgtaggtggcctggcctccaaggctggacgctgcagacactggggccagtgttcccctatcgtaggtggcctggccactgtctgtaggttgtctcttagtttcccctttaagccactctctcatttgcaagaggatagacagttcaggaaaggctagagagccaggtcacgccgcttggggatggtttagttgcctttttggtcagctgtgctgcagggtcctctggatctttctgttgctgagtcatcctggccgttgtctgatgggagactgatggaatacagcagaccagcatcatgacaccaaaacagaaacaagaacaacccagtccccggatggtggtgagaccaagagcgccgttacccaacccaaggcaagaggacacatcccatagccatgaggaccagccttggagagtctcatagccgctccttagggtgctgggcagcccgctcctgggaccttcgctctgcaggtaacatgtgcagtggcacagacgccagcatggctggccagcaagaaactggagaaaagcaatcacccaccgctgcttgtgccaacacgtcttccacccagggcaggcggtgtcccgaataacttctgctggagttggcgatgggtttctgaccgcactttctgcctgtgtgattcccactgtgggggacactcagtcatcccttccacgagtacacaaataatcacaggtggcctcgttttggaactcgagtttgagtcagaatttccagctgtggagattatagaattagggtctttgtacacagagaagtctcaggataccattcctaagatgtctgaggtattcatctgaggccagcagggcctggtgactggtcccaaggaagcagtgtctggtggaggcatatggagactggggaagggctgttgctcaggacaagaggttggaaccaaggcctgtgtcctccagcttcagttgggacctgttttagtttctccctcgtggccagggtttcgtggccagttgccccatgcaggttgctgaatttaagttttgaatgacctagggaccgatcagtaaactttaataattggttgcttttctaggagaaagggacgctagcaaagtcacaggcaatttgtttagagtcagttgtccacgtagatgcaagcagaaagaccatcagctgtcattccccagggtcccatttgatgagactggcatgtctagagatgtgcatccctggggcctggtggtgggcggtgtgtccagtggtcagtgagagtgagggcagtggttactgtttgggataatcaagaatggcactagaacgaatatgtgctaacataacaattatcataaagtgaaaagaaaatagaaaagggaccatcaacagaggtggatgacaaccaggggtccatggagaataagagggagaatgattatatataagcagatgaaaaatgaaacaaatcagacagaggtcttgtcaggacatctgagcagacattgtcccttgtccaaggtcttcatcttgcaggaaggtctgagatcagccgtctgtttctgaagaatggctgcctctagaggatctcagagaacctcagtttgaggtcctgtgtgggagtctttttctagttgtgtggaattctgaatcgctgctttggctgtgaaatgtgaaaccaaggactgattccttggagtttcactgctggatttgttagcaatacttgtaagaccccttgcaatgagtttagagaaacagattttctctgacgtcccttccagtagacaaaatctcctggttgaaggtcctaaggaggatgtttgggaagatgtcatgggaagcagccgtaacctacgctattacgtaggttatgtagggctgtgctgagtcctctacagtcatttgtcatctctgccgcagcagggcagagtcgagtatcaggaattcctaaaggtacaagccttccagtcatcagtccatggaggaagagctgagatgtctccaagcgcgcagactgtatggccaaggaagctcgagggattcggacagttttcatcttttggtccttcggtttttccagaagactgtggatgctcaggaagctcgagggatttggagttttcatcttttggtcctttggtttttccagaagactgtggatgctcaggaagctcgagggatttggagttttcatcttttggtccttcggtttttccagaagactgtggatggtcaggacagtgttgttcttgagtaaggggtaactactcagagagttctgttataatggtttgtgtaaaatgtatttctcaatcacttcatgtaaaagttggtatgcttcaggttggaaatgcaaaatcaaggaattttttggcaactttaaggaccgtagcttttaaacaaggaagtgcttcagcccatcctgaaaacacacacataacagcgaaagtatttccagtcccaagtgaacactggttaaaatctacctgaaggtgctcagagggcccttgagtcgtcgctctggggccgtgtctcaccctcacaccatgtcacgattgtgctggtgacggatacctggccttaaaagaacctcagcagtctttgtaaagcttcccaccagtgttgactggagatattcatccagtctttgtaaagctttcccaccagtgttgactggagatattcatcaatttgtctacagcatgatgagtagtttcatggattgacttagcgaatatctgtttgaaatcatctggtaccacagccagctgagagcaccagagattgagtaaaggatacaaccagaattttcagaatttgtccattcttccttttcaaaatcaggggcgaagtgttgaaatcttacaatggcctcttggcttgcctccagagatccaaacttcgaggcttagctggagtcaagctgtggctaaagcactagttgggcagaatgaccccccagagcacctcctccaacgaccgcatctccgtctgcactggcctcgcatctgcagtcaccacctctctaggaagaagtgtgcccaagaactcagcacccggcccacgtagggtgggcttccagcagagctaaaagcccctctgtttccagagcatccaccgccatgggcccttggttagttgacaagtgctggcaagtgtgatgagttctgcatctggcagactttctgcaccacagaggactgtgccgaaggagagagccaggtcagcggcagcacactgtcccagcctgcttgggctgccattgcaaaatgccatgactgcgtggcttacacggcagacgctggttctctcacagtccaggaggctggaagtctcagatggaggtgccatcagggccggttcctctgaggcctctctctttggcttgcagatgccgtcttcttcctgggtcctcacagagtcacccctctgtgtgtgtcagttccttgtctcctcttacaaggacaccagtcagattacattagggtctactgtagggaccccattttaccttagttacctctgtaaagccccatctctaaacacaatcacacggagggtcagggtttcagtggatgaacttggtccggttctgcagcacaggccctgcctgatcacctccagcttcagttgtgaagtgggatgttaggccgggattctcgacagagtccactaaggctgcaggtaggtggggtcctccacagacttcctcgtctctgaacaaagagggcgtcaccacgatgtgtcagaactgaatcgctagggagatttaggtcttctaagtcttaatgaggacctggaaaaagcaggaggagacttcagtgacccccagggcgtgactgtccaagttcatcattgtcctccccattgagggcaaaacatgctcactctcctggtctagcggcagccctggaggggcagcgtgaacacccaccaccatgaagcacgtggctttgggaagaatggacagcaaagttgtgtttcggttcagtacccctaggaagtaagggagaataattttgttggtggccctgaggtcttcggcagatcagtatcttggtatctgtactggcaggacaggcgtgtcacaggggctggggtcaggtcaggaaggcctttgggtaggagccgtaggggtggggtcgggccggggaggcctttggataggggctagggtcgggtcgggaaggccttggacaggggccgtttgtctgtagtttgagcccttcttttggatttggggtcacaggattgtggagaatttcgggtcatgttttggtggaacctctcggagcctttagaggctctgccccggtcattttgcctgtgttagtgggattgtgtcaggtgcagcgtcaagacccttacccggagtctacacccacctcatgaggcaggggtctgcccagagcccacacacttgccggtgggccgaggagttctccgggagctcaggaaacagtgtctctgatgtacatttaaggtgccatcccgttttcaggcaaagtctctgcctactaaattttcaggggtggagtcccagagcaagaatgaatgttttccaatcaagggcccaagggttacagttcagggctggaaaatagggagagaaaacacggcgggtgatttgaaacgcctcccagggtgtggtgtacctaaactgaggaggaggatgacgtgagacctttctgcaggtcggatgcaggaagagccgcagtggccaccaggaggatgaggaagaccacctgcgtccagtgttagtcaccctgagagctgaaggccaggcggaggccggccgcccgttccttcctcgggctccctcactgcctggacccaggatctttctatgtctcagttgttctttctggggatgggatcatcttttctctggtgtcctttctgaatgcagcagctattacatgagtgtgcttgttgggtgctggggctggtgaggggcgcctagctctctggtctgcaggagtcctggctcatttttgttccagagctttttcagtgtgttctgccagtggctgtcattcagcagaagggctattcccatccctacttctgcgttcgagtggggtttcactccactgacctcatgggacgaaagggctgccctcacgccagcgcctcccttacctcgaagggtagagacagtcgaggttgtcggaagggactttctagtctgtccccagatctccagttgtttcatcttacgtctgtctttgtgcttgttctaatcagttcctactggagatgttttaggggtggcatttaggactttgctatgggaccttttttgaccctcgggttcatttgttgacagagttcaggtaactctgggtcatgtgcaaccaaaagaattctaaattcttctgttggtcattgcaggtcttgtctgggtgtagggaatctgtaagtgtggctctgaattcagctccaatccaaggtttagcttctggagttgcctattcgcctggctctcgggggatgggtttttacaggcagctggcatttgggggttttaggagggctggaaaagatagaggtagagtcgatggaggagctggaagggaaggacggggcggggggagtgctgggcaggggcagtgggaggaaaaggagggagagcttacgagcctgggggtctggtttgttgccgacgtctgccaggttgctgactagctgtagccaaagaatgttttagtgaaactatttttaaatgagaagttcatttgaaggcctcttcataccaatcaaaaaatgctgcccattgggcctgaaaaaatcttattatctttcttttttaaggtgcctcttaatgaacaatttcgttaaagtcaaatgttcccccagggcagccagtgaggcccaatcatccttggggaattgaggccacttggagagacaggcaccagaattccagttgcagtgactccattcaaggagttttcctgggagaggaggggattgagacatggccccatgagagcgggtggcaggaagtgggaatttagtgtccgtgcctgtgcctcaggtccctaacccgacaccttgacacacagagcctctccccagcctcaccagaaagaacgctctgtgtgggtcaaagtcaagctctcagcacaaaaaatagacaaaggggacaccatcctatttccttgctagtctatagcagtttgtccaggcacacactggccaagccttgtttctaagaagagggcacttttcgtggagagcaaatcctgttgccctgaatcgtaactcaggcataatggatccagagctgggggtgtcctgggggtgctgccctgtcactgcctctgccgcgctgtccgccacgctctgcagcgagctccggagctgccctgtcactgcctctgccgcgctgtctgccacgctctgcagcgagctccgggccacagcctggacacgccccatgcggctgacagaagccctgtcccccacgggttgccagcctgaacccaaagcccagctctgtctcctgggtgtcaggaccatgagccaaaccaggctgcccaggagggtgggcacaggccgccccccacctcagccttctcccgcttctacattaaccacacatctccttccctaggccagacaccaggagccattctctgcccccgtgccctccacacccagtcgtggcctgtccccgacatccctgccttacctggctctgggcatcagacccagcccccagctagtctccagcctccattctcccctccccttaggccagcacccacacttcctgtatcagcctgtctgtccacacccccttcccaccaggtctccacgaccaaggccagacccgccccaaccccactgcggcacggtgaccatcctgccttgccgtctgtgtgccctgccagcctgcccatccatttcagcgacgtctcctggtcctccctggcctggcctggccactttgtcctcggctgtgcatgacaggggctctgtgggcttctgagtgtgggaagtcaggacacaccccctgccctcctgctttctcactgcacgacgcctgaagtgctgccaacacacgtgtctctcccctaggatatcatcaactccatgagcaacagccctgccaccagcaagcccccagtgacgctgaggctggtggtgcctgccagccagtgtgggtccctgatcggcaaaggaggctccaagatcaaggagatcagggaggtaacaggaccttcccagcctgggccgctgcggagcctctaggcgggctgcgggtggtggccacaggccaggcagccttcctgagccttgtccctgctgtctgcaagcccaatgctggccacgcagaccccacagctcaaagtgcgagacaggaacacaggacccatgagcaagcacaactgcactgcagggacccagcccacccactgcccagatacggacccggccacccactgcccagatacagacctggcccacccactgcccagatacggaccccccccacccactgcccagatacggaccccccccccacccactgcccagatacggacccggcccacccactgcccagatacggacctggccacccactgcccagatacggacccggccacccactgcccagatacagacccggcccacccactgcccagatatggacccccccaacccacttcccagatacggacccccccacacacacttcccagatacggacccccctcacctgcttcccaaatatggacctggcccacccactgcccagatatggaccccccccaccactgcccagatacggaccccccccaccactgcccagatacggacccccccccacccactgcccagatacggaccccccccaccactgcccagatatggacctggcccacccactgcccagatacggaccccccccacccactgcccagatacggaccccccacccactgcccaaatatgggccctttccacccactgctcacctatggatcctgcccacccactacactcctatgggccgtgctggggacagggaggaactagctggtcacatggttctgggcaagggaggccctgggcactgggtgctgtatctactccctgtgaggggcctccagggcacctggagacagccctgagccatcggcctgtcccagtgggcagagtttgcagatgtgaacttcacatccacacgtttgtcccatttcaaggaaagcctgaatccttgccctatgcagcagggcagctgccccaatcttcatttcctttcccatgaccagagtccacctttctctgtgacctaaaactccacagaggagagaggattccgtgtatttgaaaagagtcgtttgtctccctgaaaatgcctctgattagatgcctccttgtctagccttggccaggtgccaagtgcgcccgagggaaggcacagggccgggtgccaggccgtggtagcaggggcagcatgggggcagtgctgggatggcggtgggggagggggcgcgtgggctgtatgcaggtttccaaggaagtgtcccccgagctgccttgggtgccgagactcgggaggtactgctgccccatgcgctgctaccctggtgctcccttccaatgtcccctctctccagtccacaggtgcccaggtgcaggtggctggggacatgctgcccaactccacggagcgagcggtgaccatctcggggaccccagatgccatcatccagtgcgtcaagcagatctgtgtggtcatgctggaggtaccgtctgcgcgccagggccagcccacgtcagtgctggatttggcctcccagcactgcaggcaaaggcttggaagccccggtcgccccaaggactcacacagttggggctgtggggggctcctgaccccaagtcagcctgagcgagagcggtgccggtatgggcgccacaggggtgctggggctgccagctcagggtccagtgtcttcgtgggggcgtctaggggagagcatgtggagaggagggagcctctcctctcatcttcggatttgggtaagaagttgtcatcccactgaggggtcttctgcactgagttggagctgcagaaacagtgctctttacgttggagtcaggccttggggggcagctgggggtgggagggaggcaaaggcaggaggctcctctgcgcatgcagttctgcagaaggaggcgtcaaaccaccgtggaggaacagaggtcaaaactcgggaaaacatacaaaactcatgcagaagtagagatgggtgaacaaaagcattaaaacggaaaagcagagaagaacccgctcagagcagacgcctctcttgaagtttcggggggaggaaaaaactcagaagtatactcaaaattcatgaagctatcaacagttgccagtctttcctgaagcaaaaatgaagaagcctcgccccagatggaaagttctagcagctctgcagggtcagcctccagcccctcctgcagcccaggctcactcctctctcgtacttggcttggggttcaaaccccatgtttgactctttaaaaaatgtttgcgtagttgttgtttccctgaagtttgatactttgtgaagtgaaaaatatttttcaaaatattcttgttctgaaatcttccccactccctggttagggcgaaagtgccatgctggtctgagctatctgttcaactctccagtctcaggccctggaggccctgcgggccgaggctcaggagcagccagtgacacgaacagttctaggagggacatccctaatggagggccgaggtccagctcctcaacaacacgtgggtctcgtcagcgtcacccagtgcctctgctgcctgcgtcccggtgcagtgccaggtgcagctccacagatgcaggtgcacccgctgccccaaggctgcccatgcccccagagccatcatccgaaccaccctatctccttcctgggcagggaggtttgagcaagacagggagctcgtagcagacatggccagtgaagatggccaggcagctgctctcactcccgctggctgtgctgcatcccaagtcccaggggccatcatcccagggaggaagattcatcacacctggaaacagctgggtccgccctcagatgaagagtgactggaaaaataaagccaaggatgccttaaagaccctcctggttgattggaggacttctgggcttggtagtgggcatgcctcacctcacacccaggagatgacggaggaaagggctgcccagggtgccatgagtctgggtggggcctgctgagaatacagacatcgccacagatggtgccctgcccacccagggcccagcaccctgtacccagtgcagggaggctcatgcagtcccaggggaggccagcaggccctgtgcccagagaagaagtgggaatcacaggtcagggtcagctgggagctcctgtgcctgggtgggggtcgagggcccatagcacaggggcactggcccgaggctgggcatctccaggagccggggagggcagcagcggctcccgtctacctcagtcagttcctcccaccccaggcccagctcaagtcagcccagacccgccccacatccccttccccacagtacttgaggtcacaccccagggccctggcgctgcggatccagccacccactccccatcttggggctttgagtgtgagtggcgctccctgagtgctgggctggccctgagtcagccaaggccccagaactcccagcaggacaggctgccccctgccaggaacggctcatgggctccagcccccacctcttcctgctggaccaaccccagctgtggtgccccccaggcccaggacttctgcctccttgacctgggccctggggacagttagacaggggactcacccaggagaaggagggcaggctaaaaatgctggcgctggagaatgttaatcctgtgtttccgacagaatacccaagggaaattaaggcaaacctcatcgtaactatgggattttttcctctggagtctataagcactttaaacatgctttttcacatagtgaagtgagatgtttccaagtctcctgtggagatctctgctgactgtcaccacgggccaagccaagcgctttggatataggtcccggtggagtcctacagggctcaactttctccagaacattcaagagaattgctccaaggggcagctccctgtgaagccgtgcagccaggcctgcagggccctgcgcatcccaggaggggccccggtggaggggccagcaccgcagggggccgtctgggttggcggccagcccttgtccagcagggtcttgtgggcaagggacccaccccagctggcctcccacaatgggactgactctccgcactgccacagagcctcccagggatgttcggggcaggcggtactctcaggaggccggtgtgtggcaaactgcagcccagggctcagcaaaaaggagccctctggagggacaggccataagacagccacacagagggtgtgggggctggaggtcttcactcccctcccccagcactgctgcgaaactcggggaggtgtggggagcgtggagctggtgcagggggctgagtggggtgggccggggcacgcctccccattgccaggctgcgaagctgctctaacgctctctctccctctcctgtcccttttcctagtccccaccgaaaggtgccaccattccctaccgcccaaagcccgcctccacccctgtcatttttgcaggtggtcaggtaagagccgatccgctcgcggcctccactgccaacctcagccttttactgcagcacccgccgctgcccgttagtgcactcaggttttctcgccttctcacgtgcacgtctcccacccgtgctggaggcagagctcttccacctacacccagcaccaggcggacgcagggggccttcagagcggcattcccccacagagacggccccacggaatcatgttctccctccctgacccgggcaggaagatctggctctgcctaaatccagttcccagaactgggtgtttttaggaagcttagatagccggcgcgcaggcgctttctaggtgattttacgtctcacgttggaaacagcatggtgagaaccagggtcttgtttccactgacatccgtgttcccaaactcccaggatgtgcttgtagcagggacgtgcgagaggagggagctctgcactgaggaaggatgcatggcccgacgaccgggcgtctgtgccgctgtgtccggacctccgtctgctgtgagcaggggcctcacaggcgccccataccccatacccagtctgcagatctggctcttttggtttcagcccttgagctctgtgttctcccgccagggatggcagcacctctgcaggagagtggaggaggggagccctgccccagcccctcacctgagcccaaaccctggccagggcacagggaacacccacccactcagggccagtctgtggccaacagactttgaaggtgtccggcgggggttggcctggaagagctctgtgtccagtcggccgtgatgtgtgtctttgttcaagggagagttgagacagacgttcccacaggtgaccctggcaaggcagaacaggcctgaggtttgactttaccatcaaaaaggagagaaggggcaaatgttagcacttttcctggtgcttttccttacggtgtaaaggaatcttatcagatctcccagttgtggcccgtgtttgagggagagacagggagtgtgtgtccatcccttccctcccagggtcccgtgtgctcagggcagggtatgccttttccccacactggcctcgtctccacagcctggcacacaccccttcctgtcttgctgtggtcagggagcccccacatgcacatgccatccttacagcagccccagggcatggcacacccccattttatagccaggaaactgggcctggctagccagggatttgcctggtgtcacagccctgtgggcagcaggacatgtccttacctcgccgacctagggggctcaggtcacagggtcacacggagtcacacggcgggagaagtccctgtgcaaaactccatttcgctgctttccccaaattcatggttaggtaaccggtttagtaacctctgtggactccacctttatgtttaaacaaatccatgatgatatcatgtggtaaaaggtaggatttttttcaaaaggaaggtgtgtttatacaaacacatgtggggtcttaaagccactgggggaggagtcacagctccagggaagagggggtgcagctgagccctgctcagccaccggccacacacctctcactcctgtaaagaaggcagtagcacgccctccctactgcagcaggtgaagggccctgtgcagtgggtgctgtccgaaggttgatgctagaatgtcagccctttgagagctgggccctggggccctggggacagtctggtctggccagtggtcagccttggtggtggaggacagagtcgcagggagttacccaccctgaagtaacccaggggagctgccgaaatgcaaacccagaagtgtgggccggatacctgcaaggccactggcgtctccttgacgactcagacccacagtgcctagattaggacacacaacccaatacagaccctagagagctaacctggagggcccatccactttatttctgtccagttggagaaatcagggacctggaagatgccccaccactgtgagtgctctgggggcacccagcagcagctcctgtcagccaccaccgcgtttctagcacgacatggtcgtgagttaaatcagcagagcctgctaagggacgagcagatagaaaacataacagtaagaagatcagtcagaaaactcgcgtggcccaggatgcaggatgcttgagctcttgtggttcagctcagacagttggggctgacctgggaccccgtgcgctgagggggcggctcccagcatgagttccagggcccctcaccttcggtgacacatgggaacgtgcctctggcagcacctttacaaaacacttgcaggtggccctcaagacactttgtacaggacagtgaggtccttggttcctgctctatctgataagattcttttacttcctcagctgacgcagcactgtggcctcacagccctggggcttgtttcaaagctgggctgcagccgggtccctgtctggaggttgactggcctttaactccgaggattgggttgtttatgatgaaaactcttggcagattcaaaacccatgggagggtttgggctgcacagaggtgacacacatccttccctgaagtgtccctctctggtgcacagggtccccccacccccacgtgtggtcaccgcgaacaccgataccacgggtcctcatgggaagtggcgtggggcccgcacagccaggggctggtagccgctccctccacccccaggctgccaccaggcctggtgcagccctgtccatgtcccgagtcctgacagctgttcgtggtcttcactctcccttgactctgtgtggtccatttgttgtctggccatgagtttctgaatcacctgaaagcgtctccactgacgggacctgtggggcaggtggggcctctctcacctgcccggatttcagagtcagggtgggtgggaagaggctgcaggtcggagtcactgttttgaaggcgagggaaatactgaagccaaaatgaggcctcaggagccccacacgatggcttgggaggggtgtattgctgcccccacgtcaggagggccaccccctccctgtcttcagggcggtcatgagaggcagcaagctgtgactgacgtagacccacttcctacgtagactggcttttggtgaattggttttggtcaccttttagagctttcttttgttgtttggacttcttggggtaaattatttcccaaaagtatttactcagatgactgattaaattttcaaaaccgtaataattagtggagacctcttactgggcagatcactcttcgattcttttgctttaagaaacttggagtcggaagcatcaaggctgaactgtttccctcccacccgctgaactggccagctcagctctgcccgcccagaggaagtgggtgcggctcccctggggctcctggtgccctgggagggttggccctttgtcctaggatggggacaggtggagaggcacacgagggggaagcttctaccggagggtccttgtcatgctggagggtggcggcgggtgctgagccgtggtgcagccaggttgcagtctgacggggtctctctctctctctaggcctacacaatccagggacagtatgccatccctcacccggatgtgagtcttcactttgtcttcctctcacctttctcttctcatggttgtttacctacctgcatgctgctgttaattgctactaacattaatattacacaataatattaatcaacttctcagcgttcctgacctgtgtcgtatccatatgacctcgaataaccttttaacctcttagcactaattctgcttgtgttgaggacttggcctgatgtcaaattgtctcaattctgccgcagtcctgggttttcctccctcccacggggcctgggagggaactgagacgggctctgtccccgtgcagggcagtgaggatgtgctcacccgccacaggcaggcgtcagtgatactttctctgcgcctaagaagttgggtgacattatcaaacaggccacaaagataccttggcaagcacatttgagggcctggtgaaattaactccccctttcagagtccacatgaaaacatagggtccatctacacacacagatccaggctgtggaaagccagtggaataggcctttgtcttcattccagaatcagtgggatgccaggcgggcatagcgtccttggctccgcccgggccatgcggagctgggtcccatgcagctccatgaccgggggctccgacacctcttttctgctcctgctgggtctaggtgtaattccagtgctggaggaagaagttaccctcagataaacggtcggtgtaattccagtgctgggggaagaagttaccctcagataaacggtcggtgtaattccagtgctgggggaagaagttactctcagataaaccgtcggtgtaattccagtgctggaggaagaagttactctcagataaacggtcggtgtaattccagtgctgggggaagaagttactctcagataaacggtcggtgtaattccagtgctgggggaagaagttaccctcagataaacggtcggtgtaattccagtgctgggggaagaagttaccctcagataaaccgtcggtgtaattccagtgctgggggaagaagttaccctcagataaaccgtcggtgtaattccagtgctgggggaagaagttactctcagataaaccgtcggtgtaattccagtgctggaggaagaagttactctcagataaacggtcggtgtaattccagtgctgggggaagaagttaccctcagataaaccattggtgtaattccagtgctgagggaagaagttaccctcagataaaccactggtgtaattccagtgctggaggaagaagttactctcagataaaccgtcggtgtaattccagtgctggaggaagaagatactctcagatcatccatcggaggggaaccctgggcggctctgggctgtgcggctcagaccccttaggggccaagagataaaaggtgcaaactgtgagcaaagggcctctctggaggcggctttagggcccccagggagtgacggccgcactggcaggcactggggagaggagaggggagagcaacagagaacgagagacagacggccccaccggaagtgcttcgtgctgtcagcagatggggcaaacctggagttggttctgaggaggtttctcttctctaaaccattttgaacgtttgcccagctcagtagctgctcctcgtaacgcagttccagtctgtgtgctgctccctctgaactgcgagaggcgcctctgagctggttgggaggtggccgccaggtgagcgggctgctccagagccttctgcaaaccctgatgcttttgagttgggggcaaggacgtccatctgagtgagatgagaaggcaggtcaggagtgtttttaagagttaatgaacattaaataaatctttgatatagagatgcaatttactatcattgcaggaaaatttatattgaatggagaatagataacaatagttattccattaaaggcaacacatgaatcaaatggtagagaaacgctgatcaagaaaagcctttccccacctgccccagaggccgtttttagtggttcctggcgtcagacctttggtgatgctgctgtagctacatcaaggacatctcatcctggggtcagctgtagacaccagtgcctgaccccactaggaagccgggctgtggccaccacacaccggaaggcactgttggggctgccccagcctgcgcccagcagcagcgttgggcagaagcagaggtgtgtgtgtgtgtgtgtgtgtgcgcgcgcgcgtgcgcgtccccgtgcatgtgtgtggcaggggtgtggggggcaggtgtgatgtgtcctaacagaaagcctgtgtgaaggaagatgaagatggaagccaggggagtcagaggcgactttctggggtggcccagttccattaaggactcaggacaggtggtcacgcacatctagagatgcacgtgtgcagaggcaggttccaaagggggggtcacttgactttgcaaagctctggaacccaaaggaaaggcagtgtgcggtgcccttggtaaagggaaggttagtcgatggggtcagggtttgtgtttaccccagacagtcgccctgaagttggatgctcagacctgcagggaccctctggtgacaccttacggatttcctgtggccacagagcctaacgttctcactgtggcctttggctgagcacccgtctgagccagaatgcttgtggtctgaaatttccagaggccgtggctgtgtgccacggtgggactgcaggaccctgatgtttggtgattggcttttacttcgattggtggctttgctctttctcatgtgactttctcagtatctcttagaaatgggtagttgtgcagattgtttcaaattagtttaatgtataactaactgttaagagaactgcctcagtgcatgtggtaatgatttgagatacctggtgctatggtttaaatatgtctattcctccacaatttctctgttggaacctaatcaccaaggtgacagtattagagggtggggggtcccagggctggggagtgattgggtcatgagcgctccaccctcgtgaacagcattggtgcccctataacagaggcctcagataacagaggcttcagataacagaagcttcagagagtggcctcccctccatccctcctgtcatgtgaggacaagagcgttcaggcaccatattgaaagcagagacttggcccttcccatacaccaaaccagccagcactttgatctccagtttccagcccccataactgtgagccacacatttatgctgtttctgaattgcccggtctaaggcattttgtcatagcagcaggagtggactaaggcgcttggttctttactgtgaagtatctctctgtggaagacattctgtttctacatcggtgtcatgagatttgcagagcagctgttattaatagaagactggaagcttccatggtgcttttcttgcaggcgtgtaaaattgaagacttggacaatcacttaatcattaaacacaaaaataaaatgattgtttagtgacataggtaacaatagtcaggaagcaatttgtatctgagcttggtatttagtagaaatttttaaagcatcggtatttagtagaaatttttaaagcttcaatttcttactatatcaatataattatagaatatgttgttttaatttataatgtaattgaatacaaagtttatttataccacagtgccggcttatatacagatactagagtcattttttaggaacgtgatatttgacctggatgtgtgggcccatgaataagaaacatcaagcataagaaaatacattccttaggtttgagtatttctttatgtaaaactaaaatatgcatgtgttttctgtgcccagttttaaaaagtgtttttagcttgttcttatttaagaatcatctgggctgggcatggtggctcaggctgggtgtggtagctcaagcctgtaatcccagccctttgggaggctgaggcaggtggatcgcttgagctcaggagtttgagacaagcctggccaacatggcgagaccccgtctctaccaaaaatacaaaaaaatttagccagacgtggtggcacacgcctgtagtcccagctacccgggaggctgaggcgagaggattgcctgagcccgggaggtggaggttgcagtgagccaagatcatccctctgcactccagcctgggcgacagaacgagacccgtttcaaaaaaaaaaggagtcatcggcactgatctgccttcgcctgcttttctccagctcctcacacgccacatgcatcattttacccacgtcctcctcgaggcttactgtgctctggatgtgcaggtgttttgaagaggcacagagctgctcgacagggtgaaggacttaggaggactgaagtcaggctctccagtatggccactcggcagccctggagactatccatgtgcctctgtgtgtcctgcctgggtcagaccaagtgcagtttcagaaatgagaaagagaaacagcacctgagacctgggacctgagagcagagccgagagcgcccacacctggacagactgcttgactctcacccagcacgtctgcacctttaattacagcggggaagttacaccaggaaggaattgttttttctggaagaaatgagtgaacttcaaaaataccctcataggccaggtacagtggctctctcctgcgatcccagcactttgagaggccaagatgggaggattgcttgagcccaggagttggagaccaggttggacaaaagagcaagaccccatttctacaaaaaaatacagaaattaactgggtgtggtggcacacacctggagtcccagctactcaggaggctaaggtggggcagttacctgagctccggcagtcgagactgtagtgagcagagattgcaccactgcactccagcctgggcgacagagcaagaccctgtctcaaaaaaagaaaaaataccctcatatatacaaatctttatttctagtcttccagctctcctaatcactcccttacttaacgtccccatcatttaaaggggatgttgaaagcaagcaaaaataaaaacatgttagagttgacgaagagtttgccatgtaggcgattttagatgagcctttgcaccaaccctgtgaggcagatctcaggaccgtggggccagttccacacacgaggaagtggaagctctgagaggtgccttggccagagctaatgagccagggaatgggagggcttggcacagccgcccaggcagctggacgtgagtggcagatgtgcagcaacgctgggaatcaagcggacaccagtgtctactaagaagctggttcttcagtgaaagagtcgtggggaaattgtagaaatgtgtcgttgtaagtgggagccagggatgggaggcacgaccagatcctgtgctggatgcggcccttcatcccagctgtgcaatccccgggactctgtcggtgccacgcatttcccctggacacatgaagggcacgcgtgggctcttgtgacaatctcatgcacttgcagagatttgggcagattgttgcagagtgctttctcctcccacttgttctgtgtctccctctggaaccctgtggggaggtgggtgaggggtcccctcactgtagtgagagagtagtcaatgccgcatgctctgggcacatgccgaggggcccagcctctctcactctgaagcctggcaccttccaagaccttgcagctgcaagtggtgcagcggcttgcccatggccccacctgctgtcagagctgtgctactgcagccactcctttcatgaaacaagaggcccaggcaaccctcactgctggctggagttccatctttccttgcttggaacaccgcaccctctgcagggccccagtggcacggctctcacatgctgttcctcccagcttgcccttctcagaacgagactttgcatctttacaggaccctcgggcgactcactggcccgtggaggtctgagaaacactagtcaggaggcctgagaaggaagaacatgcatccagttggaagcccaggggagacatggaatggagagagaaaattccaagagacacacagagaaccttccaaaattagagaaaccatcaacaattcccaaacaggataaacaaataatacaaataaactcgacctggaacagttgagtggatagaaacagcacacgtaagatcgggtgtgcacgaggagatgcgaacaccgggaacagtcgagtgggtagaaacagcacacgtaagatcgggtgtgcacgaggagatgcgaacaccgggaacagtcgagtgggtagaaacagcacacgtaagatcaggtgtgcacgaggagatgcgaacaccgggaacagtcgagtggatagaaacagcacacgtaagatcgggtgtgcacgaggagatgcgaacaccgggaacagtcgagtgggtagaaacagcacacgtaagatcgggtgtgcacgaggagatgtgaacaccgggaacagtcgagtgggtagaaacagcacacgtaaggtcgggtgtgcacgaggagatgtgaacactgggaacagtcgcgtgggtagaaacagcacacgtaaggtcgggtgtgcacgaggagatgtgaacactgggaacagtcgcgtggatagaaacagcacacgtaagatcgggtgtgcgtgaggagatgcgaacaccgggaacagtcgcgtgggtagaaacagcacacgtaagatcgggtgtgcgtgaggagatgcgaacaccgggaacagtcgagtggatagaaacagcacacgtaagatcgggtgtgcacgaggagatgcgaacaccgggaacagtcgcgtgggtagaaacagcacacgtaagatcgggtgtgcgtgaggagatgcgaacaccgggaacagtcgagtggatagaaacagcacacgtaagatcgggtgtgcgtgaggagatgcgaacaccgggaacagtcgagtggatagaaacagcacacgtaagatcgggtgtgcgtgaggagatgcgaacaccgggaacagtcgagtgggtagaaacagcacacgtaagatcgggtgtgcgtgaggagatgcgaacaccgggaacagtcgagtggatagaaacagcacacgtaagatcgggtgtgcacgaggagatgtgaacaccgggaacggtcgagtgggtagaaacagcacacgtaagatcgggtgtgcgtgaggagatgcgaacaccgggaacagtcgtgtgggtagaaacagcacacgtaagatcgggtgtgcacgaggagatgtgaacaccgggaacagtcgagtgggtagaaacagcacacgtaaggtcgggtgtgcgtgaggagatgcgaacaccgggaacagtcgtgtgggtagaaacagcacacgtaagatcgggtgtgcacgaggagatgcgaacaccgggaacagtcgagtgggtagaaacagcacacgtaagatcgggtgtgcgtgaggagatgcgaacaccgggaacagtcgcgtgggtagaaacagcacacgtaagatcgggtgtgcgtgaggagatgcgaacaccaggaacagtcgagtgggtagaaacagcacacgtaaggtcgggtgtgcgtgaggagatgcgaacacccgcaggtctctgtctcattccactagagggagaagacactgagtgtagactctcaacgcacatgttaaagtttcaatgaccactaacaacaaagaagtccgatatgtaacctctgtgacaggaaacaagtgaggggaaaaattattaatccaacagaagaaaaggagtgaaataaaaaagaaactctggaaaagcaggacaattagaaaacaagtgtcaaaaattagtctaaatatgtggatgattgtgatcaaagtaaaattatgaaattccagttaagaagcaaaggctgccagactatatttttaagctgaacaaataggcaagcaaacaagcaaaaaataatttttttgtttttttttctttcaagagacacacctaaagcataagaacccagaaaaaatgaaagaatgggaaaaggctaaggaatatgcaacaaaatcagctggtgtaccaatattaacatcagtagggggaaaaaaacaagactttaagagaaaaactttactcattacatgttgatagaaaattcagctcacaagaagatataattcaaaatttatacgtgcctaaaacatagctttaaaatatattttaaaaattgacaaaacatagataatttgacagacattatagcaaaaacttggcacacctctctttccatgagtgataggccaagtagacaagtgtgaagaaggcatcaacagaaccacccgtgatcctgacgtgattgccgtacctcgaacgttacacctgccacagctgtagaattcatggagacatttacaaaacctcatcacataccagcccataaagcacatctcatcatctttcaaaaattggaatcgtatcgaccacactctcttagcacaaagcaattgcagtcatgcaccacatgacggttcagccaacatcagaccacacagacgatggtgatgccatgagagtatagtggagctgagaaattcctgttgcctggtgaccttgcagctgacctgaggttgcagtgcagcacgttacccccacgtgtgctgctggtgcaaacccactgcactgccagccgtctagccatctagcacctgccgttaagcacagctcgtcattctaaatgacgctgataaacaactgtgttactggtttgtgtattactatgctttttatcattattttagtgtattccttctaattatctaaaaaatgttagctgtaaaacagcctcaggcaggtcccgcaggaggtgtccagaaggaggcactgtgatcatcggagatgactatgtcaaacggtgtggttttggtgcagtgggagacaagtagactggatcagacatgagagcccaggatccctcacacaggaaggaagccgtctatgagacttggacaggacagagctgcccacgagagcctgggagagggcagatgctccacacagtgccaggacggtgggtcaaccacgtggggaaattgatctttacttcctgccataaacaaaaatcatttcccatgtgtcaagaactccaacacaagacagaagaatttagcagttttaggagaaaatatagaagaatgtcctattctgagatcaggggacgatttcttaaaacgtaagcacagactgtaaaggaaaatactggtgagttcaactttgtgaaatgttggaatactgtttctcataagacaccatgggagagcggggagaagatctgtgcagcaggagtgacagacaggatggcatctgaaatgctggggtgctcttgagaagtcagcaaaaatcaagcaataagaaacatgggcgaatgacagaaacagacattttgctggagatgaaatagaatgcaggttagaaccactgtgctgggggcctgtttcttggcctgagtgatagttgtatgggtgcattcattttgtgatcattcattgagttgcatcttaaatgcttgtaattttagtagttgtctatgtgttacattctgaaacaatgtgaaatagaaaagacagtttacagagaaacatcagtaatgggatacatcccctgcccatcctcctaccctcctctccctccctctccccctcctccctcccctccccttcctccctctccccctacatcctcccctcctctccctccctccctctcgcctgcctacctgactttcttcctctttcctctcagtggtttggaggtactggtgagaaccaaaagcctcattttttcaacagggcagaattttcccaaaaagtggaaggccccttggcacttagtcctgttctctcctttaaaaaatgtggaaattgagtccaaacgaggtgcagtggcctgactgatcccgggcagagctagggtgagcacccgcccatcctctccacagatgctcccccagcaccgcccagtgctagtccaggcctccctaggacgtcccctacatttgtaggtggggagaagagagatttgtttgctagtgtggtcatttcatcataaaaagcccaaaacgtatcaggagacatttttgtcatccgcagccacagctgctgctcactcacatccattcccccactttatagtcaaggaactgaggcctggagacaccaggccttcctgtcgccacggccacaagctgagccatcttggagccgactccaacccctgtagagcccagggagcgcccctccccgtgccccattccctggccatggggcagctcctgagccccactaggagtcgggggtttgcggatcccatctgtgccattcagcgtcctgtggctgtggatgaatttgccaggagtgtctcaccccgccgtgggcgatcttgcctgcagctctcctacccggcctgggacacttgcggtctttcctgacgtgccccgtccaggtggggcgccttcactaggaccccagatgcgcctgcttcctcctcctgcccccgcagggcctcgtgtatctccgggaggtagactgtcccggtgacttcagctggtgtccttgggacaggatgtcccccacaagctctcctggcaccctcgtcaggggcttccacacacatcccctcagataacccggcacacccgttcacgttacatcatggggcagcgcagatgccacaatgccctgccccccagcccagacctggctgcaaggccaggggttggggaggggcagggctggggagcaggccccccgatcctcccagggtactaggtactgaggaaggaagggcctttatcttgactctgggtgaactcttaggggagggctcccagctcctgagaggccaagttcaaacccacccaggagcacacagctgggaaggcgctgggaccacagtcgccgcattcctgactgtgctccctggtgtcagggaacccaggtgccaggggtggccagggcaagcatgggggtctggtcaggtgctcagcagccggccttctcacgtgcagatggcagctctgctccgagcgcccacaccccccagcattggtggcctctgtggcagcttctgccacccataccctgtgcagtgaggaagctgaggtgcctgcctggctgtgggtcgcaggagtccacacacagccacgctgggatttatttgggttgaatgttctgaagggaaaatgctggggaggtggtgccctccccaaatgtgccacctcccctgcctgctgggcagcaccacagaggagctttgcccagggtcctcctgagccccaggacaccctctgcagcacccagccttgacagccccactggaggcctgtggctcctgggaaagccaggcctgaggagcaccatgccctctgctgagcagccctgggctctccaaagggtggaagaattatgagcctcaccttgccacgtttaccattatcttctgctatttttagtttttatttaagaaatgaggctcaggtaaaataactttaaaaatggcatcaaagcccccttgaaaagtcttgtggcccgaggatgggaggagaagggctgggggcagcctgcagggaccggggacacaggcggctcccagctgagggcccgaggcgtccctccctcatgccttccacagaaccttctagcactagtgttctgtaatcccaggaaaggcaagacgcttctggaggtgactaaaaggcagatgtgtggcccctcaggtgttccccccaccccaggtcacctcatgggtaaagcaaggccctgcaggggaggggagtgggccaggcctagcacagggtgagaccagggcgaggtttgcaaactcatgcctctgtggatcccacaggggctaggctgattttagtgactagtgactcggccttgaatctcctagaagtgcagctggtcttcatctgtggctcctggactcccccagactctccatggcccactggccccagcctcctgtccacaccagctggtgagagggaggctgggccggtctaggctggagctgccggggagccagggagagaagacagcggcttccggagctgccttctgcacgccgggcattggcctgctcacagcctggactccattggcttcccccaggccaagtccttgcgttctcttgcatctgccatgtgtccgcatggccctctttctatctatctgtgcaaagttctgttactgccgttttaatttggtgtgacttgtactcgatgacaataaccttcttagctctcgtgtccctcctaccccagcagttgaccaagctccaccagttggccatgcagcaaaccccctttcctcccctcggacagaccaaccccgctttccccggtacgtacccagcccttttctcacctccttctcttctcacctggggactttctctttctgagctgtgttattcggtgcagtgcatagaacaggtgcagttggatttgtgagtgccggtgctgcggcgttcacatgcagcaggcttgctggggctggggccggggacagggtgggggcgggaggtgggtctcgctcccactgttgggggctggttcaccttacagctggccttgccatagccttgcttgtgaagagacgtctgcccaccgagggtctgcacttgctgggcagtgccctgtgctgcccgcagtctgtcctgggtggcccttcctgctgagcgtacccactgggccgccctggaggcttttctctccaggagcaagagcacagctgacgtggatgctcttctgcaggaagccactgcgtatcccaaggtggcacccagccctgccccaggagagcagtgacccgagtcagccctagcccagtcgctgtcatgaggccatcaagggtggccatccgtggcaagcccaccctgcccctggcatgcctggcagttgggtgtccctccctgcagaggcagcgccatgcctgtggacaacccccctctccccctggcgtgcctggcagctaggtgtccctccccacagaggcagtgccatgcctgtggctgtggccagagagagcgccggtgcgtgcgccagtcatattttgagcttccctagttgaagggaccctgcttatctccttgagggcaaaacattaaacctgtctcttctttgctctccaggagaaaagctgcctttacactcctccgaagaagctcaaaatctgatgggccagtcatcaggtaacacaaagccacactgacaggagaacaggccagggcagcagagcagagccccagtgggaggaggtgtgggggccctgccgctgcagcagtttccagcttccatgggaggctgtgggccagcctcaggtgctgccaagggcgtgggtggtgccatgctgccactgtggctggatggtggggcctgaggtgctcagagcagggcaccccggccatgggaggcggccgtgggagcaggaaatagaggtctcaccatggtgtgctttggaaatgggttttgtaggactacaagcaaacccttaaggaggaagatcagtctgtgctggatttgcctgcacccctcccgacttgcattaaaatgttcattcctcagatactgtggggtagcacatagatttgtagattcagtgaccaaggccatgaaacagacacagttgtttgcctggggcttagcaggttcctaggtgcccgtgaagaagatgccacacacgcaccacaccttgtggctccatgtgcacatggccggtgccacagtggcttcctggtggccaggcaggtgtcctgtaatgaccctcccctcaccaaggccctgaggactgcagtgcacacacatgccagccacagcagggttaaattgggtgggcagcgatgggaggtgtttgtggcctctttgaatgctgcggccaggagacttccagcgtgggcttggactgcaggttggggcagcctcctttacccctggtacctggaatgtcgtcatcttcataagaaacagactcacctgggccgtgctgtcctgagatgagtgaacacgtcggccatgccgtcctgagatgaacaaacacgtcggccatgctgtcctgagatgaacaaacacgtcggccgtgccgtcctgaaatgaatgaacacatcagccatgctgtcctgaaatgaatgaacacatcggccatgctgtcctgagatgaatgaacacctgggccatgccgtcctgaaatgaatgaacacgtcggccatgccgtcctgagatgaatgaacacatcggccatgctgtcctgagatgaacaaacacccgggccatgctgtcctgagatgaacgaacacccgggccatgctgtcctgagatgaacgaacacctgggccatgctgtcccgagatgaatgaacatgtcggccgtgccgtcctgagatgaatgaacacaacggtcatgctgtcctgagatgaatgaacacctgggccatgccatcctgaaatgaatgaacacattggccatgctgtcctgaggtggatgaacacctagtccatgccatcctgagatgaatgaacacatcagccatgccgtcccgagatgaatgaacacatcggccatgctgtcctgagatgaacgaacacctgggccttgccgtcctgagatggatggacacctggtccatgccgtcatgagatgaataaacacatcagccaagctatcctgagatgaatgaacacatcagccatgctgtcctgagatgagtgaacacctggtccatgccatcctgagatgaatgaacacatcggccatgccgtcctgagatgaatgaacacatcggccatgctgtcctgagatgaacaaacacctgggccatgctgtcctgagatgaacgaacacctgggccatgccgtcctgagatgaacgaacacgtcggccatgccgtcctgagatgaacgaacacccgggccatgctgtcctgagatgaacgaacacctgggccatgctgtcccgagatgaatgaacacgtcggccgtgccgtcctgagatgaatgaacacaacagtcatgctgtcctgagatgaatgaacacctgggccatgccatcctgaaatgaatgaacacattggccatgctgtcctgaggtggatgaacacctggtccatgccatcctgagatgaatgaacacatcagccatgccgtcccgagatgaatgaacacatcggccatgctgtcctgagatgaacgaacacctgggccttgccgtcctgagatggatggacacctggtccatgccgtcatgagatgaataaacacatcagccaagctatcctgagatgaatgaacacatcagccatgctgtcctgagatgagtgaacacctgggccatgccgttctgagatgaatgaacacatcggccatgctgtcttgagatgaatgaacacatcagccatgccgttctgagatgaatgaacacatcggccacgccgtcttgagatgaatgaacacatcggccatgccatcctgagatgaatgaacacattggccatgctgtcttgagatgaatgaacacctgggccatgctgtcttgagatgaatgaacacctgggccatgctgtcctgagacgaatgaacacctgggccatgctgtcttgagatgaatgaacacatcagccatgctctcctgagagggatgaacacctgggccttgccgtcctgagatgaatgaacacattgaccatgctgtcctgagatgattgtcctggttatgcagacatttctttatattatttgcttaactttaatgccctcctaggaagatttcccatactttcctcccttcaatcaaaatatcccaagttcaacaggtctggctcactcctctctattcatctaaggtctactttgttcaggaatttctgtctaggactcaggcaggaccaaggaaatcttttcagtgacattttaaatatcactgtttatggaatgtgtatagataactgaataaccaaataagtgttgttttgaaagtatctttattaaaagaatataaagaacagaaactctaggcttatatatgcaaaggaaaaataatggagaattagagatgaattggttcattcagcaccagctgatcccctcctgtgctggacggtcccacaggaccacgtctgccctgtggggtcactccctgccagggagactggctggccacagtgagaggtggtgccagtaccataagacaagatgagaggtggcattgtggacaaactgccccacccagggcccagggagggtgtggctggcagggacggggggcagggcagaggtggtggggaggaacaggagctgtgtggctttaacatggagttggggggcacaggaggcgccgtgaggaagtaggagctcattgggagtctccaaccattggaggtgcattttggggacccctctggtctgtctggaacctaggctgaggggcacagcagaggcaggaaccagcaagagggaagcatgggggtgggaggagggctccccagtctggggtattctgaaggtacatcagctgggcctgcgatggttaggaggggtggatcctggggtctccagggcccaggctgagctgcagaatccgagttacaagaaccacgtggggcctgcaaggggaagagcagagtgtcagcgttagacttgcaggttggagccgccacttgtccaggaaatggaaatgctgagcacgaagagcagagcagcctctggcccctcctgtgccagtactcatggggcttgcagcttccaagcaagagcaaatcatggacttgaactctgagaggttgtcttttatctgatggtactaagtggagatttgtaaatataaaagcttaggcttgatgatcaattagacccatattgtcactcttcaacaaagaaaggtatctatatagaaatgtgcagcttttcattggccctagcacttcatttttggctcagtgatgccattaggtctccttgctccaaattggaagaactgcctggtgggcctgagctgtctgagccaggctatgtgcaggggcctctggacagttacatcagaatcagaatgagaggcaactttgcatgctctgccatctgctgtcccctgcaggaggccggggggtgtcacagggaggtggggcactgtcgggtagagccgtgtgggcctcagaaccagtggtgtctcctgagaactaagggaaaatgggcactcagcatcagtgtgaccagcatggcctgtgccctgggtgctgcacagagaccctgagacatgctggatggccctgcccttcagccaggggcccaccagggtggctttccaaggtgtcacaagagagtatacaaacataacaggggagtgaagtcacgctgtgcacaaaatgaaaaaaacaaaatgtcctgcttgggtttctctttccttcttttgagagaggttgggactaaggaaattgggtggcagtttgggactgaagctcacagggtcctggccctctgggctgtgctgaccctcacacttgggccagctctacagccctgtctcacttgacccaggagagtgagggacaggcactggagtgtgactgttagcagccttccaccagcctaaccatgtccccttggtatacccaggtctggacgccagcccaccggccagcactcatgagctcaccattcccaatgatgtgagtatgcccgctgtacctgcctgtccctgggtagaaacaccaggcacaagtggctgtcagctctgctgtcctttgggcagagggacccactgcttggtaatgccttcaccaccccaaccccactgtttgatctgtgtcctccctcctttcctttttaaagtgggtttaatgcccataaaaagttatgtgtttttacatccctaagatgttgaacaagcaacaggctaaaggggacttcagatattaatcagtagtcagatgagagttgggctgagaacctatgttgctgtggaggcactgccctggtgcgggccaaaccttgaagaacaaggtggcccaggaatgctctagagtggacccacctgcagtattatctccatgggccctggcccctcaggaggtttgggattctccatgagttggctccaacagacttgaagctggttggatgtcacagacttgtctagattccttctagcactcgtcagtctattcatgccttcagcatacctgagggtgtggccttacgagctcccctcaacacacacagtcctccccagagtaagcacgggtcttgaggatagagaggactattctctgaatgcttgacttatccagaaactgagagaccagggagggcatgggccacatgtccttaagggatagctgccagagcagcaagcagagtccctgtgtgggctgtggaggtggctgccccacttacagctcaagtgtccaggaggcttttctgccctagagctgtggactttgggaatcttcactgttctgcccctttacacctgctgggcaggaaatctaagccctgttccttcctttcatacaagttgaccataggaagcacagatttggcagttcagggagatcaccagtcctgtgtgtggaagatggacagtggagcaggagaaaaagaggcagaagagagcagggtcgccagaggaatggaccatgaggctgtctggctggtgccactgacccgcctgaagagccatcttcatttgagcccctcatggcaatgtgcactctaggccttcttctatcccggttgctggtcaggcacagagtccccatgtctgctaaaagaagctcaggacactcacactccaggcagcattgtggtccagccttctggcatccccaaggatttctgaggttggcccaacttgaaaggcagcagcacagagccatctccccaggtgtggggtggcacagccaactggtccctgcattcttggagggaggggatttttccccaaccctttccctcactgcagtggttccttcagcatttggcttctggcatcctcctgagtcttttcctccaggtagtaaagccaccaggcttttcctgtggggttttccttctttggtgagtcagtgctcactaacaccaggtttggtgctcttatccaaacactcatttaaaatggaaatgagctttaagagaatgagacatctttggagagttggtcaacctgtttcctggggtctcctttgtacagatggatgctggttttcccagctcttcatcactcacttcccatcctcctcctggggatcttcctagggaagagacccacttctcagaaggaaggcagcttcctcttatcccagtgcctttgggtacagccttccatgcttcttcatggaaaaggctattgacgacactgtcagggggctttcaccagcacccccagattttgtgggggatgtatctgggctgcaccaaagctgatgttcctcacatggtggctgcctgctaccttcttggagaaaaggaaaaaataaaatgggcgtgcttgttctgaacttgcctgtcatctcgtccacgtccgtctcttggtcacagttggatcatgctgcctcagcgttcctgcagaaagacactgcttggaggcagggactcctgagactcacaggctccccagcacggccactggggacacaggccagtccaggggccccagccctttggttccctttctgacgatcactgtgggcctccctcaccacctatttcagtccttgctcttggtcatgcaggcactggtgcctgtggtcacccctactctgccctaagcaacagtcacccacccaccaaggctcatgcccctttccttggttcttagctgcagaatcagccaggccttctgctggggaaaggaatctaaggtgtccgacagtggtctctaggaggagaggctgcaatgggagttgttactgcagttcccgtggaatttggcattgacatctgattaggaggggccacattatttcagaatatttctatcgttcttctttgaatttgcaatggaggcacacaagggtgaggagagaggaggagaggagtctgctaactgctggcagggtttgcaggtgcaggtggggccaggtgggaggtgcccttgggctgcagggctcagcctagaaggcatcctcccctgcactgagccagctggcctagggcagggcaggtgaaggaggtccgacctccccacattcccttctcatggcagagagtgccagtatagaagtcacagtgctgttcaccttggcatttgtggttaggcgggcatgccctggctgctcaatgatgtcccatcagcattcagaccccacagctgtgtgcagaggaggggaaaggcctgtggcaaaggcagcaccctccagagcctggggagatgggcaccctgagcagcacattgcagggagcagagggagagggcggggtgagagcaggagggggatgcgtgccagagcacagctggagcgaggcagttagaagacaggggcagatggttaagagaagagggtaggccctgtttgcaggaggggcagggagatacttcctccagcaggctccgaggagagatccaacagcacatgtgcacaaggctttccgtgctgtgcgcttcagcagacaccacgcgctccagcgcagaaagtgttagggaggaaagcggctgcgtgctggccaaggaggggtataggaagtggggcagtgcgaaagcccaggagctgctctccctcctggatgttggcatcttacagggacctgtggtcatgctgccgagtcagctatgttccccctccccatgcgggccgtgctgctgtccctggcccccatcagagatgagcccttcagatctctctgccaccagggaggaagatgcagccaggcaggtgaatgtggccatgtgccaattaggaaaccaccctcctaaccccagtggcacactcaacaccacacacaggtgtgagcagggagagggctggactgcgggtggggccttgggagatgtgggtggggtctgggagatgtgggtggggtctgagaggtgtgggggagcccagagatgcagcaggagatagaagactcccagcagccctggattctccagagtgggggtctctgtggatatctacaaagactgagggttctgtagtccagtgagacagctgtcatttccttgtaaccagcagagatggcctctaaggtgagcagagttgagacaccataggtctcctcagggacaagggctggctggcagggcacctgtgtcccaccatggagctgctgctcaccccacagactgagccccttcacgcttgcaagtggacgtccctcctgcatgccgccacatggcccagcccagcccttccatccagcgtcttactggtgtaaggacagaaacctgctcctgtcactcaatttcaccaccgttctgacaccccagcagcctcacgggaggtgggagtggactctgcctcagggccctcggggacccatgtgcccagctgccctcctggtgccctgtgccgggcaccctccagtctggggctttctctgccacaggtctggccacgtctctttcctgtccaagctccagagctctcatccgtggcctatgcgtgcatgaagggactccgttccatccaatggtgggcattgagagatgccattggctcctgtgcagtcttctctgggggcccgagttgtccccgacgcccctcatggctgccccataggccccgccctcctccctcagctgcttcaaggagcaccctcattcttgatgactgccttggccagaggccactgtgttccatctttaaacaggggtcccaacaggggaatgaaaggaggcacccgaatggcctcagagtttaatctaagttcagcaaaagctaagttttaggcagcagtgagctttgctgtggcttcaagcacacgtttcttcttgagcatttgtgatgctgcctgtctgggcagaaggggtctccctgggatgtggccaagaaggtgcagacaccgctgggccatggtggagcctccctgctcagctgctggctgccacctgtgggtcgctcctggaccccggggtgaccagtgtggagcacccaggccgagtgactgtgcctcttggctgggtgggcctcctacaggagtgggtagcagggcgggtctgagaggggccagcagaggcacaggtgctctcagcctgacctcgggcaggtggcctggatcaggcaccacctgcaggcaggtgtgggcggggcctctccggggtgttgagctcaggtcttggggcagagtccaaggctggcggcccgtcccaccggccccctcgggcgcactgcccacagtcttcaggggctggcttgggctgttctctaagaaatccccccgtccttgtttctagctaataggctgcataattggacgccaagggaccaaaatcaatgaaattcgacagatgtctggagctcagatcaaaatcgccaacgccacggaagggtcctcagagcgtcagatcaccatcacggggaccccggccaacatcagccttgcccagtatctcatcaacgccaggtgagcatctcccaagggtctctgagagacgcccggaaagggacgcgccagccggcgttacatcacctggacggtcggggggtgggaggaggcacagtctgggccacactctgcctccccttctgtcccctctgctccaggctggatggtggggacaggatgggatggtgacagcctccatgtagacacggggccacctcactctcccgacctcccacccgaagcgtctccagggacaatcccggaggctagagaggaaggcaggtgctcctgtggcctcagacaggtggccagaactatcctggaaggcctgactcttgtccgctcagaggtctccagaaagaccaatgtttggggactttgctgttttgcctcctttttcattctcatggaaacgtgtagggacgggcaggacaggactctgcaggccgcttccttccatgggtccctgtgcacatgggagggtctgaagccacctgggtccctgtgactgcaccccactcggcctcaagccagtgccccacccccgccaagcacaccataccaccagtccccccgccaggcatgccgtaccaccagccccgccaggcacactgtaccaccagccccccagccaggcacgctgtaccaccagccccgccggcctctgatgtaaggaacatccgtcctctctccccaaggatgtcctactgcaagagccctgagctgggcttgtgggatgggacgggacgggatgggactggaggggaggagaagggaggggcctctaggtggacacagccctgcgtgggccctggaacccctgtcccggtgacccttctcttacctgcacgcccagtgagtgggtgagaggctgcctggagaggacgaggacaccccccgactttacccactgatgccccgctgggcttctgcctcgatccagagccaggttgggcctctttccatccctgtgccacaggcccatgggcaggaggctgggcaaagtgcagcattggcaaacccagggcgagcctggggatggggcttgtcagggaggttcccgcctgccagaccgcattactgacagccccactgggacccgtgcttggggccagatggctcttacccacatacacttactcctgtggcaaccaaagccccttctcagatgccaggtgtgaggctgggaaggccctgagcacccccaggggccgacccagggctgtgtagggggctccacatggggaaggcctcaagcccccatgcagggctggctcacacacctgacgtggtgatgggcatggcggggaccagggcggggaagaggcctgtgtgctctgctgtggtctccagctcaggacctcctgagctgaccgggatggcctgtcccagcgagcacagaggccacacagcccggcctcacgtctgcccactgatgagggcgttggttgtgaccgtctctccctctcctgcctttgtctgttccaggctgacgtccgaggtcaccgggatgggcacgctgtaatcctacccagcacccttcccccgcgtcacccacctgccagagcctaaggcccccggctctcgcactctgtacagcccaccttccctgcctcacagataccaatagagaggttttcttaattaacaaaaggacgtatgccatggagaaacacacccgcgcacacagctgctctctacagaggctgcaggctccgccgagtcccccctcagtgttattttatttatgacttacgctcccgtctgcccatgcaccggcatgcagtggtaattattttagaaatattgttccttggtgtcagcgtagctgtctgtcttaggagctgggtcggcgttccgacagcacttcctgtccgcccttctcctctgccatccagaaccgtccagaactgttgcctgagacccctcctctctcacacagccctgccatgctgactcggtttcccctcagagccattgttgtctgggctcgagtttctgccccaggttgtgtgctggaatcggggggtggctctcctgccacccatggggagcgccaggagaggagggtcatggaggatgttggggctctgaccccaggagtggggtggagggcggagcctgctgggggccctgccttcacagagatgccgcgtgctgggaaggctcttggggtcccctgagcgtcttccagggtggctggagagcacagacgcgccagggagccccctctgtgctcctcagagttcaataaatgtcgtggcccctcctca

SEQ ID NO: 731 - DNA, 27359 bp, Homo sapiens
cggtgacgcgggtggccaaagcggagcggagcgggggtgaggagagtcgagggaggtgacgcgcgctgccggggcgaggtgaggggaggggaggcgacgcgggcggtcggggtatggcgaggggaggggaggggaaaggaagcgacgcgagctgacagaggggagcagaggcccgagcggacgcgaggcgacgcggagagggcggcctgggccgaagtgaggcgacgcggggcggcggagtctgagggccggagcggagcggaggcgacgcggggaggggcgagggatcgcggccggtggctgggggccacctgctccccgagcaccggcccccgctccggggagcagagtccggagcgggatccgcggcccacaggttcgcaggtcgggcccggggacgctgcggactagcgggcgggaggcggggattctgcaccccggccccgggccgtccagtggccgccctcgaggtgaccggttgctggccggcgtgggtcgctgaccccagcggggactggggggaaggacggggagttgggggcaccaagtcacccggaggaggcgaccccagctagctgcgcttgccctgcttcgctggactgtgaagccccctccgctgcggctcttcctgcgctcaggcaggcatttgcagagctcctctcgggacttgcctcagtgccctgcacggagctgggcagtgggctcagggagcgaagcaaacgggcacatccttgtctttgtgggactttttggggaagactttagacggtggtcacggaggggcacggccctgtgggaacggaaagagaaggcggggactcaaggaataagacctaatatttgagatacgtaagccttttccttacgttttgtaatttaaaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggtaaccagcattgcactatgctagcccctcgcccagcctcgtgatggtcatctcctatttggtttggtgtgtgctcagcctcttgggatgacattaaaaaccagcctttactgatatattctgacttccagttgagaacctctcttggcctcatgaaagaagttttatcagtggcttctaacactgataaagacgtatttttcaggctcaatttaaatgcctttgctatacatggcatactagccttaatatatgccaaatttatatgagctttgtgttttaaaatagcagctttcactgatcatcagggtcattggagtatcttaaaaatataataaaaaaatttaaggccaggtgccatggctcatgcctgtaaccccagcactttgggaagccgaggtgggaggatcacttgagcctaggagttggagaccagcctgggcaacatagggagaccccatctctacaaaaaataaaaaaatgaggtgggaagatcacttgagctggggaggtcgaggcttcatgagccatggttgtaccactgcactcccacctgggtgacagatcaagaccctgcctaaagaaaaaatttaaaaaaataaaaaatttaagaatatttctatgccctttaccaggccagcttaatcagacttctctaggcctaggacaggcttaagatcagttaatttaaaacacttctgatgtttcttgagcattgaaaagttttattctttctgcttgtgttttcaatctttttgtgtttgtcttttactaaggctagaaacacgtatttggtttggttatctgaagtttaattgcattcattgtgtttatagtatttatccctgtagtgttggaattaccagtcacttacattcatattttagttttttgccttatctcctgaaagtgtgtgtgtctttgtatgtgtgtgtaataaaaatgcttcgttctagaaagtaatagtttctccatgtcttaaatattttaaatgaccttgacatgtttttaaaaatcgtgattgttggctgggcacggtggcccacgcctgtaatcctagcactttgggaggtggaggcgggcggatcacgaggtcaagagatcgagaccatcctggccaacatggtgaaaccctatctctactaaaaatacaaaaattagctgagtatggtggcacgcacctgtagtcccagttacttgggaggctgaggcaggagaatcacttgaacctgggaggtggaggttgcagtgagctgagattgcaccactgcactccagcctggcggcagagcgagactccatctcaaaaaaaaaaaattgtgattgtttccttcctgaattttgactgtatttgattcataatgctgaaatcactttataaagttgattatacctctggtacatactctttaaacttttgtgataatatgatagtcaaaaaggactcatttctgcattatagggaatcacatcattttgaaataaagataacaggctgggcatggtggctcacacctgtaatcctagcactttgggaggccaagacggctggaccacctgaggtcaggagttcgagaccagcctggccaacatggtgaaaccccgtctctactgcaaatacaaaaattagctgggtgtgatggcgggcgcctgtaatctcagctacttgggaggctgaggcaggagaatcgcttgaacccgggaggcgaaggttggggtgagccaagattgtgccactgtactctggcctgggcaacagagtgagactccatctcaaaaagaaataaagataacaaataatggctgggcacggtggctcacgcctgtaatctcagcactttgggaggctgaggcggggcagtgggatctcttgaggtcacgagtttgagatcagtctggccaacatgatgaaactctgtctgtactataaaaaaaaaaaatgtggaggttgcagtgagtcgagaatgtgccactgcactccagcctgggtgacagagcaagactcagtctcaaaaaaaaaaaaaaaaaaaaaatcaaataatgttcttggttgaatgaagccatttatatgacatagttatttttgtgtcatttttagaggatgcatacttccctattgaaactttttgttttaaatgagaggggaatcaaaataaaatattctggagaaccttgaaggggaaaagagagcataaaacatatttcaaaggaaagcataacttagagtgagaatagagagcaggattaagtgtatgagcctggccaggcctggtggctcacgcctgtaattctagcactttgggggaggctgaggccagagaattgcttcaggccaggatttcaggacaccagcctgagcaaatgagaccctgtttttaacaaaaaaaaaaaaaaaaagccttagtcatttatatgacctccttagaattatagaaagttagctggaagaaaaatttgtctaacagatgtaaagatagaagtatacatagattatgacttgtcctaggttacctaatcagtgagggacagaactagaactgagatccagaccaccgtccccactccagtggatgcatcctggaaccaggaatggggaaggtggagccactagcaaatacagccctcatttgggccagtggtatgaatttgctgatatagtatttgatttcacatctctaacaagttttattaagattgctatggtttcttaattttgataatatttgatatctcatttttctcagacctataaattataaagcaaaattagaaccattttagcagttcattcaaatcattaacagcctgcatatgtatatagatagcaacattttcatttgaaaccacagatttgcaaattacttcctgtttcatttatccaccccagtgctaccaggtgttctgttcagaagtccaaaagggtagaggaaagatgactaatattgagcaatggtcttagtattttggcttttcaactactttctattcgtcattctcacatttggatttggtttacagttgtcaagggtacactctcagcgctgatcagtggaatttgtgagagcagaattctcaaccttgacactgttgacagttttggccaggataattttttgtcatagggagctattctgggcgttgtagagcgtttagcaacatcctctaccagctagatgtcagtagcatcctccacaatagcatcccccagatcagagcaaccaaaggtatctccagatactgccagaagtctctggatggtggggaggggtgtgtcagaattgtcccgtactgagaaccacagattttttcagtattgttgtcttgcaaatttctgatgaaagatcatttagttgaccattgcgtaatgttgtctcattctcatttatgcactgagctgggggtccttctgcttggaagacttttttttttttttggagacagggacttgctgtgttgcccaggctggagtgcagtggcgcaatcatggctcactacaaccttgacctcccaggctcaagcgatcctgctgcctcaacctccccagcagctgggatcacaggcttttccttttgacattttgagggggaagttctcactgtgttgctcaaactggtctcaagactcttgagctcaggccaggtgcagaggctcacacctgtaatctcattactttgggaggctgaggcaggtggatcgcttgcagtcgggagttgtagaccagcctgaccaacatggtgaaaccctgtctctactaaaaatacaaaattagtcgggtgtggtggtgcatgcctgtaatcccagctacctgggaggctgaggcaggagaatcgcttgaacgtgggaggcggaggttgcagtgagccaagatcgcgccattgcactccagcctgggcaacaagagcgaaactctgtctcaaaaaagaaaaatcaaccttgagctcaagggatcctccccacttggcctaccagagtgccaggattataggcttgagctgccagaaggcaaatttgattctggaagagaaagaggatttatgaaatctctgttttcaactgttctttctcacaaacacacacaaacagtcctcattattcttagattccatatttccaaattcacctactcactaaaatttatttgtaacccctaaattcatactcactttgcttttgcaatcattggtgcacatacagagagctgacaaatttgagtaccttgatgtttccagctgaggttgatcgaggcagagctctgccttcttgtttcatctcttacgttataaacaagtatcttttttgcagccagtttagtgccatgtgtgatttcactgtttaaaatgatcccaagcatagcactaaagtgctggctggtattcccaagctaaagaaggctgtgatatgtcttaaaaagaagatatatacattggataagctttagtcaggcatgagttatagtgctcttggtcttgaatttagtgtaaatgaattaagagtaagtttaaattagatgtctttaaacagaaacacacataaaacaaggtcatatattgatcagttgatgaaagtgtcgtcaccagatgctgttagaaacataaccttgcatttccctaagagcagcagttcagtactcaaagcaactttatgaaatctaactactgcaaataaagggaatcaactgtttgtgtgtatatatatgaaaagagaattggccgggcgcagtggctcacacctgtagtcccagcactttgggaggctgggaggctgaggcaggcggatcacttgaggtcaggagttcgagaccagcgtaaccaacatagtgaaaccctgtctctactaaaaatacaaaattagctgggcgtagtggcacatgcctataatcccagctacttgggaggcggaggcaggagaatcgcttgaacctgggaggcagaggttgcattgagctgagatcgtgccactgcactccagcctgggcaacagagcgagactccatctcaagaaaaagagaattaatggatacagcaggcaggattctggaagaagcaggactggattttatcagcagcactatggagggattagcttttaaacaaaaggaagcccttctcctgagactgcgactactgatgattcctttcttcagattccattctctcctgactttcttcgttctacttttatcttagtaggtacttctacttggaactctgcttttaccctaatttcttcttttaacaaaattttttgtaccctcaggttaaatcctgtacatgatatactctctaagaaactttaccttcatggcattaatagtcatctttttatagacaattttatgatttgtttttaatccttaccttagaaaaatactatactacaatttgagtgcctactccatgccacacattttaactatattatctttcattcttgaaaattatcccacagggtaattattgtttgttctaatttttggataaggaaagttgaaggcccaagaagttgagactagtccaacctcataagtagcagagaaaggattttttttttttttgagatggagtcttgctctgttgcccaggctgcagtgcagtggcacaaactcggctcactgcaagctcttcctcccgggttcacgccattctcctgcctcagccttctgagtagctgggactacaggcactcgccaccacgcccggctaattttttttgtatttttagtagagacggggtttcaccgtgttagccaggatggtctcgatctcctgacctcatgagccacctgcctcccaaagtgctaggattacaggcatgagccaccgcgcccggcccaggatttttttttttttccatcagagtcatagagtgcagtggcacaatctcagttcaatgcaacctgcacctcccgagctcaagcaattctcatgcctcagcctcccgagtaactggggttacaggcacacgccaccacacccagctaatttttgtatttttaggaaagatggggttttgccacgttggccaggctggtctcaaactcctgacctgaggtgatccgctcgcctcagcctcccaaagtgctgggattacaggcgtgagccaccatgcctggctcagagaaaggatttttgaaccaggatctccttacaaagaccttgatctttcctctataccagggattggcaaactacggtcctcagaccaaatctggcctactgcctgtttgtataaagtcttattagaccacagctgctatggtttgaatgtttgtgtccttgaaaaatgcatatgttgaaatcctaacccccaagatgatggtattaggagataggacctttgggaatcaaagccctcatgactgggattagtgtccttataaaagacaccccagagataccatgtgacaacatagtgagaaggcaccatctgtgaaccagaaagtgggccctcaccagacaccaaatctgctggcaccttaatcccagctttcagaactatgagataaatcatatagtatcactcatgccacattctgttggttacaagcccgtccagattcaaggggaacgaacatagattcccaattctcaatgggaggagtgtcagattttgcaaccattttttgaaaactgccacagacttctcactagtatcagaaattcaacatatgatcttcataaaacatttcatcagcattttttcttctctgttcagtagtaccatcattatttcactcttctgggcttgaaaacttaatcatccttgctttttttcatccaaatccatttgtactacaatttctttttatttttttttaaatcttttggatgtcactgtttttctcactgccatcaccagacccctgaaccattgtagtaacaccccaaaatgcactctctgctcactggtctctcccaacccagagtgtactgtgccatgcagaataatgtgtatgtgctgcttaatctgtagatttcatcaaattatcaaggggcccattacttaaaaaaagtttgacaaccatgcgttgggagtccccaagactgcccccatatttagagattcattagaagggctaagcatataaggcatagtgtgtctaaggtttattagtaaaaggacgcagaatagaatcagcaaaggaaaaagacactagtagaaatctggaaaaagtcatgcacaggtttccttatgttttccttcctgtgggaggatactgcaagcatgttactttctccagcaacgaaaaatgtagtaatgtatatgtacagtgtttttgtttttttttgtggggtttttttgttttgttttgttttgttttttttgagagaaggtcctgctccgtggtccaggttggagtgcagtggctcagtcacagctcactagcagcctcaacttcccaggctcaagtggtcctcctacctctgccttctaagtagctggaactacaggtgcatgccaccacaccagaataattttttttttttttggtagaaactggagtttgccatgttgcccaggttagtatgtacaacgtttatgcccagagaaacccattagagactcagggtccgaggtttttattggaggctgatcatgtaggcactctaccagatacctagcaggtaccaaaatttcagactcccagaaggaaaacaggtgttggcataaactttattgtttacacagactaggcggaataaaccacccttatgagttggggaaaagtgggaatactctcaaaatctagttctgagttgttgagggccaaccttgtatataggttttcctaaaaatagcatcctccagtgctttgagagaccgaggcaggaaaatcacttgagcctaagagttcgagaccaggccaggcacaggggctcatgcctgtaatcacagcactttgggaggctgaggcgggtggatcacaaggtcaggagttcaacaccagcctggccagaatggtgaaaccccgtctttagtaaaaatacaaaaattagctggcgtggtggtggaagcctgtagtcccggctactcgggaggctgaggtaggagaatcgcttaaacccaggaggcagaggttgcaatgagccaagatcgtgccactgcactccagcttgggcaacagagcgagactccgtctcaaaaaaaaataaaaataaaaaaattcgagacctgcctgaggaacatagtaaaacctcatctctacaaaattagctggacatgatggtgtgcacctgtagtcccagctacttgggaggctgaagcaggaggatcacctgagcccaggaattcaacgttgcagtgagctatgattgtgccactgcactccagcctgggcaacagagcgaaactgtctctaaaaaacaaaaaagtttaaagaaactaaacctctttgcatccctctaccttattcaagcagaatgtcttacattctagtaaatatgattgctaaagaactcaagttacctacatcatgataagtcattaaattgtttttggctggttgtggtggctcacacccacaatcccaacactttgggaggctaaggtgggcaaatcacttgagcccaggagttcaagaccagcctgggcaacatagcgaaaccccatctctataaacaatacaaaaattagctgggtatgggggggcgtgtgtctatagtcccagctacttgggaggctgaggtgggaggatggcttgagccaggaggtagaggtggcattgagccaaaatagcgccactgcactccagcctggatgacagagccagaccttatctcaaaaaaaataaaaaaattgttttcaagtagattccctgtttaaaaataatcttgaattctttatatttcaatactcctaaataatgtaataaatacatatgttaaattaggttagaatttcattatgatctcctcactagatcttctctccgtggcaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaaggtaggtggctggtagctattagtgccccgtatacctcagaaataaggttccaaagggtgtttccatcctagcctacagaggacaaccaaaaataaataaataacacaaaaaagaatgttcccagttgttaatgtggaatgctattttgttactacataacaaaccacaccagacttagtagtgtgaaacaaaatgataaacattatctctcatattctctgggttgactgggctcatctgggcagttttcacttggaagttctcatgttgcagttagatggcagctgaggctggatgtccaagatgacttcttcacccacatctgacccttcagctgggatgactagaacaactagaaggctttccatatgcctagctcgagggtgtcagggtagccaggcttctgttacggtgactcatttaccccagagctcatgatccaacagagcaggacagaagatataagcctttgtcttacagcatcacttaatcttggcagtcatacagcattacttatgctgtattcttttattgttattgtttaatttttttttttaaatagagacaaggtctggctatgttgcccaggctggtctcaaactcctgggctcaagtgatccacctgtctgggcctcccaaagtactgggattacaggtgtgagctatcacgcccggcctacttctgttgcattctatgggttacacagagccagcccaaattcagtgtgggaggtgtctacatagggtgtgaatactgggaagcatgcttcattggggaggcacctttgaagactagctatgacaagtacctatttgttagaaaagaggtgattgcttttatgtacattatttaatcttttcaacatctatgtgagttgtgactttctttatacataagaaaagagagtggccgggcacggtggctcacacctataatcccagcactttgggaggccaagatgggcggatcacgaggtcaggagatcgagaccatcctggctaacacggtgaaaccccgtctctactaaaaatacaaaaaattagccgggcgtggtggcggacgcctgtagtcccagctactcgggaagctgaggcaggagaatggcttaagtaaacccaggaggtggagcttgcagtgagccgagatcacgccactgcactccagcctgggcgacagagcaagactccgtctcaaaaaaaaaaaaaaaaagaaaagagaggtacagagaaattaaataactgttttaaggtcatacattggcagacctcagattttatgtatttatttgtttgtttatttattttgagatggagtctcatacttttgcccaggctggagtgcagtggcatgatcttggctcactgccacctctgcctccaagttcaagtgattctcgtgctttagcctcccaggtagcagggactacaggtgtgcactaccacgcccagctgatttttatatttttagtagagatgggctttcaccttgttagccaggctggtctcgaactcctgacctcaagtgatcctcccatctcggccgcccaaagtgttgggattacagccgtgagccacccgcctggcccaaacctcagattttaattcaagttctccaagtaatggcagcctgtgaaacatgattgtatcactaagaccatatcttgctcacattttccctcaggtgcctctgggaaagggaagacgctgtgtcgttttagcagatggattctatgagtggcagcgatgtcagggaacaaaccagaggcagccatacttcatctattttcctcaaatcaagacagagaaggtatcattatcagcattcacaatatatatttggaaaggcacagggaaacaaattaatccaaaggacatttttttcttccccatagttttatttatttattttaaaataacagctttggcccagtgcggtggctcacgcctgtgatcccagcactttgggagcccaagacgggaagattgcttgagcctaggagtttgagaccagcctgggcaacatggtgaaaccccgtctctacaaacaatacaaaactagctgggcatggtggtgtgtgcctgtagtcccagctactcggaaggctgaggtgggaggatcacttgaacccacgagatagaggctgcaatgagctatgatcacaccactgcactgggcgacagagcaagactctgtcaaaataaaataaaataaagtgaaatgaaatgaaatgagctcattgagagataattcaccttaaaattcacctttttaaaatgtgcaattcaggaatgttttagtatgttcaaagtatgcaattattacctctatttttagaatatttttatcactctagaaggaaactacatatccattagcaatcactctttattctccactatgcccagcccctgtcaaacacgaatctactttccatctctggatttgcctattttggacatttcataaaaacagaatcatagaatatgtggtcttttgtgactggcttctttgatttagcataatgttttcaagattcatccatgtttggcatggatcagcacttcattcctttttgtaagaacagaccacattttgttaattcattcatcagttgatagacacttggattgtttccacttcttggttattatgaataatgctgctatgaacattcatgtacaagttttgcatggatttgttttcatctctcttggatagatgcctaggagtggaattgctaggtcatattacaactctacgtttaacatttccttcataaaactttcactgtggctgggcgcagtggttcaggccaggcacggttgctcatgcctgtaatcccagcactttgggaggccagagcaggtggattacttgagctcaggagttcaagaccaatctgggcaacatggcgaaaacccatctctaccaaaaatacaaaaaattagctgggcgtggtcccagctacttgggaggctgaggtgggaagatgacttgagcccaggaggtggaggttgcagtgagctgaggtcgtgctactgtactccagcctgagtgacagagtgagaccccatctcaaaaatgaaacaaaaaccctttcactgtaagacataatttgaactgttcatgttaaaacattatcaggagattgaaaacaaatctgacatgccaacatcatgttttatttttaattagattatttagtctgacactgctaaagcacctgagttcttagcagtttgcttgttaaaattgggaattgtttgttcacctgtcatctcattttggggactggaaatagtgttaccgagtaaaagggacttgctacccaatgtgctagaagccaataccatgatactgagtagctggtcccagctacttggcaggctgaggtggaatgatagcttgagcctggggtggggagtggagggtgcagtgagccgagattgcaccactgcactccagcctgggtaacagagaaaagtttttttttttcttctttttttttttttgagacagagtctctctctgttgcccaggctggagtgcagtggcgtgatctcggctcactgcagcctctgcctctcgggttcaagcgattctcctgcctcagcctcccaagtagctgggactacaggcgtgtgccaccaggcccggctaattttttgtatttttagtagagacgcggtgttagccagaatggtctcaatctcctgaccttgtgatccacccgcctcggcctcccaaagtgctgggattacaggcgtgagccactgcgcctggccgagaaaagttttttatttcaagtcgactaacaagaagacaggagtccagctcaactctgtctccctagctggctttaaggagtacttttattaaaaaaatgtttagggagtggattctgggattagtaggtgattggtggaaggaaaggggaggcctggaaagtcttcaggtatgtgcagttatctcttcctgcctccatataggtctcatgtgcaaattcagggggagttagtgtgaaatgtggtggaaattcaggctgtgatataagcaagcttgttttgcatatactctagtcagttattggttccaaccaattcagccagttttgttatcttacaagcggagggagtttcactgtttcagcaagttattttcttatgtgctatcctgtaagcccaagaatttagtcattggtgtttttgtttgtttgtttgttttttaactctttggggcagtttcagtagtcaagagagtttgcctcaccctcagataattccctatcagtgatgggtgcaccaaaatctcagaaatcaccactaaagaatttattcatgtaaccagacaccacctgttccccagaaacctattgaaataaaacataaattaaaaaagaaaattcccagtctagccagtctagtaacacacaaatgatttggtacaagacaagattaatttataaaacatctatcaattataatagcaaatattaagcacttactactagtcagttactctttctaggaacttaatgtgtattagcttaatatacattaattcttttttttttttttttttttttttttgagacagagtttcactcttgttgcccaggatggagtgcaatggtgtggtcttagctcactgcaacctccacctcctgggttcaagcaattctgcctcggccgcctgaatagccgggattacaggtgcgtgccaccatgtctggctaatttttgtatttttagtagagacagggtttcaccatgttagccaggctggtctctaactcctgacctcaggtgatccgcctgcctcagcaccccctaagtgctgggattacaggcatgagctactgcgcctggacttgaacttaatttttacactacagatagttggattttcctttttgattcagtctgacaatcattcttttaatttgtgtttagaacatttaatttaatgtaattattgatgtgattgggttaaaatccattgttttgctagttttctatttgttccatcaactctttgttccttttctcctgatctttctgttttgggaataatcttttataattgcatttcatctctattattggcttattatttttgcctctcaaaaaatgtctttaggccgggcgcagtggcttacaactctaatcccagcactttgggaggctaaggcgggcggatcatgaggtcaggagatcaagaccatcgtggctaacagtagagaaaccctgtctctactaaaaatacaaaaaaaaaattagcctggtgcagtggtgggtgcctgtagtcccagctacttgggaggctgaggcaggagaatggtatgaacccgggaggcggagcttgcagtgagccaagattgcgccactgtgctccagcctgggcaacagagtgagactccgtctcaaaaaaaataataaataaataaatgtttttagtagttgccctacagcttacagcatacattttaagttaataacattctgtctttatacactacattactattgaaaataccttacaacagtattctcccagttcctcctgtcttttgggctactgttatgcattttatttttacatatactataaacttacaatacattgctattttactgtagatggtcaattatgttttagagtggtaaaaaataagaaaagtctttgtacacgtaccttcattttagccatttccatggatcttcacttatttgtatagatccagttttctctctggtattacagcccttctgcctgaaggactttaatttttcttgtagtgtgggtctgctggtaataaattctgattttttttttgtctgaaaaagtatctatttctttattttaaaaaatcatcagggccgggcacagtggctcatgcctgtaatcccagcacttcgggaggccgaggtgggcggatcaccaggtcaggaaatcgagaccatcttggctaacacggtgaaaccccatctctactaaaaacacacaaaaaattagccgggcgtggtggcgggcacctgtagtcccagctacttgggaggctgaggcaggagaatggcatgaacccaggaggcagagcttgcagtgaaccgagatggcgccactgcactccagcctgggcgacagagtgagactccatctcaaaaaaaaaaaaaaaaaaattcatgctttttattgatatataattcacatataataaaattcacccttttaaaatgtacagtggtttttagtatattcaaaaccttggccaggcacagtggctctaaaattaaccatgcatggtggctcgtgcctgtggtcccagctacttgggagtctgacgtgggaagatcacttgagcttaggaggtcgaagttgcagtgagccgagatcacaccactacactccagcctaggtgacacagtgagactctatcaaaaaaaaaaacaaaaaaaaccccacaaaatgttgtgcagccatcatcactaattccagaatgctgttatcaaccccaaataaaaccacacccattagtagtcactttccatacctccctgtctttaacccctggcaaccactgtctggtatttttcaccgtatataagattctgggtcagtggtgttttgttttctttcagtactttaaaaaaatacacttcattgtctctggctctcatagtttttttgagaagtctagtgtataactgtcttttttcttttgtatgtaatgcataaatgtgtgctgctctcaccaccttcccctccacctccctccacccctgcttttaagattttctcttagggcagctgtttgaatacattgtgtgtatgtgttttagcctattctctttgctgcttggatctgcagtttgatatctttcataatttatggaaatttcttggctttttcctcttcaaatatttcttctgccccattttctctttctgggattctaatgacacatgtgttagatgatttaattgtaccatcgttcttggatattctctccatttttctttctttttttcttctctgtttcagtttagatacttttcactgaccgttttttttctttttttgagatgaagtctcgctctgtcacccaagctggagtacagtggtgcaatcttggctcactgcaacccctacttcccaggttcaaacaattctgcctcagcctcccaaatagctgggattacaggcatgcaccaccatgcccagctaattttttttgtatttttagtagagacggggtttgataaggttggccaggtgggtcttgaacgcctgacctcaagtgatctgcctgccttggcctcccagagtattgggattacaggcatgagcctctgcgcctggccattattgacctatctttaagttcactgagtctttcttatagtttctgtctctctgctaacgttccttatctgttcatatatgttgtccacattttccacaagagtctttgacattaattttacttacttcaagttctctgataatttcagcatctgggaaatataatctcttgaatctggttctgttaatttctatatctcttggtggttgattgctttagctttttttgtgtgtcttgtaattttttattgttgccagagatgatatgtaggacagagactgagattaataatatttatgtctggaaattcttctattaggccattaatatatggggttaagtcagtcttgtcaggaattgaactgggtttgggctttgttctcattacagtgcctttgttttgtttttgtttttgtttttgagacagagtctccctctgttgcccaggctggagtgcagtggtgcgatctcggctcactgcaagctccgcctcagcctcccgagtagctgggactacaggcgcccgtcaccaggcccagctaattttttgtatttttagtagagacggggtttcaccgtgttagccaggatggtctcgatctcctgacctcgtgatccgcctgcctcggcctcccaaagtgctgggatgacaggcatgagccaccacgaccaggctacagtgcctttgtttgacacaggctttcaagtgctctggtgttatccagtgtttagggtaaggattgactttccagagggtttctcagcagccctcctctcttcagttgttggattttcctgtgagcctgtgccttagacatggtctttcttgtgcccttttccctcttccagaagtagactgcttctgcttgtcacttaatgtttgtcggctaaacgggtggaggcagttctccgttcagtctatcttaagcagatgtggctctctgactcagtcttccccagggcgtagggggctttttctttttctccttccccagcctctgtgggtctttacctgattcctaggcgtgacagggattattattattaccgtttccctggcagcttaagacttttgctccttaggggaaaagtgattaggtgaggcagaggagcttgcctttaaggtattcaacagtgaggatggcttcctccaggctcctgccctgtgccgtctttttcgagcactggcaaagtccaaggagaaaagcctgtgagctggtgcaaactcctctgaggtttgcagctcctagggattctgtactatcctgctagcctgtacgctgcttgtagaaatgtgataataacattatctgaattcttaacctggttgtatgaaggcttgtgtctccctcctgatgctgccaataagccagtacttgtgtcccattgccccttggaggaccttgtcttttcttaaatttcagggaaattgatcgacttacctctctgatgagtttaagaaaagttataattttgcatattatccagcttttttcttattgttagaatagaagtgacgttctttccagctttctacattttagtccttgaattgaattttgaatggcaattaggaattggcatgaaattcaattcaattaagaaagggtgggaaggacattttgggcagaggaaggttgcttcagcaagacacaggagcatgaaattgcatgagagcttcatttaccaacagctggtttgggttcaaattaacaatgtaagtaatagctagaatggtgggccagttcacggaaggcctaaatgtccagtgaaggtgttaaattctgaaagtattaaggagccatgaatctatagcttcagttggcatttgccaccaaccttctttcctttggtgacagaggggttaataagacgtgggctgaattacttttaaaatgatttccgtgctctcgagtctgaagtagtacctaacctgcatgtagaagaagtctgctgagtgcatctaatctgcccatatattttgcttccagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggcaagtcatacttcttagccctggatccaaaaggatccaaaagatgatttgtcctctgcttttaggtagctttagagagtaggaaaccaagtcattttacaacgtaaagttacaatcagtttgactctaacatgacatacattcctaaaaatcactgtactatgcaaaacgatagaataaaaaccaaataacttaggggaaaagtggggttaaggagacaacacttaaaatgttgtcagtgacacattaaaaaaataatggaaacctaataaaacagtagcactgttttatacatgttaggtggttaagaaataaataaatactacaggctgagcacggtggctcacgcctgtaatcccagcactttgggatgctgaggtgggtggatcacgaggtcaggagatcgagaccatcctggctaacacggtgaaaccccgtctctactaaaaatacaacaactaaattagccgggcatggtggcgggctcctgtagtcccagctacatgggaggctgaggcaagagaatggtgtgaccccgggaggtggagcttgcagtgagccaagatcgtgccactgcaccccagcctgggtgacagagtgagattccatctcaataaatacatacatacatacatactacaataaatatggcactttacctcgacaagacctgaagtttgcttgttgcttgtggaagtgagtgttggaagaaatgcatctcatgagttattgtgaagttgtggaaggaaggttatgtaaaattttttatcttttgcagtcttaaatcctggggcacagttttcctcctatgaacgtatttcctttgaggcatgcatttgtaatagatgctatttaattaaaattgaatatttgattcaatgtatagccttctcctccaattaacttctgtatcactgctagaaattctttagcgcattttcatctgtacttgtggcttctcccaatagcagaaagctttgaaaattgtcgccatgttcgaaaccagtaaactaaccactactagcactaaaaggagccacttgtggtatttaagattttatttatatataggccttatttatatattttttgtatgaaccttataggtgcttctttttttttttttttttttttgagacagagtctcactctgtcgcccaggctggagtgcagtggtgcgatctcggctcactgcaagctctgcctcctgggttcacaccattctcctgcctcagcctcccgagtagctgggactacaggcacacgccgccacgcctggctaacagggtttcgccatgttacccaggatggtctagatctcctgaccttgtgatccacctgcctcggcctcccaaagtgctgggattacaggtgtgagccaccgcgcctggctggagtacttcttgaagttgttccagccatggtcattttttttttgtagcatcatcactgatgtggactccttgatatcctttgctcaggaaataatcacatgttctcatttttcttccaggatcttttactatttcaagcttcttttcaatatttaaaatgtctccattcacatgcattgcctaccatgttttgagccaggaagcttagacatgtttgagatgttaaatgtgcatctttatatatatatatatatatatatatagaaaagttcagaaaggcaaaagaagagcaaaacacaattttgtaaaatagtatgcagtgagccaaagtagcagtcagtgtttgagatgggtgcattttgtggctcagttcatctgggtgcagttttctgtgttcaccttgtgtttctcacagatgaaactgtgcataagcaaacacaaaatttgcattgtgctccaattgctctctactgtatcagtggcattggaacagatttgcattttaaacataagcattggcagaactgactatacttgtattctacctttatactttctgccagagctgagtactccctgaagtgattttttggagttctcctgaaaagaatgcagtgtgacacctgtcaggattacctgctttagccttgtcctaggctatatctgtgaaaatatgctttcatgtggccaggcgcagtggctcacacctgtaatcccagcactttgggacgccgaggtgggtggatcacgagttcaggagatcaagaccatcctggcgaacactgtgaaaccccatctctactaaaaatacaaaaaaatggccaggcgcggtggctcacacctgtaatcccagcactttgggaggctgaggcgggtggatcatgaggtcaggagatcgagaccatcctggctaacacggtgaaactctgtctctactaaaaaatacaaaaaattagccagacgtggtggcggctgcctgtagtcccagctacttgggaggctgaggcaggagaatggcgtgaacccgggaggtggagcttgcaatgagccgagatcatgccattgaactccagcctgggcaacacagtgagactccatctcaaaaaaaaaaaattagccgggcatggtggtgggtgcctgtagtcccagctactcaggaggctgaggcagaagaatggcatgaacccggggggtggagcttgcagtgagtggagatcacgccactgcactccagcctgggcaacacagcaagactctgtctcaaaaaaaaaaaaaaagaagaaaaaaaaaaaaatatgctttcatgtgatgtagttctcttttagtaattaacctttaaaaattatatttcatttaatctaaatcaccattcatttaaaaatgtaccattattttatacattacagtatttaacattattttatatgttatgtatatatttaggagacaaatgaacatttgtctgtatctgaatcaactgtaccacccaaaaagtgtgtgccacactgcattggcctgggacataaaactggaagctaaacctagtatattttccttacatcctctgggtaccaggagtcatgtttgacagcttctctgcttttctgacgcatggcttccttttgttcacaattttcttactgtaagtctttcagaggtggtgaggcttgagattgctgttgatagacaagttttcaagatctattttcccttcattctaggctggggtgtcatagaaagtttaccaatttactagagtggacactggagtacactagaccagttagtactcttcactgtctttgccatgaaactttataacatggctctccaggtgttgaatctggtgccctgtcaccctgtgctcagggaacacatggcagcaatcagcatgtgaggcgcagagggagggcaagctccccttgtgatatttgaggtatcagctgactcaagtctctctcccttctctccttattctcatgctacctctcccaaccattgtcttaacttccctggccaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggtaggggcctgtgactggtacagtcctttttgagctttctgtcttctgtcagtgttctctttctttcaggatgtggccttttatgatcagccctttaatttggaccatcaaaagctctcatactccttgtacacagcaaggtagtgtagagcagcaattctcaaacctggctgtgactcagagtccccaggagaagaactctttcaaaatgtaaatgctagaccctatctagacatcctgaatcaacatttagagctaggcttggacttttgtataattaagaagcttcaggctgggcgcagtggctcacgcctgtaatcccagcactttgggaggccgaggcaagtggatcacgaggtcaacagatcgagaccatcctggccaatatggtgaaaccccgtctctactaaaaatacaaaaattagctgggtgtggtggcccgtcccaagtagtgatcccagctacttgggaggctgaggcaggagaatcacttgaacctgggaggtggaggttgcagtgagcctagattgggccactgcactccagcttggtgacagggcgagactgcgtttcaaaaaaaagaagcttcagctgggtgcagtggctcatgcctgtaatgccagcacttagaaggcagaggtgggagggtagctttacctgaggagttccagacctgcctgggcaatatagtgagaccccgttctccacaaaaaggaaaaaaaaaaaagcttctttgatgagtctgataaaccacatttgaggactcctaatctagacagtgatggtgaaaaagacaaaggagcccttgaccatattgtttctccgtccccaaccatgatttttggtgtctcttttctgtatctttgctttccgaactacaagttgcaggagctccagtccttagtctccttcaggaggatttgagagcattcctaccatgaaccttaacttcttagaatcagcaaggatccagagggtgtattttaggaagggaaggcaaacaaacagaaggcctgcagtggggagagaagttccagagcaaaaagctggcccccactgacatttgggggtaaggatttaggagtagtgattgtttttaggtggcatggagggacttaaaataggacatacttggaatgttccaagaatagacattttagaatgccgtgttaaggatgattgtaagaacagctgtccccctctctatttttcttaaagttttttccatacccacagtgtcatctttttttcttttgttttgattctgataaactcctgcaaccgtggcactttttaaaaattagataactctaaaactaattctatatacaggttgaatatccctatccaaaatgcttgggaacagaagtgttttagattttgaattttttcaaattttggaatatttgcattatatacttcctagccgaatatcctaaatctgaaatgtaccaacaagcatttcctttcaaagtcatgtaagcacttaaaaagtttaggattttggagcattttggatcttggattttcagggttaggatgctcaacctgtattcattttggactagacgctgcccatttctgccatggtctttttttttttcctttttcttttttagagacagggtcatgctctgttgcccaggttagactgcagtggcatgatcatagttcactgcagcctcgaactcctgggctcaaatgatcctcccacctcagcctcccaggtagctgggactacaagcgtacaccaccatgcctggctcatttttttaaattttttatagagatggggtcttcctatgtttcctaggctggtctcaaactcctgggctcaagcgatcttcccacctcagcctcccaaagtgctgggattacaggcatgcaccactgtacctagccctgccatggtgtttactccaaaagatgtcacattctggagaggtggcattgtgctaattcagaacctttcagttcaggattggggtgtgatgtaaaggaagcagaagggagtagtgacagtcaagaagaggttgtacagattgtctgcacaaagaggaaacaatttagccttatcacagtggctgttagaaattcttctgtatctctccagtctcgttttccaacactccccctgggtcatgctgaattacattcttttccctgagaatgcttcattctctgcacatttggaatgcctttcagctctcttctctggctggtcccacacaatcctctgtgaaaccttctctaagatctactttcctgccccttagagcacactcctctctttccactcttgactggtgggccccagctggcccttagtaacattttccaagcctgggtaagtacctaatgcctcttcccctgtttcttcccttggacttggccttttcccaaaagcttgagctgtatggtttgagctttttcctctttcttgtaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtgacacaggactttcagagaccaaggccagggtctgctgcactgctgttctgataataggttcttaacattgtatgtatatgtgtttgctttgggaggaggtggcactgtgttagttgacagttgtgggctcatgtagtcttttttgccatgagtaggagcccctagtggggctggtggacagctttggaagaggtgtcctgctgctgttaccagccatgtgggccccataggggcactgcgcctgctgccctttcctggcagggctggtggagtcttccctcaaagcatgccttacccagctgggaagtctctgccctgatctggtactccttgtagtaagctgttttctgctcagccactgggctctttcacttttttagttcttaaaaatttatttttaagttctaaaataaaataaaaataagttcttaaaatttatttttttcctgaataaattgtatttggtaaacttctgcctacattttggaaagtgatgctggtggggaaagttctagatcttacttggtttcttctagaatcagtcttcaggaatggattttgtcacaaatggggcatgggggctttctgaggaaataactacaagtcttggtggtgggctccttattatgtttctttttctttcattcttgatacttggaagtcgtctgaatcctttagcttcaaaccagcctgagtttgagtgcttgccgtagcagaaactatccttaccacaggtgggaaggaaaggaccagtttctagcagtgtcgggccactcctctttcgaacatccctaagggaggcattcacaaaagctgtcccaagcagctggaagaaaacagcttccgagatgaccaggaggactgggcggcgccgagcccagaacgctcctggcgcagcaccgttggcgttggccgattgctgctggtggggggcgggggtgcaggccccagtctctatgcaaatcagggatcagaagatcggaatttccaccaatcagcgggaagcctcggccctgtaactgctaatgggagacagcagcgccacgccacaggcttttcccctggtttcgggaggggtggggagccaggtggggctcccgcccagaccctttcccgaggtccgccctctccgccttttctctaaattcctcttttgagtgccctcccttccggttgagaggcgggggttggcccgtagttgtacactcagtcaccctgcactgtggaggcgggggcctcccttgtggactgatttgcgtgggatttggttgttttattaagagatttaaaaaattcagatgacttactagtatgactgttttgtcatatttgcttccaggttaataaatgacaaaaatgaaa

SEQ ID NO: 732 - DNA, 6703 bp, Homo sapiens
gctgcatctgaggcggacgccgcagtgtagggcacaccctgagggtagcgagagacgtgacaggaccgagcagctgggggctgcagcctgctctgtccccaccgatcccagagagaggctgtgagtctggatctgggcgttcgcaccctgagagagggggtcaaagctcccctgcggccccgaggaagaagagcaaggttgaggacagcctcgggtcaccagagtagtttggaggcaggcctgcaggcgcgtccccgctcctcagctccaagctgacgtatctacacctgccggcgggcattaagatggctggttatgccactactcccagccccatgcagacccttcaggaggaagcggtgtgtgccatctgcttggattacttcaaggaccccgtgtccatcagctgtgggcacaacttctgccgagggtgtgtgacccagctgtggagtaaggaggacgaggaggaccagaacgaggaggaagatgaatgggaggaggaggaggacgaggaagcggtgggggccatggatggatgggacggctccattcgagaggtgttgtatcgggggaatgctgacgaagagttgttccaagaccaagatgacgatgaactctggctcggtgacagtggtataactaattgggacaacgtagactatatgtgggacgaggaggaagaagaagaagaggaagatcaggactattacctaggaggcttgagacctgacctgagaattgatgtctaccgagaagaagaaatactggaagcatacgatgaggacgaagatgaagagctgtatcctgacatccacccgcctccttccttgccccttccagggcagttcacctgcccccagtgccgaaagagctttacacgtcgcagctttcgtcccaacttgcagctggccaacatggtccagataattcgccagatgtgccccactccttatcggggaaaccggagtaatgatcagggcatgtgctttaaacaccaggaagccctgaaactcttctgtgaggtggacaaagaggccatctgtgtggtgtgccgagaatccaggagccacaaacagcacagcgtgctgcctttggaggaggtggtgcaggagtaccaggtgagagaaatgagggaatgtggggggatgaagggagtggaaaggtaactaggagagctgaggaatgagtagcattcctttcccacctcctcaggtacttagttgctaaacttctctttatttgatgagggagacacggtggagagagatggtcatatgggtaaaaaaggagacacaaaaccatgaagattggggcagattggcttccccagaggaagctgaacagataatatgacggtcactggaagcggaccactactgctaatactggcagtctacctaagtgtaagggacgtgagtaacagatacccagtacttcatttctccctaatgtgagtccttgaccaattccctgggacaggtacagataggaatagaaagccacagtacttggagataatagacatttgggacctcagcacaagcagtgtcaaaatagatgtattggtagacagaaatgccagatgtgagtcctaaactactgatagcaattggccacaccccccctctgaaagtctgggattgcatctctaccttcagtggggtccgttttccttctagagaaaggcaaagcatataagcatctttgatggatcagaatgtgcctcatatcctgatcacttttctttcctggtattttatcatagtggaaggagtgcgggatttaggatcagatgacctggctctgccacttactgtctagtcttgggcaggtgtcaacctccttgagcttcactttttccctaggattgtaaggattaaaagagatcatatatgttaaccataaagcactaaacaaatgtttgctgttttatttggctttcttgtaacttgtcttcccttgtttgggtgctgatatggttaatgccttgctttctagtcttgacttctaagcattagataattgtctcaatgacaatgagcatgagtaccatcttccttaccaaaagtctaggtagatttgactcctagcagtgcccaaacgaaggagaggttgtcttcaggcccataaaggttgacctggatatgcagcagccgctgctcacgtcttagtagtgctttacagtttataaaatatatttcctcgtgttctcctatagcagtggttttcaaattgttttttgaccaattagtgtgtcttaaaataaatgggtcatgcctagcattatctcaaaatgaagtaagagaaaatattagaacacatggaacatagtaagggtaagtactgctttatgaaacttttaagttatatatatatacatgtatatacttcatctaaaaatatattgctttctttgagttgcagtcaaaacacaaacacagagcactgtcctacaggcttcatgtattagatattattatcacccccctgcccccattttatagcaaatattgggaagtgcacagttaaggcacaaatctaaccataagtcactgctacctctgttacattaacctgacttgaaggacaaatcctagtaccatgttttcacccaaggtgataactaaagtatcccatggaaaaaacttatgtcctatgcttctgggttttagtatactgaagctgaggaaaagagagaaccttccatttctcttctaacttttttttttgagacggtatcttgctctgttgcccaggcagaagtgcaatggcatgatctcggctcactgcaacctccgtttcccgggttcaagcgatcctcctgcctcagcacccctagtagttgcgattacaggcacatgccaccatgcccagctaattttgcatttttagtagagatggggtttcaccatgttggccaggctggtcttgaactcctgacctcaggagatccaccacctgggcctcccaaagtgctgggattacaggcatgagccactgtgcccagccttcctcagctaacttttatcatcatccccttcccccattttatagtaaatattgttaagtgcacagttaagacacaaatctttttttatttttatttatttatttatttacttatttatttgagctggagtctcgctctgtcatcaggctagagtgcagtggtgcgatctcggctcactgcaacctacgcctcccgagttcaagcgattttcctgcctcagcctcccaagtagctgggaatacaggtgcgcaccaccatgcccagctaatttttgcatttttagtgtagacggggtttcaccatgttggccaggatggtctcaatctcttgacctcctgatccccccgcctcggcctcccaaagtgctgggattacagatgtgagccaccatgcctgggtgtctctttcattctttaggcagttcattgtcacttccttccattggtaaacatgtaaattatagtcgcatgatttagaattttactgaccaaagtcataataatagttaacagtacaaggaactatttttgtataatggtttatttaatacagtatacattatctttcatatactttgttacaatgttaaaaaaacttcatttttcataatataggaaataaagttggaaacaactctggtgggaatacttcagatagagcaagaaagcattcacagcaaggcctataatcagtaagatgtgtgaaaagttgggtagccacaggaggtgttcattaaggatatgattccatttatatagctatttctattgcataaccaggacagttttattgttttgaggtcaatgttcttttaaaatttgattttctgtaagaagaggctttttggcccagaaagccttacttattttacatcttccagtttgtccatcccatgagttagagttcgtcttgactctgcaagctagaatcaaagaattatgaaagtaagatcatttagatttgaccaagggcaccattaaatggtgtcaggttttaggaagcagacgggtgtataaaaagaaaatgaacaaagatttcacttattggggatcaggcataactggatgcctggattgtcctgccacccagctgccaccaataaaatcattcatcactctgcaagagggaccagatgcttccatcatcagtactccttgtttttctgttatctcctttgaggtagctaaaaatggcagccaaaaaaaaatgttgaggcttttctcaagtatatactcatgttattttgcagaagatagggtcaacttcttcagttgagttatctgaaagtgttgggcagtgacaccatgccaaacactgttaaattcatgccattaaaaacagtggagtgttctgcaaagcccgattctctgcagctttaagactggacagtattgaaatattcacaggaatcttccaagccgtgaaagcttaatattaaacagcccttttaattgcaaaggagaaaaaaatggagacacttgtgaaaccttgcattctgagtgctgccacaaataaattaaggaattccagaatttcttcatctacttctgcagtcttaactctgaattaatgactgtatatatcaaacttcagatcttaaaaaacatcagctcgcaagaggctgaggcaggagaatgacatgaacctgggaggcggagcttgcagtaagccgagactgagccactgcactccagcctgggcaatagagcaagactccatctcaaaaaaaaaaaaaaatcggctcatcttttattgctgttggttgagatgaatctactgatgaagaaaactgtactttgcttacattcagaataaggctttcaaaactgtgggtgtgctgttttcgtgagccttctacttgaccaccaaagacagtatttttgcagctgtatcaaatgaaccgagttggaggaaattgtataggagtatatcttaatggcactacagcaaactgtgttaaatttgggtttttggcaaagattgaagaaaactggtattcaagatgtactgcagctgtcaccaccaagcatgaactttcactgattacccataacctactggaaatcttcagccttgctgtcagcatagaccactgtgagaaacagtacattccattccagtttgccctgctttttgaagatctaaatgccattccatgttttctgttacatattgaagtttcttggttgccaaagaaaaacggattctgctgaacttgtggacagaacaaccccaaggttggaagaacaatgaaaaataatctatacttgaacatttcaaaagttaaaattttcaacagagttttaacacactgaagcttaaaatacattgacactgaaatgtcaatgggcaaacaccaatttcgccgttcattatgaaatacatcaaacaaaacttgccaaaaatacaaccataaaaatatagcaaatgtatgtatgagcaaactaatgctaaaaatgtctaattttcttggctagtctttcaaggaccagattcatgaagtgttatttgaagggaaaaagtgaaatacttggaattattttgagtgatgtgctcctgagcttgttcttaaaatctaccagtggtagcttttggaaagaatgtgtttcataccgatgtgcaggcctcactggaagagcttcaagaggagtttgtgaaactcaaagtctaatggttttgattagaaacttccaggcaaatactccagagaaacttgggtgtaaaatgactaaacagatgaaaaggctttatccactattccatttgctccttacaccttaaaaagcttttttattttttaatgttttgatatatctagctttggggagaaagcagtgcaagagtgttattaaaagcagcttgtgttttcttgcacctttcacaccacccaggaaagaaaagttcaggcttaacagtgacatggctatcacatcatctgaataaattttttccttctaaaattactactgctttcattaatttcaatcatgatacttaattttgaaattgtaaatggaggggcaaatgtgagattttcaggtatatgaaaagtagaagtgtgggttacaaaaacattgaggaaaaacatacagctcacctgtttattgaatgtcttccctattaggttcagctgttcactgctgtatcacaagtcagactgtttaaacttgttcctctacttctgtggctgtaccctggatctcatcttcagattggctacacatctgaaatcaactcccattgcactatgaccttagctcttagccttccaatacacttaagcacactccaattacacctgcccttcagctttagggagcccactgtttcactgactccatattttttccttcccaatttatcagacatttaacagccttactatcctactgagcctagactgcatgattcattttggcataaagacctgatacaggccgggcgcggtggctcacgcctgtaatcccagcactttgggaggccaaggcgggtggatcacgaggtcaggagatcgagaccatcctggctaacacagtgaaaccccgtctctactaaaaacacaaaaaattagccaggcatggtgacgtgcacctgtagtcccagctattcaggaggcctgggcaggagaatcacttgaacccgggaggcggaggttgcagtgagccgaaatcgccgtcactgcactccagcctg

SEQ ID NO: 733 - DNA, 10897 bp, Homo sapiens
gcgcggtgacgccatcgcagcgcgccgggagtgtggcgttctgtgaagagttcggtgctaacctccctcacgcggcggtggctgccgggaccctagcaggtttcagctggagcggcggcggcggcaacatggcagagaccgcggccggagtgggccgcttcaagaccaagtgagcccggagctctggggccgtgcggggagggagctgggtttgcagccggcatagcggaggcgcgcgtggggtgggcacgcattggggtccgtggaggcgagaggctgtgtgtgcgccggcccgcggggtcgcggaggctgcggtgatactaggcgggagagccggccccggctgctctcggggaggacggcgatcggagcccggccgccgggagcagcagcgtgggctcatcgagaagccggctatggggtggagtggggaccagaagtcccgatgaggggaggagagggctgagcctaggtcggggctggtcccgggaggcggcgggggcgaagaaccacctctgagcagtcggcctggggacctttcatccgcgatccgtcttctccagggagcagggagaatgcaggagaggggcgggtccgcagaagcccaggaggccctgagtgctgtgccccgtcactccccaagcctttgccgaacagcagtgctggtgcccccgccctggcagcgcagcctcatgggattatcgtttccactggcggctgtggggctttggttgtgccaagcactggtaaaggaaagtcccaggctggcagcaccgtcgtgggagggtcaactgggtgcgggggctgaggggccgctttcgttttggcagtcaggcttccagaagcgcagtgagccaggccttgacatctgggaagagaagcccaggccgcgtacagggaatagggggaagataggaaacccgtcccagaggctgggacaggagcagtggggtgcactgtgggccatgagaaggaaagaaagcagaggcaagggtggcagaggctcttctgggcaaggtctgggaggtgtgtgggcagaagggaggggctaacgcagggcagtgacatcttcagttatgttctgaaaggtacctggcagcagggttaagaggtaggtaggggaggccgggcgcggtggctcacgcctgtaatcccagcgcttttggaggccgaagcgggcggatcacgaggtcaggagattgagaccacggtgaaaccccgtctctactaaaaatacaaaaaattagctgggcgcagtggcgggcacctgtagtcccagctactcggagaggctgaggcaggagaatggcgtgaacccgggaggtggagcttgcagtgagctgagatcgtgccactgcactccagcctgggctggagaccccttctcagatcgagaccccttctcaaaaaataaataagtaaaaagaggtaggtagggggtccagtgaagaggccagagtggctggccagagactgtgatgggctggaccaggtggaggcagtggagaaggaaggagaaggggcacgagtgaggtcacagaaatgacagctgctcgtgggacccgggctctgggcaagcctggggatggagagaggagtcagggaggggaagaggtatgccagacctcagggatgaagacactgggaggatgtgctctgggctggctacccaggcctggccacccaccgccggcaggggtgttcccaaggagccccctggctctcactggggaatccctggaagccctgggctgttgggctgactccacctgacacaggcccaccccctactgcctcagggatcaccagccagctgcgggtctctacttctcagtgacgacggtagctacagccccctgcagtactgctggttccaccccatgccctgtccctgctgttgcccagaaactcaagggcaggggccattggggtcacttggagaggagcacctagcacagggcggggccctggggactgagggggtgggtggtgctcattcgcctcccgctctccttccagctatgctgtggagcgcaaaattgagcctttctacaagggcggaaaagcacaggtaccagcctggggaagggcagtggggcgggcagccagaggccgcggggggtgctgaatgttgcctggctgagacctctctgtccccagctggaccagactggccagcacctcttctgcgtctgtggcaccagagtcaacattctggaagtggcctcgggggccgtgctgcggagtctggagcaggtgagggcagcctgggtgggtgaggggcaagtggagagggcagcccactcacaccgtgctcggcacaccactctttctcctaggaggaccaggaggacatcactgcctttgacctcagccctgacaacgaggtatgtggggcggggcctggaggggacccgctccagcgcctccctcccagactgagtccaggaagatgtgagcagggtattgctgcccctctgctgacctgtaccctcccccaggtgctggtgacagccagtcgggcattgctgctggctcagtgggcctggcaagagggcagcgttacccgcctgtggaaggcgatacacacggcccccgtggccaccatggccttcgaccccacctccactctgctagccacaggtagggccctgccgtgcaggtgggtcgtgggcacagatgcaggggctttgggcattccaccccctcaccttgcttccccgcaggtggctgtgatggggccgtgcgcgtctgggacatcgtgcggcactacgggacacaccacttccgaggctcgcccggtgtcgtgcagtgagttggaaggtggagggggagggcagaggcaccacccaggctgcacagctcacccatcctgtcccgtccgcccacagcctagtggccttccacccggaccctacacgcctgctgctcttctcctcggccacggatgccgccatccgcgtgtggtcactgcaggaccggtcatgcctggctgtgctgactgcccactacagcgccgtcacctcactggccttcagcgccgacggccacaccatgctcaggtcagcagtgggccctggtaggagggggaggcttggaaagtgggggctgaggctaagacttgacctgaggttgccgttgctccttcagctccggccgtgacaagatatgtatcatctgggaccttcagagctgccaggccacgaggaccgtgcctgtgtttgaggtggggatgcctggaggccagggctggttgagttgggtggggagggggcatgatagcagcctgtgacccaattcgtctccagagcgtggaggctgctgtgctgttgccagaggagccagtgtcccagctgggtgtgaagtccccagggctgtactttctgacagctggcgaccaaggtgtgttgggccgggacatgggcaggcggtaggggctggggaaggcctgtggacctgagagtctcagcagccctgtccccacccacacaggcactctgcgcgtgtgggaggcagcttctgggcagtgtgtgtacacgcaggcccagccgccgggccctgggcaggagctgacccactgcaccctggcacacaccgccggcgtggtcctcaccgccaccgccgaccacaacctgttgctctacgaggctcgctccctgcggctgcagaaacaggtgcacacctgcccttgctcagtctggaggctgcgggcaccagccctcctcttacacaggtcctggctcacatctcctgctccctgccaccccgcagttcgctggctacagtgaggaggttttggatgtccggtttcttgggcccgaggactcccacgttgtcgtggcctccaatagcccctgcctaaaagtgtttgagctgcagacgtcagcctgccagatcctccacggccacacgggtgagtggggccagcccacctgacaccctgggagccgcctcggtcccttgcttgcttcccttcccccgtcttgctgtgtgacctatacctccccacaacatctcagatatcgtcctggccctggatgtgttccggaaggggtggctctttgccagctgtgccaaggtgaggcaccctgagaggtaggggcaggggcaccaggcggggaggccacgcagtaggcccatggaccagcctctctcctcaactccctgtccccaggatcagagcgtccgtatctggagaatgaacaaggctggccaggtgatgtgcgtggctcagggttccggtcacacacacagtgtgggcaccgtctgctgctctaggtagtgagtcggggctgggcccaggggtgtcagggaggtggaggcccaggcctgccagcagggctgccgctcagggagctggggaggcagtggcagctttggcttgctctgaggctccagcccaaagatgtggaacagaacaggacaggagagtccctaggtgcctcggggtcagtcctcagaagtagccctggtgaagtggttaaagggggaagggcattaggcagagagaatgaccctgcacgaggcccaggtggagaggtgacccctgcatgtaggcacagggtcctgtggctagggctgagccacccggtgctgcgggtggacaatgtagacagggcttgatcctacaggtgcctgggggtgacccaggccaacccgcatcctgggacaggccccgtggtctggaccgtgggctcccagcctggccctgtggggagctggccatcagggctggctggggctcagctgtgtctcctcctctcctgttgggtcacaggctgaaggagtccttcctggtgacaggcagccaggactgcactgtgaagctgtggcctcttcccaaagccttgctgtccaagaacacagccccagacaacggccctatcctcctgcaggcccagaccactcagcgctgccatgataaggtgactccatagccactggggtgggggtgtggccaagcccttgctgggggaagatgggggattgctgagccaccaccttctcccattgccaggacatcaacagcgtggctattgcccccaacgacaagctgctggccacaggctcacaggaccgcacggccaagctctgggccctgccacagtgccagctgctgggtgtcttctcaggccaccggcgtggcctctggtgcgtccagttctctcccatggaccaggtgctggccacggcctcagctgatggcaccatcaagctctgggcactccaggacttcagctgtctcaaggtaagtggcgctccagaccctccccacttcccgccctggtgacatctcatgccctaccccccaccttgcagacatttgaggggcacgatgcttctgtgctgaaggtggcctttgtgagccgtggcacgcagctgctgtccaggtgagtgggctggggtggggcagcgatggagtggggggtggcggggggacctgcctgacgctgagcctctccccaccccaaacccagcggttcggatggcctcgtgaagctctggaccatcaagaacaacgagtgtgtgcggacgctggatgcccacgaggacaaggtctgggggctgcactgcagccggctggacgaccacgccctcactggggccagtgactcccgagtcatcctctggaaggttgtgggccccaagggcagggaagagtcggggtggagtggaggccccatctgaccctagtctaaccccaggatgtgaccgaggcggagcaggcagaggagcaggccaggcaagaggagcaggtggtcaggtaaggccagggcagtggcgcccctccccgcatcagccctgctctgtgctgtagggaaaacgaggctgagtgccaggctccctgcctgctgactccgatggctctgcctgcagccccagccagcggccctcagtggcctctcctcccctccccacaggcagcaagagctggacaacctgctgcatgagaagcggtacctgcgggcgctgggcctggccatctccctggatcggccccacaccgtgctgactgtcatccagggtcagtgcccaccccggggggcgaggggctgggtcttcggaccactgggctctgctttccccagctcagccttcccttctcccacagccatccggagggaccctgaggcctgcgagaagctggaagccaccatgctccgactgcggcgcgaccagaaaggttggcggccagtcagggtgggtggcccggtgggcaagggccagtcatggcagattggctgggcaagacgatgagggtcctgttgcccacagaggccctgctgcgcttctgcgtcacgtggaacaccaactcgcggcactgccacgaggcccaggccgtgctgggtgtgctcttgaggcgagaggcccccgaggagctgctggcctacgaaggcgtgcgggcagcgcttgaggccctgctgccctacactggtatgtgggcacagcctggggttgggggatcctggtgggcgtgtggaccacccccctgacctccctctgtccaaccccagagcggcactttcagcggctcagcaggaccctccaggccgccgctttcttggacttcctgtggcacaacatgaagctccctgtgccggccgccgcccccaccccctgggaaacccataaaggcgcactgccctagccggtccggcctctctccagtccatcctgaacccctggaaaacccataaaggccgctctcctggccggctctgtctctctggactgcagtccagccccccaccctggccaacaccctacctagccagccagaagggcactggagctgatggtctcggccctgccacgcccatcccgcaccctggcctggcagagatccagcccgcggctccgcacgcttagacggtgggggtcatgcagaacaagctttactcagaggaacagcaaatggccccctcccatccctgctggccagggagatccgccctccccgctcctccccagccctgggatggcgcggtccatcccctcatcgggatcctcgcgctcactgctccgtcgtggggtgcggcacagagtccacgcaccctcgagggcggccctggcgccgtgggcgccgctccagggccctgcgtgtgacggtgcagcagcggctctggatggcgcccggcgaaggtcgggtgggcacggtggggggaggggcggtggcctgggagggttcagggaagccccgggcctcacccgccgggtcgtctcctccacggaaccccgtcccgctcaggagagcgcccagcccttccggccgcagcagcaccgcggggagtaggcccgcccggtcgccgtacctgcgaggggcggggtgtggttagggccccgcccgcctcggctagcctgccctgcccacgcccgctcccgcgtacctgcatagccaccagccgcggtctgacgtttccaacacgcgcacgcgcgcccccgcgggcacggacagctcatctgcgcggctgctctcgtaggcgcgggaagcacagaactggggacctggtgggagtgggtgtttggagtcaccgcggggccacagaggacgaggcccgcccgcacccttctccacattctccttgcttgagtctgctgacggcggggccgctctaagaccggttcggggcttcctctaggtgcggagaccaagcacgggctcctggcccgccctgcccgcggtgcttctggcccagtcttgccacacggtcaagccgcagtggtggcgtgaggggtggggttaggcgcataccgctgctccctagggacgggcctccctcccggccttggcccggggccgcctcctccaggtagggcgctggaaaccaggcggtctgccggtcttcgttctccaccagccaccagcctgtgcgcaagaagcgggcagggactcaaatctcgaggctccctcgggtccaggagcagaggagcaaatccctgggttcttggggggccctacctgaggggtgccgcagcagcacgtccaggctctcctgggcctgcgcctgaaaaggcctatcccgcgtgtcctgggtacagaagggctgcaggcagcgcaggctctgagcctccagactgtggatggagaggcggcccgcagcgcgagaaagaggctgctcctctggggtgggcaggatcacccggctgggaagggcagcccgtacgagtgagaggtaggcggatggggagggtgaaactgggggcgccaccccggcaagaccgccagcctcccactctctgcccctattcgctggctgttcccccccaccctggacctctcccagctccaaacgccgctgcatgctgggagtttggggcgagtcaggcacctgccgggtggcagcgcgggctccaggtccaggggttgcggtgcgaagaagccagtgatcgtcgggctccgtgccacgcgctctgcagtcgccagcagcctccgagaataggtttccaacagctgcaggcgcgccaggccgcggctcgtgcgccccacgcgtcccaacagtggtgcatcttaaggcaccacaaaaacgtactgtgatacgccgctttgggcttcactggtccctggcgcccccaggcaagccaccgccttccccgctcccgtacccaggctggcctgaccgagaagctttgggagaacgcggtcagatctccgcagcaggcccgcctccaccgggaaggtctccttgagggtcttctgagggcgggaaccagggcattggtcttccagagcccactgtgcacccttgagagggcggggtccctcacccggatggcaggggctgggagcttcagcagggacgaagggcctccagtgggagtcactgatgggaggcagtccagtgggaggcagccgcgtggggaagccgccaccgcggcatcagggtggcccagggtcactcaccttgagctgcctgaattcgtcccaactcctgcgcacgaaggtgtcgctgccgtctgaccagcgcacagagaaggcaaacgtctgggggacaaaaagttgggagtgccgtggaggtgctggtccaggcacccccttcctatcccttggggccactaaggacccagccaggtcttacttggagcctcttgatctgcaccagggctgccccttgcactgaaactgggtatcgggggcctgccatggctgtggcttccaggctgcagattcctgaaatgggcgaggacccttctgcctccccgtgcttgagagggctctgggggacccagaaaaccccctgggatagaatcctggcaacacctcaagcctgtggggtccttgtggagccgccccagctgagtcctttgcagctttcttgctgtcccccaagcccacgatctgggggcaggagcacagggattgggggacttccaggcagagctgctgggaggaagaagaagaatgagctttccagccctggaggcgtgcaagactgaagaaggggcgaagggtaggcgggactgctgcctggggccctcctgcctgcctctggccacaggaggagggaggagaaggcagggctaatcaaagcgccacctgtcctgcccacctctctggattcccctaccctgtgaggtaattgccctgccagggtgcgcccaacaactttgaactggcctggggatttctgtgcagaaccaaggactcagtgcttacagctttaagtgctttgtctgacttaatcctaatgctggaggaaaggtctcttaatgtccccaactcatagaggaggaaatgtgtgttaaatgcgtaattattgtgagctgttctatacatgctgggggaggggcagacctcacaggctcaccccaggggttcccctgcagtgaggagacttggggtaggagaaagagggcccatctgtgcagtcactggcatttggtgggtgggggtggtggtcagggaagtggtcactagggctgttttgagaaccacctctcaattcacgatttgccatgacttactgcaaacatggcctgggcagaggctcgcccaggtgccccacctctctggctgcttccttatagttcgggcttcggaagccacattcaaccctggcacacagtggtttttcctcgtgctggggccaccagttctgtgttgggatgcacctactccagccccttcagggagcagtcagcctctaaggcatccctccaggaagctgccctggctgcaacaaagggcctttgtgtgtctgtcccaccagcactctctctcatgccctcaagctgtccctggtcttggcatgggcaatgaacacctgctcacatagggctgatttgcagggttcccccagccagctgtcaccttctccctgtctcagctgagggcccagctgacctggtggggtccagcgtgtgaacccaggggagaccttgctcccctggaagacaggagaagctggggaggatttattcacaagcagaggcctagagggattctgaggccacctgcctaccccagctgacagctcctgccccacaccccatcagccctgcatggtttccactttttcctcccctaccctcttttcttgcctgaatagtacaccccaccctccatctgtatgctcctcacttgcccctacaaaatccactccaaggacagacacagtgcctcacctgtaatccaagtactttgggaggccgaggcagggggattgcttgagctcaggagttcgagaccagtctgggcaacatgttgagacctccatctgtgccccccaaaaatacaaaaattagctgggcgtggtggcgtgtgcctgtagtctacttgggaggctgaggtgggagatcacttgagcctaagcagtcgcggctgcagtgaacaagatcgcgccactgcactccaccctgggtaacggaacaagaccctgtctcaaaaaaaaaaaagaaa

SEQ ID NO: 734 - DNA, 9374 bp, Homo sapiens
gcgccagcgccagctcgggtcgcgccctcgcccgcctcctccctggtctcgccgcgcgcccgcctgaaggccccggtcgcggcagcgcgcactgacctccgcagctcccggcggcgtccttcgaagcgcggctgcctgggccagcctcggcaggaagcaggacggcggaaacagaacagagcccgaatctaaagtccttgcccaaatctaaagtggctaccgcagccccggccgctacggccgcagagaccctctgtgccctgagtaaagatggccgccgcgggctgcgcgcgaggggcggggagcgggaggcggggtcggacctgcacgccccgcccccggactcctggcggccgctgatccggggccttcccattggtcacctctcgtggcgaactcggattgggccatatcaggccggggcgggtcccatcaaccaatagcggcgcggggctggcgggtggggcggggcctcgccggcgccgtcaagtagcctgggggacaggccggcgcggctgggagcgggtgggcggccgggaggccggagcagcacggccgcaggacctggagctccggctgcgtcttcccgcagcgctacccgccatgcgcctgccgcgccgggccgcgctggggctcctgccgcttctgctgctgctgccgcccgcgccggaggccgccaagaagccgacgccctgccaccggtgccgggggctggtggacaagtttaaccaggtgggaaggggccgggcggggtcgtcaaccttgggcccggggtccccctcaccctgcatccggggtcgccccaccttgggcccagggtcgccctcaccctggatccggggtccccctcaccctggattcgggatccccctcaccgtcgatccagagtccctccaccgtggtcctggagtccccctcacccttgacccggatccacccccaccgtggaaccagggtcgacgccaccgtgggcctggagtcccctcaccctcgacctgggctcgcccccaccctggacccgggtcaggtggtaccaagcactatgggcactgtctcctcgcaggggatggtggacaccgcaaagaagaactttggcggcgggaacacggcttgggaggaaaagacgctgtccaagtacgagtccaggtgggtgccctggagcacccctgtgggtcttggcctggcgctgtcctgggaagtcgtgtcctgcctttggtgcctgtgttaatgacagggagacagaacagcccccgaggcaccagtcacccgtccgagtcacctcggcttctccctgaggactaatggctggcccctctctggccttccagcttctgctctggtccctaccccctcaacagacagtggcttttcaaaatgtaaactggaacaccagccccacttgtgggaaccgctcctggcttcccctgacagtggggtccccttattctctgtgcccggagtcctggctccccggcccctgcacccaggttggcgtattggttcggatttttcttcactgccttggaggcgctgacggtgggccggtgtgggcctgtgtttcagcgagattcgcctgctggagatcctggaggggctgtgcgagagcagcgacttcgaatgcaatcagatgctagaggcgcaggaggagcacctggaggcctggtggctgcagctgtgagtgccttaaaacctcttagaagatactttttattttccaacttagaatttgaaataacctcagacttagaaaggtacaggaacagtagggagctcccacctgcctcgcacccaccttacccctgcattaccgttttttatcaccagagtcagcgatcaaaaccaggaaattaaggagaagattctgtccacacctagactcttgtttcctggaccttacaatactccagagcatatgttacgttcagctgcatgtttgttttaaagaaccgtgtctgctgggattcagtgaatgttttcctccatcctcaggaagagcgaatatcctgacttattcgagtggttttgtgtgaagacactgaaagtgtgctgctctccaggaacctacggtcccgactgtctcggtgcgtttctcctcagggaaatcccatctcctacgtcacttcccctcttcttctcatgattcttgggaggtaaaagcacagaggggacctggggtgcatcagctttctgtagggtctgggaccctgccggatggctgcctcccccatccccaacacagcttggagcacttcgcaccgtctggctgcagcctcaccactaacctcatgctttagcgtaaaactctgagtatgtcttcccagctgtgctgttaattcaggggttcacagactcaggttgttcacagctgagtccactcacctgagagtctgtcctgactgacctgtccaggtgcttctccctgtgtgcacagaggtgaccacaccacaacttctgtggctgctattgcagagagcgcagggcactgggtgtctatcaggctgggcacatggccttgagccccaatgggtgccaagggacagggctcttctgtgaagaagtgtgcattgaaactgaagtcacggtttactgtttataaaagccaatctcgtggtcaagcgagatcaggtagcagaagtttcaggttcagaccccccacccgcccaccatcagccttctgccagcccctgctgctgtccctggcatgcactggaggccgcagctaatgttcccactctccctgcagtccccgcgcctgacgcgtcagtgtccctatcaccatgtttcagctgaggctgcccaaagccacacaaagtgcagtcatgtgtaacgaccaggcgtgttctgagaaatgcgtcattaggcgactttgtcatggtgcaaacatcacagcgtgcactccacacgccacacgccacacgcctagatggtgcagccgctctgcacctaggctgcctggcaggccctgctgctcccaggccgcacacctgcacggctcgtgagggtcctgagtactgtgggccatttggcacgtggtaagaatgtgtcacctgaacacatctaaacatagaacaggtaatgaggcacattgtgatgtcactaggcaataagagccgctcagctttagtatcatcttaggggacagctgtgctatgcagggtcccttgttgacctaaacgtcatcatgcagcacgtggccatagtgaagcccaggagcctgtggcttgctccactcaggcgatccaccgccagccctgcagacccaggaaatcagtttccccaaacacccactccaagccttcaggctcatgtacgtcctcagaatcgtacagggtttgggtgccatgcgttctctccgtgtgagaacaccgcaccggtcaccaccaggtgtgctctgagcatggttttgtgtcccctaaagcatgccagggcggatcccagaggccctgcagcgggaatggccactgcagcggagatgggagcagacagggcgacgggtcctgccggtgccacatggggtaccagggcccgctgtgcactgactgcatggacggctacttcagctcgctccggaacgagacccacagcatctgcacaggtacgggctacgcctgggctggccccggggttgaggcgggatgacaagagccccttgctggagctgcctgcctagatgggaacaggggcctgttgatctttaaccccagatgtccaaggaagcttcgagggcccagaaggatgaatgaaaacatcagaggatagaggcagaggttgtcgggcacttcctgtcccgtaacagccctcagaagggagaagctactcacctttctctctagttcaaggtccaccccgaccttgagttgtgatgggccatgcagtgcacaggtcctggaggtgccgtgtgggccccgcaccggcccagagagcagcatctgtcaaatccctgcaggccgttatgagtggcatctttccaaaggacgttttctccctggttgtcactgatatgtaggaaaactctgagtgtctcggacgtgagtgtgtggttggccggcagcccctaggctattctgggcagacagacccgtggatcgatagtcaggaccggcctctccgattcttacgcccctcagcagtcaggaccggcctctccgattcttacccgccttgctgtctgtctcttggatgttggcgtggcgtgggccacgcatggatccgtggccggaacacgcacacccagccaggctacagctccagagtatggatagctgccttctctccaggttattaaaaattccttggagtcctggtttgctgagaattttaaattcatgggcactgaaaatcccgtgttgcttttccctcttaaattcctcacttttaaacgagccttgtccccaagctggtacctgagagtggggtttgtacccaggcccgcctttgccttccagcctgtgacgagtcctgcaagacgtgctcgggcctgaccaacagagactgcggcgagtgtgaagtgggctgggtgctggacgagggcgcctgtgtgggtgaggagcggcccgggggtggaggagggcgcctgcgtgaggcgtggggggtgtgagatgggggcgtaaggcgtggggggtgtgaggcatgggggcgggaggcaggggggcgtgaagtgtgggggcgtgaggtgggggcgtgaggtgtggggcttggggtgtggggggcgtgaggtgtgggggagcatgaggtggggcgtgaggtgtgggggcgtgaggtgggggcgtgaggtgtgggggcactcactgtctcactctcacacaatgtgtcgccatcctcatggggcgcctgccccggttggcactgagtgtctaaggacagggcctggccatcgcctcatcccctcccctgccgcgtggggcctccgaggatggcatttgagatgattcctcctcaggggctgccctcctccctgcccttccccagccggccctggccacgggctgtgtcaggccatgatcggtccttccccgctccctggccgggctgtcctgggccgctcacagctgtgccgctctgttccagatgtggacgagtgtgcggccgagccgcctccctgcagcgctgcgcagttctgtaagaacgccaacggctcctacacgtgcgaaggtgggccaggcgggcgggtctgcactccggggcctgccgggtttcgttgctgcctttgtcaacattcatttatggcttcttagtgtcacttccatacatcctgcctgccctgagaacacttagtgtggcaaagtaagtcataggtatttgctgcaggaaaatcagaaaattcaagtcagatgaaaagaaaacagttaaaaacccaggaactccctggagagcgcaccctgctggtgcctccactgctcgtgcccccccagcgcccccgcaacgtgccctgcgtgactttccgcagcgcctgtcgggtgttttccactcagcagcttgttgcgaacgtctctgcgtcctgtggtttctctgtcacgctaatgattttggagccattatttcatacttttacaacaatgtctgttgctggacgtttacgtcataacagtttttcaacttataaactgtgaacacttgaaggtaaacttttcacattccttatgattttctgtggattaatttccaaatcgctcagtcaagggaatgtgtcttttagagccatagtgccccagaaaagttgtgctgatccccagtcccagcagcagggaggaggccgcctctgccccgtgtgtgtgacagccccaggcagttttcactgttgggagtgcagacagtgggtccctcagtgagccactaatactggaagccatgcgagaggctctggttattcttaggaagctcctggcaggctggcaaaccaatggtcaccgagctggaggtgggtttgtttctagaatctctgtagcacccagtttctcccaaagagttccaagccaggtggtctgcaccatggctctccgggagcacctgctgcacagcaggacgcgagtctgtgcttttgccgggagacagagacagatcgttataaagtcacttggtgatgaatgaggagaaaacccaaatcctggcggcaccggtgccttgtgcatgtcggggtctgacgggcactggtgccttgtgcatgtcggggtctgacgctggctccctgttgcagagtgtgactccagctgtgtgggctgcacaggggaaggcccaggaaactgtaaagagtgtatctctggctacgcgagggagcacggacagtgtgcaggtcagtgacggggtctgtgctggacgctggtggacccttcccaagtgaccatgatgtgaatggccccagcaggtactgccagggatgggaagcagttgagacccgtcctgcagacgtggctcccccagggtcactgtgcactcgccctgaggtccacgtgagacacagaagcagtgggggtgggggacgggctctgcatggccgaccctggtgtggatggcgctgctgcaccagcctctcgccggtggcctcgttccccaggtccaccgcctctgctctccctccagctcctgggtggcgattgccccgaggcttaagtccaggcctgccatggttgtgggctgcctgggtgagcctgggcgtggatggaacccggtggagaaagtgggtttcctgggcaggcgccatggttcatgcctgtaatccagcactttgggaggctgaggcggggggatcacgaggtcaggagatcgagaccatcctggctaacacggtgaaaccccatctctactaaaaatacaaaaaattagtcgggcgtggtggcgggcgcctgtagtcccagctactcggggggctgaggcagcagaatggcgtgaacccgggaggcggagcttgcagtgagaggagatcgcgccaccgcactccagcctgggcgacagagcgagactccgcctcaaaaaaaaaaaaaaaaggaaaagaaagtgggcttcctgggcgcatgctggccttccggccccacctggaggtctcttctctgcattttctaccagttgagggcccaacttggagacgtgaaattcttccctctcgaagcctttcctgatctttgctcctttctgtaacgtgacgtttgtcatcgttgtgctttctttatgtgaatgaatctgaatgaatgaatttcataatccgctgcgcgtctgctgagcaaagtaattattaaaacggagtcttttcattttagatgtggacgagtgctcactagcagaaaaaacctgtgtgaggaaaaacgaaaactgctacaatactccagggagctacgtctgtgtgtgtcctgacggcttcgaagaaacggaagatgcctgtgtgccgccggcagaggctggtgagtggcacggctgccctccacacaggctgccctcccctgggccgcagggcttgcacgtagactggctgcttggtctgaaatccacacagatggtggccttgagatggtgagagggggattcccggaagacaggtgcatgacatctctgtgtgggcacgcttgcgcgagaggtactggcttcctgaggatgaagccccaggttcacagctcaaacggaagttcaggcgatgaagggggaagtctctgaagctcagacctcagcgggcgatgagcagaggagcagacgcaggagaagaggcagctaaagagctggaaaagtcatccggggaagctgcccagggtgccgcagagacagggacaggcaggaagtggtggagggcaagcgggtcccccacacctgtttcctggggctaccttaccaagaaccaggaacttagggctccagcaacagaaatgtgccgctcacaggagccagaagtcagaggcccagacgcaagcaggctgcttccttgggaggctgggtgggcgcgtctgttccgggcctctgtcctcgcctggggatgccacctgctccccgtgtcttcacgtggtctccatgcgggtgtctgtctctgtccaaacctcccctctttgtaaggacaccagtcactaatgccctcatgttaacctggccagtggtaaagaccctatttccaaacaaggtcacaatcacaggtactgggagtaaagacttcagcgtgttttgggggacataaatctgcccgtgacagtcctcacagaagtctagaatatagagagtgggaaagaagcagtgttcaaggagatattggctaagggtttttcagaatgaataaggcacgattcagattccagaagctgtttcctgagcaggacaaataaaagcaattccacatctagaagcatcgtagtaaacagcaacagcaagacagaactgaggggttagcagagacggacaggccagaagacaaggctgcctgctaccccctcggtcccctctgccctgggctggccctgcctcttgcccctccctccccccaccctcggtcccctcttgcccctccctcccaccaccctgggtcccctcttgcccctccctccccccaccccgggtcccctcttgcccctccctccccccctcttgcccctccctccccccaccccgggtcccctcttgcccctccctccccccaccccgggtcccctcttgcccctccctccccccaccccgggtcccctcttgcccctccctcccccccgtcccctcattctcctccctcccccccaccctcggtcccctcttgcccctccctccccgtaccaccctcagtcccctctttctcctacctcccccaccctcggtcccctctttctcctcccgccacaaccattgttcaggctcccattctgccaggccgcaaggaaccccttgccgctcccaactctgcatcctccacacccacggcagcgtgggggctctgaaatgccgtctgcctcatctctcatctgctttgtgggaaacgggggtctccgagctgcccttggatggctgcgtccggggctttgagccaggactggacgggcaggccctgcacatgcgctgctgtcctgggaaaggcctcatccccagggccctttgtgctcagccttgacgacctatgcttgttttctgacagaagccacagaaggagaaagcccgacacagctgccctcccgcgaagacctgtaatgtgccggacttaccctttaaattattcagaaggatgtcccgtggaaaatgtggccctgaggatgccgtctcctgcagtggacagcggcggggagaggctgcctgctctctaacggttgattctcatttgtcccttaaacagctgcatttcttggttgttcttaaacagacttgtatattttgatacagttctttgtaataaaattgaccattgtaggtaatcaggaggagaa

SEQ ID NO: 735 - DNA, 9596 bp, Homo sapiens
agttgcacagctgcctggtaggtgactggaggcattgagcagtgctcactggtatttcgctgatgtggccccaaccccgcttccctccccaccccgcgatgtcagaaaaaacacaacaggggaaattggccgcagccaagaaaaaggtaaaacacaccaggtcatggcccccaacccagccacagatcccctccgatgacaagacctgtgccagagtccataccactcctgaggcataccagatggggccccccaaccccagcccctctgggctcccccaaccaaagcctagtcagtcagccccaccccttcagcaagcagcccagtccctgcccttgccaatcaccccagggtgactttgggcaggtgactcctggggctccctgctccataatcagccctcacctcctgccaccccaagcccaacctccctgggctctttgggcttgcgtctcccaggacctgggtcccccagccccaggccctgccctcaccagtcatccctgggtggctttgggctggtgactcccggggctccctactgcagactctgccctcccctcctgctgccccaagctcgacctccctaggcttcttgggctggcgtctctgaggacctgggtcgaaaccgtgtgtttccctcccccatcgtggagcagcgactcgggcatcgcgctgatgtggtcccctcccctgggaggagtggaatgcaatgatgtcacagtgcccctaggaactgtcattactgctgcaagaccggcctttgatcttacaacccagtcccctaagttttctcaccccatttctggttcctctggttgcagcacaaatttccagctggaaggggagtggagactatgggacctaggagcaagaggtttcaggctgccttactcccttaacatagacattgacagtgggaaaagcctacacttcccctgtgagctcaaaatgttcacagtatctctgggtggcaatgggagaatgggtttggtttggttttttcccaggcttctactttccagagagactttaacatttttttctgagttctccacggttctgggaccagactgcccttcagtcagtggcctctgaagtgagatttgctcatcttctgtggaatagatcttgggaaactgaacttgacagcttgaatcttcctcatatcgtctcaacctggggtactttgagtgccacaggataaatgtgggacatctttctgaagcatcattttcccttgattctcttgagaaaatgcattaatgtacttagggatgacagacacataggtttccaagcgtataccagacttcgctctgaaatgaggcttgggttgtcctctttctgataaattcccagatttaatagaaaagctgccttctgccatgaggacacattgatatgaaagtgtgagaggtactggtacgcttcttcacgctagcagacctgtgaggatgtatgactctaaaccacacggcctacagttcctgcctgcttaatgtttacttttctacctctgcccctggttttggtccctggaagctgctgattcatggcaaaaccccagagcttggagtcagaggactgagtttaagttccagtattgccttttttgatctttcttttttttttttttctatccatgatatcaatccctctcagtcactaagtgattgtgacaacaccttgtacagttgttggtggcattacatcagatggtatataagggtattttgtcaaaactgtaaaggaggatgtggctgtaggggctgatcattctcatgagtgttaccgctcttctttcccacagttaaaagcatattggcagaggaagagccctggcattccagcaggagctaacaggaaaaagaaaatcaatggcagtagccctgacacagccacttctggtggttaccactcacctggggatgtgagtctcggcgggccagggtcctggggacagggggcccaaggggcagtagagggtaattgttaagattgtagatggactgttgggtactggttaagaattctggatttgaatcctgcctctccatctgctaagaattgattagggattgattagcatatgatttagggcaagttgcttgaggtctttgggcctctcttttcacatctgtataatagaggtggtattttttgacttccatttgtgaagtttaaatgagattcgttattgttgcttttatgtgaatccttagtacatggcctgctgcaaacacccaggacaccgaggaaatggtcgttgctgtttgattttcctcatccccagtctcaaggggaagccaggccaatgagaagagccacttgccatcaggctgtccctttaggagtcactgaaagggccccagggtgggatggtggggagataagaaccacgagagaagttggcacaaaggagttatgggaaaaagggtccaagataggcagaaaagaagcttttgccagttgatgggggaagaaaggaagtcagagggcttagacagtgaggggggacagaacatctccatgtgcactctcatctcttgcagtcagcaacaggtatctacggggagggccgtgcatcctctactaccctggaggatctggaggtaagaggccctgggccgaggtgcagtgaccctgcaggccagccctccaacctcctcccacagcaggggcttgttgcccctctgccagctgaggcagcccacacacccccaccagccctaatgattattctctctacccctccccacaatcttcctccaactccttctctctgcatgcacctcagagccagtaccaagaactagcagtggccctggattcaagctccgcaataatcagtcaactcactgaaaacatcaattcactggtaagagtccagtggggtcccctgattacagctggtcaatcctggactccagtttcctcttggggccctgaagaaaggagctaggggcccctgatgccaagggcaaatggggagctgggcacccaggtctcacctggagggaccccagagcacagaacatgcagcatgggtcttctgcactgccctctttgctgactctctcttctccagacacccctgctctagtccttgccacacatgccctggggttgtcacctctctgggaagcactagcctgactggttgtcaggggtccatatttctgccctgcctcagtccctaatttgctttttgagtctggacaagccatctctcctctttatgctcgtgtttctggaggaggtagagagtatcaaaggtctcggttagctctgaaagtcagagatttaaaggcccctagaatggaaacctcagggccaagggctcctgtctgtcctttgctgttttatatctctgctatgaagaactgtacctggcctgtacatgctcagtaaatgtttattgaatgaatgcacgtttctaaatcacaaactggcagaaggggggtgggcccttctcaaactctgtctctggaggttcaccagcccctccctccagggcccttttccccctttgctttgggcaggttcgcacatctaaggaggagaagaagcatgagatacatctggtacagaagcttgggaggagcttgttcaaactcaaaaaccagacgggtaagatggggctggcatgacctggcagctggactggcattagagggctgtgggggtgacttagaatgccccagggaggtgggtggatggaagggctttgaggcagagggaaagaggtctgtgccaggggaggacaagtcttgtcatctccatgagcctcagtgtccccatcagtaaagagggaggagtgcccattgtcaaccacccacagtgctctctatctgaaagtgacttggaagactggctaccatccgggtgtgaggagtcattagcagtgaggccaagtttgggaagcctgagaggaggagctgtgcaccgaagggaggattttttttttttttttgagaatccagaggcccttattgtctgcttcctttctcagctgaacccctggccccagagcccccagcagggccatctaaggtagagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctacgtgaacaggaggataggctacatgaacaggaggagaggctacgtgaacaggaggagaggctgtgtgaacaggaggagaggctacgtgaacatgaggagaggctgtgtgaacaggaggagaggctatgtgaacaggaggagaggctacgtgaacaggaggagaggctacatgaacaggaggagaggctacgtgaacaggaggagaggctgtgtgaacaggaggagaggctacgtgaacaggaggagaggctgtgtgaacaggaggagaggctacgtgaacaggaggagaggctgtgtgaacaggagaagctgccagggcaggagaggctgctggaagaggtggagaagctgttagaacaggagaggcggcaggaggagcaggagaggctgctggagagggagaggctgctggaagaggtggagaagctgttagaacaggagaggcagcaggaggagcaggagaggctgctggagagggagaggctgctggaagaggtggagaagctgttagaacaggagaggcggcaggaggagcaggagaggctgctggagagggagaggctgctggacgaggtggaggagctcctggatgaggtggaggagctcctggagcaggagaggcttcggcaacaggatgagaggctgtggcagcaggagactctgcaggagctggagaggctgcgggagctggagaggctgcgggagctggagaggatgctggagctggggtgggaagccctgtacgagcagcgggccgagccacgcagcggcttcgaggagctggtgcgttgccccacctggggaggctgccctcttccctagccctcaaggcctttgtttccccacctgtaaaatggggcattgtagccttcacatgaaatggtacttctaaaggcatctgtgagccagagccctgctctgatggctgtgggagagaggggatatttttctaacctgcctccacccttcccggtgccatgggaggcagacactaagttctggggtctccagttttagtgggtggccactgattgcttctctctgtccagaacaacgagaacaagagcacactgcagttggagcagcaagtaaaggagctgaagaagtcgggtgagctgaaagagactgtaacctccgacccatccaagaagatgtgggaggcgggcaccagcctctggggaggggaggtgccaggccacaggcagctgcagcctggggacaggtgaccccagcaccctccggggcagtcctatgactgtttcttgcttcctgccctctgacttttagaggtgggtagccctggggtcctcccaggtctggacatcatcatcccagctagaggcatggagccccccaatcacagaggaagagacagtggtataagaggctccttatgtcgggtgtggtggctcacgcctgcaatcccagcactttgggaggctgaggcaggacaatcacttgaggtcaggagtttgagaccaacatggccaacatggtgaaagctcatctctactaaaattaaaaaaaataataataattagccgggcctggtggtgcatgcctgtaatcccagctactcaggaggctgagacacgagaatcacttgagcccgggagatgaaggttgcagtgagctgagattgcaccactgcactgcagcctgggacacagagtgacactctctcaaaacaaaacaaaacagacaaacaaaaaagactccttagattcaaactggattccggcctcggttccactggtcataattcaactactttgcatctctaagtctctgtttctttaacttcaaaaggaagttagccttttccttgcagaggtgctgaggattaaatgagataatacgtggaaacattaggcatgtagcacacttagcagatggtggttggctccgcctgcttttccaccagtctgtggcctacagtttaaatgctgggaaaaagggcgtgagatttgatgctagggaaggaggcatggggttctaggcaagggagacagtctcttaggcctggagcaaggggccaggggcctgggcaggccacagagccccacagtgtcctcgctaccctattaatgggccaggaatctggaagccagccaccacatgtcctcatgcccagggtcttccggcaggtggagctgaagagccaagaggctccgagtctgcagcagcagccagaccagtagctggagccccagtcccacaaggagcttggatgtgcggacaagcagggtggtgagtagagccctcaggcggggtgggcaggcaggagcaggggaggctcgcactgtgcccagattcccacccccctccctctctctgaagatcttagtgggctgagcctcactgatagcatggaggctgcaccgggagaggacagggagggttctcccccatgacaaccccactgcacagcagatccagcagctgcttcctctaatgcaggactccccaggagcacccaggcttgagtggagaagctgttggtacaggagaggcggcaggaggagcaggagaggctgcatgccattcttttcgggctgcggagaacagggagctaaacatcaccatcatctaagagcgggtcaaggaattgaaaaaaaaaaacaaaacatttaaggggttaatatcctacacaattcatttacttcatttgaatgttagagccacttatgtttatttgtgtttctaatttatagtttaaatttatttgtgtttctaatttatagtttaaatttatttgtgtttctaatttatagtttaaatttatttgtgtttctaatttataatttaaatttatttgtaaaaagttaaatgagagtgggtgtttctctcatgttcactctggcatcttttagcatttttttaatttgataattataggacgttagcatgcatatcgagtttgcccttatgtggtgggagttcaaacacacaaagacccactgtatgcacacaactgttcttgctggtttgggataggctgccatgctttttgaatgttagtacagcctgtatattcattacggaattcagataaaatttccttatgttctgctgttatgtttgatcgaatcctaatcacagtgagctcttcattagctcaatatgcagtttgccctcaagtgcgcggtctattactttgtaatatgccactgtgagtactgacatttacagttgtttaaaggtggagcactggaaacagcctttccccctttttctgtgtattggggatgggagtaataacattttggggaggtttttaaatctcccagaagaggaaagtggcctgctttggcaggtgtgtgcaggatagaatatgtttcatttgttccggtgccaagaatgagcgctgtactacggtagttcccttaggatttgtatgtgctctgggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagcgttcatgttccctgttttaatcacatgactacatgtcccagtacacaaaagggcactggttggcgttctccttaatgtatttagtaaagatcagaagaaatcctttaagagtttaaatgcccctggaacaggcatatacaggctctagtcaagaatgaattcgagtgaaggaaagctgtgtgacacctggcattcctctgtgttcatggagcttatttgaggctagaagatggattttaccatctagacctctctggctaatagctagtcttcaaccatctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaatgtttacaaactgcagcgcaatctactgtttgtgactgtcaaagtgtcatgaggaaagtgtctatacaatcacagagttatatttcctcacaaagttctttacgaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacacttactttaactccattttaaaccctcgggctagaaatcgtaccactgttaattagccacgttatttggtctaacagtttttgtttatcattctgaaactgagcttatctaatacattgataaattatttcaaaggtatttttatagttcaaatcgcttcacttttaccctgacacgtataaatgaataggaatgaccttcagatagcgtttagcaactgtaaccaatctgacaataatgtgttcatcaggtacctgtggattaaatcacatactggcatatttaagatgaatgtcagtctgaaaaataaatatactatattaattcaaatacgactctttgtgtaggtattttgtcatatgtttaagaaaaagctaaagagaatggaaatcctatgacaataactcaagtctttcttcaaagtgcatgcagtcttttgcagtacctcattcagccaagtatttgttctctacctcattcagtataaggcagcctttaatttgcttagaaggcaacattagaaggttagagttcagcaggaacatagaattttaaaatgtgacttcaactgaataaatttgaatttctctagggagtaaagaatcaaaacacctatttaaagactgcaaaatatgataattatttttaaagtaattgattaaacctggtaggttttcccaaaatgaaaaacaatcagttctaaaaccaaagctgatttttagaaaatgtgaaaatgtaaatcaaccctatccataatagattctctaaaactttatcttacagtcactttcaaataactattcaaaaatgtaactgctatattaacgtcttaaaataatttaaaacattttaaaatatgaatactgtagtttaaaacaaagaatctaggggaaggaaaagtagacaaagaaatgccaattccagtccaaagctgtatttgccaagttttcttagaatgacttttaccgatttatgaattcttatacacagaatgcataatggaaatactgatttttgtctaaagtggcattattgactgcttctgtgatgctactgtaatgtaatacattattaaattgtttcaaggtgctgttttgcct

SEQ ID NO: 736 - DNA, 2811 bp, Homo sapiens
ccggcgggcggcggcggccggcgggcggcgatggcggcggcggaggccggtggcgacgacgcccgctgcgtgcggctgagcgccgagcgggcacaggcgctgctggccgacgtggacacgctgctgttcgactgcgacggcgtgctgtggcgcggggagaccgccgtgcctggcgcgcccgaggccctgcgggcgctgcgagcccgcggcaagcgcctgggcttcatcaccaacaacagcagcaagacccgcgctgcctacgccgagaagctgcggcgcctgggcttcggcggccccgcggggcccggcgccagcctggaggtcttcggcacggcctactgcaccgcgctctacctgcgccagcgcctggccggcgcccccgcgcccaaggcctacgtgctgggcagcccagccctggccgcggagctggaggccgtgggcgtcgccagcgtgggcgtggggcccgagccactgcagggcgagggtcccggcgactggctgcacgcgccgctggagcccgacgtgcgcgcggtggtggtgggctttgacccgcacttcagctacatgaagctcaccaaggccctgcgctacctgcagcagcccggctgcctgctcgtgggcaccaacatggacaaccggcttccgcttgagaacggccgcttcatcgcgggtccgtgcgccctggggcgggaggctggggggcgggcggcgggccccctccctgccctttgacccggtcccctgtgccccgcaggtaccgggtgtctggtccgagccgtggagatggccgcccagcgccaggccgacatcatcgggaagcccagccgcttcattttcgactgcgtgtcccaggaatacggcatcaaccccgagcgcaccgtcatggtgggagaccgcctggacacagacatcctcctaggcgccacctgtggcctgaagaccatcctgaccctcaccggagtctccactctaggggatgtgaagaataatcaggaaagtgactgcgtgtctaagaagaaaatggtccctgacttctatgttgacagcatagccgaccttttgcctgcccttcaaggttaaagattgagtgtctttaatctgcagaataaaaaaaaagaaattgaaaaccagttacccaaattaataggtggggcttaagcatctgctcggctaagtggcttcaaagagtgtaattggagttaagcaaaggcattcattgttaaccttgtaagtacacgtttgggggacgattttgtttacagatgcttgtaatcgaagatgcacttttaggcttggaaggcgttgtgggctgggttctgggccttgggtggggttggcaggggcaggctctgcacctgtccgggattcaggtaaccagggcctgccgatgggactgaggcgggtctaggggtgtgtgtcctgtattttattgaaaaactcattcagggatccagcccctcagggggcagagggactgattattctgactgttgggagaggcttgcatggaccagagccccatcagtatgactgaaagtccagcggagccttctgtgtccctgtgcctcccagcagggtgggagtggaggaggcggctgctcccaggtggcatctccctgcccttgggtgcaaagtgctgccctcaccactctcccacctcccttacttccttgaaaaccactctgatgtcacaactgagtgtctgttccgtttcagatacccagggctgctgcccagttctgtaaacgcagcccagctaaagctctgctgtctcaagtgtgcatttatacccaggtgatttggacggagcagctaccatggcgtggacgccttcactgaactccgggctgcagtgcagggagctcagagcagtgctgctaccagtttttaactttgaacaactgtgtcaggcaatggatttgaattttaagtgtattaatagctgtgctctgtgtcgtaggcaaaattccactgaaggagcctctgtgccctgcagccggcagcgcggctgaagcatgtgttggccaaggaatgcctgtcatccaggtgccctgcagccagcagcgcggctcaagcatgtgttggccaaggaatgcctgtcagtcatccagggctctgggaggggacgagagttatgtccccaagaacaggaagtcctttacaaagcatccagtctcttcctgtcctccccttccctaggctggggtaggggttagagactggtggcccaggaggtcacctgccttgccctggattccctcttcagtggccagcaggacttggcagggccaccagctcgccaaggttctgggcggggctccagcctctcctgcctgctccttggctctgctgacctttcacaggcctgacagcagactcagcagggccatcccgggatgctgcaccttctggctggctccctaccagcgcctttccctgtacctggcagcttctctcttggccccacagtcacagcactccacttggtcacaaagacttcagagcaataagaggcgtcctgagccttcagcacctcccaggcctgggatatcgggttcagagggtgctgcagagcagcatgagggtggctccacccatgaggctggtgacactgacgctggcttggctaagttggctcaagccgggtctggcctgacagggtgcagtcacaccaggagcgcatggcagatgcagcctcagtgatgcctctcttgccgggtaggggctgggagtccccgtgcatcctgtctctggcccatgaggggctgcagcactgtgggcgccagagcacagattaaactctcaaaccca

SEQ ID NO: 737 - DNA, 34663 bp, Homo sapiens
gaacagggcggcttctggtttggcgggtcctttgtctctcggtgcagccggagctccaggtctcctcttcactactctgtgtcctgtgctcctacaggcccagcctctgtggccctgtgacctgcaggtattgggagatccacagctaagacaccaggacccctggaagcctagaaatggtgagagtgccggtccgacatcccaagcgacggggaggggctggttggaaccggtggaaagtgacggtggcgggactcaggtatccccttagtcagctccacaatctgcgccggagttcttgcccagctcggcctcggttcccttcagccataagatggcggctgcgcttatagcgcagcccccaggcgtcctgtctcttcactgtgcggtgactgtgccctggcttggagccctcgctgggcagctgcgcacccgcagagccgcttctctcccagattgtgcagagaccacgggagagtcgtcaggggagaatcctgactcggagtgcgggttcacgaatgggaagagctttagtgggttgggttcacagtttctcttttctcctattaaaaatttatggggctgggcaaggtggctcactcctgtaatcgcagcagtttgggaggccgaggcgggcggatcacttgaggagttgttagggcagctaagttcctcttcagagactcaacttcctggtcataagttgtaaaaattgtaaatcaaccctaccccttctttttccccattctccttttctcaaaacatcgcgcgtttaccctatatggaaaaagtttgtgtctagcccaaccaggatcagcttagattgtgcggtgggacctcagccaatatgggaaggacacaaaaaccggaactgcgttagggttaaatccccttcctggcccagcgcggtggctgatgcctgtaatcccagcactttgtgaggccgtggcgggtggatcacaaggtcaggagttctaggccagcctggccaacatagtgaaaccccgtctctactaaaaatacaaaaattagccgggattggtggcaggcgtctgtaatcccagctacttgggaggctgacgcacgagaattgcttgaacctgggaggcgaggtgcagtgagccgagagcttgccattgtactccagccttggtgacaaagtgagactccgtcttaaaaaaaaaatagacatcttaaaatttccttcccttatgtaaatactgtgtttgagtaatttcacggatttttcaaacactgagtttcaaaaaccaagtgaataactctgacatgacaaagcttgagcctagtgactccaagctaaggctaatattaagcctaaaacagaaggttttttttttggacagagttttgcgttttgctcttgttgcccaggtggagtacagtggcgcaatcatggctcactgaaatctccacctcctgggttcaagcgattctcctgcctcagcctctcaagtagctgggattacaggcatgcaccatcatgcttggctgattttgtgtttttagtagagacgggttttctccatgttggtcaggctggtctcgagctcccggcctctggtgatctgcctgccttggcctcctgaagtgctgggattacaggcatgagccacagggcccagccaacaggagtttataaagtcctatttagctttttctggggagcctcccctgcagatgtcccagcctattcaccggagccatggaaggaggcgttattctgagagaaggtacagagccccagaaagctggggccccacaagcagatgcagttaaggttaagatgaaaggaaactgggaggatcttttttttttttttttgagatggagtctcgctctgtcgcccaggctggagtgcagtggtgcgatctcgactcactgcaagctccgcctcccgggttcacgccattctcctgcctgagcctcccgagtagctgggactacaggcacccaccaccacgcccggctaattaaaaaaaatttttttaatagagacggggtttcaccgtgtgagccaggatggtctcgatctcatgacctcatggtccacccgcctcggcctcccaaagtgctgggattacaggcgtgagccaccgcgcccggcctttgggaggatcttactgacgatgaagttgttattgttttgaggaacattttagactttgtaaaataaaaacgttaatttatgtaaaagatgaatttcaaaaaagtattacaacaggaggaagtaccaactaactctaaaatctttatggcttgcaaaaatgtaggcagaaaagggcttttctccctagggaggagcaaacaagattagaaaggaggtgggaggggaatggcaaatggagggtgaaaaagtcagattttacatcagagaatgtcttaccctgaaatcagcatgttcttaggagggatgtaaagtggggctgtatgttgactcagagtgagggtagctcaaagttcaggagcctgaggaagggagataaacctaagtaaagtttgattaggaaatattttattttaggcctggcccggtggcttatgcctttgggaggccagcactgggattaccagtgctggtaatcccagcactttgggaggccaaggcggacaggtcacgaggtcaggagatcgagaccatcctggccaacgtggtgaaactccatcgttactaaaaatacaaaaattaactcagcatgttggcgcccacctgtattcccagctactcaggaggctgaggcaggagaatcgctagaacccgagaagcagaggttgcagtgagccagatcaagccacagcactccagcttggcgacagagcaagactctgaaaacaaacaaacagaaaaaaatatttcaggccaggcgcggtggctcacacctgtaatccgagcactgtgggaggcagaggcaggcggatcacctgaggttaggagttcaagaccagcctggccaacgtggtggaaccctgtgtgtactacaaatacaaaaactaggcgggcgcttgtaatcctagaaacttgggaggctgaggcaggagaattgcttgaaccctgcaggcagaggttgcagtgaaccgagattgcgccgctgcactccagcctgggcaacagagcgagattctggctggaaaaaaaaaaaaaaaaagaaatattttattttgaccaccgaagacaaatacagctgatttttttttttttgaatgagaaataggagaaaatgtgcagagtgtgtgtctggctgtgtgataggtaagaaaagagagcactaagtcataagggaaagagtttttctataaactgtttctggagcacacaaaggacggagaattgtattaatcacaaatattttccaggattatctatgtgtttcatctttccccatctcttttctttgttctatgcatttcttccttttggcttttcctgggctgcatcttatatatgaaaccagtaaacataactacagtgttttgctgagttctgtgagtagctctaccaaattgttgagtttcgtggaggtgataggagtccccagtttttaaacagcagctcagaagcatagatgggcccatggggtttgtgtctggcatctgcagtgaggacaatgttgtggaactgagccctgaatcagggtctgtgctgtgtgtggtgtcagaattcaaatgttagacaatgagttggtgttggagaattgtttgatgttcagcaaactacagatttggtgccagaaaaaggatatcatggagccctagcctggaataaaactctgggtgtttgggaatgggagtctctgctctcctctacacaggctgtcacgctgcccattgtcctgaaattccaggtcttctcccagggtgagagatgactgaaaacttagagaaaatgagctctgatgacagactcccttttctcacagctgccaccacaggattcccacccactcacaaaaacacacacactagacattgacatgtccacacttctcccagaactatgcactaccctcaggaacctcaccgtggcatttttgatctgtgtttttttcaaagaattcacaagtgtctacaagtctcctggcatatccccacccccagacactgaatctgcagcagcaacctgttttctccaccaacctagggtctggaccacctgttcataatctcacctgcctgcattcgcacggaaacaaatcagggtacagccccacttgggccactatctgtagcaaaaatcagtcctttcacctacattgtgctctctctcactcagggatttttttttttcttttagcttttatttttggtttgaggtacccatgtgggtttgttatacagctgaaattatgttatggggatttggtgtgcagattattttttcactgaggtactaaacatagcaccaaacaggtatattttctgatcctcttactcctcccaccctccaccctcaactaggcctcagtgtctgttgtttttctctttgtgtttatgggttcttattatttagctctcccttgtaaataacaacatgcatttggttttctatttctgcattagttttctaagaataatggtctccagcttcatcaaagttattgcaaagaacatgatttttttttaaatggccacagagtattccatgatgtttatgttccatattttgtttttgctaaatcttttatttttggtctcacttatggcccaggctagagtgccatggcatgctattggcttactttagcctcagcctcccaggctcaaggaattctctcctacctcatcctcccaagtagctgaaactacacatatgcattaccacacctggccaattttttttttttccgtggagacagaattttgccatgttgccaggctggtctcaaacttctgagctcaggcaatccaccagcctcagcctcccaaagtgctgggattacaggcatgagccaccgcatctgaccatactgtattttctttattcattctaccattgataggcatttatggcctgtccatgtctttgctgttgtgagtagtgctgcaatgaacatgaatgtggatgtgtctttataatataataatttatatttcttcggcctgacagggtatatacccaattataaggtttctgggtcaaatgataattctgttactagttctgtgaggaatcgccacactgctttttacagttgttgaactaatttacactcccaccagcggagtataagcatctcctttctcctttctctgcaccttgccagtatctgttaccttttgactttttaaaaatagccattctgactggtgtgcggtggtatctcattgtggtttttctttaatttctgtaatgattagtgatgaacttttttttcatatgcttgttagtcacatgtatgcctgcttttgaaaagcatctgttcatggttatttttgcctactttttaatgaggttgtttggttattcttgtaaaattgtttaagttcttaataaattctggatattagacctttgtcagagacaaagtttgcaaatgttttcctttatttggtaggttgtctgtttactcagtttcttttgctgtgaaaacctctttagtttaaataggtcccatttgtcaatttttgcttttgttacagttgcttttcgtagcttcatcatgaagtctttgccggtttctgtgtctagaatggtatttcctagttatctttcagggtttcttataattttaagtttttcatttaagtgtttaatttgtcctgagttgatttttgtatatgatgtaatgaaggggtccagtttcagtcttctatatagtgctaggtagttatttgagcaccatttatgaaataagtaattcttcccacatttctcttgtcagctttggcaaaaatctgatggttgtaggagggtgtcattatttctgggctctctattctgtcggtcttgtgcactcatggatttttttataacatctttttctcttctgctttttcccccataaagattctttcaggtgcatctagtgtgcaaaattgaggtgtccaagagttcaaaaattctttaaaaagttcccaaaaaaattttgctattctctcttctctttagggatttagattatatatagatgttttttctgctttttaaaacatatatgtaaatcatactaacagctaaataaactttttgtaattttttctgaccccagattgtctttatctagtacttcagatttattgctttgttttggcttctgaaaagtttattttttccatttttagtccttcaaagtagacacagatttgtttagataaaagctcattttaggagcacacagaagcttagcacaaaaataggattaaatttagcaataccgaatgataaagactaaaagatactaagttccattgacagaaacctgattattcaagttaattatcaaatatttgcaggctgaagtgcttatactgcaaaagcaaaaacagttcagtgtgtaaactgaacagtggagtctgtagttgtgccttgctttctatttattacttcagaacaattagcatagttatgtgtagtatttgcagacaacctgcattcatataaatttaacagcattttcttttctttttttttttttttgagacagagtctcactctgttgcccaggctgcagtgcagtggcatgatctcagctcactgcaactgctgcctcctgggttcaagtgattctcctgcctcagcctcccgagtaactggcatgcatcaccacacctggctaagcttttgtatttttagcagagatggagtcttaccacgttcgccagcttgatcttgaactcctgacctcaggtgattcacccaccacagcctcccaaagtgctggaattacaggtgtgagccataaacagtatattctacaatagtatgaatataaagctgcaatacttactttgaatgaatcacttaaatggttattttaatattgttatttatacttttgaaatataaagtgtttgaagtatagttgcaatttttttaaatgctacatacattactactggtacattaaaatattcatacttatttatatctaatatccaaagaaaatttactaccaaagtgttacagttagtctgacatgtttgttactttattcaatggggatcattatgggtaaacacaattttagtatcttttgtttcactaaattggaacgctgctattacaggacaaataaagacaggtgatgtggccaccaaaaaccataatagctcttcagttaactatgttacaaggtctaatatgttccactgtatgaacacagtcagattctatttcttcatcaaaaagtgttgttggaagttgacagatgatttccatatagaacccccattcaatggctagaaaatgagactgcagcagagatggaaaagaaactttataaaatttttctgaaaatctgccctctttcttcataatgctcatgtttctcatactgagagtagctgtgcactttgggtgtttagaaataaattgcttttaggggcgtattttctggctgatgatcaatcttatatctaatctgagctttttcttgagatctttttaccttttttctttcaaaataatcttgctggccgggcgcagtggctcacgcctctaatcccagcactttgggaggccgaggtgggcagatcacctgaggtcaggagttcgagaccagcctgaccaacatggagaaaccccttctttactaaaaatacaaaaattagccaggcatggtggcacatgcctgtaatcccagctactccagaggctgaggcaggaggatggcttgaacccaggaggcggaggttgctgtgagccgagatcgcaccattgcactctagcctgggcaacaagagtgaaactccgtctcaaaaaaaaaaaaaaaaaaaaaaaaaatcttgctcagatggagatttggttttctctctaatgctttgggtgtctgtttcagaaatcctattagtatcccgtggtgtctgaatgaggtgggctgtcacagtgagaacttttgaagatatgtctatctggactcatgctgaaaattcagaagtattttttccatgtcatcattataagtagaaactgaggctgaaacactgctcacattctgattattgtgaaggtgaaattctatccatgacgcctgcaggctctcctcctgcagctcagacgtcactctctgatgtgacactagagtgctgctgtggcaaatggggttcacataaaatgtaagctgtgctctgggctgtgcctcagtggcagatggtagcggtaaagagaggacactagcaactaggagaaagtaaacaggagtgctgtagcccagtgccagggagtacagagccactgctctaaaatgtaaatagccaaaaagaacactattcagccatttttgtagcagagtgaaagcctagcttcagcagacacctggcttcaagctgctaaaccaactcctgttatgaagatgtgaaaagtttatttgtcattgaatataagcaattagtatacacagatggcctcttcagtatccaggtgaatttaggatgaactatatatgacatggtgctgaaaattcttctacttgtggactaattatgatgaccatctttctgactttgcagtctcttaagcagattgatgatgatgtatgtcacattcaagtttaattgtgtaataagaccattttctttctgttctattattgtggagtttctctgaaaatagagaaaatttttcttttaattattgtttccacagagtgtctagaattaccagacatgatataaacacataaggtgccaaccagaatttactgtagaggggactttccctctcagactttgagtcagcccatacttgcgcagcaaaatgcatgctgtccattaaatatgcacgtggaattttgtctctgcctatttggtattgatagttcctctactgtcacttctagagaggctagacccaatttctacaaacttcacagggcagcaattaattaatcatttaacctttttcagtgactcttgtatcttcagatttgaaactgattcagaaactatggagcccagaaacccaatcagagtaacatgtgtgtgctgagtagacatagagacatgagaatctccactttccccttcctcctcttgctaaatgctcacaaatgtacaggtaaacacctgtggctactccagtcgttcaggccctaaacttgaagctccaaattttgaatccaggtcttgagatttgggggaaaaaaaaacttacctaagaaatgcaagtccctttggttatcaaactcagacattaaaatgaaagtactgttatgtctttctcccccctttgaactatgtattcatctcttgaaactgttcactattgccacaagtaattataaattaaactaataatgccacattagacactatatcccataccctaaaccataataatatatatgtaatcaataatcgatgttatttctgtaaataaataaaaatttctgacaatcaactttgtatcagcccactctctgtccctgtcttgttgtctttacaaattgtcttgtaactgctggtaatcaaaatgcagattccaggcaacttgaatctttgctcccaggttataatccttaagcttgacccaagtaaactatctacttatattcatgttctttcagcttttttttttttttttcatgtagacttaccatttagaatgtgctagagtagtctctatgaggggatctctcctttgattgtattccacttgctgtaacaccaaaggatgcagagccaggtggatcctacctggaatctgcagataaggtctggcctctgcctgggatttacaagaaaggaccagaacttggattgagaatgtacagaaaatgaacaaaagtcattttctgcattgtgaatgtaaacatagacatcttacagcccccatttgggagtgtggctctttgagattttcacatcttgttcattgacctgctacagttatgtgaggggctccaggagaaatagactcagatggcagaatctgtaagtgtaaataagcatcttaggagtgagagatcggggccacaaagtatccagagccatgaccacaattatatttagctgtaaaatgtaatactagagtagagtatttttgatctttctcttacccaagagctagcaaatcagaatgggtgatccaggttctggagctccaccagggcagttccattttctattcagagttagcctgagtctctccagcctggcttatcattgggccatgaggcctgggtcactgggaatctctcacaatcacccaggtgtctttgaggcatttgaggatgtccagagcagaattttgtcaggctgacaagagtggttaattctgcttctgtctcagtgtaagagaaatgagtcatcctgtgtttgttcattccctcatacaagagatatctttggttggtaccccgatgacagcttctccagtttcctggtacttggataataaggagaagatctggagacccagatagataaactagctccttccacttcatatgggcattaaaaaaatacatgaagcagtcatagttcctacaatccagaaacttttagtctagactagctactggataagtaattgaagtgtgcatcatatggttggtataataaatagatgtgttaaaaatcttgggctttagaccactttctttatattgttgtgacttctgatgtctacacctgaagggagatttatgaacaaaataattgttataaattcttttttttttttgagatggtgtttcactctgtcacctggtctggcttgcagtggcacgatctcggctcactgtaaactctgccgcccgggttcaggtgactttcccttctcagcctcccgagtagctgggattacagttgcctgccactgcacctagctaatttttgtatttttactagaggcggggtttcatcatctggatcaggctggtctttaactgcttgacctcgttctgcacccgccttggtctcccaaagtcttgagattacaagcatgacccaccgcgcttggccgtatattttctatttcttttaccttgctaactgtagatatttattttctaataaaattaccctagaaaaccttaagggatttgtttaagttgcatactagtatatagtataaagttgtcagggcagtgactagaaaagataaaaactacagaaactctgggatttaagtttcttttaggtaagcttagaaacaaaacaaaactggaagtttcctagttgcatagagaacagaattctacatagggttctcaccctgccccagacgtgttcagattcatcctttttggagaccttagttaggtctgaacctaccctggagtattgcctcacagaactcattaaaggagatcagagttttggctgctgaatcctgctgcctttctagagctggtgctcacaatttcctgaaattcaaaagcagataaatcgggaaaaaaagtatgttttgtaaggtgtttgtttttaaattttttattaaaaccagtgcttgcagagacattgtatttagcaacttgttttctattcctgcagatccagtagttgctgcacaagtcaaaaaagtaaatataaacagaatgaaattttctctagactacattaaactcttctgtatctctttcatctgtctatatttagcttttattctatacaattttttaaaaaatttgatgacagagaaacagaagaaaaaataaaaatgggccctttatctaaatcctgaaaattaagaaacacttagtaccagctccccgggtgttaagagaattaaatcatataatgtgttatgcccagcaccgtgctctgtatcatactctagcacatagtgcctgcttaataaacattgcattagtacctgtgtacatgttctttttaaaatacagacttattcagatattgctgtcttctgtttcctctgtaaattttaaagagccagcaaaaaatataaaacttttaaatggaatgggctgtccttatttttactagaagtatttggttatggcaagagtgttaagtgtaagggaccctgtgctgttcctgctttctctaactaatgctcataatgagccagtggggagcaacatcagcattgacaggggacttgtttaaaacactcattcataaaccctcttcaaacatacagaatcacattacagaatgtgcggccacaattatcaagtgatttataagctcgttaaagcttgagaggcaatgcttagcttagtggttatcagcccaggcttctcattaggatcacatgaccaatttgctgaaatctcttgtaccctccccacagcttctgtttattgttgtgggtggaagcatccatgtttttttaatgaagtgcctcatgtgactctaaggtgattccagaatcaagtataagggctttaaaatatattcatgagagttaaattccacctgtgaactagagggtggtcacagggcctattctatttgggtttggtagggacaggtaagtgtggtgcatatttccattactgtagcaaaagttgctggtgtctatggcaggggagggcacctgaggacaggaaaggagaaacttatatttttatcttcatggagcagttcattgttcccgaatctcttctgttttaaaggacagaaatgggtggctttttctgtctttttctgccagaagatgtcatgctagcaggtaaacatgtggtacacctttaaaggcatattctccagatgcaggtgtaatttgtacagagaatctcatctgagaagaaactccagggaaggaggagaaagaaaaaaaaatggcttttcttcaggtaaacatgtgtcagatgaagagctgtgtccactctgcctcctggactgccatgcgtttagtactcacaaacctttacttctctacttttgtttttcctccgtgagtttgatttaactacttcttaaaattcctatgatggtcaaggatctttgaaaaatatttcttttttatatcccacagacttctctacattctgtttgtcatagcttcttatatgccatgcagaattatcagcaagaatttatgatccacattattaaaaatattccctttgtggctgttgaacacagaaagatgtgggtactcaagattcctattggggaaaactgtggtccttagtaaagatggtaaagtaaaagcctccactcgtgttccattagctatatgcagaagataattcagaaaatgcttatttaaatgggatagaatttattacccagaatgttctgaaaaaaattattaggagatacttgctctctagggtgctaaatgaagcctatttaaaattactactaaaaattacagaacataggagttaactgtattttggagtttgcataaaactgatgtttctttatggttaaattcagattataatttacgttatttgggaggaatatttcaacagtgatactgtgttctgtgtgcattaacacatcagaaaaatttgtcctagtgcagttaatggttaatgattcacttggtgaagtagctctctctcacagattttttcactatagttaattatttttctcttcattattaagcatccttatccagcggatttgcataaaccatcacatttaatctgtcagttgtccttttttctttttttttctatatagttttctatggaagatgaaggctgttatctttgtttacaggccacaaaaacttggaaaaacacaggctcttccacttactggatgtttgacaaaatatccttctcgggccaaaaacattgacatttttggtgagcttgttagaaattcaaaaaatcagacttcattccagatcttctgggaaaaaacccccgcataacaaggtcttcagcttattgtacatattaaaatttgagaggtgacttctaactcaacatgtcttttccatatgaaacatattcacatctcattctgtatgatgtaaatatagcactcaaaaatgtacatgttcatgttcatgcccttaattttatactttattatctagaaaaatatcatatatgaactgatgttgtggatctaatgctgccctttttttctcagataatacattagagaatatttctgtgttgaagattattttattggataattttagtcagtcctataagtcagaaccacttctctttactctctcatttcaccttaagtaaaattaaaaattccacccatggccacttggtgaaaatgtgtgtgtgtgtttttcagggaccattgcaatttagagatgtggccatagaattctctctggaggagtggcattgcctggacactgcacagcggaatctatataggaatgtgatgttagagaactacagtaacctggtcttccttggtgaggataactttaatacataattcataatacaccctaaaggttttatttctcttttttgtagaatgttttttagtaatttattctttgcataaaggagtttcagatccattttttccagaaaatcttcagaatttgttcatttagaaaagaatttcttcagtgcctcttgcctgtatagttctgactttgggaggctagggcggaggagattgcctgaggcgaggagttcgagaccagcctggccaacatggtcaaaccccatctctactaaaaatacaaaaaattagccaggcgttgtggcatgcggctgtaatcccagctacttgggagggtgaggcaggagaattgcttgaacccaggacacggaggttgcaatgagccgagatcgtgccgttgcactccagcctggatgacagagcaagattacttctcgagaaaaaaacaaaaatttcttcaagatgtttcatcttaatccaatctttccacattcctgagttgagctgtattcttcactctaaattagtggtaattacagaaatttactgacgtaaaatattgtagcccccacctgaaaatctaaatgccaccaccaatttttgattcagtggtaccaggtagtaaaattaagaaacctacaaattggaagtattttctttttcctttttttttttttttgagacggagtcttgctctgtcacccaggctggagtgcagtggaatgatcttggcttactgcaacctccgactcccaggttcaagcaattctcctgactcaatctcccgagtagctgggactacaggcatgcattaccatgctctgctaatgtttgtatttttagtagagatggggtttcaccatgttggccagtctggtctccaactcctgacttcgtgatccgcccgccttggcctccccctgatctcatgatccacctgctttggcctcccaaattgctgggatcacaggcgtgagccactgcacccggcaaattgaaagtattgtttaaatatctataaatttctgttataaatttgtattttggtattaatttactagaatattttatcacatcgtctttgctgagcacattactagcttgtaattggagaatatgagcaagattcatgttatttattcttaacaaaacaggtattgttgtctctaagccagacctgatcgcccatctggagcaaggaaaaaaacctttgactatgaagagacatgagatggtagccaacccctcaggtaggtgtgagtgaaaatgaatacaacagacaacacagtaagaggtcccaaggccaaagagaaagccagtccttaaaatgtgattcgggaagctgtgttccaaaggaaatagttcctgggcagctgttttttgtttttgtttctgttttttaattttgttctcacaaagggacatcttccgttttatgcttttaaattctctaaggattctacttttgttttggtgagcttccttcaagttctcagtgagagccacagtcctcttgatggcatataagagattatacaatctggctgcttttccattcttttggggacacaaaaatatttgcatgattttgaaaaactaaaactactttttagttctatttttgcatcaggtctaaaatgtgtgagagtagtttctgttgcatttttttgttcatttttctttatagtccattctatttttattactacatagtttttaagtatagtttgcaattatacatatgatatgcttctgctttgttctttttcctcaagattgctttggctattcacacttttattgtagtttcatgtaaattttagaattgtattttccattactgtgaaaaaaataccactgcaattttgataggaagtttattgaatctgtagattactttggataatatgacactttaataatacttattcttcaagttatagacataaaatattttaaaatttatttggatcttctaatttttttattgtaaagattttttatctcttagttaatttttttcccagtagttttttttaatgctacattaaataagatttttcttcctctattttgtcaaatagtttcttttaagtgcatgaaaccattcatatacttgtgtgttaattttctgttttggtaatttactatttactgagtgtatttattagtttagacagctttttaaattttttttattttttgacagtttcgctcttgttgcccaggttggagtgcagtggcacgatctcagctcaccaccaccacacctggctaattttgtatttttagtagagatggggtttcaccatgttggtcagagtggtctcaaactcccaacctcaggtgatccacccgccttggcctttcaatgtgctgggattacaggcatgagccaccacgcctagctagacagtttttaatatactgtttatggtttttaaaatatgagattgtatgatctacaaacagcaactttttacttatttttcttcaatttcagtgactttctttccttccttccttccttccttctttctttttttttcttttttttaattatactttaagtcctagtgtagatgtgcacatcgtgcaggtttgttacacatgtatacatgtgccatgttggtgtgctgcacccattaagtcgtcatttacattaggtgtatctcctaatgctatccctcccccgtccccccaccccacaacaggccccagtgtgtgatgttctccttcctgtgtccaagtgttctcattgttcaattcccacctatgaatgagaacatgcggtgtttggttttttgtccttgcgatagtttgctgagaatgatggtttccagcttcatccatgtccctgcaaaggacatgaactcatcatttttttatggttgcatagtattccatggtgtatatgtgccacattttcttaatccagtctatcattgttgtacatttgggttggttccaagtctctgctattgtgaatagtgctgcaataaacatacgtgtgcatgtgtctttatagcagcatgatttataatcctttgggtatatacccaacaatgggatggctgggtccaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggagtgagatggtatctcattgtggttttgatttgcatttctctgatggccagtgatgatgagcattttttcatgtgtcttttggctgtataaatgtcttcttttgagaagtgtctattaatatccttcgcccacttttcgatggggttgtttgtttttttcttgtaaatttgtttgagttctttgtagattctggatattagccctttgtcagatgagtagattgcaaaaattttctcccattctgtaggttgcctgttcactctgatggtagttttttttttgctgtgcagaagctctttagtttaattagatcccatttgtcaattttggcttttgttgccattgcttttgttgttttagacgtgaagtccttgcctgcctatgtcctgaatggtattgcctaggttttcttctagggtttttatggttttaggtctaacatttaagtctttaatccatcttgaattaatttttgtataaggtgtaaggaagggatccagttccagctttctacatgtggctagccagttttcccaacaccatttgttaaatagggaatcctttccccatttcttgtttttgtcaggtttgtcaaagatcagatagttgtagatgtgtggcattatttctgagggctctgttctgttccattggtctatatctctgttttggtaccagtaccatgctgttttggttactgtagccttgtagtatagtttgaagtcaggtagcatgatgcctccagctttgttcttttggcttaggattgacttggtaatgtgggctcttttttggttccatatgaactttaaagtagttttttccaattctgtgaagaaagtcattggtagcttgatggggatggcattgaatctataaattaccttgggcagtatggccattttcatgatattgattcttcctacccatgagcatggaatgttcttccatgtgtttgtatcctcttttattttgttgagcagtggtttgtagttctccttgaaaagatccttcacatcccttttaagttggattcctaggtattttattctctttgaagcaattgtgaatgggagttcactcatgatttggctctgtgtttgtctgttattggtgtataagaatgcttgtgattttttcacattgattttgtatcctgagactttgctgaagttgcttatcagcttgagattttgggctgagacgatggggttttctagatatacaatcatgtcatctgcaaacagtgacaatttgacttcctcttttcctaattgaataccctttatttccttctcctgcctgattgccctggctggaacttccaacactatgttgagtaggattggtaagagagggcatccctgtcttgtgccagttttcaaagggaatgcttccagtttttgcccattcagtatgatattggctgtgggtttgtcataaatagctcttattattttgagatacatcccatcaatacctaatttattgagagtttttagcatgaagggctgttgaattttgtcaaaggccttttctgcagctattgagataatcatgtggtttttgttgttggttctgtttatatgctggattatgtttattgatttgtgtatgttgaaccagcctggcatcccagggatgaagcccacttgatcatggtggataagctttttgatgtgttgctggattcggtttgccagcttattgaggatttttgcatcgatgttcatcagggatgttggtctaaaattctctttttttgttgtgtctctgccaggctttggtatcaggatgatgctggcctcataaaatgagttagggaggattccctctttttctattgattgggatagttccagaaggaatggtaccggctcctccttgtacctctggtagaattcagctgtgaatccatctggtcctggactttttttggttggcaagctattattgcctcaatttcagagcctgttattggtctattcagagattcaagttcttcctggtttagtcttgggagggtgtatgtgttgaggaatttatccatttcttctagattttctagtttatttgcgtagaggtgtttatggtattctctgatggtagtttgtatttctgtgggatgggtggtgatatcccctttatcattttttattgcatctatttgattcttctctcttttcttcattagtcttgctagcggtctatcaatttggttgatctttgcaaaaaactagctcctggattcattgattttttgaagagttttttgtgtctctatctccttcagttctgctctgatcttagttatttcttgccttctgctagcttttgaatgtgtttgctcttgcttctctagttcttttaattgtgatgttagggtgtcaattttagatctttcctgctttctcttgtgggcatttagtgctataaatttccctctacacactgctttaaatgtgtcccagagattctggtatgttttgtctttgttctcattggtttcaaagaacatgtttatttctgccttcatttccttatgtacccagtagtcattctggagcaggttgttcagtttccatgtagttgagcggttttgagtgagtttcttaatcctgagttctagtttgattgcactgtggtctgagaggcagtttgttataatttctgttcttttacatttgctgaggagtgctttacttccaactatgtggtcaattttggaataagtgcagtgtggtgctgagaagaatgtatattctgttgatttggggtggagagttctgtggatgtctgttaggtctgcttggtgcagagctgagttcaattcctggatatccttgttaactttttgtctcattgatctgtctaatgttgataatggggtgttaaagtctcccattattactgtgtgggagtcttaagtctctttgtaggtctctaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccctttattttgagcctatgtgtgtctctgcatgtgagatgggtttcctgaatatagcacactgatgggtcttgactctttatccaatttgccagtctttgtcttttaattggagcatttagcccattgacatttaaggttaatattgttatatgtgagtttgatcctgtcattatgatgttagctagttattttgctcattcgttgatgcagtttcttcttagcctcgatggtctttactatttggcatgtttttgcagtggctggtaccagttgttcctttccatgtttagtgcttccttcaggagctcttgtagagcaggcctggtggtgacaaaatctctcagcatttgcttgtctgtaaaggattttatttctccttcactgatgaagcttagtttggctgggtatgaaattctgggttaaaaattcttttctttaagaatgttgaatattggcccccactctcttctggcttgtagagtttctgccgagaggtcagctgttagtctgatgggcttccctttgtgggtaacctgacctttctctctggctgcccttttttccttcatttcaactttggtgaatctgacaattatgtgtcttggagttgctcttcttgaggagtatctttgtggcattctctgtatttcctgaatttgaatgttgggctgccttgctagattggggaagttctcctggataatatcctgcagagtgttttccagcttggttccattctccccatcactttcaggtacactaatcagatgtagatttggtcttttcacatagtctcatatttcttggaggctttgttcatttctttttattcttttttctctaaacttcccttctcgcttcatttcattcatttgatcatccatcactgacaccctttcttccagttgatcaaatcagctactgatgcttatgcatttgtcacatagttctcgtgccatggttttcagctccatcaggtcctttaaggacttctctgcattggttcctttagttagccattcgtctaatcttttttcaaggtttttaacttctttgccatgggtttgaacttcctcctttagcttggagaagtttgatcgtctgaagccttctcttaactcatcaaagtcattctccattcagctttgttccattgctggtgaggagctgtgttcctttggagggggagaggcactctgatttttataattttcagtttttctgctctgtttttccccatctttgtggttttatctacctttggtctttgatgatggtgacatacagatggggttttggtgtggatgtcctttctgtttgttagttttccttctaacagtcaggaccctcagctgcaggtccgttggagtttgctggaggtccactccagaccctgtttgcctgggtatcagcagcggaggctgcagaacagcgaatattggtgaacagcaaatgttgctgctccagagatcattcctctggaagtttcatctcagaggggtacccggccgtgtgaggtgtcaatctgctcctacttgggggtgccttccagttaggctactcaggggtcagggacccacttgaataggcagtctgtctgttctcagatctcaagctccatgctgggagaaccactactgtcttccaagctgtcagaggtttctcctgcaattttgtttggctatgccctgcccccagaggtggagtctacagaggcaggcaggcctccttgagctgtggtgggctccacgcagttcgagcttcctggatgctttgtttacctactcaagcctcagcaatggcaggcgcccctcccccagcctcgctggtgccttaaagtttgatctcagactgctgtgctagcaatgagcgaggctccatgggtgtaggaccctctgagccaggcatgggatataatctcctggtttgccatttgctaagactgtcagaaaagtgcagtattagggtgggagtgacccaattttccaggtgctgtctgtcacccctttccttggctaggaaagagaattccctgatcccttgcacttcccaggtgaggtgatgcctcgccctgcttcggctcacacttggtgtgctgcacccattgtcctgcaccccttgtccgacaattcccagtgagatgaacccggtacctcagttggagatgcagaaatcatccgtcttctgtgttgctcacactgggagctgtagactgcagctgttcctatttggccatcttggaactgtccccttccttccttccttccttctttcttctttcttttgttttttggtgggatttcagtcttgttgcccaggctggagtgcaatggcatgatttcggctcactgcaacctttgcttcctgggttcaagcaattgtcctgcctcagcctccagagtagcttggattacaggtgtttgccacaatgcctggctaattttttgtaattttttagtagagatgaggtttcaccatgttggtaaggctggtcggaaactcctgaccttagatgatccgcccgtctctgcctcccaaagtgctgggattacagccgtgagccaccgcacccagccggattttttttagttctgtgaataattttctgtcacatacttctagtgctacattcaaatagatgtattgccaatggacacaatatagttttgtattggtgtctgaatatgatggagcaaacacctcttcaagttttcataaaccgatttttgaagcatttcctcaggtaactgtgtgggtttctttttttctttctttttttttttctctttttttgaggtggggtttcattcctgttgcccaggctgaagtgcaatggtgcaatctaggctcactgcaacctccacctcctgggttcaagagattctcctgcctcagcctcccaagtagctggaattacaggcatgtgccaccacacccgggtgattttgtatttttagtagagagggggtttctccatattggtcaggctggtctcccaactcctgacctcaggtgatccacctgcctcagcctcccaaagtgctggaattacaggcatgaggcaccccgcctggcccaactgtgtggatttctatgtagacagaactgaccataaactgtggttcaggcaactgaaattgaatcattgatttgcttcagggaacgcagtaaaagcgaaggtctgtaggcctgcctacatggctgtacatggatgcctttattcaggtctctggaatggcatgacctctcccagactgtggctgggatgagtttgggatggttacagagtaagttcagaattctcagtgagaccaagttggctgaactctatcctgggctgtagccaagaacaggggtcctgtagtttcccacctgaatgaaggcctcccttctgaatagaacacgtccaatcttcagctttaacagcatttcacaactccctccccggatctcaaatttctgttagaggcacttattttggagatgtcatcttgctacataatccaggctggtctcaaaatcctgacctgaagcagttctcaaaccttaatgtaccgtggagctgtcattacagttgtgaaccataatgcctggttttctcataaaggcatgtttgtcaaggatggttgagatcttttttgctgtaaggggatatgaaaatagggcacttttaatcttttcatcttactgatgtcactctccctgtagatttttactttctattttctacttcaaatttgtctgtaatttgagattcagatatttaggacaatatgctagaatttgcatggtatgcctcaagtaaattagataattagtaggcactccatatttacgaaaatagttacttgtaaatttcagtttgctgcaggcaaaaaggaattaaaggattttcatctacttactttaacctatatctaaataataatatactttattttctaatatttgttttacatatcagagggtctaaccctattctgcaaaatatgtattttctttatttaaaaatgtaagactactctttgcttctaaaattggattacagcagtttcattttgtgtaagaatagcatatatttaaaacaaaagtaactctaggttcttttaaatgctaatttattaagtttcttattagaatcttctatttataattatacggcatattctctgaaattttactgccatacagtgcataccaatgattcaaaatacctgcacttcatgagtacaaactaaaagctaaatattgcagttacctagaattttttttttttttttttttagatggagtcaatctctgtcatccaggctagcgtgcagtggtgcggtcttggctcactgcaacctccacctccaggttcaagccattctcgtgcctcagtctcccaagtagatgggattacaggcatgtgtccccacacccagctaaattttgtattattagtagagacggggcttcactacattggccaggcaggtcttgaactcctgacctcaggtgatccactcgccttggcctcccaaaatgctgagataacagacatgagccactgcacccagcctgacaattattttttttgtgatacatcaatgttgcatactagattttatgaggaaacatttctattattgtttcaaagttccatattagtgtgttttctcagtgtagggttttttttttttccgagacagagtctcactctgtcgcacaggctggagcgcagtggcgtgatcttgcctcactgcaacctctgcctccggggttcaagggattgtggttcgtgcctcagcctcccaaagtgctaagattacaggtgtgagccactgcacccagcctcattgtaggtttcttaacattagtttcttgtgttttttgattttacttaagtattataattttagacaatttgtaattctgttggtacactttaagtcaatttgaggtttaattaagaaataaattatgcatgtctatcaatcagattatatatgtatatgtgtatatctataaatatgactccaattttagttatggcttatattctttcttagctgattttcgatggtagttttatcttgtctaagtgagagtcatggagatagtcttattttcaccatgtgtttaatgattaatgtatatttctttttgtgaaagaaacacttttgtgatttgaaggtaattttcaaaaagatttataattctgtatttttttcagtttttctttaaaaacattgttttaaaaacacataacataaaatttaccatcttaaatttattgaagtttatatttcagggccaggtgtggttgtggtgctcatgtgtaatcccaggattttgggaggtcaagccaagaggatccctggagcccaaaagtttgagaacagcctgggcaacatatggagacccctctctatgaaaaaaatttaataatagccaggcatggtggtgtgcagctgtggtcccagctacttgggagattgaagggagtcaaaattgtgccactacactccagcttgggtgacagagtgagaccctatctcaaaaaaagctgttcatttcaggcatgttaagtatattcacattgttatgcaaaagacttctagaaacttaacatcttgtaaaacttaaattcaatgtccattaagtaacaactgctcattttaccctctctccataccttgagagacaagccttctactttctgtttttatgattttgactacttaagatatctcataagtggaatcatacagtatccataattttgttactggattaattcaggtgacataatattcacaaggttcatctaaaaaggtgacaagattattctctttaaggtggaataatattccattgtatgtatatgttacattttttaatatgtttataagtcaagagacatctagggtgcttcagcctattggcttttgtgaatactgattacaataaacatggatttgctttgctgcccaggctaaagtgcagtggtgcaatctcagctctctgcaacctctgccttctggttcaagcaattcttgtacctcagcctcccaagtagctgggattacatgtgcatgccacatcgccaagctaatttttatatttttagtagagatggtgttttaccatgttggccaggctagtctcgaacttctgacctcaggtatctgccaacctcaccctccccagttgctaggattacaggcttgagacactgcacctggcctgtgttaacatgttttggatatagatttatgaatacttttttccatttatgtatttttatgtctaagtagtttatttaaaatatgtttttgtatcattcaagaaaataagccaactttatcagtgttgataatcagttcttgaagagattatttttctctattttgtaaacatggcaactttgtggaaaatcatttgatcatatacaaaatggttcatttctgagctctctattctgttctttcatctgtttatgtttgtgtcagtatcatattgtttatgttactgtagcttttaactgtaggttgtattgatatctttgaaaaatgaaatttttgacccctgagcaagaatatattgaagagtgtgtttcatattcacatatttttgaatttgccagtttgacttttgctttttaatttctagttttattcaggttttattagaaaacaacccagtgcataattttagtgtttttaaattgatttgttgttgttttgagacaagatcttactgtcacccaggctgcagtgcagtggcagaattttagcttattgtagcctcaacctcctgggctcaagtgattgttctttcacctcagttttttgagtaggtaggactgtagacatgcactaccatgtaaggctaattgtttgcttttttgtagtgttaggatctcactatgttgcccaggctggtctcaaacttttgacaccaatggatctcccaaagtgttaggattataggcaagagccatggcacccaatcagtatttttaaatttaataaaacttgttatgtgtcctaacagaatataccaggtgcaaataagaatattgtgtattatcttggttttgactggagagttttgtgtgtgtctgtgaagcctagttggtctataatatggtttggatgtctatgttgtccaaatctcatgctgcaatataaatcctcaatgttggctatgggacctggtgggacacgtttgggtcattgggggcaaatttctcatgaatggcttggtacatcctctcggtaaccaaaaagtttacactgtatcaattcaaataagagctggttcattaaaagaacgtggcttcttcacctcatacttgctctgtctcttaccatataatatgtccagttactctttaccttccaccttcattttaagctttctgaaatcctcaccagaagcagatgctggcacacacttcttatacactctgccaagctgtgagccaaataaacaatttttctttataaattatgcactctcaagtatttctctatatgcaaaagaatcaatatagtctataatgttgtctaagttttttggttgttattttttacctgaattttctattattgcaaactgggtcttgatgtctacaatcattatgttgctatgtatatctcgcttcacttttatcaatatttgctttatatattttggagctctgatgttatgtacacatatacatatagatagataaatattttagttatacattcctgctaaatcaactcactttaccatcatataacgtaggcaccagccccacaggattagtgggtttttctccctgtgtgcagagataagagattgtagggccgggcgtggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcgcgccactgcactccagcctgggcaacagagcgagactccgtctcaaaaaaaaaaaaaaaaaaaaaaaaagagattgtagaaataaagacacaagacaaagagataaaagacagctgggcccgggggaccactaccaccaagacgtggagaccgatagtggccccgaatgtctggctgcagtgttatttattgaatacaaagcaaaaggggcagggtaaagagtgtgagtcatctccaatgataggtaaggtcacgtgggtcacgtgtccactggacagggggcccttccctgcctggcagccaaggcagagagagagagggagagagagagacagcttatgccattatttctgcatatcagagacttttagtactttcactaattttgctactcttatctaaaaggcagagccaggtgtacagtatggaacctgaaagcagactaggagcgtgaccactgaagcacagcatcacagggagacggttaggcctccggataactgcaggcaggcctgactgatgtcaggccctccacaagaggtggaggagtagagtcttctctaaactcccccagggaaagggagactccctttcctggtccgctaagtagcaggtgtttttccttgacactgaggctactgctagaccgcggtctgctaggcaacgggcgtcttcccagacgctggcattactgctagaccaaggagccctctggtggccttgtctgggcataacagaaggctctcactcttgtcttctggtaacttctcactatgtcccctcagctcctatctctgtatggcctggcttttcctaggttgtgattatagatcgaggattattataatattggaataaaaagtaattgctaccaactaatgattaatgatattcatatataatcatatctaagatctatatctggtataactattcttatcttatattttattatgctggaacagctcatgtccttggtctcctgcctcggcacctaggtggcttgctgcccacaatataatatcaatttttgtcttgtagaagtacttgatttaaagcatattatgtctaatataattatgaccaccttactcaattgtggttgctattttcatggaatatacatttttttcattctgttactttctgcctatttgacttaatgctaaagtaagtcccttgtaggcagcacactgtatgcttttttaaaaaaaccacttaggcattctatatctttttctttatataattttatttatatatatatttatatttgtatttatttatttatttattttatttggtttgtttttgagatggagtttcactcttgttgcccaggctggagtgcaatggcatgatctcagctcactgcaaccttcacctcccagtttcaagtgattctcctgcctcagccccctgagtagctgggattacaggtgcatgccaccatgcccagctaattttttgtaagtttagtagagacgggatttcactatgatggccaggcttgtcttgaactcctgaattcaggtgatctgcctgcctcagcctcccaaagtgttgggattactagcatgagccactgcacccagcctcatttatttttgagatagtgtctcactctgtcaaccagcttatttgtattttttgtagagacagaggtttgccatgttgcccaggctgatcttgaacttttgggttcaagtgatcagcccatcttgaacttccaaattcctatgattacatttcattttatttagtagtttaatctatatttaaaatgattggttaaagaaatgaagttgttattaccactaatattgttattgttttatgtgtttctagtagttatatttttctcatttcctgttttacttacttaattttcatttaattttgtactggcatgctttgattatattttattttcttttgcatactttgtataaataatatcttagtaatcatctcaaaaactggagattacatacatcttaaagttaaaacaatatattttaatctcataacaacttcaattgaataaaaactatgcctctatattttccagtttgttattgatataaaaattattttatatggtgtatctacaggtgcacgcctgttatcccagcactttgggaggccaaggtgggtggatcccgaggtcaggagatcgagaccatctggccaacatggtgaaatcccatctctactaaaatacaaaaaattagccaggcatggtggcccatgcctgtagtacgagctactcaggaggttgaggcaggggaatcactagaacccaggaggcactccagcctgggagacagagtgagactccatctcaaaatatatatatatttccaaatattcagtttggtcttattatattgacattgttatgcaacatatcactagagtgttttttatcttgcaaagctaaatctcagtacacagtaaataactaccaatcctttgtattttgtggttcttttcaaacaccactctgttttctgtttctaagagtataactgctttatatatctcatccaatctctgtctttttgcggctgggtcactttattttgcataatgtcatcaatatttatcttaatagttgttacagtattttctgctttttgaaaactgagtgataattcctgtacttttgtgtctactgaatgatttggtgacacaaatttcgattacttttacctagtggcttgcagtaacaatgctacaataattatgtgaaagttaatgtaatatatttgctgcattctgttttattagtctactttttcacctttatactcataccaaattattttaattctgtagctttttgatgtgttttgaaatcagaaatggtattgcctgtaacattgttcctgtttttgaagattgctgggtactttattgtctgtttggattccatatacttttaaatttgttgtttttatttctttgaaaatgctgtgagtcatttgaaagacattgcattaaatctgtagattaaattgagcagtaaagacatcttcaaaatattgtttttcaattgtttgtttttgagatggagttaaatttacctgccttaccagttacatttgtgccattttggtttgtatgtttttgttacatttatatgttcaggaagacattacagcttgtggtattttactatgtcatcttagttatgtagtttgtataattttataggttagatttgtaaagtatatttatctgagtctagcaattgaagtaatgtgtttttattgtttctttcagttatatgttctcattttgcccaagatctttggccagagcagaacataaaagattctttccaaaaagtgatactgagaagatatgaaaaacgtggacatggaaatttacagttaataaaaaggtgtgaaagtgtagatgagtgtaaggtgcacacaggaggttataatggacttaaccagtgtagtacaactacccagagcaaagtatttcaatgtgataaatatgggaaagtctttcataaattttcaaattcaaatagacataatataagacatactgaaaaaaaacctttcaaatgcatagaatgtggcaaagcttttaaccagttctcaacccttataacacataagaaaattcatactggagagaaaccctacatttgtgaagaatgtggcaaagcctttaagtactcctctgcccttaatacacataagagaattcatactggagagaaaccatacaagtgtgataaatgtgacaaagcctttattgcatcctcaacccttagtaaacatgagatcattcatactggaaagaaaccctacaagtgtgaagaatgtggcaaagcttttaaccaatcctcgacacttactaaacataagaaaattcatactggagagaaaccctacaaatgtgaagaatgtggcaaagcttttaaccaatcctcaacacttactaaacataagaaaattcatactggagagaagccctacgtttgtgaagaatgtggcaaagcctttaagtactcccgtatccttactacacataagagaattcatactggagagaaaccatacaagtgtaataaatgtggcaaagcctttattgcatcctcaacccttagtagacatgagttcattcatatgggaaagaaacattacaaatgtgaagaatgtggcaaagccttcatttggtcctcagtcctaactagacataagagagttcatactggagagaagccctacaaatgtgaagaatgtggcaaagcctttaagtactcctctacccttagttcacataagagaagtcatactggagagaaaccctacaaatgtgaagaatgtggcaaagcctttgttgcatcctcaacccttagtaaacatgagatcattcatactggaaagaaaccctacaagtgtgaagaatgtggcaaagcttttaaccagtcctcatcccttactaaacataagaaaattcatactggagagaaaccctacaaatgtgaagaatgtggcaaagcttttaaccagtcctcttcccttactaaacataagaaaattcatactggagagaaaccctacaaatgtgaagaatgtggcaaagcttttaaccagtcctcaacccttattaaacataagaaaattcatactagagagaaaccctacaaatgtgaagaatgtggcaaagcttttcacctatccacacaccttactacacataagatacttcatactggagagaaaccttatagatgtagagaatgtggcaaagcttttaaccattctgcaaccctttcttcacataagaaaatccattctggagagaaaccatacgagtgtgataaatgtggcaaagcctttatttcaccctcaagccttagtagacatgagataattcatactggggagaaaccctagaagtgtgaagaatgtggcaaagccttcaagtggtcctcacaccttactatacactgagagttctgaacttactctgtaaccatcccaaactcctcccaggcacagtctggcagaggtcctgccatttcggagacctggaggaagtggcccatttacagccatgtaggcaggcctgcagaccttggcctttactacggtacctgaagtggttcaatgactcagtttcagttacctgagccacagcttaaggtcagttctgcctatatagaaacccacacagttaacctgaggaaatgctctctggtactcactgaaagccacactcatccacatcctgatacaaggcccaccatatgcagacctgactgccaaaacatgccctagtgtctgccgtacagagtgaagtcctgaaggatatttagtctgtccaaaactaaaatgaagatttcaactccccaaccccctctaacaagccagctaaaggtggactatagtgcagacccagcaaccttgtgaccaggctaaaacccctcatcactacaaattcagagggcatctcatcaccctaagggcccaacgaaagatctttaccttctaacatcagtttatgaaaacttgaaaaggtgtttgctccatcaaattcagacaccagtacaaaactatattatgcccattgtctggttctattttaatgtagcactggaagtgtgtggcagaagaattagtcaaagaaataaaaatagccattgaaattgaa

SEQ ID NO: 738 - DNA, 48924 bp, Homo sapiens
agtccccgaggtcacaaggcagtggcaggtgtctgtagtcctcgggttgactgcagctcgcggtggtccctctccgagcccaggaagccactccagtgccgagggagaggcctgggagcgctcggagtgtgcgcggactggagaagggggaggtggcggagtgattcgtagagtaaattcggtaccgaggggcggggtcggggatttgaatcggtcggcgggcggaggaggcgggtggaggaggctgccgggcagagcgcaggccaggatcagcgcaggctgtgagtccaggtcagccgtcgggacctcgggctccgggttcgaagagcggctcccggctgcgggtgctttgccaggagagcccttccggacagaggagccggggtctggaaggagcggccgacgcgacgctcgcctgccacggggctctgggagtaagcctgtctgcctggcgggccttcaggtgcggcgtgagaggtaggattgcatccgcgctgccacggggctgtttctccggggcatttctaggcactttgttcggcttaccctgcagcacagaattagtactcctgtcaggagctgctctgggtgaccaggagtgcatccggacctgttgagagaatttctggaaatggatagagctgcgtcttgagaggggtacccttatgattcaggttttcgctacggttgaaaagccatggcttatcctttggggtctgctttggtgcctgaacagcagttttctccatttctttctgtttaatttggctttaaaagtacgcgcttagagtaaaagaatggttagcacagggtgggaagtgtattggggatggatgggaaggaagtggagatggttaataggtagaaaaacaaagaatgaataagatctagtatttgctagcacaacagggtggcggtccataatttaattgtgcatttaaacataacgaagtataattggattgtttataacaaaaaggataaatatttgagataatggctacctcatttactttgatttgattattacgaattgcatgcctgtatcaaaatatttcatgtaccccataaattatacatctactgtatacccacagaaattaaaataaaaaatgaaacctgtgacgtgtgtttctatgccagtatggactgtattacaattcagtcctgaataaggtacgtgatcgaatcacgttcatcttgctggtggggttatttttcattgtttttcttcacctcttagatggatgccaattcaaaagacaagccccctgaaaccaaggagtctgcaatgaataatgctggtatgtgatgatctgcctccttgtgaagttgaaggtttagacagagagttgtcctcacccctacaatatgtcgtccgtttcaggaaatgcctctttcattttgggaactgggaagattgtgactcctcagaagcatgccgaattacctcctaatccttgcacaccagatacttttaaatcacctttgaacttttccacagtaaccgtagagcaattgggaattacacctgaaagctttgttaggaactctgcaggtaagaaaagttgtcattctgttgtaatgcttttcaagtttaaaaataactttaatataactcagctttatttgtttatacgtactgtcatattttaggtacctaaattgcctactctgcaaacttgcttcttcagagagacttctttgcacatgcacagttcatttagcatagcagggatcacggaatcgcagggcacccagcatgataatgttcccaagtcagagtcgtgcttgatgccaatactagaaaataatgtgtgtgtgagtcactttttgacctgtcacctaggatacaggagggtgtatgatatgaatagtaataatgcattttgttttcatttatggcaaaaataagagaaagtttaagagcaattaagaaaatataatactgaaagagcaggatgtacctcctttaacaatcacaaacagggttgggctcagtggctcaagcccgtaatcccagcgctttgggaggccgaggcaggcagatcaccggaggtcaggagttcgagaccagcctgaccaacatagagaaacctcgtctctactaaaaatacaaaattagccgggcatggtggtgcatgcctgtaatcccagctactcaggagtttgaggcaggagaatcgcttgaacctgggaggcagaggttaccgtgagtcgaaatcgcaccattgcattccagcctgggcaacaagagtgaaactctgtctccaaaaaaaaaaaaaaaaaaaaaaacacaaacagaagattgattctggctaatgtccttcgagcagtagaaatgaagtttacttgtgaagtctgacttagatggaaaagaaggaaatactatatgagaatggaattggatcagagaatagcatttagaattggaggataatggaagtcttgaatatcacagggcactagaccaggtaatacataagacaaggcgaaagtggcacgccaccctaactttcattctcaaaaacatcactcttagacctttaaaaggctggattcattttgtgtgcttaggcatatgtccaaaattcagggtagtgctgatggtaggtatcagaaagaaacaatcatcttgaagaattaagaacctgagactgcatgtacctaggtggagatcttacctttcagttgctggggataaaactgacttatttagaaaaagaaaaatactgagtcaaaagcaaaagccatctgtgtgtaggaaataagaaacaaaaatgaaaacttaaaatgtgttcatgtatttattcaacaacttttaataactgttctatgtaccaggcactgttctaggagcatagactaagtcagcagacaaaaagattcctcttccactgattgtatatgaatgactgtgccagtaactctccactgagttttttgtagcacatgtttatcatgttttctctctcaggctggtacatcacgagtattggatgtggttactgatgattgccttgttttgttccaatttataagagagtttcattacaggaaagtcatcatcctaccttaaaaaatgtagacgacgttctgcagtcggtgctcggggctctcctgaaacaaaccatctgattcgtttcattgctcggcagcaaaatataaagaatgctaggaaatctcctttggcacaagattctccttcccaggtatgattttcttctaagttctgtcgtgaattccgttaatgaagcttttgtgctttctttacaccttctagtgcatctgctctgtttcaaatctggagggagattttctctgtgttttagagaacatgcagttagcggccgggcgcggtggctcacgcctataatcccagtactctgggaggctgaggcaggcagatcatttgaggtcaggagttcgagaccagcctggccaacatggtgaaaccccatctctactaaaaatacgaaaattagctgggtgtggtggcaggttcccgaaattccagctacttggaggctgaggcacgagaattgcttgaacctgggaggcagaggttgcattgagtcaagatcatgccactatgttccagtctgggcgacagagtgagactgtctcaaaaaaaaaaaaaatgcagttagcctaaatgatgatgttgaccatgggtgatttttctttgtttgctttgttttagagacaggatctcagttgcccaggctggaatgcactggtgcaatcatagcccaccgcagcaatgaactcctgggctcaaggaatcctcccaccttagctttccaagtagctggaactataggcatgtgccacagcaatgggctaattataaaaatttttttttgtagagatggggcctcactatgttgcccaggcttattttgaactcctgaccctaagcaatccctatcaaagtgctggggttacaggtgtgtgccacagtgctcaacccaaacgagggtatttttagagttatgagaccctggatagaaatagctttctagaggagctttttattttatttctcaatttttttttctagttaagatctacttttctatgaggtgaggcactactacctttttaagagcttatctctaagttactgattttttcatgactactgtgtgttgatgtataggggcaagggtctcctggacaaaatgtatttgggacaaccttgtggagaggagtagattatttatctgctgatggggatatatttagctgttttttcaaatttttatacatccccctaaaaagtcagatacagtcttgtgctacataatgacattttgttcagtgatggactaaatatacaatggtggtctcataataatggagccgaaaaatttctaaggcctggtgatgtagctcatataacatcataaaacaatgcattgctcatgcatttgtggtgaggctggtgcaaacagttctacggtgctgccacttgtattaaaatctagcacaaaaggttacctacaatacataatacttgatagtcataatgaatgactgttcctggtttatacatttactatagactttgtatcatgaatttaaagtgtactccttctactgattaaaaaaaaaaaggaccttaatgttgtacgtgtgttgtgctggcagcagcctcctacgttctccctaatccattggctatcccacagagcagtcaaggagaggcattcatttaaagtagaaatcgaatcattcacccggctgctcagaatcttcccatggcttcctgcgatcccttgaattaaacctacaccccttcctgatgccttcgtacgcccactctagtctctccccatctccttccactcacagggcacactggcttttctgccccatcctgtttccactcaaggccttggcccttgttcttggagagtacctccctcctgtgacatcttcccttagacctctttctcattgttttggcttcaactcagattttactaaagatagaggtctgtcctgattctagctaagccagcacttttagggactcagccacattcctgatatttcttctcaatagcacctcttttacctgtaactacgtttatatgttttcagaatttcactctaaacggtaatttccctggctgggtatggtggctcacactgtaatcccagaactttgagaagcaaaggagggaggatcgttcgaagccaggagtttgagaccagcctgggcaacatgacaaaactccatctctacagaaaaattttaaaaattatctgggtgtggtggcacatgcctgtagtccaagctatttgagaggctgaagttggaggatcgtttgagcccaagatatcgaggctgcagtgagctgtgattgtgccactgcactccagcctggctgatagagcaagaccttgtctcaaataaaaataaagtaattttccctagatcctgagcccctcaaacagtttgtggtgcatggaaggaaggttgttgactgaccgacacaattcctaaaacaaaaacatcaaaaaagcagtacattttgaatgtttcatttgctttgtatgtaaacattgttctccttctccagtagaaaatagagaaaaaacaattttgactagagaaacttaaaatttttttaagcagcatttcaaagtgctgcatgttcctaggatattaaatctgcccctaccatgttcaaatatgtgtgcaaaaaaagcacattcaaagtaaattgtatgaatttgagatcatcttttccctgtcgttctgttagatgaattgacataagccttttttgaatattattgctgtttatgtcgtgaacgtttgtgtcatcaaggatatttcaatgtaaaatgttctcattatgtaatagagaatttgctttatatttaactgggaagagaatcaaatgtgtgaacagatcaccatcaaacatggcttcacgatatgaactgctttttctccctgtgatatatatatattttttctgagaccaagccttgctctgttacgcagcctgaagtacagtggcatgatctcggcccattgcaacctctacctcccaggttcaagcgattctcccacctcagcctcccacatagctgggattacaggcatgcaccaccacgcctggttaatttttgtgtttttcgtagagacatggtttcaccatgttagccaggctggtctcaaactcctgacctcaagtgatcctcccaccttggcctcccaaaatgctgggattacatgcatgagccactgtgcccagcctactctgtatgatatcttaaacggaggtaatttttacttcactttttgcccattggtataatttttaaacattgccacaaacttcatatcagtggaaatgttagtagtccaagtaataaaaaaaaatctagatagagaacttcatttgtaatttaatttttatgtaaagggaactctcaatttttatattacttgtctttaactggcacttctatccctgctaatataaatttcattttatcagtctttggttggaaccctgttaacggggtttccagagagcttctgtgcttataccatcaaactttgtattttaagagaatggctggctttcaaccctaagaaggaaatatcctccaggtcccatacaatcaggaaaattagctgggaagagccaaaaaggagagcagtgcaagtgtagtatctgagcatgtatggaacttctgtgtctcgttctggcccctgggctggagggcatgtgtagacccgtgctgagtagaaacagcttggactgaaggaggtatgctgagacttacctgtgacacaagcaccatgcagatggcttcctatggatacatccagcacaacatttggtaaaaattgcaaatagacaggttcctcctgtcccttttttgttgcaccatcccagagcgcaatgtttttttggcaccttccatataatcttaggctggcctctcaacatttttgtgttaaacttccttattcaaactgaaaatgggtaattccagggtgaagaagctctgccacactaactccttaccgctgatcttcaaaaagcatatgtgtactgtatttaattttggattcaatggctgtaggcctagaatatagaaagtatgaattgattataatactccttgtatattttgcactttcacagggcagccctgcactgtatcgaaatgttaacactttaagagaacgaatatcagccttccagtcagcttttcactccataaaggaaaatgagaaaatgaccggctgtctggaattctcagaggcaggaaaagagtccgagatgacagacttgagtgagtagaaataattcgttcagttttgacttcaatatttataaagacaagcttctgagttatgaaatgatttagtgtgaagccaatcttttcagaacacaggtatatttataaagtgagactaacattaaaaatttgggacatttcacacaaaaataaggatttctggtttctcttagaaaaaaaaacctgttatcaggcattcctaatcctacatttccgcatggttgcaattaaattttaagttttaaaatgccagagataattagctcatttcacctttaccatagagcttgtggcaaatttgagtttacaaatcttgatttttacaggattattattaagctcggcaagcatttagtaaatgaaataaattcatataaattttatatgagtaccaaacacccaaccctgatgttaaaaacaaatatattcagccaggcgcggtggctcatgcctgtaattccagcactttgggaggctgagacgggaggatcacttgaggtcaggagttcaagaccagcctggccaacatggtgaaaccctgtctctactaaaaatacaaaattagccaggcgtggtgacacatgcctgtaactccagctactggggaggctgaggcaggagaatcacttgaacctgggaggtggaggttgcagtgatcccagatcgtgctattgcactccagcctgggcgaagaagtgagagtccctttcaaaaaaaaaaaaaaaaaaaaaaaaacacacacacacacacaaatatatccaatctgataatctgctatattctttaactcttagattgtaattcatttggttgttttttcagtcttttttttttcccccccaatcacgaagcatttcagataccagaatgtgacaaaatcttggtcttactgtaatcattataaccattctctggtactttacacactaaggtttcaaatgattctgttttgaattcttgaaccatctttaagtgcatttcagcacctcccatgaggattgctctgttagcccaagacaagtccccctcatctacctctagagtgcgtgacccattcagatgtaccgatttatatttgtagtttgtgactcacttattgtttcagttttttcctgggttttaaaatttatttacatcattataattctgcagacagttccttttttttagctagaaaaaaacaggtacgttgtggttgtctttttcataaagtcatacagagtattagagcataaccacatctttcaaaataacaggtgtcatcatttaaaaagcgtgaggtaccatattagacatgcaaaagtattttagtatatctttgtaccttttaaggcctgaaaaaacttaattctaataatatgaatgtattatcttttcaatagacatgttttcattcctttcagttagatttaattttttttggaataaaaaagtgtggtagatttttcttttcattgataatttagacttaagcactagattttactaaaattacgatgcacaatagccgggcgtggtggctcatgcctgtaatcccagcactttgggaggctgaggtgggtggatcacctgaggtcaggagttcagaccagcctgaccaacgtggtgaaaccccatctctactaaatatacgaagattagccaggcatggtggcatgagcctgtaatctcagctatttgagaggctgaggcaggagtatcacttgagcccagaaggtggaggttgcagtgagctgaaatcgcaccattgtactcaagcctgggcgacaagagtgaaactccgtctcaaaaaaaaaaaaaaaaaaaaagaaaagaaaaaaaatatatataatatatatgaaaacatttatgcctgtgtcgttttgtttttattttgtgtttatagccagaaaggaaggtctcagcgcttgccagcagtctgggttccctgcagtgttgtcctccaaacgtcggagaatatcctatcagagagactctgatgaaaatctgacggatgctgaaggaaaagtaattggtctccagatattcaatattgatacagacagagcatgtgcagttgaaacttctgtagatctttctgaggtaattcacttactttacgcataggaaaatgaagttgttggttttctgcataggcagttttaaggctgtcagtgccgttcttcaattttagtaccttgttctgccctgtggttcctggggtgtgtgtgtgtgtgtgtgtgtgtgcgtgtgtgtgtgtgtgtttcctacctgttaattttatggttgctggtatttatcacttattagaaacagtttggataatgatctcacttttgactactaaccttacaaagagagtaagccctggggtcttctacgtatgaggtattctagagggtgatgctccaagaagggaggaagttacagtcttgcccttaggcagtattttttctactggggagcagggtataagcagatggcttcagtggagctggtggatcaggtggagattctgtgtggggtgtactccacaggcttgggagtcttgcacttatacctgcccctgactgctttccttctgatggaaatcagggtgccattcagcaatttctcctttgctcacttctttcaagtagctctagggatttttgtggcttataactacctaaaccctgtcaagacgatcaaaaggcgatattagaaaaataatactactgaagatcagttgacctgcgcgcacgcgtgaatggagagctggtctctcgtgacggacttttcttacttcatgcttctagttctggtttgacacagtagctcctcatggcctttgtgagaggagacacctaacaccgttacagttggaaccctttctgcactttctctgtcacttagatccagtgctcgtcctattcgttttatgtggactggcagaacaaagatttgatagttattagacattcttcaggctccagtgggtttcctttgtatttcagtcgcctgtaatctcggctgcctccgcccttttcaggttgatgtgaaatccccactggacagaagcaagaataattgtttgttatcagaactttgattaattgtttgaacatacatcatgattcagatattatttctgaattagtgtgaatgtgttttctatcctagcctttaatgtttttcatatcctagttattgatatcgtttggcgtttgattaataattatataaactttattttgagaattttctctaaagaattacagatgatacagctatctaggctataacaacaaaaatatatcctttaaacttttcctggggaattaaaagttgatttgtgggatgtttaggatgcagttaatatgaatagttcatgttagattcctgtacactttgagatacactttatgagataaagtgtacacttttctcaggataaagtatctcctgtacactttatgagataatgaaggtgactgattgaacatcagatttccaggcaatccataatgtttactcaaatcttcaaaaaggcattagtagtactctaattaataaaatgtaatactctttcaatttttccccaagatatcatctaaacttggttcaacacagtctggatttttagttgaagagtctcttcccctttcagagctcacagagacttcaaatggtaagtaatcttttcttagtacatggccagttgcccgattcatagacatttatgattagtgtacctatttgctaaaatttgggggaactgaaattgtttcctactttttaggagctcatggcctagtagaaatgcttctgaattcttgttatatgagagatactctcttttttaagctacgatcaataagaattagtgaagtattttcaagctcatggaatttagtataaagaggtagcacctatgaacatattaacaagtattctttgttataggaacactacttgtaatatttttatttgtttttaagcatgtaaaaagagtcttaccaggatgtaaaaattattctttctcaaaatcagtatgcttgtactgggtgaacattactagcaagggtttagattgactttttttctacttgggtctttaaaactcttatgggcatataattggatcttgtgttttattaatccattctgataatttattgtaattggaatatttcgcctattaactttttaggtaattacttaacatggttttattcacatctgtcattttatcatatgttttctattcctgattattgctctgtaatctttcatagtctggttagttgatattatacaatttcacataaaatacagaaactacaaactctacagatcaatttcctctcctttccagccatggcttttatgatcctttacagatacacacttacttcattataagcctcacaagatgttgtttttggattaaacagctgtatgtgctttgtttttctttttttttttttaaggcagtttcttactctcttgcccaggctggagtgcagtggtgtgatctcagctcactgcaacctccctctcccaggttcaagccattcttgtgtttcagcctcctgagtagctgggattacaggcgtgcaccaccatgcccagctaatttttatgtttttagtagagatgggattttgccacattggccaggctgggcttcaactccttgcctttagcaatccacccatcttggcctcctaaagtcctgggattacaggcatgagccactgtgcccagccaaaacagttatatgtgctttaaataggttaagaggggaaaaatagtcttttatatttacccagatgtaccatttcttatgttgttttttcctaaagatctgagtttctctgtcttattttccttcaacctgaaaaagaacttctttagcatttttgtagtgagcatttgctctgacttttaattttaatcataagataaatgggtggatgtccgcctgcatggtccccctgcacagggcaaggttgtgagtttgttaccacaatggaataaggtgttcttgccttcaatgttttctttcttcttcttcttcttatttttgagacagagtctcgctctgttgaccaggctggagtgcagtggcacaatctcagcttactgcaacctctgcctcctggattcaagcaattatctgcctcggcctcccaagtagctagaattacaggtgcctgccaccaagcccagctgagttttttgtattttcagttgaaacagggtttcaccatcttggccaggctggtcttgaactcctgacctcatgatccacccatctcagcctcccaaagtgctgggatttgccaccgtgcccggcccaacagtttcttaacaattctttttgctttgctcttatgggactttgcgtaggagtgacagattctctgtgacagtgattatagattgtatgaagtgtagcgattcacagttgtcatcatactaaacacctcactctacaatgtgaaatgttgaaatcacacaggccaaaattttatttaggcatgccatgaggccgtactcagaaacagtgtaattaaacagggaagaatagatctaccatagtagatggggccttgatgaaaggagtctggtgttgatttctgtattttaaactgcgttgttttttggtggcaccccagacagtgcaccttcaggaagaataaaaagatgttccgagatggaatcaaatgtctctttgttaagggggagcttagggggacctgcatgacacctctgatctcctttaccccctctgcttcctctgttttacctatgtagccggaaatccaacatccaactcagcgaatctccctgccttctctgcacctgccccagagctgctaatatttggtatgctgatagcctcaattttttttttttacctcaaatggttctgtgctgtttcttttttattttttatttattttttttttttgagacggagtcttgctgtgtcacccaggctggagtgccatggcgcgatctcaactcactgcaacctctgcttcccaggttcaagccattctcccacctcagcctcccgagtagctgggattacaggtacccgccaccatgcctggctgatttttgtatttttgtagagacggagtttcaccatgttggccaggctgatcttgaactcctgacctcaggtgacccacctgccttggcctcccaaagtgctgggattacaggcatgagccaccacacctggactgtgctgtttcttaatccacacactttcacaccttatttttctcttaaaatatccaacgctccttcctttatttctttttaaaatttagatacatataatttatgttttcaacagataattttatagtgtgtcatgtaattgttttgtttttcttaaatttattactattatttttgaatgacaaaccataactgtatatatttatggggaacaatatgatattttgatatatttatacaatgtggcattattaaatcaggctaattaacatgtccctcacttcacttacctgtcatttttttttatggtgagacgtttgaaaattactctcttagttattttgaaatatgtaatacactaatattgactatagacactgttgtgcaatagatctcaaaactgattccacttatctatctgaaaccttgtattctttgatcaacaattccccatttccttcctcaccacttctacagcctctggtaaccactattcaactctttacttcaataaattcaactttgttagattcctcatgtaggtgaaatcatgtggtttttgtcttttgtgcctggcttatttcacttagcaaaatctcttccagattcatccatgttgttgcaaatgagagtctcctcgcttttagggttaaatagtattctgctgtgtgtatatataccacgttttctttatccattcacccattaatggatgctttttcattgatgagaatgatgttagcgacaggtttgtcatgtatgtcctttattgcgttgaagaacattctgttcctagtctgagaatttttactgtgatattgtgttaattttatcaaatgctttttctccatctattgaggtgatcatatggtttttatttttcatcttttttcatttttcaagagcgtttattaaaataggcagtaatcagtacatgtgcatcatatgagcatttattcaaaatcagcccttccaggagaggggctgcatctcagtttttctatctatataattaaaatgaccaaagtacttccctaaagtagaaaggcatttcattagtagtcttgggaccataacagaatatgattactaaacatctccaacgtggttttcattacagagaaacatgtttcacataagagcttcataatataatccagagacagaatttgtgcatggttaaaatttgaagccagactatttctgatacatatttttttcatttcttccggtttttatttttgtaaatatgcatccagtttcctaccagtttaaaacacacacacaaaacactgctcagagcaccatgaatgccttacagtagcttctttgagactataatcctaattcaaggagggcagtactaatttctattctgacttgctcctttccccaaatctcagcaattgtcagatacaaaaaaaggtttctgggcagagggccaaagaataattatgaataatttcacaatgatctggttaagaaaacacacagaaaatggtgatgatatggtttctatttttcatcttctttatgtcatgtatcacatagatttgcatatgttgaaccatccttgaatcccagggataaatctaatttgatcatggtgaatgattcttttaatgtgttcctgaattaggtttgctaatattttgtggaggatttttgcatctttgttcaccagggatattggtgtataattttcttatatgtagcagggtagtgctaaccttgtaaaatgacaaggaagtatttggaagtattttctctacttttatttgttttgaaagtgtttgagaaaacttgtcagttctttaaatgtttgatggaagtcagcaataaagccatctggtcctgggcttttcttttggtgggacatttttattactaattcagtcgtcttctcactcattattggtcttttgagattttctattggttcatgatccatttcttttatccaatttcttggcatttaattattcatagtagttgcttgtgatcctttgtattttggtgtcaggttctctggttgcttcctgtgctctgaagtcaaatgatattgctagctgtcctccatggtctagtaagatcactggctggactctgccttcagtcaggtagagctgctctctgggttctgtgattgtctctgatttggcagagttgcaggttgtcttccttggctggtcagtactattgtttggaatctgtagttgggcagaaccatgtgatgggctctgagtctgcttgaggttgttgcttggccccatagggtgggcagggcctgaggctgtactccacagatgtgtgtggattcgggcttgcctcccagcccagggtagggttaagcagagcactgagatttggtagagtcacttctctgcagctggggtcgagcagggacagatgctccttccacaggtaatcactgacacagcctggcttagggaagacttagtgacagcacaagggcttagtttgatcacctttccactgctaggattgggtaggcccagatgtacctttcatgggtaattgctgacctacagttgctccccctaagccaaaatccaaactctgaaaatttttgagtgccaacatgatgctcaaaggagatggttattggagcatttctggattttcaggttagagacgcttgactagtaagtagaatgcaaatatttgggctgggtgtagtggctcacgcctgtaatcccagcacttcaggaggccgaggcaggcagatcacaaggtcaggagttctagaccagcctgaccaatatggtgaaatcccggctctactaaaaatacaaaaattagccaggcgtggtggcacctgcctgtaatcccagctactcaggaggctgaggcaggagaattgcttgaacccaggaggcggaggttgcagtgagccgagattgcaccactgcactggagcctgggcgacagcgagactccatctcaaacaaaggaatgcgaatatttaatgcaaccaccagaacttagttggctcacatctttacagctagggttagatggggccagatatttcctctgtgggcaatcactgacctacagttgcttctcgacctggcgaagacctgatgggagcacccaggctgtgtggggaagctggacagggattttaacctggaagacccactaaccatgtttcctgcagtttaatactgctggctggtttctctggtgtggcatctctgttagctggaatgcaggaagccaccagaattcgctctctggtggctgtgatccccatcccacgttctttgtttttatctgccccccagtggcccagccttgccagtactcccagtgtttcctgggggacaagacaggagtgcagctcctgcgaagtatcccagaatggtggggaagccaaacgtctgcttcccactcactcttcccactgtagaaactgtgggtccaggggaattctctgtgtgtggcactgtgccagttgggagaagggcagcacagtcaaacagaaaagtttcttaccacttgtttgtggcttttctccattctggggtccaaggaggtgtgtcaacctcactcccaaattctgggatattcagaatgttatttttgcctgcagatagttgctcattggatttctctgggaacagggaatgaagccacagaactcttactccactatctcccccacatcactccagtgtttttgttttatatcaaagtacacatacgtaaggaattagatataattcagatttaactgggcccctgcatctttatttgccaaacctggcagctctactcatgagtgatctgagagaaagttccctggtagccttttgcagttccttgcttcctgtaccattgagaaaataagagattttgggagcaaaggtcttggtcctctcacccctaagccctcctgcatctctgtatgtgtgtatctacctttgctcctctttcaaaagggtctcaatgttcttacctagggccagcctcttttttttcttttttttttttgagatggagtctcactctgccgcccaggctgtagtgcaatggtgcggccccagctcactgcaacctctgcctcctgggttcaggtgattctcctaacccagccctcctgagtagctgggactacaggtgcccgccaccacacccagctaatttttgtatttttagtagagatgctgtctcaccatgttggccgggctgctctcaaactcctaacctctggtgatctgcccacctaggcctcccaaagtgctggaattacaggcatgagccaccacgcctggcctctaccctcttttttagggactgattcccattgctccttctccttctaaggaccttgtgtctgagttgtctcctctcttttctgaattgttaacttttcttattcagctacaagatgctgtaaaatatcccatcttaaacttccctttgccccaggattgccttctagccagaacaccatttctttactctactttaggcaaaacttttaagagaaggccacactctgtctccttgcctcccattctttcttgatccagctccaaataggccttgttgaccagccatctcctggctgccaacccagtggtagtcagactcaacacattcctttccttgatgtcttagcagcactatggacggatatagacatctacaaccaggccctcctgtgagaagccttttcctcacctgggtttcaggatgtcattctcattttcccttgcatcactgaccatttcctctttgtgtattttctttgctcctcttctttcatcctgaccttcaaatatttgaatgccccccctcgaccttcatgttcggtgcttggaccttttgtctctatatacaggttgagcatctgtaagccaaaaatccaaattctgtaactttttgagtgcaaacatgacactcaaaggagatggttattggagcatttctggattttcaggttagagatgcttgactggtaagtagaatgcaaatatttcaaaatctgaaaaaaatttgtaatctgaaacacttctgatcccaagcattttggataaaggatacccaatgtgaactctttctaggtgacttcaaacattatcacatgctgttgacttcaaattaaaatagttgcccgtggccttttcccggaactcttgaattaagtatccagctccctttcatgaccttcacttgaatgcctaataaacatctcaaactgaacatagtcaaataggtcttgatgattttttccttcaccaacctgctcatctctgttttcctcatcttagtaaatgacactctcattcacctcattgctgtatctcaaatattggacttaacttgatacctttctttttcttttccttttttttttttttcttaagttagagtctcgctgtcacccaggctggagtgcagtggtgtgatcttggctcactgcagcctcaacctcctgagctctaggagtcctcctacctcagccttccaagtagctgggaccacaggtgctcactaccatgcccagctaatttttttttttggtaggtacaggatcctactatgttgcccaggctggtctccaactcctgggctcaagcaatccttccattccaccttggtctctcaaagtgctgggattacagatgtgagccactgcacccaagtgatacctccctttttcaaatgaaacttgtaatcgcattgacaaatgctactaggtcttcaaaatatgtcaaatgtccacccacttctcaccttttgcattcctatcagtgtggtccaggccatcaccatctcctgcctggatttttttatgtatcctctgaagtggttttcctgcttcccctctttccccaatcccctgttacagtttttcacacagtagccagagcactggttttaaaatgtaagtcacagtatctcactgccctcctcaaaatctttcatcgacttcctgttatacttagagaagtagccaaagaccatattatttctactaggccttccctggcctggttcttaacctttgctctgagcttatttctcagctctcttgtccatgcccactgttccagccacagcagccttgctgggcctctgctatgccaggtacatctttacctcaggtctttgcacttggctttgtgtgcataatgtccatccctagatctatgtgtggttcgccttgttcttttcaggtgtctgctcaggaactctctgtttacccaaagcagtagcacttccttccagcttatcatactgtattcctctcttgctacattattttccttaatagcatatattaactacttgttgtgtgtgtgtatatatatatatatatatatatattaactttttacttgaaataactataaatttgctatctagttgtaagaaataatataaagaaatccagtattcccttcacctagtttcccgcagtagtgacatgttgcatagctacgatatattaatatcacaaccaggaaattgacattgctacaatccaccaacttgttttcagatttcaccagttttacatgcacatactttttgtgtatgtttagtccgtgtggttttatcacatgtggattcatgtgagcacagtacagccaagccacagcatggttctgtcctgaggatcctcatgttacccttcatagccatcactctttccctctccctcctccctgctgtgagattttataatccctgcttattccgtgctggttttgggggtttgctcatctttacttcttcagcacccagaggagtgcctgtcacatcatgtatttgttcaatggatcacttaatcataaggcaacgctctcctgtgggaagaatttgggaagaaaagccacgcctgtttggggcacatacagtgtgtttatagtttggtgtgatgatctttcttttctcattcctgccaccctcggatgttgaaatgcctgtgactctagcggtaaaattgcttattagtcaatgcttggctcagattagtttttatggtccaagtagtgggtgtcatgagtagaggcacgctaatagcttatagctgattcatgataccttctttcaacctctgactcagagatttcctggggagccaaatccccatacccactttacccttcgtagtccgatttgaggtaaaaactgaccgatgctgcttctttacctccttttctgtttccaaatgaaatcccagacgttactgcccaatcaggttatattaggtttgaatttcttcatagcatgttattatctttgcaaatactatatttttggtctagaacaaacagatttaagagatcttctgcctctcaagtttacatgtttatcttgaagcactaaaggttgctgactgtgtagtgggcaaaggatcaagtgatgccgtttcgcctgacacgttcacagcagaagtgagctcagacgcagtccctgatgtcaggtcaccagctactccagcctgcaggagggaccttcccacccccaagacctttgtacttcgttctgtactgaagaaaccctctgttaagatgtgtctagagagcttacaggtaagaagagagttaaatttcctaaagcaaatgaataaaaatgcattttgcttcaaagtaatacccttgaaatgtcatatatcatgctagtttaaaaggaaatgtcttactcgtcttaccgtaaatttttttcctcatcttttcttattaacaacactgggtgtagtttctttttgttcttatttttaaaaaattaagtatcgtatatagcatgcagaatttaatgtaagtagactgtagtttataaagggtcataatcttacataatcttattgcactaacataattatatgttattgattcattttatataattatataagtgatattaattacttaatcataattaatgtgtcaatctgttaaactgatcattccacccaaaatatttagtcttaaaagtacctcttatagccatccttttttctcgaagctcagtcaatatgaggaaagagaaagttgatgggaactagctggcatttattgagtagtttctgttgacagttctggcatatatatataacagtagtgctccgagaaaggtataggacctgtttgacatacacttaggcttgtaggttgttaagtgaacccagataagtctgctgttaaaatccatgacaggctgtcagtccatgagaggttgagagcctagcctcaggagtcaaaatgccaagtttcagatcttgacttggaaatgtaatcactgagcaaattatttgacctttctctgcctggtttccttatctataaaaatgtaaagttggtaactacttttagagtaatttgagcattaaatgggataatataaaatcaccacgagtgtctggcacttcagaaatacaaatctttttttcaaaccataagcattttaacatacaagtatgcctacaagcctgttctgatttgttctgaagccaaaaggaactaaattaccttctatttacatggatcattgatggtcaattgctatttgtaaagctttaacaattttgttcaaagagctgatttggggccaggtacaatagctcacacctgtaatcccctgactttggaaggccaacactgaaggatcgcttgagcccaggagtttgagaccagtctgggacaaaaaaaaaaaaaaaaagctgatttgggtctgtaatacacacagcactgtttgttcatatcttctcctcaaaaagacttaacatctgaacgatccatggaactcttactttctaacaatatgacacagcaaatattaagtcttgtcattagaatcatgtgaaaacatttacaactggccgggcgtggtggcttatgcctgtaatcccagcactttgggaggccgaggcaggtggatcacaaggtcaggagatagagaccgtcctggctgacacagtgaaaccccatctctactaaaaatacaaaaaattagccgggcgtagtggcgggcacctgtagtcccagctactcgggaggctggggcaggagaatggcgtgaacccagggggcagagctttcagtgagccgagattgtgcccctgcactccagcctgggcaacagagcgagactccatctccaaaaaaaaagaaaagaaaacatttacaactaatgatctttatactaagatggcaaaaattaggaggcatataaaatgtgagttgtttgctgacttttctgatttagttaaaaataaatctaaaagtaaacatgagctttgttgtataagttaacttattttgcaatattggtatgtacattttcctggtcagaaaaatgaactgacttgagagacagatgaaggagatttgtttggggcaggactatttcttagagcaggtaatgttcttagaattggatgtacaggagaaaatgaggaattcttgataacaaggactggtcagaggtttaggttgaggccggatgagtaggtggtgattaagagggaactttgatccagtctgcagccctggctgtctcctgctgagctccaggggccctgtgtttagactcgttctgtctttttatacagggcttacaatatcccttctttcctaacttgcctacactgtattctttatttgcagaaacacacagggacaactgctaccttctttccttgtttcttcctcaagaatatagtaatgtaaaaagattcaaatactaagaataggtgtggttcccatgtttaaaagacagaacacgatgttataccatttaactgttggctttttttcttgttttaatgcagttcttctatctgggatcatttacatagttttcctcatctgacaccatatatggtacttgtaaccttcaaatctgttggttctgcatccatggattgaaccaaccacagatcaaaaattatcagggaaaaaagtcacaaaacacataaaaacaataacatataacagcatcataccatacatattaacaataccatgtaacaatgccatttaaaagtattcttttaggttgggctcagtggctcccagctgtaatcccagcactttgggaggccgaggcacacggattgcttgagctcatgggttcaagacctgcctgggcaacatggcgaaacctcgtctctacaaaaaaatacaaaaattagctgggtgtggtagtgcgcacctgtagtcccagttactcaggaggctgaggtaggagaatggcttgaacctgggtgacaggttgcagtgacctgagattgcactgctgcactccagcctgggtgatagagccagaccttgtctcaaaaataaataaataaataaaaagtatgcttttacatgacatttacattgtattaggtattataagtattatttaaagtatacgggaggatgtactcaggttgtatgtaaatagtatgccattatataaaagggacttgagcatccgtggattttggtatcttcgggggccctaaaactaatctcccatagatattgagcaatgaccatatgctattattctagctactcacgttttccttagctttatttgctagatcaaacattgaatgaatttgacccatgtttattgatttctatgctttaattttgccctaaaattctgttttctaaagtagtatctaggggacatagttatgatttgtgcctgatatcatggttttgagccagaacaattattgaaaataaaggtaatctttaatactggaatatctatctgcagttgacagagaatttcaaaactgctgttcttaatgatgacgtctatgtatttctatatgtaaaattattcattaatgtttattctgtttaggaacactgtaacaacctctatgatgatgatgggactcatccgagcttaatctcaaatctcccaaactgttgcaaagagaaagaagcaggtaagaaattcatacttgtttttaagcttgaggatatcattttcatgttagtaaaacctagtataatatatgaaattttcaatgatctataatgccttagtgcttctgaaataacacgtgaatgaagaacagttgagaaggttagaatctccttggagagcctcagaattggtctgtccatttcatggatccatttttacttagtggtggtatttgtaaagaaaatttatatttcaattttattaacgtttaatatgcaaatttttacttggaaatctgttgccatattttaattggaaatgtgcttatcttctccattttgaatttgctctaccaacaattattttatagctttgctttactagctattatacaaataatagctgaatattatcacattaaaagattctagtatatgccttttagataagaaatatagcttaatttttaagttactctcatttattgtctaattatagaagatgaagaaaattttgaagcacctgcctttctaaatatgaggaagaggaagagagttacttttggagaggacttaagcccggaagtgtttgatgaatctttgccagcaaatactccattgcgtaaaggaggaacacctgtttgtaaaaaagacttcagtggtctcagttccctgctgcttgagcagtcacctgttcctgagccattacctcaaccagattttgatgacaagggggagaatcttgtaagtatgaaaagcgtggaacaagcttgccatatgtattttcatcaggcttcacctgctttgcatgagcaataactatgctttgaaataatgagatagactaaatgatatgccatggtttaaattaatctattttgtatgtaggtttttatgagtttttgcccattacaaataatacttccctgactccttgtacatattgaacagatttatgccaatgaatttaacaacttaggtaaactggatacattccttagaagacacaaattaccaaaactcactaaaggtgaaataaattacctcattatccctatatcaacttaagatatttaaattttagttaaaaccttcccacagagaaaactctaggtatagatgattttttttttttttttttttgagatagggtcttactctgtcacccaagctggagtgcagtggtgcggtcatggctcactgcagcctcaacctcccaggctcaagctatcctcccatatcctcccgtcttagcctcccgagtagctgggacatgggcacacatcaccatgcctggctagtttttgatgattttactgatgaatactaccaaacacttgagcaagttaaaatactaattctacacaagtgtttccacaaattgaaggggtaggttaattgatgtcagcattgtgatttcagcattaacctggtgcaaaatcagacaggcattataagagaagaaaactacagttcagtatccttgtaaacatagcaatatataaaaagataatacatcataaccatgtgagatttagccttgggctgcaaagccatttaatgtttgaaaaacaatcagtgtaatctgccttgttaaaagactaagacagaaatacgatcatctgagtagttgcagaaaaagcagcacaccaacatggcacgtgtatacataacaaacctgcatgttgtgcacatgcaccctaaaacttaaagtataataataataataataataataataataaagaaaaagcatttaacaaaatatagtatccacttctcatttaaaaaataaaacctctgagcaaaatggtaataaaagaatttcttcaaattgactaatgtctatgcaaaaccaacagttaatgtcttaccaacaattatgtggaaaagatttgctatctgtatttatattgccatcttactctggagttccctgaataacattataacgttagattgtgtttatgaatgaatttttaaattttctttataggagttagaaatttagcagtagatcattatgtgtactttcgcttataaattttcttagtagtttgatggattgcagttagtaagcatttcattgcaaacatgattggtaaatggtatacatatatttttctattcaatatctttgttttgctttgaattttagaatcttttattgattacccatctttatgcttattatagtttctcctaccaaaataaattcttactcttcttttgggcacattatgtattcactgcatttaaagatatctaacttctgtcttttcctttgtttaggaaaacatagaaccacttcaagtatcatttgccgttctcagttctcctaataaatcatcaatctctgagaccctttcaggtagtaacttgtttatcttaaaatcataaatgtcattttttatatgtgtatatgttgattatttttgttttcttttaaaaatttcatatttgttaccacaacatatacttggtttaaaaacacctaatagtattgggaagctgacatgaagctattcatccatcccttttccattccaagcctcatacttcataatcacccagaatttacttcctcagatggaatccccattttgttagttgctagaagcaatggagttagcctctcaactcttaagtatcaatgacaaactgctattcacagtttacagaattgacatctggattgtaaggatcattcttaaatatccagactttttcctcaacattcattgtggcgtttttagcacatgtgctttccaaggtctctggattttttatgattatgacaaagcaacagattgctcccagcttttctgacaaaccaggacttagctggcaggtgtcatgggccaggcacctttattcaggtgtcttccctggcggaaaccccttaatggcttcttgttgacacaaaccaaacctagtagactccaagccatgtgttactaagttagagctaaaatttgaatcacagtctatcacattccaaaggccatacccttaaacatattataccacctttcatttatatcattaaaagtctgccaggtgcggtggctcatgcctgtaatccctttactttgggaggctaaggcaggcagatcacttgaggtcaggagttcaagaccagcctggtcaacttggtgaaacctggtctctactgaaaatacaaaaaaaaaaaaaaaaattagccaggcatggtagcgggtgcctataatctcagctactcaggaggctgaggcagaagaatcacttgaaccggggagacggaggttgcagtgagctgagattgcaccactgcactccagcctgggtgacagagtgagactccatctcaaaaaaaacaagtggtcaaaataaaattttcctatcctacactttaaataaaatttaaaacaaagtattttcatggttatcttaatgtcctttattgcgatttcattatacaaaatgtatcgtggaataaatgggtgttcatgaaaatacatgcatttattgtaatgtgatttattctgctatcttagcttggtaatatgttaagcagtcaccatggaaagtggcgaaagtttctgagtatccagtaaacttaaaattttttaaaacaaaaaaaaaaaattggatttcaaaatttctgctgcttggctcctcttttttttgtttagatatggtattaaaggtggatatcctaaacacagtgtttccaaaggaagatgtatgttatagtttttggtttcctaccctgatttagcttttgtcttgtttatcaggcactgatacctttagttcttcaaataaccatgagaaaatatcctctcctaaagttggtagaataacaaggacttctaacagaagaaatgtaagtgtttgtgtttggcacaacgtatttgtttttaaatcgtgcaatatacttttctgttttcatggccaaatgataatgggtgaaatcttagtttaatcagtgtcattaagaattaatactttggccaggcaccgtggttcacgcctgtaatcccaatgctttgggaggccgaggcaggcggatcatgaggtcaggagattgagaccattctggctaacacggtaaaatcccatctctactagaaataccaaaaaaattagccggacgtggtggtggacgcctgtagtcccagctactagggaggctgaggcaggagaatggcatgaactcaggaggcggagcttgccgggagccgagatggcgccactgcactccagcctgggcggagtgagactccgtctcaaaaaaaaaactaatactttatcctacctagcatgtaacctataaggtgatagtgtgtttctgatttgattttaattctattagaagaaaaatctagaaagatgctttcagagctgtgttaacatggaagttaacaaaatttgtttgggatctatatgattttatgaatttcgttgaggtgaaaatggagaagatcagcatgtaattaacagaaccagaaaataatataagtataatcttttttaaattgtgcttcagtctgttttttaacactgggtttcaactgggagttatatataagcataactcccattgaatgcatgtcttttgctatttcgttaaattagataaaatttggatttttgtttataacatcataaagtataaacatatactgttatggggtatttagcttatagggttggatattaaacccaggattcaaacctagataatctaaaaattcatgatttttttccccataacccagtagttaggtgctaaattgtaggttcttaatgagtagttgatgagtgaataaattaacgaattcttaagctgttttttctttcttccctaatataattgggtaatatatgtatacttctgggtctgcatttgatagttcagaaattggtaattaccatttccaccaattttcatcaaagtgcttttaataaggtttgtgaattaagaataaatgggatctaaagtggtagaagcatcctgggaagcacaacaagagtgagagcagcacattaacatgtaattgcttgtgctttacggtatcctactttacactttctttatagcaattggtcagtgttgtagaagagagtgtttgcaacttattgaatacagaagttcagccttgtaaagaaaagaaaattaataggaggaagtctcaagaaacaaagtgtacaaagagagcacttcctaagaagagtcaggtaagcatgtgtttaaagatataataaagagtagaagtggtgtgtttccttattgtataattaggaaaatatagaaacacatttttttccagttgactttggaccaagattattaatgcaatcttaccgtggagtagaatggggtgggggggttatgtacttaactctgaattgcctaaggaacacttttgcgtcttcttcatcttcttgtgttgcgtacttcctgcacagtaaattaataggcactcaaacctgaaattctcattctcatctttgaatctaccccaacatattaccctattgggaatcctgatttttttaggcagggatgagtgtgccgcttgctacttcttagattctcttcttccagttgctgaatcaaatttttccctaaatttaagggaaagtttagaaactagctctcagtctttcttaacacttctggtcgtctcagatacccttacagtccatgtggttagccaatttaacaccttaacccagttccttttccttctccagctcagtgatctggactccacactccaaagccacctactcactcttgctgccattcttacaacttgttactgcccgtgtagcagtgctcattctctgacccccaacttcctgtccatccagcctattcactctcttactctgcagttccttctgtactgctaagctttcagatacacctgaagttcatgtttccctcttcatcctgaactgagtgaactgtttccaactcttgtcaggaatctcaattccggatccttttccttccacctcatccatccagcaaaatttccagtctgactgagttatcctctcttccatctgacatagcccctagagacactcacacaggagttggggatagtactactacacattcactgacatctggccttcttcttcaccactttgccgcttcacttcatttttaatactaaagccagtgcatacttttcagttctgttcttaatggacatcttagcatttgacatgatggaacactcctgtacagtctctaaggtttgttttctgtcccccattgttaaatgtttgtgttttccagaattctcttctttgcccttgtaaattgtttatcttctgggtaatttcatacacagcatggttaatgaccatatatgaagaccagaacttcctgatctgtaaatctgtgttcaactacgtactagacatctgtctttaaccatgctatgtcaaaatcagcatttctaaaactaaacttatcaacctatacacccacccaaaacattccgtaaacttccttccccctctatgaaataaaaatgactgcttttcttggttgagtagcacagatatccttaagtcattaaatccggaaggaactaggtgttttcctgctttagttcctttttaggtcacacactcttgataaaatgatgaaagattatcttgctgaaaaaataccattaattcaaaaatatacatacaacttattacattagaaattgatttccttcgtgtgtgtgtgtatatatattttaaagcactcttacaaagaatatacacctattcatataaaattacggccagaaagtacaaaaaggattgagcattaagtcactgcaatccctcccaggaccttgctgaattaataccatttaggtactaaaaggaatacacttagaatagcaatgagaggaggaaagggatgaggaggggtattgagaagccgacgacagccttcaatgaatttctagaagaccaagcagatgggagcatgttgacagataaaaaaaggtggaaagatttacagttcagaatgtgctaggagggagctagagaggagctgggagccggcctgttcatgggaatcccaggagaccctggcccagaattggcaggtacgatggatggtgagagtgagaggtggtactgaaaaacagagaaatgaattgaagtcctatacgtgggacagtttgcaccagttggcacaccagcctcctcccaccctgatgctcagaacagatgttgtcatctagattaaagccctcattctggcatttggaaagtcccacagtcttgacagccagctcttgccctaatgcaaatcctgacagttgaccctccagtattctgccccaccctaggtaggatttccacgcaggaaagagactgagctggaaagcagaggaaacctatataccaacttacccaatcttaaataagaaacaaggcaattgaatagaacaaatagcatgaaagtgaaaagaccaatgttaataaggttaaaaactgacttcagagaaataggttattcaaggaatagaaggaaattttacatacataaatactccactccaatttaagaaaatatcatctgcataaaagtaaggagatactatgaaaaaggaattgcaaaaacataaaatttagtagttggacaaaagaattaaagttaaggaaagtctcccagaagatagagcaaaagaaagactggaaacgagaatctaggagacaccataggactcttaggaaaaagaaggagaaaatagaatgggagaagtcatccaaataaaagaagaggatttcccaaaaatagaatggaagaaattattcaaataagaggatttcctagaactgaagaaaggagtcttcaagttaaaagcgcccactgaataactggtacaatgaagaagggccagggggtaggcctgtaactgtgaaactgaacaataaggataatgaggaaagtgggcttttcctacagagaaataagaaccagagtggcatcaagactagcaatagccggaaagctacaaaatcatacaagagttcatttaaagcttagaagaaaatttcaaccgagtattctacacccagccagtctcaattaagtgtgaaggaaaaaataaaagacatttgagtgtttctttttttcttttctttttattttgagagaaggtctcactctcacccaggctggagtgtagtgctgtggtcactgcttactgcatgcttgacctccctggctcaagtgatcctcccacctcagcctcttgagtagctgggactacaggtgcacgccaccacgcttggctagtgttttttgtttgttttttgtttttcttttgagatgaactcttgctctgttgcccaggctggagtgcagtgatgcatgatcttggctcaccacaacctccacctcctgggttcaagcaattctcctgcctcagcctcccagttagctgggactacaggaacgcaccaccatgctcggctaatttttgtatttttagtaaagacggggtttcactatgttagccaggctggtctcaaactcctgacctcatgatctgccttcctcggcctcccaaagtgctgggattacaggcgtgagccaccacgcctggctggctaatttttttttactttcttgaagcagcggggggttggggggtctcaccttgttgcccaggctggtctcagactcttcctgggctcaatcacttctctcaccccagcttcccaaagtgctgggattacaggcttgagccaacatgcccagccagaaagttatttttctttggatgctactggaggaggaactctagcaaaatgaggaactaagcttaagaattcaggacacaacggatctaacaatacaagagcgcaatcaaagggaaatcgctggttgtagctgttcagccagcctagaagagcaaccagtccaaatttgagcagggagaaggagctggagctaaaaaacggaaaagacctgtgattgaaagaatgaatggtatgaaaggtatgtcacataagaaaaaaacggtaattatataccatttcaaataaaagtctatataaaagttttagagtaaatatgaaggaaacattactgtgatttcaagcaataatgcagtataaggaaaagtagattttatagtgctaggaatcatctccctcaaggggcccggaggagaagaaaagagtatgaaagctgtacttggcagagccgtgaaaaatgtttgcagtcataataatacagatgctatttgttttcaactaaggacgaagcttttaacaacttggttgttgtgcaggacaatgtgagtattaacaatctaatgataggaaaatgtagttaatagcagaaggtgaaaagtgagttaaggtagaaacaagggggctaatggtgtgctggtaagagtgcagactctggaccagacccctgggtttaaatcctgggttcattcctgcctccagtgcaatgctgggtaaaattctggactctgttttgtttgtgtgtttgtttgtttgtaaaacagtggtggaaatggatgttagaagcttctgaatcttaatgaattcatgcatgctcaactcttagaacagtgcctggccatagtaagctttgtggtcattatcatcattatcatgagacattcaagatatatattttaaaatttaatgaaaagaaatagaaatataaaagttcaatgtttaccaactgaagagccacaattaacatagaaaagaggcaggtttggttttaaatgagcagttttttcatctttcatagcaagatgttgacagataactaaaattagattaaatgccacttctcaaccagaagtagcattagaatcctcaagagtaaattcctttataaaccagaaatggagaaagttcccaaagtgtgactcaaaaaccagaaacagtgagggcaaaggattggtgaatttgatatcttttgaaccatacagcatggagcatgcgtaaggaaaaaaatccccataagaaaatttaaaagacaaagaacaagcttgggaaaagtatttgcaactcatatcagacaccaaggattaatgtcactaatatttgaagagcttctaaattacttagaaaggaacagtcttcaaaagataacaaaacatttacaaaactgaaatgaaaatgaccttcagcacaggaagaaaatgttcagacttcctcatcataagagaattgcagctgtaacgtgcattgagatgccgtttctcaccttttagattaccaaaaatctgaaagttgacagcatactcacgtggtaaggctatggggcaaacaggcacactcatacattttctgctaaagcagacctctgtggaggagtatttggcagtatctggccaaattaaatactcatttgtcctttgacccaacaggcctatttctaggaatccatctcaaagatccactgatcaaaatacaaaaatatatgtttatttattgcagcattctttgtaaagcaaaagactaaaagcaaaccatatgctcatcaatatgagacttgttgaaaaaactatggtgtttccacaaagcgagtattaggcagctgtagaaagttgtgaagagaacttccatacacttctatacagtgatgccaaggggacacagatggccctctatatactgttgtccagcatctgtggttggttgaatcaaaaacactcagggctgggtgaggtggctcacacctgtaatctcagcactttgggaggctgatattggaggattgcttgaggccagtagtgcgagaccagcctggtcaacatagcacaaccccatctgtattttcttaatatattacttaaaaaaaaaaattcagaaaaacccaataacaatacaacaattaaaaaaataaaaattttaaaatacagcatattaactatgtagcatttatattgtacttggtgttaagtcatctagagatgctttaaagcatagttattatgctgtatttttacagtataatgctgtaaaaggaagtttacatatgctctatgcaaatactgtgccattttatgtcggggacttgagtatctgcagatttttggtatccacaggaggtcctggaaccaatttccctacagatactgagggatgactgtgtttactgttaaaatgaaaaaagcatgttataaaacaatatatgtggtcaactactggttatggactgaattgtgtcccttcccaaatttatatattgaagtcctaactcccaggatctcagaatgtgactgtatttggagatttggtctttaaaatagttattaatttaaaatgagatccatagggtgggtcctaatccactctgactggtgttcttataagaggaggaaattcggacccacataaggacaccagggacgagtgtgcattgagaaataaccatgtgaggacacagcaagaaggtggccatctgaaggccaaggagagaggccccaagagacaccagccctgccaacaccctgatcttgcactgctagcctccagaactgggagaaaattagtttctgttgtttgaactacctagtttgtgacattttattacagtagccttacaaactaatacattaccctttgtctaagaaagtagagtacacatatagttttgatttttcagttgaagaataaaccaaagagaaataaaaaactggctatagggagaagggaggagacaggagagaatgtgaatgcaagctagacttcgttaagtgtgtactgtttttcagttttgattgtgggaccatttaaatgttttacctgactatgaaacaaaactaaaactagtagaaagagaacaatctctaataagcgaaagcaaaatttgacaaattcttactatgtcaagttggtggcttaacttcattaagaattttttcaaacctagaaatttgaatataagtgggataaatctttttttttttgagatggagtcttgctctgtcacccaggctagagtgcagtggcgtgagctcggctcactgcaagctccgcctcccgggttcatgccattctcctgcctcggcctcccgagtagctaggaatacaggcacctgccaccacgcccggctaattttttattttttattttttagtagagactgggtttcaccatgttagccaggatggtctcgatctgctgacctcgtgatccgcccacctcggcctcccaaagtgctgggattacaggcgtgagccactgcgcctggccctataagggggataaatcttaaggacaaaaataactgcaaagaaattataaacagtatgaaacactcaatagaagcactgaatttagaataaagcaaataagcaatttttcccatcattaagaatcaagatgtgcactcagagacaaaagatatatttttaaatccaacaaatttaaaactttggaagactaaatttgaattggaaataagagtagaaactcattttattttccatttaaaagaattgtccagctctatccattgataaagcttaaaattcatgagcatccctggtgcatagattatcattagacataccagttaaaaggggttagggtcccttggtgaaatggctgctttcagatttacaacaacaaatttaataagtgagcctggttgggtctgtaccagagtacaaggaaggatgctaaaaaaaactactggtgtcatgttaacagacacaaatccatcttcaagggacttacactgaccagatatgatcatcagcattgcaaagcattgaagtacaatcatgaaataacacataagtttattacttttttttaattaatggacactttagaagcttgctaggatacccactcatttttctgataacaggaaaataaaatttgagctctatttcaggtaaacaaatagttgatgagggaaaagttgtttatagaagaatttcaggtaataaaagaaatgctcaacaaagctgcttaaaacgtttgataaaaggctgatgtgacatagtaacaatcaacagaggaaagaaacaccgtatagaatgggagaagatactgtaactacaaaccatacatctgataaggggttaatagccaaaatgtataagaaactcaaacagctcattagcaagaacacaccaatttaaaaatggtcaaaggtccagaatagacagttctcaaaagacatgcaaatggctaacatcactaatcatcagggaaatgcaaattaaaaccacaatgagatatcactggctattatcaagcagatgaaagattacaagtgttggagaggatatggagaaaagggaatcctttgtacactatcaataggaatgtaaattgctacagcctgttttgattggcaaagtcaactaaaaatatagaactgaatctctaaacaaaatgttttatttgggaaaacgtaattgcagtttggggcaaacacacagaccgaggtggtctttgatatgtcctaagaacgtagaaagttggggtttttagtagaaaaagaaatgttacatattatttagaaaaaaaactcactggccctaagcaaaattttggggagctggtaaactctggtgagtgatggtggtagttaaatttagtcttacagtcccaagtgctttttttcccctggtctctggactctagttgtttatgacacagtgactccaaataatccattttcacaagccattgtgggaaacattacgggggttcctcaaaaaattaaaaatagaactaccatatgatccagcaaatcccacttctgggtatgtatccaaaggaaatcagtatatcaaagagcgataaccaagttacagactcaagctgagtatccatcaacaggtgaatggataaagaaaaaatatgtgtgtacacacacaacaaaatgctattcagccttaaagaaatcctgtcattttgacagcatagaaggaccttaagggcattacgttaagtaaaatagtccaggcacagagagacaagaagatcttacttacatgtggaatctttaaaaaataaaaaataaaaaaaaaaaaaactcacagaagctgagaatagaatggtggttgtcaggggggctagtggcttgagtggtgggggatgaggagatgttggttcaagggtacaaagtttcagttaggatgagtaagttctggagatctgttgtacagcatggtgactaggaaataataatgtatatgggaaaattgctaagagatgacattgtaagtgttcttgccataaaataattatgtgaagtggtggatatgttagtttaatcatttcccaatgtgtacatatgtcaaaacctctcatccaccatgctatatgcaatttttaatttgttggttatacaattgtattcaaatttgcccatcaaaactgaatctaatcaagcttctagatctaattaccaatttataggacatggaggaacatagactcacctactgtagtgagccaaatctaggacttggctaattctataggaaaaatgcctcaatttactcaccaaataaatgtcaagggaagtaaaaaaggagccatagaataaaagagactaaaagacatgaatcaaatggtatgtgtggagatcttattggggtcctgattagaacagttgttttagaaaaagaaattatgggccaagggagaaatttgaactttgaggagatactagggaaaattgccatcatggtttttgtgttttgttgaattacattttgttttgttttgttttgttggaatggagtctcgctctgtcgcccaggctggagttcagtggcacgatctcggctcactgcaacctcctcctccccggttcaagtgattctcctgcctcagcctccccagtagctgggactacaggtgtgcaccaccatgctcagctaatttttgtatttttagtagagacggggtttcactatgttggcctggctggtctcaaacccctgtcctcaggtaatctgcaccccccccccgccccccaggcctcccaaagtgctgggattacagatatgagcctctatccctggtgtacattttaagttttgtgatcattttggatacacacactcttctaagaagtaatgcagaaagatcccaagtaccctttacctagtttcccccaattgtgacatcttgcgaaaccatagttcagggtcgcagccaagatattgatacagccgagatccagacagctttcccatggccctttgtagctacatccacttcctacccataaccccgcctcatcccctggcaaccactaatctttcttcattcctacagttttgtcatttcgaaaaggttacccaaatggagtcatgtactgtgtaactcggggactggctttttcactcagcataattctctggagatttgtccaggttgttatgtgtatcagtagttctttttattgttgaaccatatttgtaattgtctctaatagaaaaagaacctttaactcttcaagacactgcaggattttcagatgaaatgatgtgtaacgtctgggatttgctttaaaataatctggggttaggggagtatagatgaatcatgatttctatgtgctagtaattgttgaagtagctgatgggtacatggggttctgtactttttgggtgtttgaaattttccataatcaaaagttaaaaatatagcagtatgagccctttatcagagagagggagctaactgcaagagctaaaagtggagccagcagataagtaagcaccaggggcaggcaagtgtgtgcttgatcaccgtaacctctcctatatggtgtgatttgttgccatgtccatgaattttttttttttttttttttttttttttgagacagagtctctctctgtcacccaggtggagtgcagtggctcgatctcagctcactgcagcctccgcctcccaggctcaagtgattctcctgcctcaggcttccctagtagctgggagtacatggcttaccaccacacccagctaatttttgtatttttggtagagacggggtttcgtcatgttgcccaggcttgtctcgaattcctgagctcaagcaacccacccacctcggcctcccaaagtgttgggattaagggcatgagccaccgtgctggcctgaattagtttttaaaaattttaaagctattctctgaaaataatttaaagaagtcttaattatgcaaataagacaaaagataaacatttacttctgcctcctgacctccttcactgtgtgagaagaggaatcagtgattttggagtaaacgaaattgctttagggacaatcccttcagttgttctttggcgattctaagccataatccaccctaaccatttattgatcaaatggcttcccccgggggttccaagcatatacaacttcttctgttattacactatcagcaaggcttttgtactgtggtgaattcagattttgataagtttgtggcctttgctgatgaaatcttctcatgactaagatcagctctgccagatgtattttcaggacagacagacaaacctgaggtgctttaattgttcttttttgggagaggtggggtggtaatatacttctcttggcccatgaccatgaaaaaacagaaatttagtctttcaatcatgttgagcaaattttatgtaagcttaactgtacttctttgaccattcattcattcattcattcgtatttgtggagtagccactgtgtgcttggcactgttgtagatccagggacataacttccaaaatcatgtgaagaggggatctttttttttttttttttccccatatatcagaagctattctggcgattataatctggtggcattgcccacagtgtattaactgaccacactgggtctatgccctacaataatactaataacataatttaatattaaaaattaaaagtatatgaagtaatggatatgttcattagcttgatttaatcattccacagtgcatacatatatcaaaatatggtgttgtatgccatacgtatattcaatttttgtcaattaaaacttttttttctatcttttaaaaagggtcactctgttgcccaggctggagtgcaatggtgcaatcataactcaccgccgcctcaacctcctgtgttcaagcagtcctcctgcctcagcctcctgaggagctaggactacatgtgtgtgccaccatgcctggctaaaaaaaataaagttgtcatgtttttcctcatattaactctcaagtaatggaaaagaatttgaaagaacaagatagcttttaccatgggtcaggccctacattaaccagctctatcacatgtcaactcatttaatattccccacagctttatgtggagtgtgctgttgtgatttctgttttgcagaggagaatgaggtacagaaagttgacttgcccagggttataaaacagttaagtaacagagtcaagactttaacccaaagtatctgccaccagaggccattttttttatttatttattttttgcaacttatctgtgagccccaagttaagatttttcttttctcttggctttcaggttcattgaccaagccagcatttccccaactgttccacggaatgtcaacagatgttccatgaaaaaaatatttactggaaaaatatttaacccagcattttcctaatgtgtatagagattatttatactgtggacttctcatagaatttcatgttaaatgtacactgtaaatcaccaggaggaacattcatcttgtacagttctaaaattatttttccgtggaatgttttgttttcacaggatatctatagatttctcaaggagcacatagttttgtgccatttctgtactcttgaatctcaccattagtttcacctatatattctgtgctgtcacccaaatgacctttcttaaatttaagatcaaacgttgacactctcgaagtcaccatgcagtgagccttcattgctttcattcaagtcactggcaagggctctgctcctgccactcctgcatggatccacgggccgggccatgtcttgctgcatgcagccctgcacctgtgctgtgctgtctcactttgagttcatgcacatggcattcccttctctttgaagagcctttctgcatcgcccccatagtaggccaaaacagcccttgcttgtttgagatttgacttagacattacattttccgtggagccgatcttgaacacctcctacaggccaggtgcccaccttcacagttcacacagccagtcatggtgcgtgtgtatggtcactcctttactttacaccagcagctccttgaagaatacatcctctttgcttccagatcccacacctggcaagttattacctggcacacagcagtctcaataaatgtgtgaatgaattccactttccagatgtttgtttttgtttttgttttgttttgttttgtttttttgagacggagtctcactgtcgccaggctggagtgcagtggcgcgatctcggctcactgcaacctctgcctccctggttcatgcaattctcctgcctcagtctcctgagtagctgggactacaggtgcgcaccaccacgcccagttaatttttgtatttttagtagagacggctttcaccatgttggccaggatggtctcgatctcctgaccttgtgatctgcccacctcggcctcccaaagtgctgggattacaggcgtaagccaccacgcctggcctgtgttaattgttaatatgttttatgttggccctaaattctggttctcttcaacattgtcacattgaatatatttcattcctttcgcccataacagtctgtctttctagtatttcagtacagcatttccccaaggtcttttccatatgaaacttttttaaaaacataaaacattatttcttggttgctgatacgttactcagaattgaatgtaataccccattccggatattattaagcgacttttaatttttatggaaacctacattttcagtcaattaatgtcagacctttgtcttccatcttctgcttgtgcttgttaaaatccattttgtttgactgaatcttgattaagtcatctgttgtttgaatctgcaggttcagctagctttgtgttttcttcatattttacatacacacctcctgtttcttcatccggacctgggagcataaagcagtctcccatagcttgcagtatgtaattcacactaggttaatcctgagtcatcacaactgtgcgtcttacagatatctcatgacattatatctgtgcagttctaaagcatcttatatattttttcatttatccagccctagttttggcaagtgccttgtggaaatgtagaaagctaccatacaatttataaactgaatcctgctttgtagtttatttgactttgtggaagttacctgacttcctaccctcgatttagatgcttacaactttaaatgaaatataaaagttatctatgcaataaagcactgtatgaacaataattagagatattatagaagttgaagggtcagactgggcattgtggctcacacttgtaatcccagcactttgggaggccaaggcaggaggatctcttgagctcaggaatttgtgacaagcctgggcaacgtggtgagatcccatctccaccaaaaatacaaaataaaaagccagtcgtggtggtatgtacctgtggtcccagctacttgggaggctgagatgggaggcttgcttgagcccaggggcagaagttgcagtgagctgagattgtgccactgcactccagcctggatgacaaagtgagaccctgtctcaaaaataaataaaaataactagttaaagggtcaaaattttacatggtgctacatctttctcaattgcaatgttttaatgcattttctcaggttttaaaaagttgcagaaagaagaaaggaaagggaaagaaaagtgttcagaaatctttatatggggaaagagacattgcttctaagaagcccctcctcagtcctattcccgagctgcctgaagtccctgagatgacaccttccattccgagcatccgaagactgggttcaggtatcctgacattttcctggtagttatattttatcttttctcttcaccctctttgttgctattttacttttttcacttttttcccattcactatgtaaagagtacgtaaattttaaaaagcaatgtttcctcacattaccatgaggatttcaaatggaggaaacagtcacgtgtaacttgtaggtgacttagatccttttcagaatctgatggaaactggatcctttccccaggaaaaccgagacacaagattttgcatataatatcagtaataatttctgtgcatcctgtttccttttgttttttaaagcattttgtgaaaataaattccatttggtggtgtagtccatcgttgaaagtgaacgagagctggggcacctgcctgtgatcccaaccatttgggagcctaaggcggaaggattgcttgagttcaggagtttgaggccagcctgggcaacatagcaagaccccatctcttaaaaaaaaaaggaacaaaaaaagtcaatgaggtgatgattcagtaatatgtataccttatatgagttaaggacaatgatgttttgttagagttggcactactgttttctaaaaataatacatataaattgagcttgattaccttgaaagttattttattatcaagtcagttgatatatggggtagataaaaaatggactggaattgtttctggtttctaatgcccaaattttaaatggactgaatcttgctgaaaataataatgatttttttttttttttttaatttttagtagagatgggtgtccctgagttgcccaggctggtctcaaactcttgggctcaaacaatcttcctgcctcagcctcccaaactactgatattacaggcaagagccacgctgtcttgcctgaaaatgataatgtgtgtccatttggtgtgttgatttgtatagaatcatttttcaaatggctacctttgtcaatcatcagatatttatagcctacctcctatttgcggtataccatacaagattaataatagacttgaggatgaatgaggtacatgccaccattgactcctggcttctgcgtcctgcttaacattaggatagcacaggagtttaaataaacagccacccctctgtcgcatacgccctggctcacactcttctcctgccatgctttctcacaggctgtgttgtgacagggcatccaccactctacctttaatctgacctaatgttgcttatcttccaagattttgctgtattgtctgtttttccaggaatactctgcaacatacttccatcacctagttttatgatgatctattttctatgttcccctgctccctaaaacttcagtctccttgagagtggaaactaagtcttattttcattacatctctagttcttaacagtttttcaaaagatgattaaacagtgactgtagtaaaattttccatgttgtatcgtattagagaatttattttttaaaatacctaaagcattttttgtctgtaaccagtggtatcacctgctacatgggtttaaagcaattcagctccttgcttcctttatcttctctatctctttctctttttcctttcctctctccctatatcttctttaccttccttctctagtatgttggattttatgcgaaatacatatctttttgtttgtttgtttgttttttgagatggagtctcactctgtcgcccagcctggagtgcagtggctcaatcttggctcactgcaacctccacctcctgggtaccagcaattctcctgcttcagcctcccaggtagctgggactacaagcacgcgccaccatgcctggctaattttgtatttttagtagagacggggtttcaccatgttggccaggctggtctcaaactcctgacctcaggtaatccacctgcctcggcctcccaaagtgctgggattacaggcgtgagccactgtgctcggccataaatatcaatttttaaagctgtctaaagagcccaactaacattggttggcactgagtgggcactgacctgtttaatctctagctttaagtgacatgattttaagtaccttaatcatggatatatttttaaatggaaacattgtttttttagacttttggctcaacttatgttttatactttttttagtttttattttatttaaaacactttattcatttgactggccacttaaaaatatcatctgaggtatcaaaaaagattgcatctaatagttagttctaagatttagaactcataaagcctgaactcatgtgggctgtgttacttaccaatctgatgatggtttttccacctctgatgtgccagaaatacatgaaagcctacccacacgtgtcttcctggaggatatttagtcaaaggctgaggaattaagggtcgatttttataatattgaaacaaacctggttctgtttcggagtacagtgcactttatagtaatttttaacaaagggcatgagacctgagtgtcttcaggcatgctgttttagctcataagtcctcaaataccccagaattccaaattttccctcccctgtttcggaggatacattggtagaaagtttcagaagcataatgttgcccatttgcagtcattcattttcagggaaatgggaaatgtcactgcctcatactcatggaccttgtagcacgggaagggtgttagaatggaggaagctgtttcagatgctgttctcattttcatggtttgaggttatatgctttattaattcatgcgttgaatacctattttcttaacctgtggatcgttggagaactaaaagaggaggaggaggatgacagaagggcaagcacagtgtaacatttgtgggtcttgtgaatgcttaaaacacaaaaacaaaacaggtcacctgattatttaataaatgtaaagttcattcccattgttactttttaattagatttaaacctatttacatgcccataggttatttcagttcaaatggcaaactggaagaagtgaagactcctaaaaatccagtgaaaagaaaggatcttttgcgtcatgacccagatttgcatatgcatcaaggctatgataaatatgatgtctctgaattctgctcttatataaaaagttcctcatcgcttggcaatgctacttctgatgaagatccaaatacaaatataatgaacattaatgaaaataaaaatattccaaaagcaaaaaataagtcagaaagtgaaaatgaaccaaaagctggaactgacagtcctgtttcttgtgcttctgtaactgaagaacgtgtggcatcagatagtcccaaacctgctctgaccctgcagcagggtcaagaattttctgctggtggtcaaaatgcagaaaacctttgtcagttctttaaaatttcaccagatttaaacataaagtgtgaaagaaaggatgacttcttaggagctgcagaaggaaaactgcaatgcaatcgtttaatgcctaattcacaaaaagactgtcattgtttaggagatgtcttaattgaaaatacgaaagaatctaaaagccagagtgaggatttgggaagaaaacccatggaaagtagcagtgttgtgagttgcagagacaggaaagatagaagacgttccatgtgttattctgatggtcgaagtttacatttggaaaaaaatggaaatcacacaccatcctccagtgtgggcagctctgtagaaattagtttagaaaattctgaactgtttaaagatttgtctgatgccattgagcaaacctttcagaggagaaatagtgaaaccaaagtgcgacgtagcacgaggctacagaaggatttagaaaacgaaggtcttgtatggatttcacttccacttccttccacttcccaaaaagccaaaagaagaacaatatgtacatttgacagcagtggatttgaaagtatgtctcccataaaagaaactgtgtcctccagacaaaaaccgcagatggcacctcccgtctcagatccagaaaacagccagggccctgctgctggttcttccgatgaacctggtaagaggaggaagagcttttgtatatctacacttgcaaatactaaagccacttcccagttcaaaggctaccggagaagatcctctcttaatgggaagggagagagctctctgactgccttggaaaggattgaacataatggagaaagaaagcagtaattgacatttcctgcagagtctgtggcaagagggaaagtaaccatctatgctgaaatgatctgtctagttcccattctctgttcaacctcagtgtttcaaaagttcctaataaataaactcatttgagttgaacctacttttatgtagaaataaataagtttcttcatcattcagatagaaaa

SEQ ID NO: 739 - DNA, 2025 bp, Homo sapiens
cgagctcactggtgacgtagatctcatgtgaccaggagtcgacgtgtgcagaagtcctggtaatctggtccttgttcccgtctggataccagcttccttcagcagcgcaggcggtggtccctgaggcccgtggaaggagtcaaacttgcgggaattttgcaggttggtgtcactgtaggtgttgactggggatttctagtgtgggggggtttaaggcagagacttgtgggagtgccggtcaggtccgtccctccaccctccacctccaggtctacgggaactgatgacccttgggaaagggactaggggtcctaggagaagaacagggagacctgtggtagtttaaaaataatcatcctctgctatctaagactgctttccggacccccaccctcctcccgaaccccgcctcagtcttaaagatagtttggaaataatctgctttctcactctttgtctgatgggaaaaacgaactgacttgcatgcactgtggagagggggtgaactaggggaaacaaaaggtgggaaactttccatatccgaaaccctaaaggaggaaagctacgtgtgtcagtctctggcgctggtcggcccaccaagcgctcgccccacccccaccgtcccctcccgtttccagtttatctgcagggctgttgtttccagcaagacccaaagctagaaaaggaggaggaagaaactgacccgatcagtgccaggtaggtgagaggaatattataaagtctcctggggtggagacaaaggttgtaagcgccaccgttcctgccggctcccttccaccccacccctttcccctcttcttttctctcccccttctcctttcccctcttcctctgcctgccagccacctttctcttttctggcctggtccctgtgttaggccctatgggggaaaaaggtctggggagggctggacggcggaaaggagggccttggaaaaggttagagggaaggacaagagagaagtgaggaggtggaaagtggaggtaaaaggagtggggatagtgaagctctgattgctgactgggcttcttaggtggaagatattttataacagctctgaataaaaaaaattaaatgctaaggcctctgtccacagcacctgtccactcaccaagtctttaacttactgtcttctttttgctttctagaagtcattgtattcaaagaagaataagcaagaaagaaaagaaggaaggaagagaggtagacagatacaagatgaaatcctgtcaaaaaatggaaggaaaaccagaaaatgagagtgaaccaaagcatgaggaagagccaaagcctgaggaaaagccagaagaggaggagaagctagaggaggaggccaaagcaaaaggaacttttagagaaaggctgattcaatctctccaggagtttaaagaagatatacacaacaggcatttaagcaatgaagatatgtttagagaagtggatgaaatagatgagataaggagagtcagaaacaaacttatagtgatgcgttggaaggttaatcgaaaccatccttacccctatttaatgtagtttaccttgatttttatctgatattaacaataccatatagcttgctttttattagcatttcctgatattcctttgtccatatttctacttataacctgttgctattaatggttttagatgtatctcttgttatctgcatctcattgtttattgtattttgaaccaatctacaagtctctgtcttttaataaaagaactttacacatttgtaaaaaagaggttcttggtaagatataaaatggaaaaaggctaagtaatatgtgaatatcatatttttgaaaggtaaaaagtacatttgtatattacatatatggacataacttgtgaaggatgaaagaaagtacagcctctcggtggtgggattatgaatgatttttctccttttgcttgtttgtattttctatattcctaaaattaacacacattattattgctagaataataaaagttttataaaaaagaagcaacaa

SEQ ID NO: 740 - DNA, 7541 bp, Homo sapiens
ggggtccttcggcggcggccagcgcgcgatcctcccggctccgtccccacatgcgggtggaggggccggggctcctcccggtacgtgcgggcccccggacagcggcctctcggacgtgcccttcggcgctgccaagacccgtcctggtacttgccgagccacggaccgcggcggctaccgcccggcctccctcgaccaccctccgcagcagcatcgcccgcggacgggatccggcaacccctgaccgtgagcggcgggcgctccggccaatcccggaccttcaggaagtcgcgccgctccagccagcgtgaggctgagcgcaggaagcggaagtgccgatcggtggggcggaaccatgcaggaaggcggaagtggcttcgctagggagcctcccggcgtggagatggcgggagctggtcgcggagcagcggtgtccagggtgcaggcgggtcctgggagtccccggcgagcgcgggggcggcagcaagtgcagccgctggggaagcagcgcccagccccgtggcccgggcttcgcaggtgactgcgctgccccgcgaggccgccacacttccccagagaaggggacgccttgaaggctccgcccgggaccccctagggagcgttcgctcggaccccttccccaggtcgggctcagtgccctcctctgtctgtgcccgcggcccacgctccgccaggatcggttgaatgaatggaggcgcgagcgagtccttggttttgcctttcccgcgtcccagtgtcccgtctttgtggttctggacgaggtcagggcggaaaggcctcctgggctttcggagtgcctttcggcctcgcgtcccgtgaggaaggggttcagggacagccactgagtgagaccgagaggaaagatccctgctccctggactgctggaccggctcgcaccacagaagccagatgtggcccctgtatagatagattctttttttttttttttttttgagacggagtctcactctgtcgcccaggctggagtgtggagtgcagtggcgcgatctcggctcactgcaagctccgcctcccgggttcacgccattctcctgcctcagcctcccgagtagctgggactacaggcgcccgccaccacgcccggcaaattttttgtatttttagtagagacggggtttcactgtgttagtcaggatggtctcgatctcctgacctcgtgatccgcccatctcggcctcccaaagtgcagggattacaggcgtgagccaccaagcccggccagcccgtgtagattctattgccagacccaactattgtttctcttactgattctgcttgtgctttacttgggacgggtctcacccccgtgttctttctcccagcaaagagaagaagaaagtgaactgcaagcccaagaaccaggacgaacaggagattcctttccggctccgggagattatgaggagccgccaagagatgaaaaacccgatcagtaacaagaagaggaagaaagcaggtgtgtgcaggcccatactgggcggcagtgaagctttgtgtgtctcaacccgcccaatcgcccaaatacttcagaacgtttcaggcagaggaaatatgccaagacccggtgctcagaaggtgggggagcgtggccaaagctaaagcagtggctggcagctggtggcgctgtggttccagacgaggcttggaaggaggctgtggggtgggcggggaggacccgttatggggcctcaggatccatgctaaggagcggcgtttttttctccccaaaagtagcgaagattcatcagagtttttagcagggcacggccaattcatgtttactctaagcaaaaaaagggtcaccgagcgatgatggagtgagggagagtggacctggcaactggcggggctactgccagggagaagccatgattcttgggacaagagtgctgaagcaatggtagagagaagtgggtggagtcaggagctgaaggaggaaattccatcaggcccctctgagaagtcttgccttcctcccccaagtctgggtagggtgtccacatgtccaccgctgcaacccagaggtaacactctgggcatgttgggaaacggagtccactgtgtgtatattttgcttatagacacatttctcttcccaaacgtggcactggttttacagcaaagctgttttataatttgtgtataaactgtaggcttcttgttgggggttatatggctgccaaagggatagtgagatagaggtgaggaaggtgcagggaggaggcgcactggcctgggtagcacatggcacgttctgaaccgtgctgcattgaattggcacctttgtttgtttgtttatttatttatttattgagatggagtcttgcttcctcgcccaggctggagtgcagtggcgtgatctgggctcactgcaacctccacctcctgggtttaagcagttctcctgcctcagccgcctgagtagctgggattacaggtaacgcaccaccatacccagctaattttttgtgtgtggtttttttttttttttttgagacagtctccctctagcccaggctagagtgcagtggcacaatctcagctcactgctacctctgcctcccctgtcccagttccagtgcaagcaattctcctgcctcagcctcccgagtagctgagattacaggcacacgccaccaagcccagctaatttttgtattgttagtagagacgaggtttcaccatgttggccaggctggttttgaactcctgacctcaagtgatttccccacctcagcctcccaaagtgctgggattacaggtgtgagccactgtgcctggcctttttttttttggagacagaatatcggctcactgcaacctccaccttccaggttcaagcaagtcttgtgcctcagcccccccagtagctgggattacaggcctgtgccaccatgcccggctcgtttttgtatttttagtaaaggctgggttttgccatgttggccagtctggtttcgaactctggcctcaggtgatccgcccacctcagcctcccaaagtgctgggattacaggtgtgaaccaccatgcctggcaatatgcatgtcttcacatatttatgaacacaaccacctgcctggcactgtccgcctcctgtgttctacactcgcccggggtcctgcgcttgcgttctcagtggatgtcataggtctgcccacgtttcttttttgagatggagtctcgctcagtcgcccaggctggagtgcagtggcgcaatctcggctcactgcaagctccgcctcccgggttcacgccattctcctgcctcagcctcccgagtagttgggactacaggcgcccaccaccatgcccagttaattttttctgtgtttttagtagagacagggtttcaccgtgttagccaggatggtctgaatctcctgaccttgtgatctgcccatcttggcctcccaaagtgctgggattacaggcatgagccaccgcgcccggcaggtctgcccacgtttctctgtgtagctccactgggcttctttcggcagctgtgcaatggagtctgtgggtgatcagaggagaattcattcaaccagccacctaggggtggacattaggttgtttctgctttcctttttcagctgtgctgcagtggacatctgtgacaggtgccattgggctggggggtcacgtccccggggatgccgggccgggcattctacatcctcttcagctgctgtcgttggggtgcttccagccagcctggtcttcccttcctgtggctttgggaggggaaatgagcatgggtcacctgcctgccactgtctgcctcctgcctcctctgaggcctccctttgtcctcagcccaggtgaccttcagaaagacattggagaaggaagcaaagggagaggagcccgacatcgcagtccccaagttcaaacagaggaagggggagtctgacggggcctatatccaccgcatgcagcaagaggcccagcatgtgctgttcctcagcaagaaccaggccatccggcagccagaggtgcaggcagctcccaaggagaagtctgagcagaaaaaagcaaaaaaagcgtgagtggaggcgggagggggaggggtctgccctgggagccggagggaagacattgggttcccatgacggccctctgcaggtaccctgtttcatagccatggggcagcctggattcagggagaccaagccagagccctgggagttggcgagtcggagcatccagctgggagccagtgagggtgtggcctccaggaggctgcggaacctgggaactctgcggagacctcgcttggtccttgctttcacaggaaaagcaccagaaagccctagccctgtgggaatcagccctgagggggtcggtctgagggtgacgtgcccaggggttctgtttccattagaacagaatgtctctcgtccaagagactacaccttcctaattctctaaaagctttggccgagtacagtggctcacgcctgtaatcccagcactttgggaggctgaggcaggtggatcacgaggtcaggagatcgagaccatcctagccaacacggtgaaaccttgtctctaataaaatacaaaaaaaaaaattagccgggcgtggtggtgcatgcctgtaattccagatacttgggagcctgaggcagtggaatcgcttgaatccgggaggcagaggttgcagtgagctgagatcgtgccgctgcactccagcctggtgacagagcgagactccatctcaaaaaaaagaaaaaaaaaaaaaagctttgaaggtttgagaggttgctttcagctctgtagattccctgtttctggattgttgtattacttatagttaccttagccagtgaaagttcatcacagagaacgtggcccagatacagcctggcgccacggtgatctccagagctgtcgctgaaggtgaagcttccagattcacattgagggagacgtgatatacaatgcttgttaggccctttagacacagcagcaccggatgggctggatgagtctctgttgggtggtctttggcagccttcccagccttcgtgcacaaggtgccagtagcccttgcccacgtgtctgcacacattgtcagatgttccctggcaggtagctgtccccagctgagaaccactgggggacctgtgaggggcctgttggggtcagagccttctttggtgggcagctgtgggttttggggtggtaaggggagcggggacttggaggcagccacctgttcttgggtccctgctctgccacaggggatcccttgtgggtggggcggcctctgcctcctccctgggtggaaagagaatttaggaatctgagtgacatgtgctttcttccccaggttccagaagcggcgactagataaagtccgacggaaaaaggaggaaaaggcggcagacaggctggagcaggagttgctccgaggtagctcttcccaaagcgatggtgtcagcagtggtccgggtggggcctgggcgcaggccttctgttccccaccagccctggctgcactgggcacctgtggtttcccctggggtccacagccattagaccactggatgagttggtgttctgtcccagccctatgggagggaggtgggcgggtggtggctctgggtgtcaggggtgcagtggctgtgggcagcagtcctcagttgtattctgctcctccagacacggtgaagtttggtgaggttgtcctgcagcccccagagctgactgccaggccccagaggagcgtaagcaaggaccaggtaagtggggcacggggacaacttgagtttgtcccccagtgctgccagggaacagaagccttggacaggctggacacggtgggtcacacctgtaatcccagcacattgggaggccaaggcaggcggattgcttgagcccaggagttgataccagcctggacaacatagcgagatcctgtgtcaagaaaaaaaaaaaccctcagccaacgtgtgcgctgtctggtgtgtggcctgagagtgcagtgttctcgctggcgggagagctgttgaagctgtgaggctttctgttgcatcccctcctttcccagcctgtgcctcaccctcccctctctccctcagcctggcaggagatcgcagatgctgcggatgcttctgagccccggtggtgtgtcccagcctctgaccgcctccctggcccgccagcggattgtggaggaggagagagagcgggccgtgcaggcctacagagcgttgaagcagcggcagcagcagctgcacggggagcgaccccacctcacttcccggaagaagccagagccgcagctgtgatggagagacacccggggcctggccacgctctggggcaactggcaccaggagctgctacacctgggtaggagagaggcaggccatgccagcagtgtggggtgaggcctccagctacttgttcacacgttgggcactagtgggtccacatcttgcagggggtgagtgcccgatggactagggccaaggcctggttgacagacggcccgtggggcccggtgtcactcacagctccatctctttgttttgaacgtccattctgagtctcagcccaggtggaccttaggaagggctggatccctgtccctgaacaccaaataccgagacagctgatgaggctggctcagtgtgtgacggaggcccccgggagtcagcagagccgagcgtacagtgcacatcaggcagagcaggccacgggcagggacgacgcatcgggacagggctctgcaggggaccgtgactacaggccagctgtgagtggtcccctacagaggctgcccacccaaggtttggttggggtgaaacatgatgacaacacatacacttaagaaggtgggaaccgggggccgggcgcggtggctcacacctgtaatgccagcactttgggcagctgaggcgagtggatcacctgaggtcaggagttcgaaccagcctggccaacatggtgaaactgcatctctactaaaaatacacgaagaaaaaaaaaacagtgggaacagagttgtcacctacctaacagggctctgagagagccgggaggcccaaagtggctggaagaaggtaaaggaaaaatcctgtcttgggctcaaggtcacagagtggggcccagggggagttcctgctgagggcagggccttgccaggcttcagtctccagtgccaaaggaggaaatgcccaggctgtcagcatttccagatgagagcagaagggagaagcttaaacccaagtcacacatccagcaatggagtccgacagcccagcaccatctgggaactgagaagcacctctgcccggcccccacaccgtgtggaaagtgaggagcacctctgcctggccgccaccccgtctggcaagtgaggagcgcctctgcccggccgctgtgcaaccttccaagtgtgaagtgacagccttgtgtgtgatgttttctgccttccccaagtttgcactttcgacattaaagtttactttttagttaaaagtttt

SEQ ID NO: 741 - DNA, 9721 bp, Homo sapiens
gggagagcgctgaacaaggccgcagagctgctccgccatctcccccacgcctcctgccaagttctgtggcgccgcggttccccacctcctgctcccatccccctggctcccgccgccctgtagctcggcaggtgcagtaggcgctccgaggaggaggccccttagcttcaagaaacccgcgtgggcggggtgaggagcgcagtcctcctactggcgccgtgaaggagatcgcgatgcgccggagggaaggaggctgcgggcggggaaggacggagggcgtgcggggagggagaggaggggcttgctggggggggggccccgaggcggggccgggagggccgcctggaagaggaggtcgggggcgaaggaggccgagaagaaaggtggggccgggacccctcgggctgcgcctctcgtgggcgtgtccagccagggctgggggtccagggaggactgagtttccctctcccgccgtcctcgcagccccgggaggtgcaggggcatcgcgggaacagccccggtgacacgctgcccggggtcttcacgaatgcccggaggcgccgctggccagaagccagcccgaccttccatccccgcagacagccccacgttcctcccggcccgcgtctttcggggccgcccgtgcaggcgggcccggctcagcggcgcccgggcagcagctgcttccatgcgccggcttcctccggggctgctccgtggcggcggcagagggaagcgctgccgcgggcgggcgaggatcgggagcgcctgaggaggctgccgcgggctccggctgcgcgttcggggcgggggagctgcccgggacttcgcgccaggggccaggggccggccgcgctggggtctgcgctgtgcggcgcggcgggctctgggcgcctcctggcggcccagcctggaaggcggcgcgatggggcgaggctcgtccgctccgactgcgtaagcggccccacagggcgccttccggagtctgcgcgctcccgcccggcggttgctaggttgccaaggggcgtgaggcgctgatgggtggggtctgagcgaggcggggtgtcgggtgtcgtgacgattgagcctgcaagggcggactctgcggtgttctccatatcaacagccctgccaggagcccggaagtgggtccgcacgagacagaatagactacactcaaactccaggggaaccgttcattgggcttggacacgaaggcgggaccctgccgacgcagtgattggatgcatgtccggccagcgcggtgattgggtacaggtctcgggagcgcggtgattgggtacaggtctcggccagcgcggtgattgggcgcaggtcccagccggcgcggtgattgggcgctggacccggcccgtgccatgattgggctcaggttccagccggagcggtaactgggcgcaggtcccagccgccgcactaaacccggcccgtgcggtgattggacgcaggccccgggccgcggcggaggcgggcgatccgaaagaggctggtgctggctgcatggggaggcggcggcagcgggtggaccccgcggctggggcccgggccggggccctgcctgaggccatcgccgcgttgagtcggtcgctgccctcgggacccagccccgagatcttccgccgcgccaagttcgaccgtccggaggcggtgacgctctcgcggagggcaggcgggccgggtggggtcccgggccctcgcagggagttgggccggctccgctgaccgcccgctttttattttccgcagacctccgcgctctggcagctcctcttccgtgtgctctcgccactccctgcgggcaacgccttggcatcgctcgccctgggtaagccccgctcctggccccgcccacccggtagcactggccccgcctactcctgtaaagccccgccttccccagtaagccccgccccggcaggctctagcccccacccaacactgaccccgcttgctcctcaaaactccgccttccccggtaagccacgccccctgatgggccctagctccacccccttgggtagcactggcttctgctcctacaaagccctggggacgtccctgttggcccctggtctcctcatcctggtctgagttctagctctcccactatcatctcttctgaactaggccttgagcttctgctcaagtgacctgtgggggtctctggagggatccaggtggtgtcacctccaggtgggtggtccccctaaggtggtggtcttctgtcctagaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccaggtgcgtgtgggtgagggtgagctgagccagccctggtctcaactcctggggccagagcaagggcaggcctgggtcagccccctctgtctgctttgctcctcagggcagtcccatgaagggttacccagctgcccagctgaaagcacggaggctccctgtgcagggagcacccgttgtttttggctgtgcctccactaccgtctccatcctggccttttctggggggcagggtggggtgggagcagggcctgacccttgcccctctccagtgtgaggccctggccagccctggcccacctgcaccccacatggaagcagagggtcctgtggatgtccgccatgtgcagtggctgatgggaaagctgcggttccggtggcgccagctggtgtccagtcagcaggagcagtgcgccctcctgagcaaggtagagctggcacagggcttccactcaggggctgtgtcccgtgctgcaggccgccagctgccagtccctgcagcccgtcccgtgaggcctggcacaggcttttggctggatgtgggccttcctgccctggcttacccaaagcctgagcccgtggttcccggtggtccttgtagggggcagggctgggcagggagcccagtggggtgggcaatggtgggcagaaacgggtgtcagagagctcacagaatttgcctttctgttcccaaaagttaccagtggacttccagctctgtgaacagtgggatggggtctgtgccatgaaagccactccctcctgggcactggagggggaggaagacagctcctgttgccaccacatcctggtgggggctgacttgcggggtggacagctcctgtggggtcctgaaggtggcaggggctggctcaggggcacaggtacccagtggtgtgtccactgtgaggccagcgctgacaggtgggtctgtggcagcggcgggctcccaccagcgcgggactccttggagacccccccatcccacccttgcagagggtctgttgctcagctggcctttccagggacctctcaccccgtcgggcctggccttggcaccagctgctccgcttacttatgtgcctacctgtgaccctctgtgccaccttccagcctcccttttttggggagccttccccatttccctagatccaagcagtcgttcatgtccccactgtgagcctggctgaactgctgtgcctgtccagaggctgttcctcccccgatgctgctggggaagccagggcaccccactccaatcttgctgctgcttggaagctgggcggggtggggaggccatcagtgaaattgcctggcgcccccttgcaggagaccccagcggtgctgatggttgttctgcacccagcccagccccgccaacctcaggcaaggagtggctttctctgagccctctttcctcatctgggaggtgggctctgatggccgacctccctggactcatggagactcagcgttgggggaggtgcttgactgccactcagcctggggtctgcactacctgttttagatccacctgtacacacgcggctgccacagcgaccagagccttagccatctgtctgtcactgaagcagagatgctcagggacccagagggaggccagcaggtgagggcgggcaagctgctgcgggggggtgggggtgggctggggggcacagcagggggactgcccagggtgggaggggcctgggggcggggcagctcttgggcctccagcggtgggtgtctctgcatgtctgccactgatcattgccagcctgggtgacagacagcttctctgggcctctcctagcctcatgggccactcacccttcccttccacaaatcaagacgtggcacgggtgggggcccaggacgcaggagcctgggctgggcaggcagctggctaagggcaggctgttggaataaaggaacacagatctcaggtgtgagctggtggtgttggcatctcaagcaggtctcacttggtgtgtcagggggcacctaggggtgtggggggccagcccacactgggtgaagggttgggcacagggctgactgtgggaggggacaactgcccttcagaacccaaggccaggcccacatggggtgtgctggaccgagcctcccaagctggagccagctccataggccctggagacttgcagtcccgttctgcttgctacacccggaccacccgggggcacggcgctttctaggcaggcctgcccccggcgaccggggctctgtggtcccaggcagatcctgagccctggatagcatagacctggaggaaaacctgcctctgagccccaggtggctgtgtgaccttggggagacagcatcctcctctgactggggctgctggagcactgacccaagtgttagggttgacctagccccaggcatcttccccagggatggccgcttcctcgcaccctgctgctggccttccatcctcatccttctttctgggggtctgcccgcccgtcatcactggcttcttcctcttggctggcttggtttcaggggatagggcagggctggctgccactcttttaatttattttatttatttatttgagacagagtctcgctgtgtcgcccaggctggcatgcagtggcacagtcttggctcactgcaacctccgtctcctgggttcaagcgattttcctatctcaacctcctgagtagctgggactacaggcacctgtcaccacgtccggctaatttttttgtatttttagtagagacggggttttgccacgttggccaggctggtctcgaactcctgacctctggtgatccacctgcctcgacctcccagagtgctgggattacaggcgtgagccaaccacttgggctgggctctgtactgtcctgagtgacgggctggcactgtcctgctccaggtgcatatggccgggcaggagggcagaggctcagggctggtgtgacctcttcttccagacccagtcccccttctctgcctcttccctctccaatcccagagacttggcccctgtacctcatcccaggcctgcccagggggacctaggggtcagaggcggatggcctggctcctggcccctagtcttgtgtctgctggggcttcctgctcgtagcaagggcctgtgggttccagctctgcagcccaagcctgggggattgcatgcctcactcatgggcttacagggcccaacccctgacgcctgcctggcccctggtgccagctggacctgtgtccctggctgaagccgggctggcgcccacccagtcagcctgcactggcgttggcagtgctgaggcagcatccgggcgtcctggtctgcccttgtccctacctgccttgtagaggcggctcagcgaagcccaggcttctggcccctgggacccctgggttggggcagaggagaggctgccctggccccaggctgctcctgcccagtgcctctgtgggaccaccctctgtggtgggctgggggggcctggaagtgaggccccgccctctccccgaagctgtgtgcggcactggccaggtggactggggccatggctggcttccttccaaggtttctggagcgggagctgcccaaaacctggacctggcctacccaaagtgcctgcactccttctgcactcctgggatgggtcccagaaccttctggaatgatctgtggctggtatgtgagcagccaggtctgctgccgggtgactgggcagcacccttggatcctggtggggcctcagcctgcagcctgctctccccttttagggcggtaagtcggggaggctggcagggaagtggagaccgcaggacttgggggtgggtgggagggggtggcgagggggtgtgtttgctcctcctctcctgcctgctcccacccctggcccttaccttcttgggaactgtggtgattgccttctgtcaggtgtgttgaagcggccgtacccatggtggaggcctttgctcttcttgtggcgtgctggggtgggcaggtgggctgcagccccggcaccagcctgctccagctcccacaccgcccacagacctccctgtcctcatattctctgaccgcaggcctgcctgcctctgctctgctccgccccagaggggctgggttggacctggtgttcaaggccattcctatctgccccccagcccactgctggagccccaggcccctgcagcctgctccacactctgggttcccgggggaagcaggggtagagtggggcaggattcaggtgtagagggcctgtccccagcaggggtccccttgccccgggcccagggtcactggtacagatagcccatgagcgaacctgggaggccttccgtgtgtgggcagagcagctgctgtgtcctggccattctccagccgcctgtctgtgggcactgtgggcaggtacctttgtgcagggccatggggcaggcagggcggggtctcctggccctgcctgacccttcacttgggaatgtcaagtgtggctcagctctgccttctctgccacctgggtcactaggcagactcctcactgccttagggggtccctgaagttacaggggatgggttttccctcccccagagcctggcttgctccttcgtttggggcctccccgtccgcctgcagtccccggatacagcccgcattcagtgagggctgtggggcagaggtctaggcttgagaggcacctggacctgtccctgaccttgttggactggcagtggggctggtgtgggggacagcggatgtcctcagagccggggggcagctcttgcctggcaggcagggcctggccgtgcactggttgggggctgccctgcactgcagaaaggacaggtgggctgtggcgtccgcaccacaccagggtgccctgctcatcgctctggccagagaacctgggcgcaggcaggggagggctgcaggggcggggcgtgagctaggcgttgggccgggtgtcggcgctgggtccagctgtccatccgactgtctgtccatggggtcccgtgtgaggttctaggccagctgccgtttgccttccagctgctgcggactctggagcgtgagaaccagcgcctggaggctgtcctggcgtggcggcgctctgagctggtcttctggcggtggatggtgaggaagcccgcgcatccctctcccggcatcccttcccacagcagcccccaggtggggcattcgggatcttcctgttttccagacaggaagaggggcttttagggaggccacagacctagtgtaggctctttctaggacttccactcgccttctggggaggctcactgctgcccccgccctcagctccatggccttctagagtgtggcctttgtgcctccctggacgtcacagttgctgagatggtggcatccagcccgctgtgggacctgggggactaccactgccctctttgccctctgtccctctgtccccttggcttggtgcacgctgtctcacttgggtctctgtaggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggtgagtgccagcctcgctctgggcaccagcccagccccaccttcgggggatggctgacctgagggcactttggacttgctgaatcctacagttgcatttgtcaagcatggcaggggacacacttagaggcacgtaccctgagggagcgggagggcacctggtgaggagccgcagctgctgcgagacagcccccgcccctcctgcgggaggtctgttgtctgattctttgcatgagggagggaagcccgtgctgtgtgggccctgctgctcccatgcgtccgccacacatgcatcacacggtagtagtcactcctccacacctgcctgggacccgtctaacctcctggtggccacctgggcctccaccctagactcagagctgcccgcttaacctgcgcaggttcatggctgtgaacacggggctgtgttggctccatctattttctttttctgaagagttttaacttaaattgcaggcatgattttccccttaaaattttcagtaagcctctctgaagagcatgggcgtttcccgcatgcctgcagcgcctgcacctgagtctgggctcagggaatgctcagggagcctgaggccagtgtcctggggggacagagccattgccattgtgtcccacgcaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggccaggtggccgcagggacgatgcagatgcagagcccacgtcacatgctcgctccaggggtggggctgggctgactctggccggatcccaggcctgtggctagcagcactggggacaggaatggctggtcccttgaggaggtcgtgacaggctcagcctggtggtctggaggggactcggaaataaattgtagcagctttcctgccgctggccctccccctgccaccctgtcgggtttccctgtttgggggtgggagcgtggaggagcccctgggcagtggtggccagtgtagggctggccaggtgctggaggacatgcataccccagcactggtgagtggcaggaccacggggaggtggcacaggcctccctggagcgggattatctcggccccgccccccttcatttgggctcccgctgtgggcctggccctgggctgtgagcacagctgcccccacctccggccaaggctgtgcctggtgggtgcgccggatgggagcccggggctctgctccttcccgggaggtggtgctccgggtggggaggcacag

SEQ ID NO: 742 - DNA, 77343 bp, Homo sapiens
gaactgtattcagcggcgacagcggcgactgcggcggccgcgggagggcatcccgttggggatccttccgcacactgaagagtacgtcttcgggtctacccctaatcacgtaagtctcgcgtctgccctacctgccctgtcgcatttttaagtggtgattcaggctgtggcttttgagggtgttttgcactgtaatacctcggtcgtagcaaagtgccgtgggaccgaagtattatggtgcagtgacttgacgctcgagcctggttgggcctgggggctgtaggcggagttcacagtatctagcgatggagctggtaggtcctgagggttcgtctgcagcttggaagacaggcccgtagaggcctgcttaacttccattagttaggcaggaaacctgggttctagtcccactatgtacacggactccaattcctcaactttctcctactcctgattagttacagcctcccaaggaacctttgggacttgcactcgaacactgataatgatgttgagtgcaatttttaaattgagcacctactaaatgcctggcactaggtgggttatgtacttgtttcactaacgtctcattctgtgaggtaggaattcccttcctggttttgcaggtgaagaaacttatgctcattagagattttaaataccgaaggactacaggtcataaagggggagcctggaagtgatatctgactcggaagtgtagttctttcaaccatttcacactgcctgcccagtgacaattttctgtctcacagtttttgctctagagcaacttggaatccaattttttaaaaacaagtgttatcgctgctgcctttggctactgtttttttgtatagtgcagcctgccattcagagtgcttgcatatttattgtctcattgacttctcacaagggactggaaggcaagtatttctgtgtgatgatgcctccacctaggaaccacgtgtaaggcttatggcataggctcccacagccagctagctacaggaagagctgggactagaccaggggttggcaaactggctgtgctgcctgtttttgtgcagccagctcctgagctaagaaggagtgttacgtgtttatatggttgggggaaaaaatgaaaagaataatgttttgtgatgtgtaaaaattacatgaaattcaaatttcagtgtccataaaaaaagttttattggagcacagctatactcatttgtttgtttatgtatgtccatggctattttcacactagaaggtcaaagtgagtagttgtgcatgcctcaaatatttactgtttgttcctttagaaaaaattagctgatccctgaatgagactcttggttttctgtcaccatagtaatgctcttttttttttttttttttttttttttaagacagagtctcactctgtcacctaggctggagtgcagtagtgctatcttggctcactgcaacttccgcctccctggttcaagcgattctcctgtctcagcctcccaagtagctggggttagaggcacacaccaccacacccagctaatttttagtagacagggtttcaccatgttggccaggttggtctcgaactcctaaccttaggtgagcctcggcttcccaaagtgctgggattacaagtgtgaaccaccatgcccaggcaatgctcttttacttttaactcaaaacaacttagaaactcataatgcatgataatagctaatgtgcttttatacatgccaggcactgttctaaaagctttacttgtgtttatgtcgttgacttgtcataaaaccctatgggatagggttttcattttcattatgaggaagctgaggcagggaaaggtgatgtaacttggccaagatctcgcagccagtaagtggtggagccacatttcagaatggcctaattcccaagtgagtcttcattcatagcaatcaaatctcataatactacctttaaataataccagtaagtaatttactcctaaaaatgtatttcaggcaaagtgaccatgtcactgaagctgacagttcttcactttcttttttctttcaagagatgagggtgattttttgaagagaaatacaattcttagctatttactaggatttgcatttatgtaaataattaatctctaatcttctacctgtatctttaagttgcatcatagattgtgtctataatttaattatattgcaagtggcatgtatctttgctcttgattatacaaaccaaagtaaacatctaggattctgtttatgccacataaaaatagaagaaaaggatagcagaaggagtcaggaaatggaataagtacaggaaaatacccaaaataagatgatgggcatgtgagtatgttgagacttgagtacttaaagtaggaaaaaaacttttagcaggcatgtctgtaaactcagagaaaggaattggatgccttatatagtcttgggtatatgaaacattggcactacctcaaattattttgaaaggcttttgtgtgcatcaggagaagttacttaacatgatgctttaagaacacagcttatagagttagacatattaagtttatgctgtttgtccacttacaagctgagtgacgtggaggttattaggtaaaataaggataataacagacctgtcttattggacacttatgacagtcgagtgaggtaatcaatattaagcttttgaaaagtatctccaccaagttagctcctaaatattagttattttattggttatgtagtacggtgtaacaaaccatttcaaaagttaaggttttaaaataaccatttccttctgattctgtggatcagcagtttgggtgggacactgcttggtgatactctagtggtcatacaggacacaattcctcctgttgtaataggtggtgacaacacatgtgaaatgtctaccagggaagcttattagagacttaatgcccagggtttttattgggggctaaatgcaaaggcatccactgtctgacatgtaccaaaattccagactcgcaagtgtttagcataaactatattgtttgtatgaacagtttagcacagtgaaccactcttactggaaacactcctgaaatctaagctcccaaactggactccagcttcaaaggagagcattcaggcctattgtattagtacttctgcacacaccacttaaggcctaagctcagaactcccacagcgtcattcttgccacattctattggttaaatcaagtcacaagcctggtccagattcaaaagggtagaaaaataggccacctcttttgggacaacgtaggatgggaggaaattggctttttaggtttttttttttttttcccaatttatcagacttattacctatctcaaaacaaatatatatatttaaatacagctttaattaggtatatttgtaattataagtttgcagtaaatttgcatgtctgtttttgtgtgaattttcagaattgaaggctacattttgttctttcagaaggtttggcttaagaaaccaaaggggagggaaatatgattgcgcagaaattgtattattttgttttcctaaatttaattaaaagcaatcttggtaaatatgaaatgacctctcattcactatatgtttttctctatctgtgcttgcctatacatgttaaatgttaatttcaggttaacataagatactttaactttgtattctgtcctactttaagataatggctgtgtttaatcagaagtctgtctcggatatgattaaagagtttcgaaaaaattggcgtgctctttgtaactctgagagaactactctatgtggtgcagactccatgctcttggcattgcagctttctatggcggagaacaacaaacaggttggtaaactatatttgggttaacttgtttttttaaagcaaaatttcattgctgcccatttgaataaacttaagcttaagaatattaatttctttacattatgtgcccttctgtgataatacaccattttcacaaatgcctctgtgtatctgtgtcagaatgttatgatagaatttgaaatgaattatttcaaaattaagctcttatgtatggttatacacgggacatgcatatttgatgtttaataggaagatttaggataaacatgtaactattattattgtggtcaaattatttttatttaataagacttttttcattccctaaacttttaaaaactactggctcttgtaccccaatcctggaaattcttccaatctgcaccgggatactggaaactgcctttaaaaaatttccacaaagtgattcttacttaggtagcttgagccaaactagcgtttggatttaagccgtagattaagggttagaggtgttcagatgagagaaggatgaatgtaggatagagtggtaaggaaaggctttgtgatattagatagattttagataaaggaagagaaggctgtagaggaggtatgatgaggaaagtcagttcagaagaagggttcaggggaatcaaagtcatggtatgaacttggcaaagatactggcttgactagagaagaggatttttgaagggtagaattagcttcaatgggtctgttgggctagatattgaaatgacattctgatgagttattttaattttatatgtcagtagtttccagatttttagattccatagacagtaaaatttctaaaaaattattagacactgacagattttaaccatttctcatttttgcaaataaggccattgagaaaaaatagttactatatactatgatcatcattttgaaaaaggaagaatattttaacacttaaaaattaaaaagtataaaatcttaaaacagggatagtgttttctacctgtgaatagttggcagttttgcatattttaaacaatgcatgttaagataaattttgaatctcgaaaacaatgacaaaatgttattttattttatgtagtcagtcattttttgaacaaatattgagtttttactgtgtgttagacatcattgtaaaaattgggaatacagtaatgaaagaagtcacttcttatggagtgaaccttctagggagagatagctagtactgtaagatatttagtcttttaggacataataaatgctattaataatagtgttattaatatgtacataataaacatacagaaaacaataaaacatgcgactaaggaatatgcagattttggggtgaaagggttgttggaatttgaaatagggtggtcagggaaggcctcacctggaaagtaccatttgagcaaagatttgaaacaggggagggcattagccatggggatttttatgggaagggactaccgcaggcaaagggaggagcaggtgtagtggccctgaggtggctctatgcctggatgttccaggaacagtaaaaaggccaatacagctgtctgaataaatgttaatctccttccctccactaattacttttttctctttttctatttttgagcttctactataagccaggcattgtgatatatgttggggttaaaacggtgagcaaaactagacttgactcctgccatcatgaaacatattacctagtagataaggcagacattatgtagaggatcatacaaatacatgtaaactaatagccataagaagaatatgatgctcagacaccagataattgacttcgtcaaagagatcaagctgagcccctcagttgtactctttggtctagaggctcttttttaccctctccagggaatgaaccttcaattttttgccaagttagatgattattctcccctacctcaacagaaattaattattaggcaaaaatcaaagcaaagattacccagagagataagcacaatactggaataacttctagaatcacttcattggcaaatctcttcaccaatgccttccactgggcagattgtttttctaggagacatattaagagtgttgcctttcaaaggctttggctttatgtggcggggtgagcagaaagggttcctgattcagctttctaccttttttttggactctcctttgtctttcaaaatttgcgctcagggtttataaaaactaggttctagagtgccagggagtagtagatgccttgaaacaaacacaagccccaccttttgcttacccttgtatattggcactttctctttgtttttgaccttttgtagtttctcttttatagactatttagtcatgctttaaaaaagtttttctattttctactgtagttttaggtgttctgtaccaggaagtttttctgcaaatcaagttagccatattgcactgttggtgtgtctgttttaaagttgtaacagatggggccgggtgctgtggctcacgcctgtaatcccatcactttgggagactgaggccggcagatcacatgaggtcaggagttcgagtccagcctggccaacttggtgaaaccttgtctctattaaaaattaaaaaattagctgggcgtagtggtaggcgcctgtagtcccagctactcgggaggctgaggcaggattatcacttgaacccaggaggcagaggttgcagtgaggcactgcactccagtctggccgacagagcgagactctacctcaaaaataaataaataaaataaaattataacagtatcagctctttctgtatcttgtttttttccatccaacattattttcaagatcttttcaggtagtgatagacagaaaagttaatctaatttattcattttatcactctcacatgttcctttaatatgactgccatattctatttattggtggatctttagactgaagttcttttgtgttatgaatagttttgccttgaaatgaaatgtttgcactgagcaagaggttttttaggttccttatttaagtagttacatgatagacacatttttatcttacacgtggcagtcagaatttacatttatgggctagacacactgactcatacctgtaattgcagcactctgagagtccatgatgggcagatcacttaagcccagaagttcaagaccagcctgggcaacatggcgaaacctcgtctctacaaaaaaatacaaaaattagctgggtgtggtggagtgtgcctgtagtctcagctacttgggagactgaggtgagatcacttgagtctgggaggttgaggcttgctgtgagccaagatcactccagtgcactctagcctgggcaacaaaacgagaacctatctcaaaaaaagaaaaaaaaaaaagaaattacatttatgtcatcaatggaagagagtgccatttttttatccctctttccatattagatgtcagagtttattagaaaagattaaaaaatggtatttcattttatttttttggacagctaccatgtttaaaaatttgtttaaatgcttatttgatcatttggtatctttctttttcatagtagattcatttttaataatgaaataaactagaaatattctacatgtatatgacctggaggttggttctatatagcattgtaaaccaccagtagaatagtgtgcaataattaaatagcttgggtacatgtacatttattgacatggaaaaatattcaaaatatattgttaataaaacagagcagtttgtattatggctaagagtaaatgctagggagtcagttggcttgggttcacagcctaattcagccttttgactgagtggccttagacaaatcacttaatttttaaaaaaaattagttttttaaattgacaaaaaattgtatttatttatcatgtacaatatattttgaaatatgtatacattgtgaaatggcttaactgagcaaattaatatgcattacctcacattcttaacatttttgtggtgataacaattaaaatgtattctctgaacagttttcaaggatacaacagtgttattaactagcaacaccatgttgtacaatagatctcttgaaattattcctcctaacagaaactgtatatactttgatgagtatctccccatccaccccacccactgtgtccccacatcccctagtaaccatcattgtctttctacttctataagttcacctcttttgtttttttgatggagtctcactctgtctcccatgctggagtgcagtggtgcaatctcagctcactgcaagctccccctcccgggttcacgccatttttctgcctctgcctccctagtagctgggactgcaggcacccgccaccacacccggctaattttttgtatttttagtaaagacggggtttcaccgtgttagccaggatggtctcgatttcctgacctcgtgatctgcccacctcggcctcccaaagtgctgggattacaggcatgagccaccgtgcccggcctgtaagttcaactttttaacacaccacttgtaagtgagattatgtggtgtttgtctttctatgcctgtcttactttccttaatataatgttttccaggtacatccatgttgttacaaatgacaggatttctctcttttatggggctgaatagcattccattgtgtatatataccacattttctatccattcatccattgatggatacttaggttgattccatatcttggctattgtgaacaatgcagcaatggccataggagtcctgatctctcttcactactgatttcatttcctttggatatatacccagtattgggattgcaggatcatatggtagttttattttttgagaaactttcatactgtaatgcttatactaattacatttccaccaacagtatacaaaggattcccttttcttcacatttttttttaacacttttatcttttcaataatggccattctaacaggtcataatttattttggtttccatttgcatttttctgatgattagtaatgttgagcattttttatatacctcttggcaatttgtgtgtcttctttttggaaatgtctattcagatcctttgtccaattcttaaaaaacgattatttttaaaattcattttattatttagagacagagtctcaatatgttgcccaggctgtacttggactcctaggctcaagaattctcctgcctcaacctctgaagtaattgagactgtgggcatacgccactgcatcctgctcttttgcccattttttttttaatggggttgttttcttattgagtttcttatatattttggatattaaccttttatctgatacatgatttggatatattttctcccattccataggttgtctcttcactctgctgattgtttccttggctgtgcagaaagtttttagtttgatataatcccattcatgtatttttgcttttgttttctgtgcttctgggtttatgtccaaaaaaccattccccagaccaatgtcatggagtttttcctctgtttttttctaggacttttgcagtttcaaatgttaaatttaagcctttaatacattttgatattcattcttctagccaatgagcctggaatgtttttccatttgtttgtaccttctctgatttctttgagcagtgttttgtagttttcattgtagagatctttcacctccctggttgactgtatttccaggtattttattctttttatggcaattgtgaatgaggttgcattcctgatttgcctctagacttgactactgcccaaagcaatttatatatttaatgctaatcctgtcaaacttccagtgacattctttgcagagctagaaaaagctcttttaaaattcctatggaacccaaaaagaccccaaatagctaaggctatcctaagcaaaaagaagaaagcaggtggtatcatgctacctgacttcaaactgtattaaagggctacagtaaccaaaacagcatggtattggtagaaaaacagacacatagaccaatggaacagaatacagagcccagaaataagaccacacaccaacaaccatctgatcttcaacaaagctgatgaaaacaagcaatggggaaaggattccctattcaataaatagtgctgggataactggctaaccatgtgcagaagattgaaaccggacctcttccttaaactacatacaaaaatcaactcaagatgagggacttacatataaaacccaaaactggaaaaaccctggaagacaacctaggcaataccattctggacacaggcatgggcaacgatttcatgatgaagatgccaaaagcaattgcaacaaaagcaaaaattgacaaatgggatctaattaaactagagagcttctacacagcaaacaaaactatcaacagagtaaacagacaacctacagcataggagaaaatttttgcaaactatacatctgacaaaggtctgatatctagtatctataaagaacttagacagatttacaagaaaaaatcccattaagaagtaggcaaaaagctgggcatggtggcttactcatgtaatctgagtactttgggaggctgaggcaggcggatcacttgaggtcaggagttgaagaccagcctgggcaacatggtgaaaccccatctctactagaaatacaaaacattagccgggcatgggggcagacgcctgtaatcccagctactcgggagactgaggcaggagaatcacttgaacctgggaggcagaggttgcagtgagctgagatcacaccactgcaccacagcccaggcaacaagagtgaaacaccatctcagaaaaaaaaaaacctaaaaaaaagaagtgggtaaaggacatgaacagacacttttcaaaagaagacatacatgtggccaacaagcatatgaaaaaaagctcaacatcactgatcattaaaaattgcaagtcaaaaccacaataagatatcatctcacaccagcagaatggctataattaaaaaatcaaaaagtaacagtggctcacgcctataatcccagcactttgggaggccaaggtgggtggatcacttgaggtcaggattttgagaccaacctggccaacatggtgaaaccccatctctactaaaattacaaaaattagccgggtgtggtggcatgcacctgtattcccagccacttgggaggctgaggcattagaatcacttgaacccgagaggcagagattgcagtaagctgagattacaccactgcactccagcctgtgtgatggagcgagactctgtctcaaaagaaaaaacaaaagaggtactggcaaggctgtggagaagaaggaacatttatacactgttgggggagtgtaaattagttcaaccattgtgtaaagcagtgtggagattccttgaagacctaaaaacagaactaccatttgacccagcaatcccattattgggtatatatccaaaggaatataaatcattctatcataaagacacatgcatgtgtaggtttattgcagtgctattgacagaagcaaagatttggaatcaacctaaatggccattaatgatagactggataaagaaaatgtggtacatatacatcatggaatactctacagccgtaaaaaagaacgagatcatgtcctttgcaggaaaaggaactagagaccattatccttagcaaactaatgcaggaacagaaaaccagataccacatgttctcacttataagtgggagctaaatgatgagaacaaatggacacatagagggaaataacaggtactggggcctactgaagggtgacgggtgggaggagggagaggatcaggaagaataactaatgggcacttggcttaataccggggtgacaaaataatctgtacagctgggcgctgtggctaatgcctgtaatcccagcactttgggaggctgaggcaggcagatggcctgaggtcgggagtttgagaccagcctggccaacatggtgaaaccccatctctactaaaaatacacaaattagccaggccatggtggcatgtgcctgtaatcccagctacttgagaggctgaggtgggagaatcacttgaacccaggaggtggaggttgcagtaagctgaagtcacgccattgcgttccagtctgggggatagcgacagagcgagaccctgtctcaaaaaaaaaaaaaaagaatctgtacaacaaacccctatgacatgaatttacctgtgtaacaaacctgcacatatacccctgaacttaaaagttcaaaagaaaaaaatccattttgagttgatttttgtaaaagggataagggtctaatttcatttttctgcaggtagatacccagttgtccaacatttattgattagactgttctttccccattaggtgttttttgtatcttttttcaaaaccaattgcctgtaaatttgtggatatatatcttggttctcaattctgttccactggtctatccgtatgtttttatgctagtactatgctatttggattaccatagttttgtagtatagtttgaagttaggtagtgtgatgcctccagctttgttcattttgctcaagattgtttttgctgtttggggtctgttgtagttccatataaattttaaaattgttttttctatttctgtcaaaaatggcactggaattttgataggaatagcattgaatctgtatattgctttggataatatggacattttaacaatattaattcttccagttcatcaatatgggataactttccgtatacttgtgtcttctttaatttcttttatccatgttttatagttttcagtgtgcagatctttcatcttcttggttaaatttatttgtaaaaattttttgtttttatagctattgtaaatgggattgttttctggattactttttcagattgtttttagtgcattgaaatgatactgatttttgtattttgatttttgtatcttgccactttacacaatttgtttattcttacagtttttggtggcgtctttatggttttctgtatataagaacatgttatctgtaaacaggaacattttcacttatttctttccaatttggatgccttttgtttctttttcttacctaaccactctggctacaccttctagtactatgttgaatagaagtgggaagagtgagcatccttgtcttgttcctgatcttaaagggaaatctttcaactttttcactattgagtatgatgttagctgtgagtttgtcatatatggcctttctcatgttgaagtatttttttatatctaatgtgttgacaattattataatgagaggatatttaattttgtcagatgtttttttctgtgtctttagagatgatcatagtgttttgtccttcattctgttatgtgccatgttttgtttatagatttgcatatgctgaaccatccctggtatgaatctgactttatcatcatgagtgatccttttaatgtgctgtttaatttggtttcctagtattttgttgaggaattttgcatatgtgttcattatggatattgtcctctaattttttttttcttgtagtgtcctagtgtggctttggaatccgggtcatggttgtttcataaaatgagtttggaagtattcccttttcatttttttggaagagttcttagtgcatacagaacattcgtcaagatagatcatatgttagcccacaaaacaagtcttaacaaatttaagaagattgaaatcatactgagtatcttttctgattacagtggtatgaaactagaaatctgtaacaggaagaatttggaaaattaacaaacacgtggaaattaaccaacggttcgaagaagaaattaaaaggaaatttaaaaaaaccttaaaaaatatggaagtacaacataccacaacttatgggatagagcaaaagcaattctaagaggaaagcttatagcaataaacacctacattgaaagaaaaaaagatctttaataaacttaacattacaccaaaagaaactaggaaaagaacacactaagcccaaacttagcagaaggaagagaataataaagatgagagcagaaataaatgaaatagagactaaaaaaacaatagcaaagatcaatgaagctaagagttggctttttgaaaagataaacaaaatcaacaaacctttaggtaaaagtaagaaaaaagagaagcctcaaaaaaaaaaaaaaagaaatgaaaaaggatacattataactaataccacagaaataaaacaggtcataaaagactactatgaacaatttgtatgccaacaaattggataacctagaagaaatggataaattccttgacacgtactatctaccaagactacatcatgaagaaataggaactctgaatagaccaataagaaataaggacattgaatcagtaataaaaagtcttttattaaagaaaagcccaggacctgatggctttactgctgaattctaccaaacatttaaagaactaataccaatccttctcaaactcttccaaaagcatgcagaagggggaacactttccagctcattttatgaagccagtaggtaagtattctcctcatagactttctattcatatccttttcttattttactgttgagttgtttttgtctcttgtttttgctgtgagacaggctctcactctgtcgcccaggctggagtgcagtggcacaatcattgttcactgcaacctcgacctccccaggcttaggtgatttttacctcagcctcccaagtagctgggactacaggtacgtaccaccatgcccagctaattcttttatttttttatagagacagggtttctccatgttgcccaggctggtcttgaactcctgggcccaagggatctgcctgcctcggtctcccaaagtgctgggattacaggcatgaaccactatgtctgacctctttcttatttggaatatttctatatgtattttagatattctctttgttataaattttgttggtactgtaagggaggcaaaattttacctccacccttttagggtttttggctgggcctgagaattaaattgacataaggcagatcaacaggagaaaatcatacaaatttaataggagtattacatggcacaggaatatgtataaggaaatgaagaccaaaagacaagttagagttgaacacttacatactgaatcggagaaagagtagtaaaatgaaaatgtgggccgggcatggtggctcacgcctgtaatcccagcactttgggaggccaaggtgggtggatcactaggtcaggagatcgacaccattctggctaacacggtgaaaccccatctttactaaaaatacaagagaattagccgggtgtggtggcaggcgcctgtagttccagctacttgggaggctgaggcaggagaatggtgtgaacccgggaggcagagcttgcagtgagatcgcaccactgcactccagcctgggagacagagactccgtctccaaaaaaaaaaaaaaaaaaaaaaaaatgacaaggcaaaggaacttgggtgtttaattggatggagtagtggccaggaaataaagattagtttaataaggtttgtatagatttccctggacctcagtttacactccttgatgataagaccgttacttgtataaagagggtatctttcacatgggaattttgtcttctgttttgaagaaacggaaggaagttcatagtgatcatcttgcacctgctgtttttcgagtacttttagcctagattttcattttaccaggtggcataatttgggggtggagtgatcttaattatttcagtatcttctagttttacctacaagttttagcttttctccattttacctactttcactggatgcatttcccttacattcttctacctgcatttatgtgagataccattctactgagtcttaaatccagtatgatcatctttaccttgatgtccctgtactgtttccacatcatttttttttgagatggagtctctcccacatcaatttttaaaatagagcacattgtttgctttttcaactgaccttcccgttcatattcttagtcgtattggcatgtgccattgttcactcagtaacttaagctagataccctatttttattttaatttattcttctttggtagtgtgaggaagtagtactaaggtaaatgatggattatgagaatattgaataaatagactagctaagggttaaaccttggtgaccatacactggaaaataatgagagaggaattgaggcaatttttcagaatcagtattgtatagtgattggaggctgttattctggaatcagactatattcaaatcacctcctttcatttatttatgacttacttttaaagaaataagtagattttttcaacaagctaagtgaaatataccctgaaaaacatttaaccctcattgtaagaattttcacatactgaaatattcaatccaagtcagtttttcttcaggatttgtttacgtagcagtcactcagtgtctctttctacttgctaattttctacttgctaattcacttaattcagtgtgaaagttcagactctgggtgggaaagaagaggtgagttgcaactgagattttcacagttcttgtatgtgtgtgcacatgtgtagtggtgtggtaggttgcagttcagttttatttcaactttccacataagagttagcttaggcatcctcaactgtgctctgacttccaagcagtatgaaacaacatacctatatgtctgcgggtgcattcgtgagtagcatatagtaattaaaagtagatagagttggttgtatatatccatgacgtatattttttatcctgtgtttgagctctatttagatttctcttttggtttttgttttgttttgtgttttttttgtttgtttgtttgtttttgagacagagtctcactctgtcacccaggctggagtgcagtggcacaatctccgctcactgtaaactccgcctcctgggttcatgccattctcttgcctcagcctcctgagtagctggactacaggcacccaccaccacgcctagctaattttttgtatttttaggagagacggggtttcaccatgttagccaggatggtctcgatctcctgacttcgtgatccacccgcctcggcctcccaaagtgctaaaattacaggcgtgaaccaccacgtaagtttttaattctctgaagtttgagaacatgagtcttaaagtataattcttacagctgaatttgactacagtaaaacttttgaatacctagtagagttgttagtctgtctaatggcatatttgttttttctcaactgttaaagtgggagaaaagaaaagacatattgaaatactctttaagttttaggtttttagcatgttttttgagggggaaaattttttagcttgaattatataatgcctctctagcagttatatactgctaaagattttttttttttaattctagggtatatgtgcacaacgtgcaggtttgttacatatgtacacatgtgccatgttggtgtgctgcacccattaactcgtcatttacattaggtacatctcctaatgctatccctccccgctccccccaccccacgacaggccccagtttgtgatgttccccttcctgtgtccatgtgttctcattgttcagttcccacctatgagtcagatcatgcagcgtttggttttctgtccttgagatagtttgctcggaatgatggtttccagcttcatccatgtccctacaaaggacatgaactcatccttttttatggctgcatagtattccatggtgtatatgtgccatattttcttaatccagtctatcattcttggacatttgggttggttccaagtctttgctattgtgaatagtgtcgcaataaacatacgtgtgcgtgtgtcttcgtagcagtatgatttataatcctttgggtatatacccagtaatgggatggctgggtcaaatggtatttctagttctagatccctgaggaatcaccacactgacttccacaatgaatgaactagtttacagtcccaccaacagtgtaaaagtgttcctatttctccacatcctctccagcaccttttgtttcctgactttttaataatggccattctaactggtgtgagatggtatctcatcgtggttttgatttgcatttctctgatggccagtgatgatgagcattttttcttgtgtcttttgggtgcataaatatcttcttttgagaagtatctgttcatatcctttgtgcactttttgatggggttgtttgatttgttcttgtaaattttttttaagttctttgtagattctggaattagccctttgtcagatgggtagattgcaaaaattttctcccattctgtaggttgcctgtttactctgatggtagtttcttttgctgtgcagaagctctttagtttagttagatcccatttatcaattttggctggtgttttagtcatgaagtccttgctcatgcctatgtcctgaatggtattgcctaggttttcttgtagggtttttatggttttaggtctaacattcaagtctttaatccatcttgaattaatttttgtataaggtgtaaggaagggatccagtttcagctttctacatatggctagccagttttcccagcaccatttattaaatagggaatcttttcccgatttcttgtttttgtcaggtttgtcaaagatcagatggttgtagatgtgtgatattatttctgagggctctgttctgttccattgatctatatctctgttttggtaccactaccatgctgttttggttactgtagccttgtagtatagtttgaagtcaggaagcgtgatgcctccagctttgttcttcttgcttaggattgtcttggcaatgtgggctcttttttggttccatatgaattttaaagtagttttttccaattctgtgaagaaagtcattggtagcttcatggggatggcattaaatctataaattaccttggacagtatggccattttcaccatattgattcttcctgtccatgagcatggaatgttcttccatttgtctgtgtcctcttttatttcattgagcagtggtttgtagttctccttgaagaggtccttcacatcccttgtaagttgggttcctaggtattttattctctttgtagcaattgtgaatgagagttcactcatgatttggctctctgtctgtgattggtgtataagaatgcttgtgagttttgcacattgattttgtatcctgagactgctgaagttgcttatcagcttaaggagattttgggctgagacgatggggttttctaaatatacaataatgtcatctgcaaacagggacaatttgacttcttcttttcctaaatgaataccctttatttctttctcctgcctgattgccctggccagaacttccaacactatgttgactaggagtggtgagagagggcatccctgtcttgtgcaagttttcaaagggaatgcttccagtttttgcccattcagtatgatattggctgtggctttgtcataattagctcttattattttgagatacttcccatcagtacctagtttattgagagtttttagcctgaagggctgttgaattttgtggaaggccttttctgcatctgttgagataatcatgtggtttttgtctttggttctgtttatatgatggactacatttattgatttgtgtatgttgaaccaggctttcatcccagggatgaagcccacttgatcttagtggataagcttttagatgtgctgctggatttagtttgccagtattttattgaggattttcgcatggatgttcatcagggatattggtctaaaattctctttttttgttgtgtctctgccaggctttggtatcaggatgatgctggcctcataaaatgagttagggatgattccctctttttctgttaattggaatagtttcagaaagaatggtaccagctcctctttgtacctctggtagaatttagctgtgaatccatctggtcctggaatttttttggttggtaggctattaattattgcctcaatttcagagcctgttattggtctattcagggattcaacttcttcctggtttagtcttgggagggtatatgtgtccaggaattgatccatttcttctagattttctagttcatttgcatagaggtgtttatagtattgtctgatgatagtttgtatttctgtgggattggtggtgatatcccctttatcgttttttattgtggctatttgattcttctctcttttcttctttattagtcttactagtggtccatcaattttgttgatcctttcaaaaaaacagctcctgggttcattgattttttggagggttttttgtgtctctatttccttcagttgtgctctgatcttagctatttcttgccttctgctagcttttgaatgtgtttgctcttgcttctgtagttcttttaattgtgatgttagggtgtcgattttagatctttcctgctttctcttgtgggcaattagtgctataaatttccctctacacactgctttaaatgtgtcccagagattctggtgtgttgtgtctttgttcttattggtttcaaagaacatctttatttctgccttcattttgttatgtaccagtagtcattcaggagcaggttgttcagtttccatgtagttgagtggttttgagtgagtttcttaatcctgagttctagtttgattgcactgtggtctgagagacagtctgttagaatttctgttcttttacatttgctaaggagtgctttacttccaacttagtggtcaattttggaataagtgcggtgtggtgctgagaagaatgtatattctgttgatttggggtggagagttctgtagatgtctattaggtccgcttggtgcagagctgagttgaattcctggatatccttattaactttctgtcttgttgatctatctaatgttgacagtggggtgttaaagtctcccattattactgtgtgggagtctaagtctcttgataggtctctaaggacttgctatatgaatctgggtgctcctgtattgtgtgcatatatatttaggatagttagctcttcttgttgaattgatccctttaccattatgcaatggccttctttgtctgttttgatttttgttggtttaaagtctgttttatcagagactaggattgcaacccctgcttttttttttgttttccatttgcttggtagatcttcctccatccctttattttgagcctatatgtgtctctgcatgtgagatgggtctcctgaatacagcacactgatgggtcttgactctttatccaatttgccagtctgtgtcttttaattggagcatttagcccatttacatttgagtttaatattgttatgtgtgaatttgatcctgtcattatgatgttagcgggttattttgctcgttagttgatgcagtttcttcctagccttgatggtctttaaaatttggcatgtttttgcagtggctggtaccagtttttcctttccatgtttagtacttccttcaggagctcttgtaaggcaggtctggtggtgacaaaatctctcagcatttgcttgtctgtaaaggattttatttctccttcacttatgaagcttagtttggctggctatgaaattctgggttgaaaattcttttctttaagaatgttgaatattggcccccactgtcttctggcttgtagcgtttctgccgagagatctgctgttagtctgatgggcttccctttgtgagtaacctgacctttctctctggctgcccttaacattttttccttcagttcaactttggtgaatctgataattatgtgtcttggagttggtcttctcgaggagtatctttgtggagttctctgtatttcctgaatttgaatgttggcctgccctgctaggttggggaagttctcctggataatatcctgcagagtgttttccaacttggttccattctccccgtcactttcaggtacaccaatcagatgtaaatttggtcttttcatatagtcccatatttcttggaggctttgtttgtttctttttactcttttttctctaaacttgtcttctcgcttcatttcattaatttgatcttcaatcactgataccctttcttccacttgatgaatcagccactgaagcttgtgcatgcatctcatagttctcgtgccatggttttcagctccatcaggtcatttaaggtattctctaccctgtttattctagttagctaatcgtctaatcttttttcaagtttttaccttctttgcaatgggtttaaacatcctcctttagctcagataagtttgttattaccaatcgtctgaagtcttcttctctcaactcgtcaaagtcattctctgtccagctttgttccattgctggtgaggagctgcattcctttggaggagaagaggcactctgctttttagaatatttggcttttctgctctggtttctccccatctttgtggttttatctacctttggtctttgatgaaggtgacgtacagatgaggtttggtgtggatgtcctttctgtttgttagttttccttctaacagtcaggaacctcagctgcaggtgtgttggagtttgctggaggtccactccagactctgtttgcctgggtatcaccagtggaggctgcagaacagcaaatattgcagaacggcaaatgttgctgcctgatccttcctctggaagtttcgtctcagagggacacccggccgtatgaggtgtcagtcggcccctactgggaggtgcctcccacttaggctacttggtgttcagggacctacttgaggaggcagtctgtccgttctcagatctcaaactccatgctgggagaaccactactctcttcaaagctgccagacaggatgtttaagtctgcagaagtttctgctgccttttgttcagctatgccccgccctcagaggtggagtgtacagaggcaggcgggcctccttgagctgtggtgggttccacccagtttgagcttccaggccactttgtttacctactgaagcctcagcaatggcagacgccccccacccccagctgccttgcagttcgatctcagactaatgtgctagcagtgagtgaggctcttgtgggcgtgggaccctcttagcaaggagcaggatataatctgctggtgtgccgtttgctaagaccattggaaaagcacagtattagggtgggagtgtcccgattttccaggtaccatctgtcatggcttcccttggctaggaaagggaattccccgaccccttgcgcttcccgggtgagatgatgccctgccctgcttcagctcatgctctgtgcgctgcacccactgtctgacaagccccaatgagatgaacccggtacctcagttggaaatgcagaaatcactcatcttctgcgtcgctcatactgggagctgtagactgtagctgttcctatttggccatcttggaacctcctcctaaaaatgtaacctttatagattcattgaggacttttgacgtcattatatggcgaatgtatatgacttcattaggaggcaactaatattttggctttctttctttggaattagcttcttagtttgcatctgactgacaatcgtgttaatagaggctattttttttttgccttaaattgtcttattgagaaacttacaatattccattgcataaaacagatgaaggtattaattttatacctttatggaaagcaattacagtacctgtgattgactgtcagatttgaaaatgatgtaactgtgatctaacaagaagaaacaggtttttaaaattgtattgcattttatcaccactctttcccctcaaaacaatgattttactttaaataggagaagagaaaggaaattgacatttttgattacctatcatttgtcaggtgttatttaatctgtgtaatctcattttataaccaaggaaactgactcaggggtttcagtatcttactcaaggtcacatagcccattagtgctcttaagtagacctatcttttctttaatgacaacaaaatgtctagtcaattaaaaatgtaaagtttatttaaaattttgagttattagaaaaatatgatataatgtacaaagtacgaatgctctggaaaatatgtaactcttgattttctcattttattcttgtgcaatacaatccttcttatgtccatcagagaattaaagtggtgaacattttgaacttccttcatatattagccagctggcatgttttcctagcaaaatattttctgatttgaccacagactctctcaatcagttgttactggtttgaataatagaatatgctgtcatggtgggcacctgatcatgaaaactgatatctggagtgcatttttatttggatttaaaatgtttttacaatcccagtataaacactgttaatctagtcaaaactttttctcacaagatcaagagcttgcatagttttactttaactagttatagtcaaaagggtaagaataagttgtgcatttacattacacaaaatcttattttaaacatgaaggatgtcagactaaaaatagtgttaggaatttttgagataaaacagtttagttttaaaactctaaataactggatttatttaatttacatagcatttggaaattttctgatgtgtaacctttgtggggttggggagtaagtgtacagtttttggtacaatgctggaaaattacaaatatgtcctacatttggagaatagatccaatgtttgagagttactgatttttttgtttttggttattcattgaactagtttcatgaaatagaattaatttccattttcatgacacaacaggcccctgcactaaggacaatgaggataatttttttagttgtgtttgtatagatgagtaaagagctgcttattttaaggcagtttggacacttagtcttaaatgtggatagtaagtactaccagtggctaattattataggaagtataaaaatgtagatttaaaagggtcaaatatatagaaaataatatttaggagtacttgatttctttctgtttttgttgtgtaaagtttatattgtagtttagttctagtgaactatagttgtacttgaatacccacccatcttcaaatgcaatgagttgacagatcttggtgttagtggaaactactaaaatattaaaggaacttaactatagaagacagcaatgtattacatttcataaatcatatctggatacttaaaaatatttagtactcatggtgtattaaaaaggagtagttagaatttaatttttgctgaattagggctggcagcttttggaaggcatcattattaatttctagaatattaatggagcagaatggaatcaataaaaaaaaccttcaacttgttcactgagagaatttattatgcagatgttgaagaagactttaaagaaagcattatagttagataaaatattagcatgcaaacatgttggtaacattagtggatctctaagcaactatatgtcactgtagccaggttataatctgttttatttctcgtgggatagatagaaattctgtcaaaaaagagaaagaaaaagaataattttgcctgattactaacatctgacaacttatagaaagaaacctgtgtctttttagcacttgtttgttacagtttcatgtgtccatgagctgagaagaatcaaaattaatctctggctcaaggttttacacttgatcttagccaaaaggccgagaagcaatggctcaaggttttagcactgatgttttgctttcctagtaatagtaatgaaacataattttattgcttcaaagagaataaaatacctaggaacccaacttacaaaggatgtgaaggacctcttcaaggagaactacaaaccactgctcaatgaaataaaagaggatacaaagaaatggaagaacattccatgctcatgggtaggaagaatcaatatggtgaaaatggccatactgcccaaggtaatttatagattcaatgccatccccatcaagccaccaatggctttcttcacagaattggaaaaaaattactttaaagttcatatggaaccaaaaaagaacccgcatcaccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcggaaataatgccacatatctacaactatctgatctttgacaaacctgagaaaaacaagcaatagggaaaggattccctatttaataaatggtgctgggaaaactggctagccatatgtagaaagctgaaactggatcccttccttacaccttatataaaaattaattctagatggattaaagacttaaacgttagacctaaaaccataaaaaccctagaagaaaacctaggcattaccattcaggacataggcatgagcaaggacttcatgtctaaaacaccaaaagcaatggcaacaaaagccaaaattgacaaatgggatctaattaaactaaagagcttctgcacagcaaaagaaactaccgtcagagtgaacaggcaacctacaaaatgggagaaaatttccgcaacctactcatctgacaaagggctaatatccagagtctacaatgaactcaaacaaatttgcaagaaaaaaacaaacaaccccatcaaaaagtgggcaaaggacatgaacagacacttctcaaaagaagacatttatgcagccaaaaaacacatgaaaaaatgctcaccgtcactggccatcagagaaatgcaaatcaaaaccacaatgagataccatctcacaccagttagaatggcaatcattaaaaagtcaggatacaacacgtgctggagaggatgtggaaaaataggaacacttttacactgttggtgggactgtaaactagttcaaccattgtggaagtcagtgtggctattcctcggatctagaactagaaataccatttgacccagccatcccattgctgggtatatacccaagggactataaatcatgctgctgtaaagacacatgcacacatatgtttattctggcactattcacaatagcaaagacttggaaccaacccaaatgtccaacaatgatagactggattaagaaaatgtggcacatatacaccatggaatactatgcagccatgaaaaatgatgagttcatgtcctttgtagggacatggatgaaattggaaatcatcattctcagtaaactatcgcaaggacaaaaaaccaaacaccgcatgttctcaatcatagatggaattgaacaatgagaacacatggacacaggaaggggaacatcacactctggggactcttgtggggtggggggaggggtgagggatagcattaggagatatacctaatgctaaatgacgagttaatgggtgcggcgcaccagcatggcatatgtatacatatgtaactaacctgcacattgtgcacatgtaccctaaaacttaaagtataataataataaaataaaaaaaattaatctttatgaccatatttttagactaaacccttggaatattgtgttatatgggaattcactatggcaatgagaattttaaatacgagattaaaaatagattcgccaaaagaacgaaaaggaactaaaaagaatcaaaattttcccccatcaatagtacttaagtatagtttactgcccacccatccatccattttgggtagaagaaatttgacgaatttcaagaaatgtaacagcggctatgtatttaccagttttatcatgtgcaaacttgccttagttgttcatattttataaaatcatgaaaacctttttcttttatatctggtttccaaaattgtctcatagttcaacttgggtgttctcttcaaacccacaaaaattgaatgtagactttaccaaaatttaatttgtatttcttatctcagttataagttattgaatattctggtacccaactttattttttttttttttggcattatctttttcagcacagtggagaatttacagtctctctcagtgatgttttattgacatggaaatacttgctccatgagaaattgaacttaccagttgaaaacatggacgtgactgaccattatgaggacgttaggaagatttatgatgatttcttgaagaacagtaatatgttagatctgattgatgtttatcaaaaatgtagggctttgacttctaattgtgaaaattataacacagtatctcctgtaagtattttttaaacaattctattttaatcaaattaaaatttagctctatttattttgaattatagtatcaccagttatagtaacttggtaatgtttttgctttgtgaatcatgttaaaaatgggaaaatttagctacctgaaagctacttattacttgaaagaaagattttgtggtaaattttcttggacttgtgttattgttatttagttgctatacggatagcttcttattagatcaaaaatccctaacaaagaaattagtcccaaatgcctgatttctttttgaatcatgtcaaagattgcttttgtattcactttcttgatttaatgtgcatctgttcatttggcatatgttggataaatgattggtgtgactttttctatggattaataatgttattttactacatataggtatcatttattttatgaaaatagtattatgcaatatacatgagataatagactattctttttttgcacaagcatttttttaatggagtataaatgtaaaaattaaatggagtagtatcccttgcagtttggttttgtctacgttagaatttataaactgttttagaatatatttgggtgtatctagttatttttaaagtgttggaaatatttttagttatttgaacatttactgagtgccaataaagtagtagttaaatagtggcaataaataactgaagctggaattagaggaaaatgtttgctatattttgtaagataatcaattattttataaatatttcaatacaatacttgagaacagtgttttagccgattataatagaaacctccactacaatagttattgagagaaaaatagaagtataactcttttatgtaagatgtctaaagatatgcaaccaagactgatatgatagctccatggttatcagagacctggactttttctatcattctgctcgcccattttagtccttggttcctaccctctagaccattttatggtccaagatgactgttggagctccagccattatatccattatattggtattccttgtaccaagaactagtaaggaagaacagcactttgcttttctcttaagggtacatagctttttctttcatgtcattgccaaaaggttagtcacatggccacaacaagctgcaagggaggatggagaatatagatcttattctgggtaatatcttgccagaataaaaacaaaagctctattactagggaagaaagggagaatggatattggcaggcagcttgctgtctttgcctcattgaactatcataaaaacctttgccttgttacagcttcctcaaaacatatccgcacacatgtacaactacactatggtaaggatacttgtaaagatagctttttaaattcttccttagctatattttatttgcttgcttacagagatgatttttgtctatttttcacatagttgatttagagaggcttaatcatatatcagtactggattgtaggacaacaaagatcttaaaaaccagtgacagtataatctacctgaggtctttgggcgcattgttttccttctattcctcgcccttgtctaagtcctctaataagtttcctcatttgagtgggttaagttatagtatgatatatatcagggtacaagtttgaggttgtctctgtgggatactctctccaaatgtcatcgtgtcatcaggagtaaaattgaagctgctaagatggtagtacatgaagtagaaaatgttctgcattttaaccgtggaagatcaacaacttaatctctgatactattgtttgttctagggaaatttccagtgcggggaaaaagtagacaggaaaatatatccctagattgatttctcaaaaatgcactaagtataatcccaatttttgctgaaagtctctttcaaggtacatattagaatattccaaacagttttgaatgtcatgatcctgaattttcataatcctgataaagtttctttgtttcatatttgttgtagctgaaataaggtagggattatgaggaattaagataaagctaagtcagggcaattttgggaatgtggtcacttaaacagtgccccttccctcttcactccctacttacgattcctctcctaaggaaaatggattcagggcccatgggcatctcggagcatacaaggccttagattgtaactggagactaagtagagagatttgatacagggcttgctttctcatgaactgagcaagtatctggaagacaggatcagagacctggggtgaggagcagaaatggttaatcctgagaagagcttagcctcagagatctgtggacgtctttgggggaaggtcagcaaatgacctctgtaggtacgctcatattccctgaccctcaagccaagaagtagctgaatagatgggctcacttcttgttggtgaggcttgggagaacacaagactcttccttagcctcagcagatgactggtagcctgtttgtttgtccactgctgctctgtaagtatagatacaatttcaacttctattacttgtagaactgtcatcacttaagctacttcagcagtcagatctgagtcccaaaaagctaatgaagaaaacaacacaccatttaagggtttccagcagccagagaaggatgagttagctgcaacacacgtgcgtaacagaacagagctactggggggaatgacagcaacttgaatacgtataaatgttaggtacttgggaaaattcaagaatagcacctcaacataaaactatggatctggcaaaaaagaaggcagtgcacctgcgtgggcctgggtctgggtgggggtgccgcgggtgcttcatgatgctgggctctctgggatggggggatggcagagggtgctgcaactacccacggaagaatgcagctgaaggcataggtttttggctttaacttctttgtgatgagaaggccacccttgagaaagctcataaaatgtagcacctctgcagaaatggtccttagttggagcctgcggctgctgggagatgcatcaacatcagtgaatggggtcctttgggtgggtccctgatgcctgcacactttttaggaccttctgatctacctggcaggggtcaactatacagccaccttcagaaagaggaagcttgctgctgtctaggccagatctcttggctcctggggaagatccaccagtgtcagcctcattgactctggagcggcagaagggagagtccctcttagcatggagctggtccctaaacttcagattgcctgggattcccatcacggtccagaagaagagacgagacctgaagaagctggcagctgtcatgcggcaagtgagacaatgggaaagccacccgcttcagaacattgaagaagccacctggcaccaactcactgtccaagctgagaagaaggaaccagggacccaaggagcttcagtttaatataaaaccaggagcaaacctccgaagtccaggcatctcagagaaatgctttttttgtgtaccatggttaccaaatacagagctagattttatttttgtaaatatttgcatctcctgctttatcaaaaagttttcttttttcttcctaaaaaccaaagaatgcttttatttccaactgcatcccttgctctgctgcttcctcgctcctcttcctagatgttgggcaggtgggctgggtcttctcagggatgcagatgaaagcttgttgctagagtggaataaaaaagggcagcccctgttcgaaatctcagactggattgaaaaacacaggacataatatagtctaagtccatctaggatcttctgttttaagagacaggtgtaaagatttactctcaaactgcaggatgggtggaaagtattccagatcaaggttccagttctccctgggagcacccacatttcttttaaggtttctagcagagatgtaatgatgaaattactcacaaaagggattagatgcaggctggtagttgcagttactgggttactataaatttcgtgtattgatgttctacatatgtggtaagaatttatttactgtgtagtatgtttaaacatttgtaagttttatgagctagttcctcctgtgtaagctgacaattcaagttgttcactgttttcctgtgacagttattatctggttataaaattatcagataaaaataagagaaggttattactttttcaaatacaacatgaaagtataaaaaagcagactttcctttgtaattgcataacattgagataaatacttcagagtaatttcatctgatacttattaaaaatcattttcatgacgattaaaaaaaaaagggttcccaaccctttggtagatcaattcagaccaaaattagtttcttgaaaattaagcacaataaatatttaaagcacaaagaaaaatattaggtaaagaaatcatgaagtacttagtaattttccaagtagaagaacagtaaaacaaaaaaaaaaaaaaaggaaaaagaggagttaaacagaaacagatgcataagaggctataattaagtacataataatttgatataaatatatttgttataagacgtattttccttagctgaaacaaaagcagatagcaccgttattgtaggttggccttttgagatatcttttcaggttctttgcatgtctgacacccatggttccacctggacctacccagaagcaattcagcatgcaggacgacagctttgatcccctatgatatcatctctgcctccaccaatcagcagcaagcctagccacccctcactccttcttccaaattgcctttgaaaaccccctaacctatgagttttggatgagattggtttgaatactacctgtctcccacgtggcatggccagccttgtgcctattaaactcttttttgagacagggtatcactctggcgcccaggttggagtgcagtggtgtagtcgcagctcactgcagccttcctgggctcaagtgatcatcccacctgagcctcttgagcagctgggactacaggcacatgccaccatgcccagctaatgttttgcatctttcgcagagacagagtttcgttgtgttgcccaggctggtcttgaactcccgggctccagcaatccacctgctttggccacacaaagtgaggattacaggtgtgagccacggtacctgaccctaaactctttctttactgcagttatgtggtctttatttgtgtagcacacaggaagaacccatgggcaattacattatgaagtttaattatatgtattcttaatgattgctaacaactgtcaggtaatactctcaactgaaacatcaatgacactgagtagagctttatgtgaagtattttttatagtcagcatagcattttattagtaatactctatgttttctacagagtcaactactggattttctgtctggcaaacagtatgcagtaggtgatgaaactgatctttctataccaacatcaccaacaagtaaatacaaccgtgataatgaaaaggtactgataaactgtgagtaaattaaagcagactataatccctttcaaatcactgaatttggtggtaccttaaagttactaatgctttgtaaaaatttttttaacaaatctttagtatgtttaaaactgtattcgcaaagaataatacattggaggctggtgagaatgtgataaaagagtctttatggtttggggccaaggtaacaggcattgaacaaaaatagttatcattcaaagtatcaggaaagtaattgaaggtccagtttgtcagagttctttgactctctttggtaaacttcacatttactcttttagatggttcatccttgggagaatatgctcaactgaaaaatctggtctgtaccccttgcagtagtacagctcatatatcaggagtttggatgatagggtttgtcgtataaaccaccgaaaagtagtgccacatacaagtttggtttaatataatttacgttcagctgaatactatgctgggtacctaaacatatatggtaaccccactaaccatagtagtagtacttacgaaaacggggactaaactatgaccttttttctctcttgcccaaattcctatttaaggggcctggggagtcataccttctaaactgtaacatctcatcagatgggttttatttaaccctctataatgtggtttactttccagcctgactctggcataacatcacatgacagatagagaaggaaataaaaatattttaccccaaaatatgtttctttgccatattttgaaatggtcctacaaagctgtcttttgtggaggaaaatttgcgtttgtaaaggatatcaattaactaaatctttccccttccaggccctcccagtcctgaagagataactgagagtctagcaccttttaataggaagcatttgccatctattgtttctaagggtggccacctatgagacgtcatctacataataagaaccttggtcttcacaatcccatatcttaaaccagagactcctttctactgattccaggtctttagataataattctttcaaccaattgcttgccaatcagaaaatctttgaatctacctatgacctataagccccatttcaaggtgtcccacctttccaggctgaaccaatctttacctcacatgtactgattgatgtcttatgtctctctaaaacatatattacctcagctacttgggaggctgaggcaggggaattgcttgaaccagggaggtggaggttacagtgagctgagatcacaccactgcactccagcctgagtgacagaggaagactccatctcaaaaaaaaacaaaaacaaaacaaaaaaaccatatataaccaagctataacccaaccaccttgggcacatgttctcaggatctcttgagactatgcctcaggccattgagagacaggactagctggatttcctaggccgactaaggattcctaagcctagctgggaaggtgaccgcatccacctttaaacaagtggcttgcaacttagctcacactcaaccaatcaggtagtaaagacagctcactaaaatgctaattaggctaaaacaggaggtaaagaaatagccaatcatctatcgcctgagagcatggtggggggggggggcggggacaatgattggaatataaacccaggcattcgagcaggaacttcaacaccctttgggtcccctcccattttatgggagctctgttttcaccctattaaatcttgcaactgcacactcttctggtccgtgtttgttatggcttgagcagagcttttgctccagtccaccactgctgtctgtggctgttgcagacctgctgctgactttggtaggatgtccgctgtgctcctgatctagccaggcgctcattgctgctcccaagcggctaaaggcttgccattgttcctgcatggctaaatgcccaggttcatcctaatcgagctgaacactagtcgctgggttccacggttctcttccgtgacccacggcttctaatagagctataacactcactgcgtggccccagattccattccttggaatctgtgaggccaagaaccccaggtcagagaacaagaggcttgctgccatcttgaaagtggcccgccaccatcttgggagctctaagaacaaggacaccctgataacaccatgatcactcatatttggctcagaattaaccttccttttttttttttttttttttttttttttgagacggtgtctccttctgtcacccagactggagtgcagtggcgcaatctcggctcattggaagctccgcctcccgtgttcatgccattctccttcctcagcctcccgcgtagctgggactacaggtgcccaccaccacacccagctaattttttttttttgtatttttagtagagatggggtttcaccctgttagccaggttggtctcaatctcctgacctcgtgatccgcccaccttggcctcccaaagtgctgggattacaggtgtgagccactgcgcccggcccagaattaaccttaaatattttacggggcttaactcttggcaaagtttctgtgattaataaaatcaccattgacaagatgagaatttaagagtgttgaaaaaagtaaaattatattcaacatattttaattatttttgttttatttattttgcttattatttttttgaggcagaggcttactgtgttgcccaggctgaagtgcagtgtggcacgatctccacttactgcaaccactgcctcccaggttcaagcgatcctcccacctcagcctcccaagtagctgggattacaagcgtgcaccaccacgcctggctaagttttgtatttttagtagagaccaggttttactatgatggtcaggctggcttcgaactcctgacctcaagtgatctgcctgccttggtctcccaaagtgctgggattacaggcatgagacactgtgcccagccaacatattttagaaatatgatatgtaaatggtctagaatgcatttacttccaaaatcacctgttccagtaagttaacacatttggtgaatcaccttcatttttgacaaacattgctgaggtagattcttctatatgtcccatgttaaatagattgcacttaaaatatatattttatcagtgccctcaaatacttgtatgtctcttgtaatactcttgtatgtctcttgtaatactcttgtaatactctagatttaataaagtgttttatatgtgcatctgatattttttctgtcctatttgaaagtaagttgctgacatgtgggtccctggaattctttagcgtacatttcctaaaagtaatggcataaccgcaatataagaaataagaaaatttaaataagtattttaaaatatcatttactaacttccatatttaaatttctccatttgtccccaaaatggttttatatctccttagactcttttactccagaagaattcccctaatcttttttttttttaattttctgattaattccttgtggtattatttaacttgtttctctatttgctgtatttccaataaactggaagtgatatctgaaatcttgcttagattttggtttaatatttcctaagaaatacttcttaactgatgcagagtatttcattttatatcttattgggaaacaaactcaggttatcctgaattgccaggtctctccagtacaaagatgtagtttttcctttgctgtcagcaaagatctgtgaggtgacactttggcactgtataaataatcctgtttctcaataaccttttatctaatggttttaagcattgatgatcctgacttgaatcagttatttctgtagtatctatagaatagtgagcttctggccaggcacggtggctcacgcctgtaatcccagcactttgggaggctgaggcgagtggatcacaaggtcaggagatcgagaccatcctggctaacacggtgaaccctcgtctctactaaaaatacaaaaaagtagccaggtgtaatggtgggcgcctgtagtcccagctactctggaggctgaggcaggagaatggcgtgaacctgggaggcgggagcttgcagtgagccgagatggtgccactgcactccagcctgggagggagtgcgagactccatctcaaaaaaaaaaaaaaaaaaaaaaagaatagtgagcttctaattctgttatgtctttacattaattacttgccatttctcaataaagctttatcttatcaaatgagatgaagtacccttctctaaaaatctcagggtaactcctcaattctctaccaatttaggggttagtgtaatagttatatataatataagcaaattagatatttattcttttattgctctcctttttgtgtgtctattgtttggattcatgaatttatatttattcactgttttaaaatgagttacactcattaatctttgatgctaaaatagaggaagctgcttcaagcaggtttttgtgtcttttttacatgctctagtagacttttcaagcattttcctcttttctggtacaagaaaatatcccaagcccaccttgaatgtttcctgcccagacctggttccttttagagatttgtaactattttctcttgcttgaaattaatttttcacttacatttcctttcttttcccttgatgctccaaatcttgacaaagtgattgccaaattgcctgatcttttctcggtggcgcttaagcagtgtatttgtgtatcaaaagggtagattacttaaagatctcttttatctatcctgtatgtactacagggaggaaattataattgttatatttgtatttttaaagaggaatgaaccaatttgtatatgtgaaaagaattaagcttttagaacttcggcttataaagtttaaaggagtatctgtgactaaagattataagcatgtagtttcctgatttaaacaacactgatagtttcattgtgttaattctctaatttctaacttttgctttcttggattatattttctaatagaattttacctactagttcaactaatggatttgattttctgaggagtattaaattggcagccatcttcctaaccatgcttctgttacttgcagtttctaatttttctttttacaaggtctttttggaagtcagtgtatttcttttttcccctctgagacggagtttcactctgtcacccaggctggagtgcagtggtgtgatctcagctcactgcaacctccgcctcctgggttcaagcaattctcctgccttagcctcctgagcagctgggattacaggccgtgccaccacgcctggctaattttgtatttttagtagagacagggtttcaccatgttggccaggctggtcttgaactcctgatctcgtgatccacccacctcggcctcccaaagtgctggaattacaggcgtgagccaccgcacccagctggaagtcaatgtagctctaattaaaatcctaatgtgaatttttgggcttcagtcttgcagagaaatattttgaccatcaaatgtgtttactaatatgacaccagtcttcaagtaggtgaatggattgaatttgagaaacaatatttttgtttccttattttattttacttcattttatttttcctaaggtactaaaccattgcttttaaaattctgaagtaatgaagggaataatagaataaaggccagaaaaagaaaatcatcagttaaaaaaaaaaatctactaagtatcttagtttttgtccaactttttttttgtcagtatatataagcatttatgcattggcaaacaaaagttaaaaaaagaccctgtataaattgttaatcttctcagcttagaaaaactgactttcttcaaactgaggttgaatatctgcctctcagtaagaagagataggaaaagaaacttggaattatcagaaagcttaaataaaattgtccagcttctaaacaaacattgcaaatactttgtggtatggatataatcagtttattaaacaaataaacagaacagtatccttatttttggtgttttggtaaaggcttcaatcttgtggatgttttcaatttaggcccttgctcttggacatcataactatacttatgtggactgcttttccagggaacctctttaaaactcacttgtaaatacaagagcaaggaaaccataacagccatgttatctgaccataataagagggatagatttccaattgcagccatgagctaaaagaaacactctaactgtgaggactccaagatgtttttccctgaagtttgcccaacatcacagatcagaaggacaaaatttgctaaccttaaagagcaagttgtagatgtgagagcttaagccctggttttgtacccaattaggatcaggtatatacatatttgttaagttcttgttatttttgaacagcagaagcacagtgacatagagattgcattaagttaaatgtaggaaaagtttctgattacaatgtgaatgtcactttttctctgctttgattttcggtaaattgtgttattcttctcagatgtcaaaggaatacaaagaattgtgtcttagactattgcactgtgaagttaaaatggaaactcatattatagacttgtgtaatagaagtattgtgatttactgtgaaagtaaagataaaaggacatttgaaatatgagcagaggctgggcatggtggttaacgcctgtaatcccagcactttgggaggctgaggcaggcagatcacctgaggttaggagtttgacaccagcctgaccaacatggagaaatcccgtctctactaaaaatacaaaattagccaggcgtggcggcacatgcctgtaatctcagctacttgggaggctgaggcaggagaatcacttgaacttgggaggctgaggttgtggtgagccgagatcgtgtcattgcactccagcctgggcaacaagagggaaacatcatctcaaaaaaaaaaaatatatatataatcagaaaactatattatacattattttataaaattttaggagaagccttaaagcttatttttatttggttgtgacttagaatacctttctttgtaaggcaccataataaaaaatatggcatttattttatcccaggtaagtttttttttctttggagacagtctcattctgtcgctcaggctggagtgcagtagcattatcttggctcactgcaatctacacctcccaggttcaagtgattcttgtgccacagcctcccgagtagctgggattacaggtgtgtgccaccacgtccagctaatttttttgtatttttagtagagacagggtttcgctgtgttggccaggctggtcttgaactcttggtctcaagtgacccacctgccttggcctcctagtggtgggattacaggtgtgagccaccacacccagcctcaggtaagtttttcttaatagatttttaattttgaaatttttaaagagtcaaatttatgtattaatttttctttcattcatcattgaatgaaaactcattgagaacctattgacaaaaacagattgattacctactataatgcgagtcattctgttaggatctaaggacagatgatttgctctcatggaactcacaaagtaataggaggattaagaaacgttatcagaaagtggctaggcatggtggctcatgcctgtaatcccagcactttgggaggtcaaggcaggaggatcacttgagcccaggagttcaagattaggctgggcaacatagtgaaatattgtatccttaaaaaaatattaaaaagaaaagtatgcagagaattataatagggtgatatgcagagttatcacaggatggcaggaaagagaatacatgaatgtctactttagactggggaatcagggagcatctctgaaaaggtaacatttacttaatatgcaagaaaaaatctttctcatggttaatctttaaactttgttttcttgtaattaattttgcttaaattctatctcgagtccatatttaaggcaatgctttcctgtccagtgaagtttttcttttaaattgaccctgcctgcctcctactttttaataattgttttttgcatgggaacttaaacagtcaaaatatattatcttttgaatttattttaaggtgtatatgcttaacaactatctaagaggcttgctaaggatttgtaattttttattgctgccttttttagtttcttttatgcttcaaaaatttaacatgtgattagattgaatatgatgaaattttagttttaataagggaaatattttcttagcatttacagatgataaattccggggatattagttgtgactgaaattactgaaggatttttgaatttcatgtgttttgagtgggaatcgagtttagaattcgtgagtctgttatctgagggaataggcaagaatatgatttcaagtggacagtttgggaacaataagaattagaaacaggattctagagcagaaggtgggatcgaagtagttgagaaggcaaaaataggaagaaaattccatgcaaggaatttaattttgcgctgctcatggtggctcacacctgtattcccagcacttttggaggtcaaggcagaaggatcactggagcccaggagttcaacaccaacctgggcaacatagtgggaccttttctctacaaaaaataaaaacgttttgctgcttgtggtggcacatgcctgtaatcctagctaccggggaagctgaggcagaaggatcacttaagcctgggaggttgaggttacagtgtgccctgattgtgccactgcactccagcctaacagcaagaccctgtttctcaaaaaaagaaaaaaaaaaaaggaatttgattttgatgaaatgaaatttatctttttatttttccttttctcattgtgcttctggtgtcttatgtaagaactctttgccttattccaggtcatgaagattttctattatgttttcttttaaaagtttaatagtttatgttgtacatttatagacttatgatccactttgagtttacttttataaaaggtgtgaagtttaagttgaagttcatgtgttttgcatatggatgaccaattgctccaacaccaattattgaaaagactgtcttttcttcattgttccttttgcacatttgtgaaaaatcagattgctatatttgtgttggtctatttctgcacgctattctgttccattgagctgagtgttcttttgtaaatactactctatcttaattattgtaatcgtatagtaatttagattgtttctcagcatttttaatatactgttccaatatcatctggcctacatacttctggatgatttgttaaccttattattgttcctctgtaggtaatgtgtcattttgttctggctgcactcaagattttctcttacttttggctgtcagagtttatattcattttgtttggttttcctacttaaatagcttattggatctataagttaatgttttctactaaatttgggatgctttgggacaaaatgtattcatgtattttttctactcttttcacttctcttcagggattccaattacgtgtatgtttgacctcttaaattgtctcattaatccctttgattctttcatcttttttgttgttgttgttctcctttgtttttcagatttgataatatctattggtttgtctataagttcaacaatactttcttctactctctccaagttgctgttgaacccatcaagcaaattttgttttacttattgtacttttcatttccagaatttattttgtccacttttctgttgacattccctctgttaatttgttggtaacagatattcttttaattcattgaacatatttcctgttaatatcttgaacataattcataataactgccttgatgtttttctcctaaactcagcatctaggtctacttggtgacaatttctgttgactactttttaccttgagtagggggggcacaccttcttttttctttgtttattgatttttggatgaaaactggatattataggtaatattttataacaactctggattcctctatgttcttctgagaaatattgtgttttcgtgctagtgggcaactgacttgcctgaattccaacttaatactctgtctccattctatgttggtatacaactgctgatatctgttcttgagtcttcctttgctgctttttttagctggatttttgtaggtctcccctctgcctgccaaatttggtagtcagtcaagaatttggggagagatggagtttattgattgcccaacctgtttttatatggcagttttatttttctaaagagttaagtgaggtattgtgattgaatgattacatacatttttactgcttatgaaaaagattatggatttagaagaactgcaataaagaaattaactgaatattttattgcacaggtgcagctgctagcaaggaaaattatcttttcatatttaaatctgctagtgaattcaaagaatgacctggctgtggcttatattctcaatattcctgatagaggactaggaagagaagccttcactgatttgaaacatgctgctcgagagaaacaaatgtctatctttttggtatggttgtgtgacatgttcaaaattaagactccttgcacagtggatccatgtatcctaatatgcttgtaactaggatgaaacaacttttaagtggttaatttatgttctacctctgtatttgaaaatccatggtattttaattttttaccatatcgttcaagtttggtaaaggagaatttctctaaagcagtgtttccttacatatgttctgtatagtgctagccctgataaattctctgtgaataaatgtttccagtgtcaaaacgtttctgttaaatgttctttgaataaatgtttccaagggcaaaatgtttagaagtagtatatacccttattggttatacataatccatgattgtatataagagctctgagaagtcctgccataaagaaatctgcttgtagcaaattaagcttgttatttaatctgttgtttcctaatttatttgaccatagaactttcccctaaattatcgacatttcacaggatttgtctttcttagaatgtaccttggaacatttcatgtttgattggaacacttacgtacagctatcacatatgtatttttatcattgtaaggacaagccttttgaactatacatgatcccaggatgggaaagctggatgtaacttagtgattatctagtctgtatttttattttacaaatagagaggctgaggtttggaagtgttaaattgcccaaccaattcacctgtttaacacaacagatcagctgacgctaaaaattcccttgttccatgtaacaatttcaatagctagtagtcaactatattataatatattcataaatgagttctttagagtcaataatacattctaattaatatactttagctcttaatttgtcccctaactcagctcctcagcctcaatctgcagctgggtgtcattgccaccacacttgctagcatgaattctgcatggcatttgtttctttggttatttacttctgactcaaagtgtgtcatgagccataaaatgtgcttcacttttaactgtatacccagaattatatagatttacttagctttatgaagtaaattacagtttaataaatcactggacataacttatccgtttgttttaattcataggtggccacgtcttttattagaacaatagagcttggagggaaaggatatgcaccaccaccatcagatcctttaaggacacatgtaaagggattgtctaattttattaatttcattgacaaattagatgagattcttggagaaataccaaacccaaggtaatgacttttcatatattacaaatatgtttttaatctatctttaaaactttacagaattgggtagaaataagggatattgaaatgaccaagcatcagaccaaacggtgaggcgaagaaacaaaatctagatgaataaattataatcacatgaccttacctcctaaatttctgcctgtgattctgagttttggccaaagtcaaaagtcacatccatactaaatttgattagagaagagagttaccatttatttttatctggatgaaatagatttttgaggactggcaatgagcagacagataatttctgtatattttttatttagcaataaaggaaactgatatcaagaatgagtaagaaaattgacaaagatatgaaatccctattctattttctgttgtttttcattttcttatgtgcaaatctttggttcatctgggatttgtttttatatgatattggaggtaagagatttttaaaaatctgatagacccccatttataatattggtatattgagtggtaagtaagttttaggggcagaagtggattgtaatgctagcaatcatggtggatcattgtcaatttggtatcctataacataaataaacataataaaaatagctgatatttattgaacacttgttacatgtcagacattgtgctaagttctttactcagattatcatttgatcattacaacaacctgacttgatagatactattactattcctaatttagaggtgaagagactaaaacacagggatcaagtaacttgccctaggttatattaagtagcagagtagggatctgaacacagtcagtactgtgcatccattctcttaatgactatatcttgttccatgaaacttcattccattctaagattctaagaaggattttttttcaggattttattctgaattgcagtctgtcttctcatatggatatccattacaaagaagtaaatttggaagagggttttgaaaataacttagagacaaaataagtgacatcttctgaacttccagataatatattggggagccatttctattgaaatatcagatatttaatttttaaaaaattttttgtaaggcaatatagatatattttgttaaagtcaggtggtactacagtcatctgtcagttttttgcccttgaagatattccttctggaaagtcccctgtcatctttattcaatctttgcttttgctcgttaggcctgtgtcagagtggcaaccatgaaccttcatcctcacctcgtgaaacagtctctgcctgtttcctggctcttatgactttattttaattggtaaaccccttattttgctcaagtagctttctcagaaaaagtaaatggtaagcaaatattttatgttagtcttatatttggttgcatatgattttatgtcatgtttcatttatttctctaagattatttattatatttaatgtaaaaatattgttatctgcttcctgaatggtctttgttttatctagattggatgcttttctgttttttactttcttttttttgccctctttcatagtagaggtgttcccacaatgtgtggtgattctgaactgtcctttcatatttaagagtgaggccctatagagctgattagtagctctgtatagtgggtttatttatagcatgatgcccagttggctcttttgttggagacttactctccaaatgtcagtaactttagatcttttctttgggactttcccaaaaatttccacagaggaatcttttaatctctgaaagctgtaaatctggctagcaatattctgggatttgagataggtccacgttgatgctgagtctcacagttccgtatgtagacttactcaattcctttgtttttagtcctgctgcccctgggtctggagcctctcatagtttctttagaacagttctgcttcccatgctgaggtgggagagaagcactagactgactgctcagaatagagggagaatgggggtataagtgttccttatggagactgtcaactagcttttctgttttcaaccctgcctttacatagccatcagtattgccttcaatttctgattaatttctgagtttgcttcttactgatgttcctcttagcagttacttaggttttagcttttgtattctgggtagttagttatgactcaaccatctgttttcatttttttgtactttgatgaaatgcctctactctcatcagctgttgtttcctctctcattctctttttcttcatagatggaaacttttttgttttttgcttttttgtcattttagtgaagttttggaaaagagcagagataaatgtgtatgttcaatccaatatggtttgttataattacattccttttggaggaatttctggttgtggtcaacagggtagaagtacatttgttttagaggcatctagggtgagggaatagacttcttcaacttagcagccatttattttggatattccatgtggttataataaggaagtatcttctagagaaggtcttgaggaagtgagtatctaaatagtgaatgtcttcaactgggtatctgaatagtccacttgagcaatttttgttatcttttttgtgttgatttgtttgtttatttttgttctgcagtaggtataggtttgttttataaataaaataaaattattaaaaactaaaaacatataccctatgcatatcataatagatattaatagaaggtgtacagaggaaagggcaattgacctggtttctgggagccagggataagggtgtcaagaatgcttatctggatgggtgttaacagttaagcctaattttgaaggatgaacttgaaggagttaactagacatggtgggtgggaaagtggataacccatttggacattgcttcactggttattcattttatcttataatttcaacctctccctttactagtactttagccacattctataagcttataagaaataaacaacaaactgtcttctttgtttcttccagttccttcttccttttacagctcatattcttaaagaaaatactttccttttttctgcttccctctttgtaagtatttaatgtatatttctcaatagacagtaaactcaatgagagtttattggttttcttcaccaatattccctagccctagcacaatttttgccagaatagacagtcaatatttatttgattgtctgtacttgactgatttatactccttcactttttccctctactgaagctattctgccagtggtcacttgtgatcttctaattatcatagtctttggtctcttttgagtcttcaaatttagtcatttcctattggaactcttttttcctataacttcagatacgtcattctcttattttccacctacctcttctactacatatatgcaaattcttctaaatctatatttcagtgaaattcgaacctctttcctgagtttcagaaacatatcttcaactatctttaagatggtgcctcacaggcaactcatatgtcctaaactaaatttttgtctttctctgcaaaactgcttctcctcctgaagcgatgaagcctgtctctctccagctcccaaacaagaatctggggcatatcctaaatacattcactcactaagatccgtcactttttcttacttcacattttttatgttctttctcctcatctcttcctatagctactattttatttccagtgtttactgtttcagactttcatcctttcttgtctggaccttttcacgtgtcactgagttgtctattctgcctccagtcttaagttgccctatcctgtcgtcctcattgctgccagagtgatttttctgaaacaacaaatgttactcccataattaaaacttttcagtgattccatatttggtacagggtaaagcttcaggaacctcaatatgatacacaaaactgtctatgctctaactcctgcccatctctcactctgacctctttatcctcctcgtctctgtcaaccttaaaacttagaaataaaaatgtatttagctcttgtatctgaggaaaagtttatactacttatttttaaatagaaaaattacagtaatgtttgagtccaaggaagggtggaatagacagactgggaagaaataaagaacactcatcgccccactgcccacttttcatgaggccatcttagctataggtggctgcatttctacactttgccagtaggtgacaccataaaatgcatagtgtactttcacctgaaagatgtcttaaatgagatgtttcaagttgtatcaattaatagttccctgttgttcagaagttgaaaattctgtatttcacatttatcacacaactttttaatgcacatttacattatactgtcatgcgccacttgatgagaatatgctctcagaaatgcattgttaggcaatttcatcactgtacaaacatcatagactgtacatacacaaacctggatggtgtagcctgccacacacataggctatatggcatagcctattgctgctaggctacaaacctgtatggcctgttactgtatcaaatactgtaggcaattgtaacacaatggtatttgtgtggctaagcatatctaaacattgaaaaggtcctgttcagaatgcagtataaaacataaacatagataagcatagggtacttgccatgactggagtttgcagcacttgaagttgctctggatgagtggtgagtgaatatgaaggcctggaacattattgtaaactcttgtagactttatacacattataaacctaggccacactaaatttatagagcaaatatttctttcttcaagaataaattacacttagcttgctctaactttatgaactttaaaatttgactatgaattttttaaaattttgaaactttttgagtcttgtagtaacacttagcttaaaacacaaatacattgtacagctgtacagaatttttttctctgtatccttattctatatgcttttctctgtttaatttttcttttttttttttttttttgctttttaaacttttttgtttaaaattaagacacaaacataaacattagcctaggtctacacagggtcaggattatcaatatgactgtcttccacctccacatcttgtcccactggaaaatcttcaggagcagtaatacccctggaggtgtcatctcctacagtcacaacaccttcttcaggaatacctcctgaaggacctgcctgagactatttcagttagtgctttttttttttttaaataagtagaaggagtacactctaaaataatgataaaaggtatagcaaacacataaaccagtaagagtcatttattataatgaccaagtattatgtattaaacataattatgtgcactatactattatattactggcagcacagtaggtttgtttacacaagcatcaccacaaacatgtgagtgatgtgttgagctatgatgctacgatgttacatcactaggcaataggaatttttcagctccattataatattatgggactaccatcatatatgtggtctgttgctgactgtaatgttattatacagcacataactatttatgttgggctaaatatacatgtttggagtgttaaatctcactgaaatttttcagtctaatctcctaatgttaaagtttttcttgtttaaaaatatttcatggccgggcttggtggctcacacctgtaatctcaacactttgggaggccgaggcgggcggatcacgaggtcaggagatcgagaccatcctggctaacacggtgaaaccccgtctctactaaaaatacaaaaaattagccaggtgtggtggtggcgggcgcctgtagtcccagctactcgggaggctgaggcaggagaatggcgtgaacccgggaggcggagcttgcagtgagccgagatcgcgccactgctgtccagcctgggcaacagaacgagactccgcctcaaaaaaaaaaaaaaattcagaaatatttttcatatattttatgtggcacctttaattacatttaatttttaaaggtaaaatttacttcaacaaatagttatcaaattcttgagtatggtatggaaaagcagtcactttatttaggaaagtgaagaactcagtaattacattaaagtattaccaatcatttgtctgtattattgcttagtgttctcttccagttactttattttggtacaagcttggggattcagttgtgcttttcatcagcagcctcttgtttctctttctgccccagggcactggtgtgatgcagttaggagtcaggagctcagtttgcctctttctcatctaaattctcctattaatgtttatccagaatagccataatatatcttctgggaagcactcctgaatacctcctccttctctctacttccccactcaaacttgtctatactttcagtagttcattgtatcattatcacttgtgagctcttaaagagaaagattttattcatttttgtattgccggtgaacagcataaatatcctgatgtcattttagttaaaacttctggagtttctaggctttagaagcaagaatttgaattaaaccactgtgttgctgagcagatattagaagctaacctaatggtggctctagaagtgagtatatagtaatggagtaatcagagcactactgtttggggtattttgccatggcttcaaaatgttgaccttggcaagtctctgaaatacaagtcttattttttcctaaatacaattcagccagtgaattacatcatctttaaaatttaacatttttgtcatgtagaaggaatgagaaaaggaggtcaaaggtgactttcctaatatcatttgaagcattttttttgttcttataattggcactaagacagtcccagattttattaaccatttgaatcttttccaaaactcttttctattagagattaattcccaggaaaagcatataatgttaattacgttttcattttggctacatttcatccagttcacagctgaaaaagaaagtccacatatatgtgaaagaattcctagggtctactcagacttctgattacagaagtatggcagactaggcccccagattgattcttccattgaaaataattaataatgttggatagcatatttcaaaaattcttcttaaatgcgttggtaagtaggcaaatgtaatgaaaatataggtcaaaaataggtgaaggaggaaagccagcgaggcaagtgaagaagggaagccagcttttagcccaggaactggccagcatggggagataaataggaaacacatacccattctacagggctaagccctcagtgtaaaaataaactaagaataagggctttactttgacaaaagggtttctctaaaaacctagttaatggtaaaacgttttagtgttctgcttaagaataagacaagagttcctgctgtcatcagttcttttcaacatagcatgagatgtccaattcagtgtagtaagacaaaaagaaataggagatataacagttgaaaaaataaaattctatttgatgataatatgactaattatatagaaaactccaagaatgtaaaggcaaattattacaattggcagtacagtttaagagtgttgctggacacaaggccaataaacaaaatgcaattggatttctgtatcattactaaatagaaggatttttttttaaaaaaaacttcaaaaatataaaatacatagaataaatctagtaaaaaccatgctagcttattttcccttgaaaggttcaaactgaatgtgaaagtccctgcttgtcctcttccaccttgctgctatccctgagctttgtatcctgatcacagtgttactagagatgtttgtcctcaggatgatatcctgcttgcttactatgcacagctttcggcttaccatgccagctctggttggttcctttttgagggagagattgggtggtactgggagatttttgtctcttcggtgatatgttcttcagggtatctagtatgccattgtgtaagtagacaccacctaagtacttttgtattgcaaataataataatatgaatagtaaaatatatatcatttgtcttactattaaaaactttagattgttgcatgtgatagtattcatttattcaacaaacatacatcaatcatctcttctgtgtgccaaatgtaaactgacagtatgaagatcagtaaaatatgattgctttctcaaggagctgattttttcatgacttttttctcacccttgcctaatcataagaatcacctgtggtacttttaacacaatgcaaacatttagtgctcttctctggagattgtaattccataggatgggatctggagttgatgttttaaacaaatgccggatatgagtctgatgattaggaaaatgcattgtcatcatacactaagtctctctgcaattttcttctaactttcctcttctatctggaccagctacttaaatgtggacattcatctctttctagcttgttagggaacctggcatttctgtaaaacatacaacctggcaataaggcgagagtgaaaacttcatttcataatttcctttatgccactacaaaagagaaatttaatagcatacccaaggttgaaagtggcagagctgtgatatgtgctcaggcagcctgacttcatggtctgtagtcagaccacaccagtttctcatttggcactgtgctgcctttccagtgatacctctagggatgggatctcctggctttaaaagagaatcctcttctattggacacacctcatttcttccttaaaacggaccaaaatccttcctcttatatgtttctcacatttgtcctttagagcagaagctgcaacccaaactcttaattttaggtgtggtataaagaaatatcaatttcgggtttttaaaaacacttgtctgttggccatagttggtccagtttcttgtttgctttaggtcattactaacttgcttagtttcctcttccatgtaataaaacctttcacttattagaatgcaatatcatgtttttcacgtcagtttccttcctccctgtctcttccctcacacagaacaccatatgttcttggacaaaccatttaacctttgtgggactcaaattttctcatttgtgatgtagggataataatatcaacttactgaattggttttaagattaaatgaatgtaagagtctagatattcaatgagagataactgttcttgttattttagttgtatctaaaggtatatattttaaatatattgcatgtgtacaaccacttctgaacctgttatatttcacatataactaaattatttcccatcagctttcaaatcaaggaagaagaaacttattgaaattacttgcttttagacaaacttttaaattttgtttctaatggtccttatctttttcttaaatgctttaactgtttgatatataagatcaaagctatattctttgaaaagtgttaactctgaaaattatattttcaagtctataagcatattataatttgcaatactgctatagaggcaatctaatttctattttcagcattgcagggggtcaaatactgtcagtgataaagatgcaactgattaaaggccaaaacagcagggatcctttttgcaaagcaatagaggaagttgctcaggatttggatttgaggattaaaaatattatcaattctcaagaaggtgttgtagctcttagcaccactgacatcagtcctgctcgggtaatgagctttttatttttcattatccttttatacaaatcattatctcttctatttattgtagaaatggtttattattgctacttaagtcagaagagtgtgtttcctgtgttctaaaatgatattgaaaatgtaagtttctcaataggattatgtaggattacatgttcaacttgggtaaattatcacatatttgggccaaatttctgaatttgttaaagtaaggcatagggtaatctctggtatcccttttagtactaaaaacttataattcttgatggatattaaggtgttttatgctatttttccataaatattcttttttttttttttgagacggagtttcactcttgtagcccagactgtagtgcaatggcacgatcttggttcactgcaacctctgcctcctgggttcaagcaattctcctgcctcagcctcccgagtagctggaattacaggcacctgccaccatgcctggctaattttttgtatttttagtagagatggggtttcactatgttggccaggctagtctcaaactcctgacctcgtgatctgcccgcctcggcctcccaaagtgctgggattacaggcatgagccaccacgcctggcctaaatattctcataaacaattactttcccatttactcagatataaaataaaagcctgttttttctgtttctgactttaatactaagcattgtattaggacaacaacagtcctgttagaaattgcttccattcagcagtttacttttcttttataaatctctgtctcttgttttctacctccattactaaaacctgtacctggcaatttttaaactatatattcccagaacatttacttattcttaattttttttttacagagataattaaatagagtagattctaacccacagaattataagagaaattgactactgtgtttttagaacagaattttagagtagtatagttcgtttattgcaatttattcaactttctaatagcccctttttattaggtatgattatggtagccagtgtatgaagaaagacttttgcttaatttttattatttatcattcattcgttcattcatttactcacagcactctgggaccacttttagctatttttctataacagtgcttgtttttagatttactttgaaggtggggaagattcagggttgttgacctgtgtatttcatgggtgttaacacttcctggtgaatagtttggctcaaatgacaaccaggttattactataagtatcaatcagaatctgtcaacttcaaataattaaaaacatcaattgcttccatttcttggcagaagaaataaagataccaacaatctggttcttaatttcatgttttcaaccaaatcagagatctttgaaaaatataatcaaatgatactcatgaagttactattaaggaatatggaattctgtggtactaatgaaaaatatatgtgaagcaccagattgtgataggcaatttgttataattccagtagagctatatacattatagttcacctggtaacctgagtctgccaacagagaaagaaggccaagatgatattgatgaaagctgaagaaactggcacagcttataacagatgtcccagaagatgtagctttgatatctaggtataatgtccagcaaccctctgggttaggcattatcattgcctctattttgtcatggagtttaagaagagagttcaagcaccttctccagagttatacaggatatacaactaagcagttggtatcaaatccagccagaaatgccttcagagtttgtgcttacatgtatctatacataatattttattattatatattttattttattctatctagtcatgaagtttttttcagctttccctttttaatctgctttatctctattactactatcttagttcagaactctccatttctaaactgttctattatagtctttaatttgtgacctgtctccagatttgataacattcgtatctcacaatatattttacacattgccatcattggttctttaaaatctaaacaggatcattttacttccttgcttactgaagcaagagatttttcctctgtaacagactggcttataacttcttggcatgatatacaaagtttcccaggctcatctcataccacttcctcccttttaccttattcttcagccatgccatgctacctggtccctgaaagcaccatgctctcttcttcctctgggtgcctcctcctctgtggaatcatctttgatgccagggtacattggtcacttcttttgtactcccactgcactgtgcgtacacttattagaaatagcacttagcattctgtaatgcaattgtcagttacttatttatcttatcaaggaaactatgggttctttgaaggcaatggttgttacctttggaaccttagctttaaatatagtgcttgggacatagtatatgcttatcaatgattattgaatgaatgaatgtcaactagcttttcatttttgcatttgatcgttacagtcatccatggggcctgtattcagatagccagaacctcatcattctttggcataagagagaaaaaataaatagagatgttgagccatggggctgatgtcacatagctagatagtggctaaagttttctgactcaaagcctaatgttattttgaccagaacctaatgtcttcttttgatgatattatttttgtgcttttggaattggtaaagttgattatagcatggcttaaggaaaaatggtcacatgcctcacagccacttcttatagctgatgttttattactttaacaatagatgaaagaggccagtgccacagggaatttaaaagtatggccattcacccagctggggtgattattacatttacctaaaattattttttgtctcagccaaaatctcatgccataaaccatggtactgcatactgtggcagagatactgtgaaagccttattagttcttttggacgaagaagcagctaatgctcctaccaaaaacaaagcagagcttttatatgatgaggaaaacacaatccatcatcatggaacgtctattcttacactttttaggtaagttatgtggaagttatatgtgttataaatgttaactctagagaattataaaagaaatgtatgcttatggtaggaaacttagaaactacagaaattgtgaagaaagaaaataaaagttaattaaagggagattgaacatttgaattcaaagaggttatatataaaagaagtaatattttatgagagtacagcctgagagatgtctttggtttcagtgttgtttttagttcttgttgttttgctttgaaaatatttatttcctttgctgtgggtcaagaattttgctaaatgtttcagttaaattatttcagccttcccaaccaacatgttcttaagtgaagaattagaggctccactttataagtgaagaattagagacttgagagatattaagtaatttgcccaagtgaggtatgttagcaattagcaagggtgtctttcttaaagcctgaggcctatgctctcaggactactattctgcctagaataagagagagcacatacaccaaacttacactggaattgacagctcctgcttctccctcaaattatgaagaaaaatatttaccaaattaatgctggtattatgtgtaagacattgatgctgtcttcgtctactcaggctggcataacaaaatactacagactgggtagcttaaacaatagaaacctattttctctttgggctggaagctggagatgcagggtgccagcatggtcagggctggtgagggctttccccttgggttgcagataactgcctttttgctgtgtggtcacatgtcctttccttggtagaagcacatggagagagatctctttgtcttcttgtaaggccaccagtcctgttagatttggatcccacccatgtgacctcatttaatcttaattacctcctaaaaggcccaaatacagtcacatttgggagttaaggcatatagatatatatatatgggtgatgcagtttcatctatagtagatgctctccagttttaatgattaggtcagtcgttgagtaggttgttgatatttttaattaattggacattcactttgagaaacattaaaatttttagaacaaccattttaaattgtatttagtacactgtagagaattttcacaaaattatcgtaccgcttgatctcttctattttctactggagctattttattgaaatctggcttcatgattgcttcacatactctctcctatgcctcagtatcctttctcttctctttaaacagaaactttacagtggtctgtcattcagtgttgtcatctattccttaaaatctcatcttctttaccaacttccatgactattcttttatatctggacatgaaataattcttccacattctaccttagaatgcccaaatattttattaacgataaatatttttatcagtgatttacttatacctgctgctgggatcccagaaaacagtaaaaagaaataaatgaacttttattttttctcttttcatcttacttctgtttaacaagtttgcttttgggtagaaatgtaaataatttcaattttctctcagactgaattcattttcttaaagttattttcctttcatgaaatttttattctaacaaatttaatcccagagtccattttaaaaaggaatctttctaggccaggcatggtgtcttatgctaataatcccggagctttaggaggccaagacaggagcattgccagagaccagcagtttgagtccaatctgtgcaacatagtaagactctatctctgcaaaaataaaaaagaattacccagtgtggtggtgcatgcttgtagtaccagctacttgggagcctgaggtggtgcatgcctgtagtcccagctacttgggagcccaggattgcttgaggccgcagtgagctatgattgcaccactgcactctctcctaggtgacagagcaagaaagaaaaggtttttctatacttaatcatgtcactgaacacattgctattgttcacagtttggattctgcattcgcatttctaattgtcattgtgcagacaaacactggtctgtggtaaagtaaattttcagtggtctacactgaaatgataaaattaaggacaatgaggtatatcaatttaaggttatcaactattctttcttagggcaggcaatcttttattcttgcttagtagtcatttgagtcaagggggttctaattctggctctattaagccaaaagggattaatttattaaggtattcaagttggtctgaatccaaaactatagggtgggtcttctcctttttaccttctctgaccctcctatttctatgtttttctcttttgaattctcatactattttgaatttcagttatgtggatttcttatattctttacttagacttcaggatgcctgaatatagggtcaataaataagtcaactttctattcttcacaatatcttgtatagtgccttacaaatagtagaagctcatgaaacatttagttactggattgactaagcaaactattaatatttaggattctcagaatagaaataatgacacttttataaagtacagttatgcattgtttaatgatgggatacattctgataaaggcatcgttaggcaattttgtcatgtgaacattatagagtatacttacacaaacctagatggtatagcctattacacacctaggctacaaacctgtacagtatgttattgtactaaatagtataaagaaatagtaacataaaggtaagtatttatgtgataggaatttttcagcttcatcataatcttatggcatcactgtcaaatatgtggtatgttgttgaccaaaatgttgttatgcagcacatgaccgtattataaacaagtagatttagtggtcctttatcctataactgtgcttttgggtaggggcggggcagatactagtttaaaagccattttggtttgtaagtgtcttcatctcttcaggctgttagaacaaaacaccccagactagataatttgtaaataacaaaaatttgtttctcatagttctggagtctggaagtcttaagatcaaggcaccagcagatttggtgtctgatgagggcctcttccccatagattagattttcttgctgggttttcacgtggctgggaagactgaagggcaaaaagtgctcccacaaaccctttcataacggcactaatcctgttcatgaaggcagagtcctcatgatttaatcaccctgaggccccacctcttaataccacagatggtccccaacttatgatggtttgacttgtgatttaccttcacatgactttacaattgtgtgaaagctgtacacattcagtagaaactgtgcctcgaaatttgaatttggatcttttcctgagctagcaatatgtagaacaatattctctcatgattctgggaagcagcagtgaaccacagtattcagatagccacatgatcatggcggtaaacaactgatactctgctgtgttgcctgatgattttgcccaacagatattggaatgtactaattccagctaattccatgtttaagataggctaggctaaactatgatgttcggtggattgggtgtattaaatgcatttttgacttaatggtatttttaatttatgatgagtttatctgggaggtaaccccatcataagttgaggaaaaactagattgtattgggaattaagtttcaacgtgaatttggagggaaacaaacattccaaccatagcaataaatttttgccttttttttttttgacataggtctcccacacaggtgaataattcgataaaacccctaagagaacgcatctgtgtgtcaatgcaagagaaaaaaattaaggtacaatttaatgcatgccatgaaaatagcaaacactgttttatttttagaagaaataaatacatgaagctgagctgggtattgtaaatattgtaaacattgtacatgacacagtaggaattaaatggaaaatgagttatgacagttgacgtacagagactttccttttatacagtcttgactaatctgtttctggtttgcttaatccactggacctaaaaaagggaaatgaataagcagttgctattgtaagtgttgaataaatatccgttgaatgagtgatgtggaaaataaaagaagataaggctttctcatttacatttctatatcttaaactgaatctcaagatatgtgattttaaatttgctcctgtctgaagatataatggcagaatataattaattatagattgagctgagagcattttacactgctcttgactagaactgttcctgttctttgttcatttagtttgaactaagttttgctgtcttcatatgaaacatctgtgcctataagtaatcaataatgtgttttcaagcaatttttattggccttatttttcaaaaagaaatttggctttaactcatttatcatacttttattgggtatctactatgatccagacactgttgtatggttgggaattcattaattcattaaataagatttttatataaaatttataatcatccttaaactgtcaaatattcatcttgatacaacaaaaaagagaagactaatttgtatgccctttattttttcatttggaaatttagtttaaattaccaaagcttttagttaatacctgtttcatctacataccctatacccatttagtttatttattaataccttttctttctattgattattagtagttgttagcaattaatgcttgtggaatacatcattgagtttcataaaatttttctgtgaataaaatttgtcaattctttgtcatattaatataagtatttgcaatcaagggataagatttttaaaatctatccattggacttggatagaaacagaagtgtaacatatcaaaaaaatttttttcttgctatggatactgacaaactttaatattttgatttaaaaataagtcatattttggggagctcaatttctctgtctccatttcaaatagaataccaaagtgggtcaggtatggtggctcactcctgtaatcccagcactttgggaagccaaggcaggcagatcacttgaggtcagaagttcgagaccagcctggccaacatggtgaaaccctgtctctactgaaaatacagaaattagccgggcacctgtaatctcagctactcggtaggctgaggcaggagaatcgcttgagtctgggaggtggagatcacaccacttcattctagcctgggtgacaaaatgagactctatctgaaaaaaaaaaaaaaaaaaaagaaagaatgtaagacatgacataaggaaaaatcactgacagtgaagtacgttaaatattaccgggaaagggcttagagttttcttttattttatttacttttattattttaaattttgttgtttgtaacttttgtgggtacatagtaggtgtatatgtttatgggatacatgagatgttttgatataagcatgcattgcataataatcacatcatggagaatggggtatccattctctcaagcattttatccttggtgttataaacaatccaattggattttcttaaaattaagtaaatcaaaatgaaaaaatctatctgagaaatgagagtgtttttaaagaaaatgttaaggctcaactaattactacgaaacgtatagacaaatttagaaagttttgggaaatagaacagagatcatctaatgcagtctcatttacagatgtggaaaccaaaattctaagaaggcaccttatccaagatctcataactaccatgaaatattttataacagtttgcaaaaccatggttaaatactaatgaggttataattacattgcttccattacttaacagtagagctgacttagtctatacagctctgaatctactaataaacggcaatcaagaaaggaaagcattgcttatgtttttgcgatactctttttaaaagtgaagtatgaaaatgattagtttaaccaggtatacaactgaaccatagccatgtagagtatttgttggaataacaaaaaatgctgccaatatttactaccaaagttcctatggaaaagtagtttagcagctgattatcttattactctgttacttttgctcttttggcatatagtggtttttagtcacagaaataatatatgatctacacagaaaatatcttgaaatgagcatttcaaaggtagaaaataattagataacttagaattttgatgtacttgcttatgaaatatccatgtcattattatatggagtaaattaactcagattttagtttcctcattcttaaatagaaatagatgctcctgcgatcacaaaagtttatgaaaccctttggaaatagttcacgaacacactcattttaggtcctcaacttttatttcctactgtagtgtatcaggaatcttgtttatgatggtctttcagaggtttttatcatgaaagggtgttgaattttatcaaatgctttttaagcatcagttgaaaggatcatatgatttttgtccgttattctgttgatataatgtatcacattgattgatttgcatatgtcgaaccattcttatatccttgggataaatcctactttgtcatgatgaatgatctttttaatatgttgttgaatttggtttgctggtattttgtagaggatgtgtgcatcaattttcattagagatgttggcctacagttttctctgtttggttttggtattggtaatactgtccttgtagaatgagtttgaaagtgtctcctcatctatttttggaatagtttgagtaggattggtattagttctctttaaatgtttgctaaaattcagtagtgaagccattgggccctgggcttttctttgctgggataattttttttatttttttgagatggagtctcagtttctcaaccaggctggagtacagtggcgtgatctcggctcactgtaaccttctgtgttttaagtgatcctactgtctcatcctcccaagtagctgggattacaggcacccaccaccatgcccagctagtttttgtatttttagaagagatggggtttcaccatgttggccaggctagtctccaactcctgacctcaaatgatccacctgcctcggcctcccaaagtgctgggattacaggcatgagccacccggcccagctgctgggagactttttagtacagcttcagtctcattacttattattgatctattcaggttttttatttcttcatggttcaatcttggtagattgtgtatatgcatctaggaatttatctattttttctaggttttccaatttattggcatttgttggtcatagtggtctctaatgaccctttgaatttctgcaatattagttgtaatgtctccttttttaaaaaaatttctgattttatttatttgggtcatctctctttttttcttagtctagctaatggtttgttgattttatcttatcaaaaaattaacttttcatttccttgatattttgtgttgttttcttggtttcaattatgtttatttctgctctaatctttattaatccttttcttttcttctactaattttgattttggtttatcttgcttttctagtcccataagatgcatatttatgttgcttatttgaagtttttcttgtttttggatgtaggtgctcattgctataaaatttcctcttagtactgtttttgctgtatctcataggttttggtatgttgtgtttcgattttcatttgtttcaagaaattttttaatttcctttttaatttattaagcactttaagtaagttattataagtacccttatacctttttattaaatgatttttcaaggagatacctccttaaatccctgtgaattaattggctttattctttccaacttggtttagtggtagtttgcacatcaggcacaattgaaaagtcatatatacaggtcttttccttattctgagtctaatgtttatagcatattatattgaatgtctgagtaatcatcatttagccagtcaataacttaagtgtgctaatcaggaaaatactggacctttaacatggagctgttgggacagtgaaagtcaggacttggtataaaaaactggactggctagaactctttattttcataaacacccaggtagtagtccaatgcctatggtattaacaaattcttttatttaaccccatggtattagaaacttcaaatttaacctttatgatatttgaaaactcttgagtacatctaaattaaaatagtggattgagtttaactaatagaattttcttcccctgcctgatacttgaaatgagtacaaagtaataaaaactaataaaaataatcagcatcaactaagaaagaataatgtaatcagatgcaataagcttaaaagatgatggtcagggaaagaaactgaagatttcagagtgaagaggcatagaatgatttggcaactttagttagtcctagtccccagatacagaactagtgaattagcaaaattctgaggattaccactaatacttccaaaactgagaactaaggtgtgcattccttttttttcttttttcttgttcattagagaaatagtagaagtggcaatggaagaggaatatagacaaaatgtggaaaatgaaccctgggatttacacactgagagaaataaaggctctagttctatctactgaattggggaaattatccaaatgctttccttccacttgattgaaatacactccctaatgagatgaagtgaaccttcctctggtatatacaatatgtaataaactcctagagtgcagaacccagaaattttcatagactacctgtctcctcagatgagttgagcttctacctctactgttcctcaagctacggaaaaatgagggataacagaaaaaatgcagctttcaaaatgtaactctgaggagaaaataaaatgctgtcagataaggaaggaacagaatcaagttgtgatgtggagacttctttttttcatgaggatatagtacgtcatggtagaacaccattctcgctacgatagcaaaacaataaaaggcagataagttggggaaaatatattttaaagacataggagagctatataatcaaagaatttttaaaaaattaaaaatctggacaggataacatccttctgatgtgagaagtctattgtcagctgctttcttccctgggatttgttgctacttttgaatatgagctgaggattggtgttagcccatgtaaaggaactctattgaggaacagagaaaccaccaaagtgtttgggtgtcttgaggggctgtcaacaaattggaaactttagcagtcctaaatgcagttatttttacctaggacacatactctgaattttgtagttgtgtggggaggtagggagccttactacaatagactaaaaccaccttgattccacttgagaagtgggacgtgcctcaaacacgtggctggtcttttttttttttcaagatatttgccatatttggaaataaagtggggtgggagatcacagaacatagtgtgaaaacccctgaaaaacagactgaatctcccagattttaggccagaggtgacagagatccctacaaggctcgcagttgaaagcttagagcacacccgaggaagagataagaaccagaagtcaaatgtgagttaatgaaaagtgcaacccagctctgatgcagctcattccttgattgtattgaggttatcagtctttcactgtgtctgcctaacagtgaaaaggagaactcttcttgctggaagaggtcatctgtagcttctagagttcctttatgtgcaatatccagcatgaaataaactatactggacatgagaaaaggcaagatgatttgtcctttaataaagggaaaacatttaacaatagagggagactcacaaatgatccagatactgaaatttactggcaaggaatcagaaagaaattaacttataaaagtaattggaggaaaagatggtcaaaatatatgaaaaaaatggagaattccaacagagatttagaatcgatgacatagaacaaaaaagataatgtttttccagaattgtaaaaacattatctaaaattaagaccttgttagatgtggttagtagaagaccagacacagcattaggtagggtaagtggacttgaagatggagcattaaaaaaatctccaaactggagagaaaagagagaaaaacaaatgaaaaagcaaaatagaagagcaggacacagagaaaatgtctaacgtatgcctaattggagtcccagaatgagaggagaaaatagggtagaaacaatatttgaagatacattggtcataattctttccaaaggtcagttcacatcagattactacctagcatttagaagagagggtggacaaatgcagggtttcctttacaaatataaagttgcctatgggttccaaatgtgtggacccagcatactacaaaatgtcccatagtcctttgagaatccatctgcagacatgaatgtgccacagggcatagactgtaaagctttgttctagagcagtgctctccagtagaactttcagtgatggaaatgatctgtgtttgtactgttcattactgaaggtcctagtcacatgtggctattgagctcttgaaatgtggccactgcatttgaagaacggggttttaaattttatttaattgtaattaattatccgcacatggctagcacattaaacaatgcagttctaatggattaaagatacacttaaatgcaataactagagacccatattaagtggaggaaataataagagatgagaataaataggatttgaataggcagagagattgaaatagagcatttcaaacaactgatgatgaaagtattaaattgccttgctgttgtaaagagaatgtgtgtagggtagttgtgaaaaaaaacagtgaataaataatgttggggaagattaaggacagtatgccttttatggtattaaggaatagagtaattttttaaggggtttattgtaaggacgagagagaaaggcagaatatttaagaactcaaaagtaaacggtggaaattaagcagcttaaggaattcagctgcatggttctttgtacttaaatgtgatttaggttttctctgcatgtatatttctctcttgtttctgtaccaactggtttctttaccctattgaacagagtagagtttactctgaacatatttttctacctcaaagcttgtgttcctagggtgatgtagttgttcttttcaagtctacttactttttaaaaatttattgtggatacatactagttgtatatttttatggggtacatgtggtattttgatacaagcatacaattatcgtgtggttaccttatagagtctgttctctttttccacctccaaacttttgcttgctcatggcttctgttccctcacagctctgcttgcatatacttgttatagtctgttgtaattttacttcattaattaattcattcaaaaaacagtaagtacctcctggataccaagttcagtcctaggcactggagatacatcagtggaaaaaaacagacaaaccttcctgccctaaaggacaaggcttctctaaagatttatacagctgaggtgcaataatataaatggaagccactggcctaccctgaaaccccttcaaccttgattttgtttcatactctgaagaatactctgccagtaggtctgtctaccccacagcccatcacccttgccataaacagtcagctcttgaggctaaaggaagaggccagtgccagcccagtgcccaggggtccttgaaacaggatctataaaggaggtcatggtttcctggtgagcatgtctaaagctctgggcactcctcaccctgtaaggaggggatggcaacaggaggaccacagctggccatcagttgtcaaactgtaagggttttactgctgatggagtttatattttagttgggagaagcagacaataaacaaacaagtggattatatggtatatttgaaggttatcagtgctgtggagtgaaatgaaatgggtggggcctaaggaaagtggggttcctttgtgtgtgtttgggttttaaatagccataagtaggagtctccttgagaaggttgacattcagcaaagtctataagggactgagcaacattttccgttagaatgaaaaaggaatgtttgtattagactgaattaaaattgaatttgttttagctgaaataatgggatcaggatttattgagtacctactaagtgttcagtgtttatactggatattttatatccctcatcccaattaatccttgctcaactctggaaggcatcattttgcagaccatacatatagtaagtaacagcaagggtttatagtcaggtgtcagacttcaatgtttatgctatcttcaaagattaaataaaggcatgacaattatgatgtaggatcataaaacgataatgctactacttaggtcaaaaagatttttttctgctattaagcagagtaaatggaatttcactgatgaagaaaaggattatttgatttatatacaattaatatgtcattaaggatataaaatctctgttctttcaaaaatgtgataatgtaaaaataaggtaaacttagaatatttttagttacatatttactaggtatgttgaataatttcctttttcaaacttgctaatatatttattggtataatgggggtttagaactttcattttcgtgttaatacagctaactctgagtgtctatgacttttcagtgttttgactcatttattttaatttaactggagtcaggctttcctatgtgaagtactattttcctcaaactgggaacttactaataatttcaaattaaaaagagcttgtggcaaaaggacttttccagttcttggcaagtgtgaagttcattgcaattatgctgtggatagaaatatttccaaagggaggaaatcactctacaaaggaatactttcaatccatttctctcatgtgacttgaacatgaaatgattttaacagccatgtatgaatctggacattattcttagttgtttagtacttcaaaagcacttttaagagggaattgttttgcttatttgtgattccaaatcaaatacacagagagatttggaagatttgcaacaggaagtaatctcagttctatgtagccactaatcttgtgtagaaaaattcaacttttatgaacaaaggaaaagcaatctcttttaagttataaatataagccaatgtaggttgcgttgtttaaataattaaaatgaagaagctgtttgtaagttcatttttttgagctgcattcctaggatcattgtagaactggcctgattctgagatatctaattgaacagatctttttcttacaggaatactctcttcctacatgttattacaataataatgatatagtgtctacatagatttctgcagtttatataaccttgacatatgttaactgcatccaattctgataattctgtgaggtaaatattcccattatgtgtggataagtgagaggtataatggtttccccaaagttatctagttagtaagtaatacggccagcattagaagccaggtcttctgactgcaaatctgatgcttttcccatcacatcatcttatctttttgtgctgctttcttagttggacagttgttggctcagtcaagttcatatcaatttaaatctctaggtcttttacatatgttgtttttaagtcaggttctcctcatcctgtacctctgtaattgatatttttaaacttaaatactggactttgtttatccccatccattttcatcttattattttctacttatggttctagccttctgaaatcttttcaatcttgattctgttatccagtttatttgttattcctcccagctgtttgtcaatagcaaattttataagtagaatgtttttgaagttgtagaagccatcctagtaatctctagtatacgctgtgcttgtcacatagttggaacttaataagtggtaattgattaaaaaaaaagagatttttgtacagggcaagggaaagaaaatctgcatataatcctttatgaaaagaaaaaatctcaatatacaaagggggggagttctgttgtgtttatttcttatattttaatatatttataaataatatttttcatggtagagaaagtcattaattatttttcttttacatctgaacttgttttcagtacttcaggaatccattgccttgtgatggtagttttctgaaattgtactggggtctctgaggagtttagaatttgtctgtgggggaggctgaattgaggaaatctagttgtaaggagagctattgcgcttattttgtgactatttgcatagcaagcaaagatttttttacctagactatatgttaaaaattaataaaagtaacaaaacattctaaagaaatttttgtttgtgctaaacatgagattgaagaaacattagttttctgtactaaataatataattattatttagtattatgtttttatttagaatattttatgggtggtgctcatgagagttttgcagtgagaagctaacatctcccaagctaactctaggtgccatcactattgggttacaaagagtgatccaagccagccactcagcatctatttgcctgcgtggtcttactatactctttataactctttataagcaataagtttataattctctataagccataacttttgtgaagtgaaaataatgtgtgataagataatgtcaacagttagtactggttttgcagatggaaataaaagttcatggataatgctactattatgtagtataatatagagtcaattttattaataaaacttatttaaataggtttatctactgctttaaatctgtagttataggattaataaagtccagaaagagctacttaaaatcttcagttacatatagggcatcttgaggtagaagctatttaataagtgttgcattcatagggattcatgaaggtagtgggttgtgagtccattctgttcaacttttaaaaaaatagtttttgatcttgtatattttcacgtttattttcagttttgtgcattttatgcttaaatggaagataaaactccaattgtctaatgcttcatgtaagcacatgaaacataatttttagtgatctgggagatggagactgtcacagacctcattagtcagaaagatagaaaatttgtcatcctaggaaaacttgcttttatgaagcagctggacagacgaatattctaactttttctaagtcatagtcagtagatttcactgccattgtctttacaaacatctgagtgaattaatgcatcgatctttgaacatataatatataactactgaatatataaagtcatgctgttttagatttcatgactgtatcaacaaatactctgtaagtaataatcagggtaatgtagttatactcgaagtgttacatttttgaattactgaagtcatctttattgaattatgtatttgaaactttgtctatgtcagaaaatgatttcaggtgacttctaattatttggagacatctctccattaaacctgaatggtattacacatcatttgtaattgttgaaattggcattatttgtataggctactttgttctaaaattaatttctatccccaatagctcactggtttatgtttgtggaacaaatttccaaaactactttttttggcatccttttcagtgatcaagaattgagttcatctttgtaattttctcctatttatgtagaaagttaggccctcctatttgatgtttgaagataaatgcaagagtatactttggatttctgaccattaagtcacttggtcaaatctttctagactgatacattgaatcatctttcttgttttcctaaatactcgagaaataatgtctttcctatatcattttgttttatcttgcagtttctttgctagtttcctgtttttgattgacctcacttagttctttttttcatcttagcatttcttccctccctaatttcttgaattccatatgctattttttttccaagagtgtgttcttcttaggatgaagaacttgtatttttctatgattatgtatatcacctgtattgttattttacttacaataagacgctccaaagcagtgctgacacaggaacatgtaacaaagccctgcgaagagtctaaaattgattgttttgtaactgttaccaaaaaaaaaatcaaaaatatacataaagctattattttggaaaagaacaaaaatgctagccataacaatgaatgagtttgcaaactatgaaatataaaaggttagagagaggttctcaatgagtaatagaatttctaagggaaatttttataccttgattactatagagtgtgtgtctatctagatgaagaaataaaataatgaataaatttgcatattttcttctttctttctgttactagatgaagcaaactttaattagatcccaatttgcttgtacttataaagatgactacatgataagcaaggataattggaataatgttaatttagcatcaaagcctttgtgtgttctttacatggaaaatgacctttctggtaattgaccttatttgtgcaattaaataacaatttaattctagtctactaattagttttaacttaagtaaaattaggttatttttgcaaagtactatgaaatgtaaagggtaatatttttaaagacctcagtttatttaaaaagttaaatctaagtacaaatttatcgataggaataggacacagtttgatttaactaaatgtatttaagaagtaatttgtagcatatgtttaaggattaaatgtcatgcattcaaacaaatatttcttaatagggctgacaagttgattactggccaaagctaactcagaggtgctatgataaaatgaaaagtaataggatagtaatgtagctatatttgtcaatcatattatttatagcattattttactttaaaaatttgaatattcgttagccatttttaaagtttattgtaaagttctcgtaaatattaatactcaatatcatgtaattcctttcccctttttatcttgcataacagagggtgtaaatccatctgttggaagatcaacaattggaacgagttttggaaatgttcatctggacagaagtaaaaatgaaaaagtatcaagaaaatcaaccagtcagacaggaaataaaagctcaaaaaggaaacaggtggatttggatggtgaaaatattctctgtgataatagaaatgaaccacctcaacataaaaatgctaaaatacctaagaaatcaaatgattcacagaatagattgtacggcaaactagctaaagtagcaaaaagtaataaatgtactgccaaggacaagttgatttctggccaggcaaagttaactcagttttttagactataaatttgtgtcttatatgctttaggtttatgtatctataaaccattcaccaaagacatgcttaatttttaagagatcaaggtgtaaattatgatgatttattattttggtctacagtgtatgtaaggttagtatgttaagcattgtttaaaaatactagtaagtcataattatgcagaattttcacaaagtttaatgcacagagaaagcatatcatttcagttactgatacatcttaacactactttcttttaaaacagacatttaacatacacaagttatagtagcagtatgggcttctcctcccattggcaattaaatgcttttattttcttctgaaaagatgatgtggaccaacaggtatcagacttgccaacaaggtcggtagactcttcccagcatacatctgagcactgaaggaagaagaaagtttaaattgtttaaaggactataattatcacacaaaatttattaagaaaaaaagaatggatctagtataactaattctgagtaaaccaaaatgataataattaattgttgctatttaatcccacatttttggcaggtgtaattgagccatggtcttatttgattttgttatgattgcatccaaattcactttaactcagagttctgtttaatggtggtaggatgtaagaattgaattttgaaaagactactcactgtcaaaatctctccttcctataggaaatttagctgagttttcttcatccccaatttctctcttttcttgtgttgattcagtattctgaactccattctcagctgggaaagctacagatccttttagtgcaagataaggttttatagccagattcagtggcagaccatgatttaagaaattatgtttggagcctgtgttctgtaaagagaaggttgatttggtttttagctatcgtattcggagtggaactataatacaattgtataatattcttgttgatcaattcaaagttactctgcactgtttttgactttttaaaaataccttagatgcaaatttataggagaaaaaacactttcagataagaggtgtttgctgggatggaagaactacctggcatgtaagaaatatcgtcagtcgtcctaatgcatattgtgactgtttgcatatacttctgtttataaaagtatcagttttacttttcagaggatttgtaagaatcatttaaattttcattgaaataaacgacaagtcacattgccactta

SEQ ID NO: 743 - DNA, 30571 bp, Homo sapiens
gtggtgcgcaggcgcagtctgcgcagggactggcgggactgcgcggcggcgactacagacgtgtcgggggtccggggcctgtcgcggttgccaagcgctcggcgcctggcgctggcgctggccaaggcggtgagtccctgccgcggaccggggcagggcaggcggggggcgaggcggcggtaggagcgggacggtccccagcgggtccgagcggagcgggcgccgggtccccgcgccccctgcccggggatcgggaaggggctgggagagccctgggccggtgcgagggggagccgcggagtgtactcgggggcctggggagctcggtccttagcaggtaggccgcgtcccggtgaaggtcgcgaccccgcgggcttgctgggcgtcccctccgccgctttggtccgggcctggggtccggcgacctcgcgggctgaggtagcccctcgcctctgcctggcgggtggactcggggaggagtcgtgtctgcccagggtcaccggggtggagtcctggctgggccgggcctctgccgccgtctgtgagggttgtcctgcggggccgcccgcagcccgtgggtggggccggcggggcgggtgaaaccgcccgggtgggtgcgaggagtggccgggctcggccgggtgggtgtccggtgggaagcgcggcgcgcccgagcttgggcttgcagttcccctttccagagagcgcaaatctgtgcatgtccacttcgggatcttggaagttaaggacctgtactttgggtcccgtttggtggcccttgtgccacaaaaatgtgccggtgtttaaaagcagctgtgccagtttttaaaaatcagacggagagctcagggcactgaccgagcgaggactccaggacctgtgcttgcctgtgcgctgagtacctcgagggccgggctcggcttagtccaggatgatggtcagggttatacttccctgagcccttgctctctgagtgtctgagtgtgccctctacgattgcatcttcagaatcggccttctaggattttatttaatcaagcgaaattggataggtttagttgtttggttcttttaaatgaacttagccacccacctcttaattacaaagtaattttaaattgcagagtaaaaatctcaataggaaccaaggcattcagcaatagtgatttgaattatgcctgtgattgtgcaattttctcctttttgaaatagttattgaaaatctctttgaattaaatgtgaggattagtcatacagccatcctgtcaacatcggaaagcgtgtaaaccgttctagcgtgttgctgtggttggtgctgaccaagcagagacccccgccgcatcttgggctcttaggagctgctgggagggcgtccacaagcaggaggtgaagcccatggtcagtgggactttttaggggcactggtagcttgtggttggagagaagctagatagagccagtgcctttgtccccaacccagatggtgcccagtgttccttctgcagactaaggccccaggcacctcagaccagatggcaagatagcaaaatggaaccaaaatttagtcttgggttttgtaaaagtctttttatcttgatgaaggtagcttttcctacagaaagtcgtgcgtttttgggttcttcgttggctgcttttgtgattgtgtaggttgtacatgcagattcgtttcttgctcatgatttataggtgcattttattcgatgaggaccccttactttgctagatttcggatatgaatgtctctgcacttgttacttttccccctccacctcctgattcagtcatctgaaattctgtattgttaagcaaggtctaagtattccttttagttatatgttccccattttttttcttagaggaaatgtttgatagtttctcctaaaaaattaataattggcacaaaagactagttttgtgtcaaaagtagttttgagttttatctaaagactgacattgacttgaagttgggctttccagattcaaatatctgccccagatgagatttagatgcagagggttagtgtccttttccccagggggatggcgtgatgatttgttcaagattgtgttatagtagctgccccttttaagccagctgtgtgtgtgtggtggggggtgggcagtgtgtattccacatcaacatcctagaaagaacgaataaacatttagtgatctcactgtttctacttacatttggtataatgtactgtttttattggtgctattacctatgttaatggggcactttacaaaattttcaagaacgtttttattaaaattatttcaaagacttctttcttaaaatatgattttaccatgtaaaaaattatactaaggtagaagaatattcgttctttctcattttctgaaaaaagaaaaaactaaattagcttatgtcaataaaaacagactagaaattggagaaatgaagaataattttttatcccacataataagtaatttgtgaattgcaagtatttctaaatacttgaagacatccctcacatcccctcttctgattgctgagtgcataatttcctaaagcttttttttttcttttgttttttggagacattgtctcgctctgtcgcccaggccggagtacagtggcacagtctcggctcactgcaacctctgcctcctgggttcaagcgattctcctgcctcagcttcccaagtagctgggattacaggtgcccgccaccacgaccagctaatttttagtagagagggggttttgccatgttggccagactggtctcgaactcctgacttcaggtgatctgcccaccttggcctcccaaaatgctgggattacaggcatgagccaccgcgcccagcccctaaaactattcttgatgatatttctgagactattcagtggtcttctaaaatgccgccagcagaatggaaaacgtatcccctaaatggctggccaaccttagcatatgggacagtgtgacctctctcacacagagccactaaaaactaaacactaaaaccagttttcttgagtaaaggtttctaagatggaaaatttaagcagcgagatatgtcaagttgtagacgttggccaggaaaaagccagcagcaaccaggcaggggagagtgtgcatccgacatcctcctgtgtgatgaagggatgacacctcttccctctgggctgtcagcctttactgttgcaggatacagatctcctgattcaggtgtccagtgccttttgaactgaccgcaagccctcctggacgattggaactgtaatgtggaaagggctctgatggagccggttaaaatgcttcattatttgcaaaataccacatacagtaatacgatctggatgtctttcccctcctccactaagtagcataagtgaagacttcccagaggaagtgcgtctttttcatctcgtatctgagtcagtgagtatcctttttggaaacaagcttcatcctggttttctagagtgccaagccagggtggaaaggaggacctgggggctcagtccttccttgccccttgggctgcccttcagggttaagtagagggtcccagctgagctctctggatgcacaggagcacctgggtacataagaaggtgaacagtttgcaaggggaagtttgaattactatcccccacagcatttgttccttcaggacactaaccctctggatctgtgtcttctgtgtctccagtggccaacagtgttgcaaacaggaacccgaggtgttcacttcactgttgaaggaacgagagggcatctgctaaagtttcagattccgtaagttcatgctttttgttccattataaatgatttttttggcttgggggtaaggatctataccagtttgttttcatatgagtcatagacataagggaaaaatttctcataggtatccaatgcatgctgaaattattttcagtgtaataatacttaattgcaagtacaaatataaacatagatgttaacatttttacttgtatctgttatgtatctataaattagatttaaatttaggtcaagtaaagcaataaattaaaatgaacagtatctgctgtgatagatgataaaatcctactgaaaagaggaccgtggggcccttccggtgtgggttccttggtattgagtgtgcctgttctctctctgttggaaaactgaaacgtgctgagaagttcttttctcataagctcacaatagcgactgaatgctccttggcaccttctcaggcataagcataggcacggccctgaagtagagttgtggtcctcagtctgatcccatggaatagaccctctaccattcatagaatctgattatcagtcccttctccaggtgcgaatgtgcctacttctccccgcactgttcagggctcagccccaggacaggatggaggccctgtgtgcccagcagttgctccttttatctttgtcaagctctttcactggcacaagagtcttcatgtttggcatagtggaacctgtgattgacaggtgaatttttcttttccagatttctgctcagtatccagtagtggatcatgaatttgatgcagtggtggtaggcgctggaggggccggctttgcgagctgcatttggcctttccgaggcagagtttgatacagcatgtgttaccaagctgtttcctaccaggtcacacactgttgcagcgcaggtaagagaaaggtgccccactgtgctcccactccgtgcaggtcccgcgcagcctcgcactttctacctgggcagcctcctgcctcctccccgtgctccagccacttggcctcttgctgtgccttactcagctcacccattcaggggtctctccctggagcctcttccctggggactttgaagggcgggagccttgttgtcactcttaattcagactccagtcacacttgggttttctctgaccatctaccctccccacccacccctgccaccccaacaccttaagaaaaggagatcatctaaagaggaggattcagaatttaggttggggaagaaaagggcaagggtttcatttgtccctgtgctgctgtcttctgggactctctgaggggtaagacggtggtgggcacacacagccaaaggaagtaggggtacaggggagtgcgactctgagtatggagtttattacttggcaggaagcacttctgatctttaacacatgcccgtaaatgccgttgggaagatttgttaataaaattatgcggagagattcatggagtaccttttctgtgccagatacgttaggtaataagcatattacaggtagcctttcactcactgctccagtcagcccttcctggagttccctctgtctccaccacacagatgaggagactgaggctaagggatggaatcactgggtgagtctgggaggggttgtgatctggaatctgtcaggcctggctgctcctctgctgaggtcagccctcactgggagtcaccgcgtgagtagttggctttctctgaatcccccagcgggtggatttgggcctggaagacaaagctggggttcctgtttgtggcttgtaaggagtggttggtgtttccaggttggaatcaatgctgctctggggaacatggaggaggacaactggaggtggcatttctatgacaccgtgaagggctccgactggctgggggaccaggatgccatccactacgtgacggagcaggcccccactgccatggtcgcggtgatgggcgggaggctctgggtgctctggtggtctgtttctagtacaagagtcctggaaaaaatgtaagcagttgaggcagatgtggcagccgaaagaatggtgattagcaaagctcacagagaagtctttgtccgtcatgaactatgtattacatgtaataagaaaaacttctctttgatgaagtgttgacattttcataaaataggttaatttgggtttgcagatttgtattaaagttgtttagtgtagattagctgtgaatatcttgactcctttaggttaataaggcttttgtttgtttttatctttcacaggtagaaaattatggcatgccgtttagcagaactgaagatgggaagatttatcagcgtgcatttggcggacacagcctcaagtttggaaagggcgggcaggcccatgggtgctgctgtgtggctgatcggaccggccactcaatattgcacaccttatacgggagggtaaggccgccccccgtccacctgagacaggacacgtagtgctggggcttgtggtgacagcggggaatgggttagcgtgcccagtgagtcagccagagattgcgtaaaaagcaacagagaacagcggtgtggggcacatgcagcgactgtggatgtgacaggagcaggcgtgtgccttgagaagctgcccctaaggcaatgtgtgagttgttgcctctatgttgggaagttgaattgataatcttatataccaggttttcacttgggatatgtgacactcagcatgtaagaacagagcaagcaggccaggcacagtggcccacgtctgtaatcccagcactttaggaggccaaggcaggaggatcacttgagaccagtctggagaacatagcgagaccctgtctctacagaaagtttaaaaagtagctgagcatggtggtacatgcttgtaatcccagttactcaggaggctgaggcaggaggatcacttgagacagtgagccatgttcataccactgcactccagcctgagcaacaggagacctgtctcaaaaaaagacaaagaagaagtattttaaggctcttttaccacctctgagttcctgaatggattggtttggtttgtttgttttgttttgctttgtttttgagacggagtctcactctcacccaggctggagtgcagtggcgcgatctctgctcactgcaacctctgcctcccgggttcaagcgattctcctgcctcagcctccagagtagctgggactacaggtgcacgccgccacgccttgctgattttttgtattttagtagagacagggtttcccatgttgcccaggctgctcccgaactcctgagctcaggcagtccacccacctcggcctcccaaagtgctgggattacaggcgtgagctaccacacccggccatggattgttttaatattaactgttatcactggacaaagacttgaggtgacaatagtgactgggtaatcagggtcaactttggcatgaccaaataatatcctgaacagtattgattcagagtaatccatgttctgagctttgttgttttctgatgcgtggggacggatcagtaatgtgcaggttgttagaacaccagtgacttctctgtggctgagtgcatcgacaagtgtgtggtgggaggagacggcggctccgtccggagcaggagctgtcatgtggggagctggcccaggctcatgagagcaacttgcgctggctgagggaacggcaggtccaggcgggcagcgctgtctggcgcctccctttctgcggtgccggaatctgcttgtctgcgaccgtccgctttggtagctgccagccacatggggctgttgctaatgtggcaggtgtagctgaagagctgaatgttttgacttattttaattaattaagtggttatgtgttgccagtagctcccatctgggctgtgaccccatggtctgcggacctcactctggcaccagactccgagtggagctgcatgctgccactggacagtgtggagtgcctcttcgggttgtgtagaagtaggaaatgtgtcaccaacataggagctgttgctgctgcgttctctagcacacctgccttgttggtactgctgggcgtggaatgcctctcgggctctgacagtgtcattgacactcttgctgatctccttggatttacctggtccatttggatcaagttctttcacctattcacatgagcagataccaccttaaaaccttaaaggttggcttaacacttcttgccctttttttttctttcttttagtctctgcgatatgataccagctgttttgtggagtattttgccttggatctcctgatggagaatggggagtgccgtggtgtcttcgcactgtgcatacaggacgggtccatccatcgcataagagcaaagaatactattgttgccacagggtaggaatctaatttctactttatttcctttgtaaaaatgaataaattccatttagagtgtctttattttaaggaaaatagaggcattgtagaatagcagttcagacacaggccttgatataaccgtgtgagggtgatggcctttcccagccgtggttcctcacctgtaaagggtgaggacagcagcacctgcctcagggggtgagaaagcatggccctcagtagtcggtagtggctgccgtcaggttcacagcgtacctctcccgattttagatgaggaaactgtggcccgaagagtcacatggggttttctggcaaaatccctcttgttttagtgggttctatgtttatactgattcctgggatagataagtctgtcttctccacataatgaaaataaaaaactttaattttatacagtggcagttactttagccactttaaaagttaagaagtgtcagtacagccaagaaaaaaaatcagcaaaactacaggttgggaaaaaaatattttccaaaccatatatctaatgatatcttagtatctaaaatagcaaaaaaaataaaaaataaaaaaaagccctactaaaaccaacctactaaaccctactaaaaaacaaccctactaaaaatgggcaaaggacttgaatagatatttttccagagaagacatacaaatggccagttgatgtatgaaaaaatgctcaacatcaccaagcaccagagaaatgcaaattaaaaccccaatgagtatcatctcatctcgctccagttagagtggctgttaccaagaggacaaaagatagtgttggtgaggatgtggagaaaagggaaccctgtgtgctgttggtgggaatgtaaattagtacaactattgtggaaaactctggaggttcctcaaaagtcacaggactaccatgtgctccagcaacctcatttctgggtgtatatccaaagggcatgaaatcagaagctcaaagagacacctggacccccatgttcattgcagcgttattcacaatacccgagatatggaaacaacctaaaaatttttggtgtttaatgacaatgtggtgtgtgtacacaactgaatattattcagctatgaaaacgaaggaaatcctgtcatgtgtgacaacgtggatgaacccaaagtcattatgttaagtgaaacgacccaggcacagaaagacagatactgcatgtcactcatatgtggatctaaaactgtcacaactcacagaaacagagtaggacagtggttgccaggggctgggggaatgcagactgtggcgatgctgattaaaggtgtaacttcccgtcacaaggtgaagttctgaaggtctgataaacagcatggtggctagagttaatgttatagagcatggtggccagagttaacattatacagcatggtggctacagttaaaatcatacagtacggtggctatcattaatataacttgaaatttgcgaagagagtagaccttaggtgtctgtatctccaaaaaaaaaggataattgtatgaggtgatagatgtgtattaagttgattgtgtcatcagttcacaaaataaatcatcacgttgtacaccttaaatatatacagtattgttttttgtttaattcatcaatcatacctcagtaaatctgggggaaaaaaacaaaatccataaaaattttaaaattttcattataaaagtagtatatgcttactggggaaaccttttgaacagcacaaatctaaaatacaaacagggccagacgcatagtggctcatgcctgtaatcccagcactttgggaggccgaagtgggtggatcacctgaggtcaggagttcgagaccagcgtggccaacatggcgaaacccagtctctactaaaaatacaaaaatcaattggatgtggtggtgcacacctgtaatcccaggtacttgggaggctgaggcagaagaatcacttgaacttgggagcctgaggttgccgtgagccgagattgtgccaccgtactccagcctgggcgacaagagttagaccctatctcaaaataaataaataaaatataaatggaagtctcttctctgatcccaggcttctatcctacctgcgcagggtagcagcaccactggcatggcccccagtgatgtgtgtggggtgtgcgtgagttgggggttgtgtgcacacagcactgagaagatggtgcccgggggctgccctgtccgttctgtgatctcattagacaggaggtccggacgtgggccactgtgtgcagtcactgctctctgttgtttccataggctactggcgcaactacttgagctgcacgtctgcccacaccagcaccagcgacggcacggccatgatcaccagggcaggccttccttgccaggacctcgagtttgttcagttccaccccacaggtagggcaggacgccttgcccggaaagcgttcggctcgtgtgtcttgtaagcgtgtggtgcctactcattgctcttccatagttttatgtaataacatggttttgaagatcagcttccttagctctcaggtcctaacttcaatgtcatttccttaaggagacttttcccacactccccttcctctaaggcagtttgggccaccatcttatgcatttctcaagagccctaaaccctgccttggtgatacttatgccagcagtaaagcagggattgaggccgggcatggtggctcacgcctgtaatcccagcactttgggaggccaaggcaggtggatcacctgaggtcaggagttcaagaccagcctgcgcaacatggtgaaacctcatctctactaaacataaaaaaatcagctgggcatggtggcatgcacctgtgatcccagctacttgggaggctgaggcgggaggaatgcttgaacctgggaggcagaggttgcagtgagccgagatcgcaccactgcgctccagcctgggcaacagagtaagacttcgtctgaaaaaaaaaaaaaaaaaaaagtaaagcaggaattgttcagtgtccctctttgcagtgaggtcgtcagcaattcgggcaggcaggtcttctcattaactggggtgctccacgcccagcacatggtagggtctccatcggggtttactgagtgagcattctgagagctgggtgaatgctgtggaaccaagaagcagcacaggcagatttcagctttgtaggacaacacagagcttccgtgacaatgggatgtaaagttaagacacagccatgagagaaccccatgtgacgttgggcgctgggctcagcccccgtgaccactgagggagcttgtcgtggggaagatgagcttgtcttggggacgtctgacggttgaggttacgaatgtgcaatttggagacattaactcagaaatgacagttgaagtcttgagtttggaggaggttcttcaaaatgagtcagagacagacacacacacgtctgcctcttgtttgaggtgactcgtcctggacttttctgggttgcttttctgacctgtggacgatggagacccctgaagtggtgccaaagaaccagacctgtgtcttttctttctctgtcagtgtcagctttctgatccctggaagggatgaaaataagaaatggatttgttgtaggtttttttttttaatttgtttagagatggggtcttgctctgttgcccaggctggagtgcagtggagcaatctcgactcactgcagcctttgtctcccaggctcaaacgatccttccacctcagcctcccaaatagctgggactacaggcatgtgttagcatgcccagctaatttttgagggtttttttgtttttggtagagacagggtgtcaccattttaagcccaggctggtctcaaacgccagggcttaggcgatcctcctgcctcggcccctcagggtgctggcattatagccatgagccactgcacccggcctgttgtattttttattactgtttttaatcagtaaaatgtcagtgagcccctgaattccctctgtaatttgcttagagctccacttctcatgctttgtcttcaatatgtgagaagtaaccacagaaaagagagcatggaaacttagaaaatcaaaaggcaggtgagatgcaagaatcacattcttgttttgaaagcaagattgccctttttgtatactaataaaaattgtagcttttgaaatacatttagtttagggtttttgatctcctttgttaaaattcgagagcttggcacgccctgtttctcatcgcactgaggagtcacagagccgctgtttggggcacagaccgccggactgcccaggtttgggtttgagctctgtcctcagctgcatgactggatgttaccaagcgttaatttgcttgtcactgagaaagggggtcgtactacccagagttgttgtaagacttaaatgagtttaatatgtggaaagcagctagaactgcccatagcaagtgcagtgtaaagatgaactaaaataatcattattactgtccttgccactgtttgggtaacttagatatgaattctccaagctagtattcttaactagtcaccacagtatcgtagcgcaaaagaatgttcaaaaattaaaacaaaatttgaggcatccaacgtacaccgggctgtaatcagagtattggccagaggtctgtgggccggcctttctcctctctggggacgccactctgccccagcctctgctgcagctgtcagccttgtcagtgctttttgttatccagactttctactgtatcttaactgttctttctgttcagttttgcatataatgccttctgcatatcttttttgtctctcccccaaaaaatatcttgtaaaaaaaagtaatgcatttgaaatagagacccagcaattgttaggttataaatgtgtggttttttgcaggcacatatggtgctggttgtctcattacggaaggatgtcgtggagagggaggcattctcattaacagtcaaggcgaaaggtttatggagcgatacgcccccatcgcgaaggacctggcgtctagagatgtggtgtctcggtggatgactctggagatccgcgaaggaaggtgcgtgtggtttaccaccagcactgtctgagcgggcacacgggccggggttgcttctgtgagtttcagcaccactcgccctcaccttcgtgtgcaggcacatgtgcacagccacctctctcagctgccggcaggcatctgttagtctgcgatattttcctaaagacctacattttgaaaattttagccagtttctttctcaaatctgtggaacagagtttctcttagtgtgtgtgagtatgtgacggagtatggaagagagagacacgcacccaacctgaagtcggcgtgtgagccttgggtgtggtgtctgatacccacagatgtttttcgacagctttcaaagtgtgtgggtcatttgcctttcagaagaacagtttgcagctctttcattgcctgaccctgttctttaatgtgataacacttgctaaatatctgctggtatctggtgtggcctttagaggttttacatttttatattaaaaaaaaaagaagtcggatggttttttggaatatggtggccctccgtatccatcggttccacatgtgtggtttcaaccaactatgtactgaaaataaaattgcatccttacaaacacgcagacttttttttttccttgtcattgttcgctaagcaacacagtgtagcagctatttacctgcatttacattgtattaggtactatgagtaatcctggagttgctgtacaacttaaatgtaaaacttgaaatgaggatgatttaaaatatggaggaggatgtgcataggttatatgcaaatactctgccattttatattagggacttgagcatccacggattttggtgtccgtgggggtcctggacccaacctgccacggatacgcagggacgactatttggcatagaggcctaatgcttttaccaaggacagccgctgcaggctgtgatccctgagacgagtgtgagttcagtaagggcagagtatttgttctggttctcagctgtgtcccagcacctaggattgtccctggcacacagtagatgcttagaaaagatttgatgggagggtggccgtacatgaggggaaattttcctcagtatcaaaacatgttgcaactcacacgcttccaagatgacgtattctcaggtctgctgccgttgccattctctgccttatgtgatggtgttctgtcttaccagaggctgtggccctgagaaagatcacgtctacctgcagctgcaccacctacctccagagcagctggccatgcccttgcccggcatttcagagacagccatgatcttcgctggtgtggacgtcacgaaggagccgatccctgtcctccccaccgtgcattataacatggacggcattcccaccagctacgaggggcaggtgatggtgctggcttctctcccacagctggaaagaaggctgggacaacggggcccatcttgcagttgtctctttagatcttagaggaagagacagatgtttccttaaagaaagtactgtattgttttctaaattgcacttgaaatttctatcagtggaggatggaaggaggcttaataatttattcctcctaagtaaactgtcatagatacatcatttgcagcttttcccattttataattactttcctatatgatcttgtgttatttctaatgagcttatacatcaagggatctttataattgctatttctaatgatcttgtacatcgagggatctttataattcatacctttgagtggtttgcggttcacacagagcttgtcagtcacttagcctccttgttgggcgaggtgggtggaagctgttactttccccgcatagatgaagaggtgaacagggggtagaagagtctggaacatcagtctcccctgctgatgttcctccacctgccgtgctcctgggtctgagctggagcacaggtggtgagggcctcgggaacatgggacacgggggacagtcgcagatgctgacattggaggtcctctgacctgcttgtaacagcaggtgctcaggggcagaggggaaactggggtatacattcggaagtttccctctgaagaagagtagctatggtccttacttccttcttagatacggtctttacttccgtctctttgtttcttggagatggagactcgctctgtcacttaggctggagtgcaatggcgcgatctcgcctcactgcaacctccgcctcccaggttcaagcgattcttctgcctcagcctcccgagtagctgggattacaggcacccgccatcatgcctggctaatttttgtatttttagttgagacggggtttcaccatgttagccagacagttctcgaacccctgaactcaggtgatccacccgcctcagcctcccaaagtgctgggattacaagcgtgagccactgcatgcccgacctacttccctctctttctctgacctgcagcacagacaccctgttgagggaggtgggcttgtggaggaatgggcatcttgacatttcacctgaaatcttcctttccacaggtcctgaggcacgggaatggccaggatcagattgtgcccggcctgtacgcctgtggggaggccgcctgtgcctctgcacatggtgtcaaccgcctcggggcaaactcgctattggacctggttgtctggtcaggcatgtgccctgagcatcgcagagtcgtgcaggcctggtaagtgttttcttcaggacccagactatttgagaaggcgcaggaggttagtcttttttctttttttttgagacagggtcttagtgccctgttcttagggcgcgaagaacaggacagttagcatcgttcccacctccagagatcctcacggttgttatgcagcctcgtgtgctcagaacagtgtgaggtggatgaggcactggtggatgtttgcgtggcaaggatggtgggaccccaggcccatgttcttcccgttagctttctctggtgttaactgtttagcatcatttctgctgtttttatagaacaggcgctttttgctttttgtatggactcaagtgaaataaaaactagcaccgccgtaccttataaacgtgcgcccttttctatctgtagttagaaaggtacaggcagtattaaaagggtagctacttcagacactgtgtctctgtggatctgacgacagctcaggaggccagcacatgcagagccggcgtctcatccccagccgttgctgatcatcggcgaaggcggggttcaggtgcctcgttcctgacgccacaggttgtgcttgtctcactccatagccctgcactttgtcgcagtgaggtctgataccacttctctcagagcagtgtagaaattttgagcttctctttctttgaaaatgcagaaaagaacattttgtgagaataccctatacttgacatctgagaaaccgctcacacatgcagcatctcacgcagaatgctgtggagtcggactcaaaaggctgcacgcctgtggtcctattgataggacattctggacaaggcacatctagggaagaaaagggattggtggttgccagaggctgtttcctgattgtgctgaggcttacagacacagctctgtgtgtgtcaaagtttgaaaaacctgcattaaaaatgatgagtttattttactgtatctttacgctttaatttttaaaaatgaaaaggaaagaaaaaatgcttgtagcatccctacttctcccccaacccccgacccccccaaaaaatatatatatgtgtatttttagacatagtctccctctgtcacccaggcttgagtgcagtggtacgatcaggtgcacgccaccacatctggctaatttttaaaaatgtattctagggacagggtctccctgtgttgcccagggtggtcttgaactcctgacctcaagtgatcctcctgtctcagcctcccaaagtggttacatgcatctatccatgtgttaaaatcggtagaactgaggccgggtgcagtggctcacacctataatcccaccactttgggaggccaaggcaggccgattgcttgagctcaggagttcgagaccagcttgggcaaggtggtgaaaccccgtctctaccaaaaatacaaaaattagctgggcatggtggctcacacttgggtagtcccagctacttgggaggctgaggtgggaggattgttggagcctagaaggcggaggttgctgtgagccgagatcgcaccactgcactccagcctgggcaacagagggaggagacactgtctcaaaaaaagaaaaaaaaaagaaaaaagaaactgtagaactgtccaccgaaagaaaaaagtcaattttaatggatgatcaatttttaaagcgttataaacaaaaggaaaagagacaccagcaagcctagaagcatttgagcagaccgtcaagagacccacagcctggtcccgaggagaggcggtaggcgggacagggcctgttggactcctgcatttcatacctcctatctcctgcatgtgttacttattgaagaaaaaatatatataattttataaaaaaaaaaaaacctttaaaacttttttcaagacatcttggaaacacaagagttgcaaatcttggccttgtgcagcagctcacacatgtgatcccagcactttgggaggctgaggcaggtggctcacctgaggtcaggagttcgagaccagcctggccaacatggtgaaaccctatcgctactgaaaatacaaaaattagccgggtatggttgcaaactcctgtagtcccatctactccagagtctgaggcaggaggattgcttgaaccaggaggtggaggttgcagtgagccgagatggtgccaccgcactccagcctgggctacagagcaaaattccatctcaaaaaaaaaaaaaattgcaaatcttgaagtatagatgagagcacacaatagtccaaatcagcaggtgacttgcaagcacacagcagccaccttcctccccctaatgtgaaggacagtggggcggccggccccttgggaccaccatctggaaggtgtcattttttcccgttagtggagtgacatttatatacacttaatgtatataaatctgtatacatttaatttttttttttttgtaagacagggtctcgctctgttgcccaggctggagtgcagtggcgcgatctcggctcactgcaacctccatctttcgggttgaagcagttctcatgccagataatttttgtgtttttagtagaaatgaggttttgccacgttggccaggctgctcttgaactcctgatttcaagtgcttcacctacctcagcctcctaaagtgctgggattacaggcgtgagccactgcacccggcctacattttaattttttaattttagagatgatttctagtttattcactctaagatcacttaatggatatctactgtgtgccaacagttttgccttttatgtctgttctttaaaattggccccaactcaacagatggcctcagatgtagggtgggttggcagtgtgttagctcaggagacttacacagtttccaggctccttgagcggctatgctacatttttgtgtgtcgtactaaatccatttgtttttttaaaacggttttcaaaagttaaattctagctctttttgttgttgttttaggagataaagtccctccaattaaaccaaatgctggggaagaatctgtcacgaatgttgacaaattgagatttgctgatggaagaagcataagaacatcggaactgcgactcagcatgcagaaggtaagagcctggactcgctctggagtgagcaggctggctgcatacctggccctgcactggttttgtttttttaaaaacagatctagggggatgcaggtgcagctttgtgtggatgtactgggaggtggtggagtctgggcttttcatgtacccgtcacccaagtcgtgtgtgttgtactcagcaggtaattgctcatccccacccctcccgctttttggagcccccagtctctgttagtccactccgtgtgtccatgtgtactcactgttcagctcccacttccaagggagaatgtgtgacacttgaccttctgagtcacttcacttaggatagtgacctcccgttccatccgtctggctgcggaagacatgattgcattctttttttatggccaagtagtatttcatggtatatatgtaccacattttctttatctggtcgtccgttgatgggcacttaggttgattccatgactttgctattgtgactagtgctgcaataaacatacgaggctgcaccagtatctggaggtaaacagcagtaggacatactcctcactgtatcaagaatatgaaagagaccagaagtgcacttcttctccacatagaaggtcagcaggccagggcagaattagtgactgcttagcatccaggacagccttctgtggttcacttgtgtgtgcttgggcatgaccgccgtgccctgaccgtcgctggctgtcatggatgagtcacagcgtggaggagagggagccgcaggaccaccggagaagctccgtccccagcagggcagctttctcttagaggtttcctggagttcaacacaagactggtgcttacatctcaggcccagatattgatcatgtcttcatgcctggcttccagcagctcggaaacgtctttaagctggacctgttgctgcccctaaatatactcagcagagagggagagtgggcggccggtggacagtgatctgtgtggcctgtgctgctgggagtcggtccagtaggaccgtctgtgatgatggaaatgttgactgccgtccagtatggcagccattagccatggggccgtggagaacctgatatatagtcagtctaagaaactgaattcctctaataacaaggattcttgtccatgaatgagaatctcttgtctactatttgcaagaattgctgcgtattttctaggaagaagtccactgctttagtcctattctgaaaggcatttggtgttagacacaagagaacaggttccctgctgacattttcagaggcccgtgcccttcggtcttcaggtgaggctgggcttgagggaggctttgtggaacggtgagaagaacagcgtgactaaggcacagaaggctgagtgatgccctgcagtgcttttgtagggttggaggccagctgggaaagaaggaacccttgcgttagagaatgggaacatgccttaggatatagaaatggcaaatctgagatagtttgaagtgagaatactagaagtgttcccaccaaacaaggtgtgtcttggtgcctgctgtatcccaggctccgtgaggtgccggagtcagcactgaacaaacagagcttcctatgcttgcggaaatgcatttcgttgggggaagggatttttctgctgactctggctattaatagtaacaatcaaaaaaagaaatgaggtaaattgttagaaacaggcccccaaatgtggccataaactggccataaacaaaatctctgcagcatgtgacatgctcgtgatggccaggacgcccacgctggaaggttatgggtttaccgtaatgagggcaaggaacacctagcccacccagagcggaaaacctcttaagacgttcttaaaccacaaacaatagcatgagcgctctgtgccttaaggacatgctcctgctgcagataactagccagacccatccctttatttcctgtaaggaatactttcagtaagtcttatcactggcttgctgtcaataaatacatgggtaaatctctgtttgaggcttttggctctgaaggctgtgagacccctgatttcccactccacactctatatttctgtgtgtgtgtctttacttcctctagtgccactgggttagggtttccatgacccagctggtcttggcagtaaatattgaaaaggaatagatacagtttccattatttacagatataatttccaaaaaatttccagagaataaatggaaaaactaacagaaacaaaacaagaatgtagtaaggtatgtggataagagatttgtatgtaaaaatcagtagctttgcaatgtgccagcagtaatctgctcagacatcagtaaatatctcattcgcatttcaaacaaaaaatttaaaatgccttgaaataatgtaaccagaaatacgaaaagatgatacgaaaacgtcgctgctgaaggacatgaaagaatgtaatactagattctgagatgcaatttttttcatttgttcttcctgaaaaaccgttaggttgatgtgcattacagtgttacgattatgtatgagtctaaggaaaatcagatgaaatgtccaaattgaaccatgaaggtgcattggtagaggaagagacaattagggtcagtggagcaaagcacagttagagggagaagcaaggaggaggagggatcacggaggtggtgcctgtgtgtcccacaggaagcaaaagctgatgcccagttcccagcatacctaagtaaacttcaggtccactcccagcacgtttctcgtgatagtaaaactatgaaggaactcagtgtacaaggagcttctacaaaataggcagaagacagtagccagatgggccaagggccccagccacccacgcccctccctctccttgaagaccttcggttccaaccccaccatcagcagggctctgctcagttcctccttgtgtgtatcaccacagggctgctggctcgtgtcacgttcaccaccagaccccacatcaggagtcccgccaggggtgtggggaggcagcgctgcctggttggccgtggagccgtatggaacatggtgcctcacaggcagtctgcttggcgtcctggatcctggctgtatcccgctggaaaggatgtgtgtgggtctaagatatgtatataatagaaacatttattcagaagctttagtcaagacttcatttttaagttcagagtaataaactcatagtctaaatttcctaatttttctgtttaatttacataaataaaatgaaatgcaaaacaacaggtctaaaagttaagcagttcttggtatggctgcttctatgaattaaaagtttacaaataatattttgtgccacagtcaacgcaaaatcatgctgccgtgttccgtgtgggaagcttgttgcaagaaggttgtgggaaaatcagcaagctctatggagacctgaagcatctgaagacgtttgaccggggtgagcagacagtgggctctgtgcacactgttgggccctgccttctgcagggtgggctggtgtctgtcccgtcagtgctgacttagttccatgcttgctgtctggatgggtgctggcccccagctgtaaagccacaaccagtgactccatggactagcaggcccaggctgacagctcggagggcccgtgtgactgggtcccacctgcccctgatggaactttttgtgtccccaggaatggtctggaacacggacctggtggagaccctggagctgcagaacctgatgctatgtgcgctgcagaccgtcaatggagcagaggcggggaaggagtcacggggcgcgcacgccggggaagactacaaggtgcgccttctcgccacgcccacctgcacctgccttttcctcccgcctggtgggactcagccccacccctgcattttctctgcattttatgtcgtttccccaaaagtatatccaaaaaatgcctttttccctctggtaactttgatccctgggttctcgccattttctggatcactgtgacctgttccttgctttgggtcggcatccactgatgccagcagtggcatctccaagccaatgtgctttgctgttagaaggccaaggttagaagtgcagccagcgtggcatgaccaggaaataaatgccagtttattaaataacgagtaagccaccgtttcaagcctgccctgtggaggaaatgccagtttattaaataacgagtaagccaccatttcaagcctgccctgtggaggaaatgccagtttattaaataacaagtaagtcaccgtttcagacctgccctgtggaggaaatgccagtttactaaataacgagtaagccactgtttccaacctgtcctgtggtttggaaaaggtattatagagcctgtcctgtggtttgattacggagcctgccctgtggtcacttgttcttcagatgaactgatttttgtgcagagcacacgtgttggattctgcctggtaagagtttttcacatatgatagcaaaaaacgacggaaagggaagcttggggtgcaaatgcaagttcagcataaaccacatcagcaaaaggacaaaggctccacaaggcaggcgcacaggctggttcagggccatgtgtgggcggctggtggcagcctttccagtcagctgaacacagtgaatgggaaaatcatttttattcaccatgaaattttactgatttaccctccactagaatatgctgatggctgtgatcactgctcagaatttgctcgtctcctcatacatattaagagtctttcctgcaaagtatatgaatccgtgtttgccagaatacagaataataataaatttatgatttttaattttttgagatggagtctgactgtcccccaggctagagtgcagtgttgcgatctcagctcactgcaacctctgcctcccaggttcaagtgattctcctgcctcagcctcccaagcagctggggttacaggcgcatgccaccgtgcctggctaattttgtattttcagtggagatggggtttcaccatgttggccgggctggtctcgaactcccgacctcaagtgaaccacccaccttggccttccaaagtgctaggattacaggcatgagccactgtgcctgtccaggagcataaatttagttggtgacaacgagttttaattagaatagaagccagatgcagtggctcccacctgtaatcccagcatttgggaggctgaggcaggcagatcacttgagccccggagttctagaccagcctgggcaacatggcgaaacctgtctctacaaaaattaaaaaattagccaggcgtggtggtacacacctgaggtaccagctgctcaggaggctgaggcaggatgattgattgagcccgggaagtcaaggctctggcgagctgtgatcacaccattacgctccagcccaggtgacatagcgagaccctgtctcaaaagaaaaaaaaagtgtttttaataaaaacaggctgaaagaaaggattgaggtagtctcccagcgcttggagcaaaaagacaaagtatttgataaactcttaggtacataaaggatgtctaagggaacatgcggacatggattactctggactcactgctggctgcacattgctggccagccatgtggcctctgtgcgttctgaacgtgttgatggtgccaacctcctgggctgaagtggaaatggaatgggttctagggcatctgtctcttagatcattttaacgtttgctgtgttttttctgtattgctctgttagagtaatgagaaatgtgatggtgtttctgggctcaggtgcggattgatgagtacgatcactccaagcccatccaggggcaacagaagaagccctttgaggagcactggaggaagcacaccctgtcctatgtggacgtcagcactgggaaggtcagtgtggagctcgttctcaccacagcccagcacccacacggccccgcccaggtctgcgggctggccttgctgatggtgaacgcagaggagcaggccagatttaaatcacctcccgacagatttgaggcaccgctgaaaaaggcactctgacagcagttgggcttcgggctggaaacagaatccagtgcctgcaggtggttcagaggagccttaaggaagggttgctctgtggtgtgggccagatggacgtcactgggcaggagcaagtgtccaaggcctggtggcaggggaagagatgatgattatggacctagcgagaaagcatctgtgtagtggggacacagccactaccagaaaccagtcccgagccaagggagcccagaagagatccctcccctctcctcccatgggctgggccaactggaagcatctgcaggggagcagaggggatgaggtgcagcccttagcatcccctgggcactgagcaagcagagaagggcagaaatggaggcggggttggggtgagcagcgtcctgggaacagctagccgagggtgtggtaggggggttgcagcttgttccacacaagcacagcgtcctgggaacagccagccgaggatgtggtagggggttgcagcttgttccacacaagcacagcgtcttgggaacagccagccgagggtgtggtaggggggttgcagcttgttccacacaagcacagttcacccgtgtggcatttccgctgggcattgagattcagaaatcatgaagatagaaagcttttacccttaagcttttcataacttgtaagggagagtcgtataatcacttagctgtgtctgtggaagttacctttggactctcactatcatctagtgtgtctgtgattcaggcagtaggtcattttcagaatttatcatgaaggccatttcctgatagtatagagaggtcacacttgcttagcacaagtctatttttaatgtttccgggttcaggttttttgttttgtttttgttgttctgagatagagtctcatctcttttgcccaggctgaaatgtggtggctcgatctcgtctcactgcagcctcaacctcccctcggctcaggtgatcctcccacctcagcctcccgggcacatgccaccatgcctggctaatttttgtatgttttgtagagacggggttttgccacgttgcccaggctagtcttgagctcctgagctcaagtgatccacctgtcttggcctccccaacaggcatgaaccaacacgcccagccagtttcagtgatttttcaagaaatacgtactcattttagaaagtacaaagagattgaaataagagctcactaaccagagatgacccattatggtttaaatttctttgtatatgtgcctaccttttcctgtgtgtgcatatttaatacacggcttgagtattccttctctgaaatcgttgggaccagaagtgttttggatttcaggcttgttcagactttggaatatttgcattacacttactgtctgagcatccctaatgggaagatctgactccatagcacatttcttttgaatgtcatgctggtgctcagaaagtttcagatttgggagaatttcagatgtttggattagggatgttctacctatataaatatttactttgaagtagaaaaactggaagtagatagtttaaacatgaagtgtcttggtatagacaagggttctcccacttttcatgatgggagcatttttgtaaagcaaagcactgagaatctggtacagtgtcattttcgttgctctgttccactctaccgatctgccgtcatttacagtcccctgttgcgcatgtagatcatttttgaatttgttattggaaaatactgcagcaaataccttaaagtttacatgccgtaaatctacttttatagttaaaatttttcaaaaggaacacaagagatggctttttgtacatttttgtgcttaacttaccactgacttcttttcaaggtcactgtggaatatagacccataatcgacaaaactttgaatgaggctgactgtgccactgtccccccagccattcactcctactgatgagacaagatgcggtgatgacagaatcagcttttgtaattatgtataatagctcatgcatgtgtcaatgtcataactgtctttatacgcttctgcactctggggaagaaggagtacattgaagggggattggcacccagtggccggggagcgtggcactttgtcccttgcttcattcttgtgacaagataaaactgggcacagctcttaaataaaatataaatgaacaaactttcttttatttccaaatccatttaaaatattttactgttgtgactttagtcatatttgttgacctaaaaatcaaatgtaattatctttgtattctgttacatcaaaatccagatattttgttgtagtttcttttttttttttttttttgagacaggatcagtgcagtggtgcagtctcagctcactgcagcctcaaactcctgggcagctcaggtgatcttcccgactcagccttctgagcagttggggctacaggtgtgcaccaccacgcccagctcatttattttgtaattgtagggacagggtctcactgtgttgcctaggctggtctcaaactgctgggctcaagtgatcgttcctccttggcctcccgaagtgctggaattataggtgtgaaccaccatgtctggccttattgtagtttatttctaagttcaaattaatgttggtgcttttcctcctttttcttggcagatggtttgctaggtgagtgtgtcctcgattctttaaatcagggtccccagtccccaggccacagatcgttaccagtccatggcctgttaggaaccaggccacacagtaggaggtgagcagccagccagtgagcattactgtgtgagctcggccccctgccagagcattactgtgagctccgccccctgccagagcattactgtgtgagctccgccccctgccagagcattactgtgagctccgccccctgccagagcattactgtgtgagctccgccccctgccagagcattactgtgtgagctccgccccctgccagagcattactgtgtgagctccgccccgtcagagcattactgtgtgagctccgccccctgtcagagcattactgtgagctccaccccctgccagagattactgtgtgagctccaccccatgtcagagcattactgtgtgagctccgccccctgccagagcattactgtgagctgcaccccctgccagagcattactgtgtgagctccgccccgtcagagcattactgtgtgagctccgccccctgtcagagcattactgtgtgcgctccgccccctgccagagcattactgtgagctccaccccctgccagagcattactgtgtgagctccgccccctgtcagagcattactgtgtgagctccgccccctgtcagagcattactgtgtgagctccgccccctgtcagagcattactgtgagctccgccccctgtcagagcattactgtgtgagctccgccccctgtcagagcattactgtgtgagctccgccccctgccagaacattactgagctccgccccctgccagagcattactgtgtgagctccgtcccctgccagagtattactgtgtgagctccgtcccctgccagagcattactgtgtgagctccgccccctggcagagcattactgtgtgagctccgccccctgtgatcattactatgtgagctccgccccgtcatatcattactgtgtgagctccaccccctgtcatatcattactgtgtgagctccgccccctgtcatatcattactgtgtgagctcctcccccggccggagcattactgtgtgagctccgccccctgccagagcattactgtgagctccgccccctgccagagcattactgtgtgagctccacccattgtcagcattactgtgtgagccctgcccccatcagatcattactgagctccgccccctgccagagcattactgtgagctccgccccctgccagagcattactgtgagctctgccccctgtcatcattactgtgtgagctccgcccccatcatcattactgtgtgagctccgcccccgtcagagcattactgtgagctccgccccctgccagagcattactgtgtgagctccgcccccctgccagagcattactgtgagctctgccccctgtcatcaatactgtgtgagctccgcccccgtcatcattactgtgtgagctccgcccccgtcagagcattactgtgagctctgccccctgccagagcattactgtgtgagctccgcccccgtcatatcattactgtgtgagctccgccccctgtcatatcattactgtgtgagctccgccccctgtcatatcattgctgtgtgagctccgccccctgtcatatcattgctgtgtgagcctcgcctcctgtcagatcagtggtggcattagattctcataggagtggaatcctgtcgtgaactgcgcatgcgaaggatctaggttatgccccgcttatgagaatctaatactgatgatctgagatggaaccgtttcgtctccaaaccatccccacacttgtcagtggaaaaagtgtcttccgtgaaaccagtccctggtgccaaaaaggttagggactgccggtttaaataaccaaatgctaaaagaactggcatagaagtaaatgggctgctgctttatttttaggctgttctttttagagaacaatgacagttatttccaagtttgtcattagaaaataatattaggttggtgcaaaagtaattgcggtttttgctattgctttcaatggtaaaagccacgattacttttgcaccaacttaatatgataaatttgttccttaaagtgtatttttgataagaaagcccttttgtttttccttctgttaattttttgtttttttcttggtagagacagagttttgccatgctgcccaggctggagtgcagtggtgtgatctcggctcactgcagcctccacctcctgggctccagcagtcctcccacctcaacctccctaagagctgagactacaggtgtgagccaccatgcctggctaatttttagagacagggtttcaccctcttgcccaggctggtcccaaactcctgggctcaagcagtcctcctgcctcagcctcccagagtattgggattataggtgtgagccactgccagaaaaacgtttcctaagacaaggcaggtcttacattatatttaaattttttttaatgatgtcttttttggcagtgcacagccagagaacaacacatcacacacaagaaacagttgtgctcatgtgatgggggcctcagcactaggaaggagtggactgttggcgcacgcagcagcttgaataaatctgaaagtcactacgctgcgtaagagaagccaaataaagcgcatgctgtgtacagagggtgtcgagaatgcctcctacgtgacggaaagcagatccgtggttccctgcagactggcaggagcagattccaaaggcacaggaagaagcttgcaggtagaatgtgttcattaccttctgcgcattataccacaaaaaagctgggaataaaaatgctaaccaaaaaaaaa

SEQ ID NO: 744 - DNA, 12654 bp, Homo sapiens
tcctctctgctgggcggccttgccgacgcacttttctcagcaagaattcccgaagtaagattcctcatcctgtgctcgtgggatgccactccccaccaagtcgcccaaagacccaggtccatatttttggtacccaggatccccaaagcaagtccgcggactgcttagttctgtagcctccgcctcctgggttcaaagccattctcctgcctcagccacacaagtagctgggactacaggcgcgtgccaccacatccagctaattttttgtatttttactagagacggggtttcgccatatcacccagctggtcttgaactcctaggctcaggtaatccacttgcctcggccctgtaaagtgctgggattgcaggcatgagccactgtgcccggccaactgcttagttttcatgagttgtttagttagtgagagctataaaccaaaagtatctgagacaggcctcaatgaatctacttactgatttatttgagatgaagttttgctctgtggcccaggctgcagtgcagtggcgcgatctcggctcaccacaacctccacctcgcgggttcaagcgattctcctgcctcagtctcccaagtagctgggactacaggcgtgccccacagcgtctggctaatttttatatttttagtagagacgtggttttgccatgttggtcaggcaggtctccaactcctgacctcaagccatctgcccacctcagcctcctgaagtgctaggattacaggtgtgagccaccatgcctggccaatttatttattttttatttcaatactttttggggaacaggcaggttttggttacagggatgagttctttagtggtcaataagtttggaaaggttattttgcgaaggttgacgacatgcctgtgacagcctcaggaggtcctggcaacatgtgcccaacgtggacacatgttgcttttatactttttagggagacataatacatcaatcaatacctatcatatgtacattggtttggtcaggaaaggagggacaacttgaagggagggggcttccaggtcataggtagatttaaagattttcttttttttgagacagagtctcgccctgtcacccaggttggagtgtagtggtgcgatcttggctcactgcaacctctgcctcccgggattaagtgattctcctgcctcaacctcccgagtacctaggattacaggcacctgccaccatgcccggctgatttttttttttttttttttttttgagacagagtctcactctgtcgcaggctggagtgcagtggcgcaatctcgggctcactgcaacctctgccgcccaggttcaagcgattctcctgcctcagtctcccaagtagctgggattacaggcacccaccaccacgcatggctaatttttgtagtttcagtagcaacgggctttcaccatcttggccagggttggtcttgaactcctgaccttgtgattcacccgcctcagcctcccaaagtgctgggattacaggcgtgagccactgcacccggcatgcctggctaattttcgtatttttagtagagacggggtttcaccatattggccaggctggtcccgaactcctgacctcaggtgatccacccacctctgccttccaaagtgctgggattacaggcatgagccactgtgcctggctggctttcaggctttttgtctttggcttgaaggtggggtttcactggggacctgcccgtatctgcctaggcattcgactgcctcctgccaccatcaggcatagctcactgcagcctcaaccgccaaggctgaagtgatcttcccatcttagcctaccaagtagctgggactacaggcaagtgccaccatgcccggttcattgttttttgtctgtgtctgtatgtggagatgggggtcttcctacgttgcccaagttggtcgtaaactcctgggctcctgccttggcctccaaagtgctgtgattacaggtatgagctaccatgcccagcctacaaaacaatttttaaaaacttagctgggcatggtggtgtgtgcctgtaatcccacctacttgggaggctgaggcaggaggatcacttgggccaggaagtcaagacggaagtaagtcatgattgcctcactacactccagcctgggtggcagagacccctgtctctaaaaacaaaacaatcacacacacaatcatattcatagttcaacatgagcacttgaagtaattaaagaccccagggcagcacacagaatctgcttagcctgtagatagagaacacaagaaaagccatggcaaaaaactacgtatgtccggccgggcacggcagctcacgcctgtaatcctagcactgtgggagtctgagacgggcggatcacttgagtctaggagtttgagaccaccctgggcaacatagtgagactctatctttacaaaaaatacaaaaattagccgggtgtggtggtgagcacctgtagtcccagctactcaggaggctgatgtggcaggattgcttgagcctgaggaggtcaaggctgcagtgagtttgtttgttctcaaaaaacaaacaaaaaacagtttatagtctttatacacagccgctttgggaaagctccattccttaacttgtgcttgtcttggtcttcctgtgtgtagttactgctgtagaaaagtattaatagcttcatttttttgttttgagacagagtctctgtcgcccaggctagagagcaatggcacaatctctgctcactgcaacctccacttaccgagttcaaaaaattctcctgcctcagcctccccagtagctaggattaaggcacctgccaccacgcctggctaattttttgtatttttagtagagacagggtttcgccatgttggccaagctggtgtcgaacacctggcctcagctgatccacctgcctcagcctcccaaagtgctggattacaggtgtgagccaccgtgcccagcctaatagtctcattttgtttcttttctttttttcttttctttttttgagatgaagtttcgctcttgttgcccaggctgaagtgcaatggcacgatcttggctcactgcaacctctgcctgctgggttcaatcgattctcctgcctcagcctcctgagtagctgggattacaagcatgcaccaccacgcccggctaattttgtatttttgtagagacaggtcttctccatgttggtcaggctggtctccaactcctgacctcaggtgatccgcccaccttggcctcccaaagttctgggattacagacgtgagccaatgtgcccggcctaatagtttcatttcatgtaaacataagtaacttccaagcaattacgtagagggctaaaattgtacctggtatttaagtcatcagaaccggttctgcaagtgactgtgttttgcattattgtgaagatatgaaaatgtggtgaacgacaatttaaagagtgttccacatcaccgtttaatttcttttttattatttatttatttttgagatgaagtcttcctctgtcgcccaggttggagtgcagtggcgccatctcagctcactgcaacctccgcctcccgggtttaaatgattctcctgccgcagcctccctggcagctgggactacaggcgcccgccaccacgccccactaatttttttagttttagtagagatggggtttcactatattgcccaggccggtctcaaactcctgacctcaggtggtccagccacctcgtcctccaaaagtacagggatgagccaccatgcctggcctattttactatttcagagttgaggtctcgctctgtcacccaggttaaagtgcaatggtacaataatagctctctgcagccttgaattcctgcagccaccgatatttcacttctgcattccagcctaggtgacagagccagatcctgtctctcaaaaaaaaaaaaaaaaaaaaaagatatggattgcaatcttgtttcctctggggctgagtgagggattgagccatgtgggacaagaggtttttgacttgttccatttattgcagcataacttgaatccagccgtcctttctggactagtgatttttgccagtctcatggctagagttttacaatcaaggctatagggtctttgtttaggtctatttggagctttatgtattttcatgtgattgtctttgtatattgtctgtgatacatgataccaaaaaaggagtactcatacattttattttattttactatttatatttttattattattttttgagacagagtctcactgttgcccaggctggagtgcagtggtgcaatctcagctcactgcaacctccacctcctgggttcaagcgattctcctgcctcagcctcctgagtaactgggactacaggtgcatgccaccacgcccagctaatttttgtatttttagtagagacagggtttcaccatgttggccaggctggtcttgaactcctgatctcaagtaatccacctgcctcggcctcccaaagtgctgagattacaggcgtgagccaccatgcccgtccaggttttatttttaatttttcaaaattttcatatttcttcagagatagggtctctctctgtcccccaggctggagtggtttgaccatggctcactgcagcctcgagctcctaggctcaagggatcctcctgcctcagcctcccaagtagctgggtctatagaagtgagccactgtggccaggcacggtggctcacacctgtaatcccagcacttcgggaggccaaagtgggcagatcacgaggtcaggagattgagaccatcctggctaacatggtgaaaccctgtctctactaaaaatattaaaaattagctgggcgtggtggtgggagcctgtaatcccagctactcaggaggccgaggcaggagaatcacttgaactcaggaggcagaggttgcagtgagccgagatcaggccactgcactccagcctgggcaacagagcgagactcagtctcaaaaatgaaataataaaataagaagtgagccactgcacctagctaattttttctattttttgtagagatgggggggtctcactatgttgtccaggctggtcttgaactcctggcctcaagtgatcctcctgcctcagcctcccaaagcgctgtttgagagccactgctcccggccgagttatgggtttttatttatttatttatttatttatttattcatttgaaacagaatctcgctctgtcgcccaggctctagtgcggtggcgcgatctcggctcactgcaagctccgcctcccgggttcacgccattctcctgcctcagcctcccaagtagctgggattacaggtacatgccaccacgcccggctaatttttttgtatttttagtagagtcggggtttcaccatgttagcaaggatggtctcgatctcctgaccttgtgatccacctgcctcagcctcccaaagtgctgggattacaggcatgagccaccacaccaggcctgagttatgggtttttaaaggtgcagaggcagaggtcacaggcaagtcataaatcagtacatggaggttgtacactggttttgccataaatagcaaggagatcttgaagccagggaccacgggtcataggtggattcaaaggttttctgatttggtgcagaagcgaatctttgtctaaaactttgggatccgcaggaaagaatgttagctctgggttgtgggcatggcctcctccaggcccctcaggatgggcatagcctcctccaggcccctcaggaagaaatttaggtaagagaagggtggtcagaggccagtcctcagctcccgctcatgtgaggtctgtgtgccagcacgcccctttggtgggagtccctgtttctggaaaacaactgaggagcacctgctaagatggcatggtttgcttctgtggagactctcgggactctggcttccatctgttgttctaagctcctgtgaccttcttgtgaccttcctgtggatcggctgctcatttccttctctgggctggctgggggcctggcttgcccttgaaggaactcaacattgtccttgcttctgtgcttgggaagacccacaggcccctaagggcgggggggggtccttgtttggtttcaggagcagcaggtgcaaaggccctggggtgggaggggtgagatgtgaggccacagcagcgggtgagggccaggctgcagagggttttggggaccatgaaggtgggcccttcagagatcaggcagggtcaggaaaggcagtagggaggcccaagacagcagacactgtggttgcttccatctggaagatgggcagctgcaggagcctggctgttcagggtcacacttctctccctgtcccggccccatctgctgggtgtccttccttggagcccttgacagcacctgagcccctcctctccatcccctgaaccttggtggttgtgccccccctcggggcccaacaatctcattagggtggcactgagacgcctaatcagctcatgaagcagcgagataaaggccggggctggcaccctgcggagggaggcccagcactcacagcacagccccctgagacccgccctgcacttggtgagtagtggccaaccccgctgtctttcctggcagccacttcccccagtgagtcagtgggggtctgctcatcacccaaggggcagagggagctgacaggcttttaccaccgtggctgaggtctgggtctgcagatgcctacccgccaccctgttattcagaggggactcccagccaacctcctcctctgctcccccatggtaaccagtgcttccaccatccccaggccagtgatggtctgggaacctcaggccacgtgggctcagctgacctgagtggacgccagtcacaggctgggtcgggccagggcagcgcaggcagcggtttccacatggatggcatctgatggttggagctccatcagggcccagagctgcccaggacagcccatgtcccagggctggagaagcagctggacggggcctgtgctatctaggatatgaggattgggtgccatgggatctgagcagctgggaccaccgggctcctgagtgctggttttgcacaggctggtgctggtcccagtcccggggacagaggctgaaccttagtgagggaaggtgccatggcagggtccaccccaatcccaggtgcccagcaccccttgcagagcccgcgtccccaaaatgggccacctgcccttgctttctgatcactctcacgcctgaagctcggcaaacagctggtagtagcccagggctggagtcaggaatcccagccaaaaagaccaggggcaggaaaggggaccccaagaggtggtccctggggcatccagtgcgggcaagcagcccctcctgtctgtgtcatgtgcctccttccagaactttccggcagcatgtgcagctgacagcagctcgatgggagattaggaattcccctctgctgttaataggcttaggggaagctgaactgcccttggcccaggtcactggggcttagggcatctggggagaggctgtagggagaggaggaggagaggccaccctgtgcagcagtgcagggacactgatctcgtccagagcggccgaggcccttcagccacgccacgccacgccaggcgggtgaccctgctccccgagctgactccagacacagagagggcctggtgattcccccagcagggggaacacatgcccggcaccctccgtccccaagccccagcttgtccctctatgaagtggggttggggaacgcagggcttcacagctcagcaccaagtctctgagacaggcccctttcccaggggcgccgtgcctggggaccctgccccccattttgtgggtcattctccatcagcactgcggggtgcccgtcatggtgctgaggggctcagggatgcctccgtgagtgggtgaagggaactgacagcaccccaactgcaaagcacagacaagaggcagaaagcaataaacccatcaataagaatcagaggggttggccgggcgcagtggctcacgcctgtaatcccagcactttgggaggccaaggtgggtggatcacgaggtcaggagatcgagaccatcctggctaacatggtgaaactccatctctactaaaaaatacaaaaaaaaaaataaattagccgggcgtggtgtcgggcgcctgtagtcccagctactggggaggctgaggcaggagaatgacgtgaacccaggaggtggagcttgcagtgagctgagatcgtgccactgcactctagcctgggcaacagagcgagactccgtctaaaaaaaaaaaaaaggtgagattccagccacagctctggaataggatcctagggggctactttggcaggtattaaaacttttttaggccgggcgcggtggctcacgcctgtaatccctgcactttgggaggccgaggcgggtggatcacaaggtcaggagtttgagaccagcctgaccaagatggtgaaaccccatctgtactaaaaacacaaagaaaaattagctgggtgtggtggcgcatgcctgtaatctgagctactccggaggctgaggcaggagaattacttgaacccgggaggcagaagttgcagtgagccaagatctcgccactgcactccaacctgggtgacagagcaagactctgtctcaaaaaaaaaaaaaaaaaagaatcagagggcaacagcccgggagacgcccaccagcctggaatcagggctaactcgacgcgtgatgagaagcggcaaatcagaacctaaggacacagtggctgcagggcgggggttcaggggagacctccctgagcgggaacttgagatggaggcagcccactaaccatcaggaagggcagctcagaggcaggctcctctgctgggcctggcaggcccattcccagcaggagccacagaggactttcatcagagtagcagctgggccgggtgcggtggctcacgcctgtaataccagcactttgggaggctgaggcgggtggatcatgaggtcaggagttcgagacaacctcgtcaacatggtgaaaccccgtctctactaaaaatgcaaaaatgcaaagattagccgggcatggtggcagacgccggtaatcccagctgctggggaggctgaggcaggagaatcacttgaacccgggaggcggaggttgcagtgagccgagatagtgccactgcactccagcccaggcaacaagagcaaaactctgtctcaaaaacaaaacaaaacaaaaaaaaacccagagtagcagttaaatgccgacgggagtcacgcttccctggggtggggaacgcaggggaaggggcaggaagttgtcagtggtcacccacagggaggtggtgaggactccaggctcaggacctgccacaggttgggaggctaggtttgctgtggattgtgggccggggcgagggaggccaggacaggggggagtccggagctgtgtgtggccagcgttgcaggggggcatccactaggcaaggggaatgggagcgtgcgggtggacccaagcaaagctggcaggctggttaccccagggcggattgcaggggctgctgtctggatgacgctggagctggcggggctgggtctcagcccctccaccggtgggttgagacccccacaagggttggaagcaggagggctgactgggacccgggcctggtctgcccccagaccgcagcaggagggagtccaggagccaaggttgccgcggtgtctccgtcagcctcaccatgaacctggaaccgcccaaggctgagttccggtcagccaccagggtggccgggggacctgtcacccccaggaaagggccccctaaatttaagcagcgacagaccaggcagttcaagagcaagcccccaaagaaaggcgttcaagggtaagcagagctgggggatggggcctctgaaagggaggaggcggtcctgaggctgcacaggaaggggagggcggggcagagcctggggccacttcactgggtgagtggtcccagcctcacagctggggaaggtagggcggtgcctgagggcctgagcagggatggaggagggggaaggggaattgggggctcctgtcacccgctccagatgctactgccaaccatgcttgaaaatacagccactgccggccaggcgcggtggctcagcgctttgggaggctgaggtgggcagatcacctgaggtcgcgcccggcctaaaaaaaagttttaatacctgccaaagtagccccctaggatcgcgagtttgagaccagcctgacaaacatggagaaacctgtctctactaaaaatacaaatttagccaggcgtggtggtgcacgcctgtaatcccagctactcaggaggctgaggcaggagaatcgcttgaatccaggaggcagaggttgtggtgagctgagatcgcgccattgcactccaggctgggcaacaagaagaacaaaactccgtctcaaaaaaacaaaacggccgggggcggtggctcatgcctgtaatcccagcactttgggaggccgaggcgggcggatcacgaggtcaggagatcgagaccattctggctaagaaggtgaaaccctgtctctactaaaaaatacaaaaaattagccgggcgtggtggcgggcgcctgtagtcccagctactcgggaggctgaggcaggagaatggtgtgaacccgggaggcagagcttgcggtgagccgagatcacgccactgcactccagcctgggcgacagagtgagactccgtctcaaataaataaaaaaaatacaaccactgccacccagggacagccatggcacaatgcaccgaggagtgtccactcacacatgcgcacacacgggcatctcgctcccatcagtgcaccgaggagtgtccactcactcgtgtgcgcacacaggcaccgcgctcccatcaacgcaccgaggagtgtccactcacacgtgtgcgcacacacgggcatgacactcttatgcacaaacacgctcacacctccacatatgcacgtgaggcacactcacagacaagccaccttcacaaatctacactcagaccatgcaccaaccacgcacccccccgtactcccccagggcacgcacctgcccagcatcctgggacttgcacctccttttctaggcctcagccccatgatgctctgggcagcagactcaccctgggtctgtgagggaagcctcctcagatgcgccaagccctgggaggttggggaggaggcgggtctctgcccactgggctcccagccaaacacctcatctcctaggaaggctagagatgacctcgggcctcaggctgactgagccaggactgggcccggccatgtccctgagtgctctgtccttgcaggtttggggacgacatccctggaatggaaggcctgggaacaggtatgacggctgccagtaccaacccgaggtctgcccaggtccccccaggcacacccagcacgcccggggcccattgcagcccacctcggcccccacctcccctgcttttcacttagggacccccagcctgtccatcacttcttcccccaacactgagctccagatccactggatctagagggtggggctgtccccatttgggacacttgcaccaggtgaggggaggggtttgggaaagaacagaacccctcgctgcctcctcccccttcagcaagccccaccctcctctggttccctcccctggacctgctgcacccaccctccttcccccacagccagtgtgtccccagaggagggccccactccagcgtccgcacgtccccgctcagcacactgtagggctacacctgggctgtgggaaacagggccacaggggatgggggggtccctaggccgtgggatcctctctgatccgtggcccgtttctcccacagacatcacagtcatctgcccttgggaggccttcaaccacctggagctgcacgagctggcccaatatggcatcatctagcacgaggccctgctgaagtccagaccctccccctcctgcccactgtgctctaaaccctgctcaggattcctgttgaggagatgcctccctagcccagatggcacctggacaccaggatgggactgcaacctcaggtctccccctacatattaataccagtcaccaggagcccaccacctccctctaggatgccccctcaggggctggccaggccctgctcaacatctggagatacaggcccacccctcagtcctgcccacagagaggcttggtcggtctccactcccagggagaacgggaagtggaccccagcccgggagcctgctggaccccagatcgtcccctcctcccagctggaaagctagggcaggtctccccagagtgcttctgcaccccagccccctgtcctgcctgtaaggggatacagagaagctccccgtctctgcatcccttcccaggggggtgcccttagtttggacatgctgggtagcaggactccagggcgtgcacggtgagcagatgaggccccaagctcatcacaccagggggccatccttctcaatacagcctgcccttgcagtccctatttcaaaataaaattagtgtgtccttgcc

SEQ ID NO: 745 - DNA, 28168 bp, Homo sapiens
agaacacatctgctttcctgtgtgagggtgaggcttgggccgggttccccgggaggctcatctccattgcgcagcgctacggcgacccgcaactccgaggctcggctggatgttgagagttgagggagcagccgtttcgggtgggcccaggcgaggagctgacaggaatcggcgtgggtcccgctctggactacatttcccagagggcctggtggcctgccacttttctcgcaggaattcgaacgtttcgtcactcctggcgggacccttagatctgggaggtgagatattttggtccccaggagaactggctcaggtctgcaagttcccatccgggatgactggaaagggcttaggtgaggataccgaagaccgatggggagctggcgccttgggcccctgcgggcggagcggcctgaaaggtggaggttgtgtttgggaggccgaggcaggaggatcacgaggtcaagagatcgagaccatcctggccaacatggtgaaaccccatctctactaaaaatacaaaaattagctaggcatggtggcgcgcgcctgtaatcccagctactcgcaggctgaggcaggagaatcacttgaacccgggaggcggaggttgcagtgagccgagatcgcaccactgcactccagcctggcgacagggcaagactctgtccccaccccaccccacccccccaaaaaaagaggggaggttgtgaaattgtctgggagataataacactgcggcttatgtgcggatatgggatacctgtcactgtgggggttgtggctgtgtgttcccgtggtgatgtgtgattgtgactctgcgacagtgtggggtgcctacgattgtgcagctgtaattgtgtgtttcctatggtgtgtatgtgattgtaactgtgttgccgtgtgtggctccttgtgggcaggtgagacgtgcatgtcgccttaagtgtgactgtccctaaatgtatgtggcattctgtgtatgagtatggggtcctgtcaactatgcgattgtgactccagaactctgtctctaggaaacctctctgaggtctggtcagattccaaccctggacagcagtgaacacaacctttcccctgagccactggaattggacagaatgccccattctcctctgatctccattcctcatgtgtggtgggtaatggggctggggaagaactcttacttgactaatctgggtaccaagaaaaacctggtgtctcacagttactcttccctctcccaattttacctttctccaggtgtcacccagaagaggaggaaagaatgcatgatgaacttctacaagcagtatccaaggtgtgttggggtttcctctttttcttctgaaaattcttgcttaaaggaatgtcatttaattataggtccctataattttcccatcacagaaaaggatggttgctccacttatgcttgctgaattttcttctcaaatatttattctgatttaaaaataaaaggatgattaatttagagatctcaaaaacacagcattaccaagaaaaaataaaatttagccactcagataactagggttaatattttaatgtattttcattatttgtcaaaaaccaaattttatttcatttaccatttgatgttctacatttttgcaaaaagaagtgtcagaaatattctcccatgtcatcaaatggtcttgggaaatacatttttgatgtttgcaaaaactatgatatacaaatcagacatgccagacttttaaatcctcatttgaatatatatctgtacttatacccgcccacccccacaggtttgaatttgggtttccgtgattaataataaaattgaacatattccatatgtttattggtttttagtcatcttttgtgacatgtcagttcaaatctttactcatttttctcttggaatagctcttattgattcgtatgagttatttatgtaatctggatctcagtcctttattgattgttttcctactatttggactatttcatcatttcctgtaagatgattttatgataagttctaatttttaaaaagctgagtttatcaatattttttctttatggttagtgctttttgtatctttttaaataaatccttccctgtcccaaggtcatgcagatactctcctatatttatgcttaaagccataagtttcactttcatgtttagatattttatatagttgcaactggtttttgtatatgttatgaggtaagagtcagattcccccctccttattaatacccagtttatcaataccatatattggaaggtctattgtgttctcattggtcttcaaatatacctagtgtctatatgtgtatgggtatgtttatgaactctttattctcttccactgattttttatattcctgtgccagtatcatacagtcttgattagctcgtctcccttgatggtaatctgccttgtcttcctctgactgttttgtttttggctttctgtaattttagtgtaagatatataaatgtgttttatttgtctgcttgggatttgtagagttttaaaatttatggatggatatctattattagttcaggaaaatcttcagtcattataccttcaaaaagcccccgtatcattctctccccctttccttctcaggttctaactaaacatatgttagaatttcttcttcttttctgtgtcttatctctttttggtttttagagttgatacttatagctgaaatcaaagcaaacaaaagaaccttgcctcatctcaggagggggcagtgggcatggcaggcaattacagagtttttggattcttcctccaagtaataataaaaatatctttattcagtttgtgtttcaacacttctaatcttggggaactcactaaattgtaaggttatccattcaccaggtaatcattttatctgaaaattagaggatacatactaggatagaggactcagaatagtgacaatgttttctcaaggtgtaaatttggaactctgagtgggcctactctcaatttttaaattgtatgtgtttggtacagatgcagagaaaatcaggataagaataagtctaactaagtattttgtgtaaggcctttctatctgaatttcttttaaagaggactgagtcttccctctcctgtgccaaagcccaaatagaatatctgcttcccctcttgcatcagtctctagttacacttctcatttctatagagaagattgttgcccagtattaacgggaataactagggacatgtagtatactgtagtagacaataaatttttattttttttgggacagagtttcactcttgtttcccaggctggagcacaatggcatgatctcggctcaccacaacctccacctcctgggttcaagcgattctcctgcctcagcctcccgagtagctgggattacaggcatgcgccactacgcccggctaatttttgtatttttagtagagacggtgtttctccatgctggtcaggctggtcttgaactcccaacctcaggtgatctgcccatctcggcctcccaaagtgctgggattacaggcatgagccactgtgcccgggggacaataaattttaaaagaaataaaatttgttttcagaacttaatctaatgtttaatcaggaaatatttgaaacatcaaaatatttgaaaattagaagtaaaacaaggatataccacattaccaatgttatttaacattgttttatagatattaaccaaaacacttacataagaaaaaaaattaggttaaaaattacaaaagagggcataagattatcgctttatagatgatgtgactgtgtaactgaaaaaccaaatctgcttgtgatcagcattttgaaataagcaggattccatatgaagcaagcaaaagaaaaactttttcctcataatttctactctcaaccctctctgtgggttaatttttttgttgccctggataagaactggtatagactataatttttatcactctttgatgtcctttgattgttttcagtcaaaatctagtctcattttactaattacaacctctagttcactgtaataatatgtgagtttcatttaaagcctcttctctgagctgagaattgcttcaagcttgcaaagtatgaaaagggacataattaagcttcttgatttcctcgccctgagcttctatttctcctgcctaagtcagtctctggatcctatgagattagagcaggggtagggaagaggaggtaaggaaaagaaaagtctttcttgacttgttttggtgttgatctcttttgccttgatggatgttcaacactcctttgttaggagacactattaagagtctctcagagaagcccctgctggaaacctctaattgcatttcctgggatatgcacagcatgtcttcttgaaatggctacttatgacatctgtcatacacttctgcattctgtgatccattcctttgttgaggtcactttgtccctttattgggtccacatctagtccaaagagggaaataggtactaatctttgtgccccctaagctccagagaatacagcaaaaattattccaaagtatctcatcattccactttggaccctggagtctaaaggggcccccttgcttgtcctaaggtgagggagaagtaccctcatttctcctatcaattgggaatgtgtgtccttttataaacaaaatttttgggacactaactgagtgtcctatagtttaactgaattctgacactacccagagttaacatagaccccattgcttaagaggctcagtcccagctggtcatgcctataatcccaggactttgggaggccgagatgggaggatcacttgaggtcaggagtttgagaacagcctggacaacatggtgaacccacatctctactaaaaatacaaaaattagctggatgtggtggtgtgtgcctgtggtcccagctactcaggaggctgaggcagaagcattgcttaaacctgggaggcagaggttgcagggagctgagatcgcaccactgcactccagcctgggtgatggagtagactcagtctcaaagaaaaaaaaaaaagactcagtcccacaagactgtacctgcttcagacaccagccacaagtctaaggcactgcacttctgcctagccagccaaaaatttagaggttcccgtaactctccttcaggttcaataattcattagaataacatatagaactcaggaaagcactatacttatgatgatagttttacttttttgttggtttctttgtttgttggttttgagatggcgtttcactctgttgtccaggctggagtgcaacggcacaatctcggctcactgcaacctccgcctcccgggttcaagcaattctcctgccttggccttctgagtagctgggattacaggcatgcgccacgacacctggctattttttgtatttttagtaaagatggggtttctccatgttggctaggctggtcacaaactcctgacctcaggtgatccaccccccttggcttcccaaagtgctggaattacaggcatgagctaccgcacccggcctgattatagttttattacaaaggatacaactaaggaacagcaaaatggaagagatgcatagggcaaggtatggggaagggcctgcatatctggaaaaggtcttaaaagtatttttgcctaagaaaatgtctgaaatgaaagattcattcagtagtatttatattgtggaaatttctgctaccataagggtataaaagttgaatttgtttatgttaatagggaataattatgacagtcttataagaattgtaatttccaagaaacttaaagtatgctgttgtctaagtgatactttaaatttatgtttaacccatttcgcattttaaaaattcaagaaatgggccaggcgtggtggctcacgcctgtcatcccagcactttgggaggctgaggcaggtggatcacttgaggtcaggagtttgagaccagcctgaccagcatggtgaaaccctgtctctactaaaaatacaaaaattagctgggtgtggtgaccggcgcctgtaatcccagctactcgggaggctgaaggaggagaatcgcttgaacccgggaggtggaggttgcagtgagccgagattgtgccactgcactccaacctgggcaacaagagcgaaactccgtctcaaaaaaaaaaaaaatttttcaagaaatgttaaaagacatgaaaaatggcagggcattgtcccactaacccaatcctactccccttaggtggctactctttttgctgtttctcttagcatttttcctatatttctaattaatattcctatattgctattttttgatacatattttccagtgatttctaggcaggtaactatggattgagatttcccataccacagtcttcattttttgtccatgcaatagaattatatcacaatttttcttttctttctttcttttttttttttttgagacagagtctcactctgttgcccaggctggagtgcagtggcgcaatcttggctcactgcaacctccgcctcccaggttcaagtgattctcctacctcagcctcccgagtagctaggattacaggcgtgcaccaccacgcccagctaatttttgtattttaagtagacacggggtttcatcatgttggccaggctggtctcgaactcctgacctggtgatcctcctgcctcggcctcccaaagtgctgggattacaggcatgagccaccatgctcggctcataatttttctttcaatcattgctatccctgtgattaggaccttgcagacattgttgcagacattaggaccttgcagacaatgtgagccaagtaaaacaccagattctggattctttctaatacaatttgtatttttctcagaggaaattgccttgtttcttcttttgcccggttttatgtatgtgtcactatttttttcaaattctctaacattgctgtcagttgcctgtcaatattttctacatgatgaaacatactagctccttagttttctttggagatgtctttcctatagtcctcacttcttctgttcctagatgctgttctctcagtctgctgccggatgatgttctaggatttgccttttataattatactggcactttcatcaccattttcatgttagttttacagtttcttaatatagtaccttttctttttcctaatttactacctagttttgatggaacatgtagcctagtagcttcctaagaaaagccacattggaagtacttttatcattccctgcagatttaaaattgtcttgatttaatcttcatagtggcttagtaatctgactggctatagaattctaggtcagaatttattttcctttataatattaaaggaattgcttggttttttcttatttcaaatgatgctattgagaagtctattgccattctgatttctgaaaacttatgtgatctgtgttttcttctggaagcttttagaaactttcatttttgttttcccctgatattctgaatttttactccatgtattataaggtgtgtttgaaagcccctcccattttcccctctcttggggcataaagggaaagcggggagggggaagaaactcactaattgagctgaatgcatgctatttcatatcactggaaaagtccagtctatttgtatatccctttgtacacaggacgtatatcttctgatatgataggattcaccccctttaattttgcttactctgtcctttcttgccacctctaccgccatctttttcttttctcctttcattgtgaaagcatgtttgttgtttcaggggccggtgatgttcagggatgtttccatagacttctctcaagaggaatgggaatgcctggacgctgatcagatgaatttatacaaagaagtgatgttggagaatttcagcaacctggtttcagtgggtaaggataactattccccaaaattcagagtgtgcccttggaagtgtctcctttctccattgtgaattatttgcttcatgtaaccagctgaatttctgctccctgttccctaaggaatggtttgagttaaaatagaatggaagagttggaagtgggcagctccaatgggctgtggctgaagcttcatcttctccatctttctccggtccttcttgtagtggcatctctcctttgatcactaagggactggatctgatttctggggaccccacagcataaccatgtcccatgtcttttcttgtgaacaggactttccaattctaagccagctgtgatctccttattggaacaaggaaaagagccctggatggttgatagagagctgactagaggcctgtgttcaggtaagtaagagatgatggctcaggagcagggctataaagagatatacttctgagatgttatcaggaagctccctttaaaggcctgaagcctcttccatataagctatcccactttttttttttttctcatactttttccctagtccaatatagcaagtacctccctggctacaattatgctataattattctagtcacattttagtttcattccttcctatgatacgctacgtttagatttgtataacagtagacattcccaccctgagaaatagatgtaagtgcatgtgtgtctttttctttccctgtgcttgttttcattttatctactttcagctatttaacatctttgaccagtttgttctggatttaaaagctcattctttcatttatcaaacatttgattatttcttacttgaaaacaaaattgaagtataacatacacacataaaactgcatgactatgattgcatagtatggtgaaattgagaatggtgaaaccactactaggacgataaatagaacattactagcacctcagaaccccttctctgccccttcccaatcaccagcctctttttcctctctcaaaataaataccatcctgacatttggcaccatggattcgttttgcctatttttgaactttgtatagacgcaatcacacagtatttagtcttttgcctttggctttttttgctcaacattatgtttatgtgacatatctatggtgctgcatatatctggtgttagttcattcttattggctatgttatatttcattctatgaatatatacatatatatatatatatacattttttttttttttttttttttttgagatggagtcttgctctgttgcccaggctggagtgcagtggtgtgatctcagctcactgcaacctctgcctcctgggttcaagcgattctcctgtctcagcctcccgagtagctggaactacaggcctgcgccaccacgcccagctaattttttgtatttttagtagagacagggtttcaacatgttggccaggctggtttcaaactgctgacttcaggtgatccacccgcctcagcctcccaaagtgctgggattacaggcgtaacccactgtgtcctgcttcattctatgaatattttttaaattatgctttatatattattaattactataagtgtccttctgttgacagttggtttgtttgcagtttttagctattaaacataatgctgctgtgaacgttcctgtgtataacttttggtaaatgtatgtacacatttcttttaggtatatacataggagtggaattactgagcaataggatatgtgtgtgttcaactttagtaaatataccaattttccaaagtagttataccaatttgcagttctactagcagtatgaaggttactattgctctgcattcttacattcttaccagttattattgccaggccctttaattttagttattctgatgtgtgtgttctgtgacatgcctgtttaagtttcttggctaaacttagtcggttgtctatctttttcctgttggtttcaaagaattcttattatattctatgtatcagccctgtgtttggttatacatgatgtaaatatctcccaccactttataccttgccctttactcttttaatagtaccttttgatgaacagaagttattaattttaatgtggtcacagttatctttttctttatagtgttgcttttttgtgtcctggataggaatcattgcctaccccaaggtcttgaagatatttcctatgttatattctagtagctttattgttttactttttccatttagatctactttcctgaagttggtatttgtatgtgttgtgaggtaggggtcaaatttcattttttttccatgtgaatatccagttgacttcttagtgtttattgagatgactgtccttttcccattctatagagataggactatatctatcttttccccaatagaaataggactacctttgtcataaatcaggtattcctatttctgtgagtctatctctgaattctgttcctttggcttatttgtctatccttgtgccaataccacactatattaatactgtagcatgtaataaatcttatctagtagagcaagttctcctgctgctgcttagtcctttgcattttcattgtaaattttagtattaggccgggcgcagtggctcacgcctgtaatcccagcactttgggaggccgaggtgggtggatcacctggggtcaggagttcaagaccagcctgggcaacatggtgaaaccccatctttactaaaaatacaaaaattagccaggtgtggtggcgggcacctgtaatcccagctactcaggaggctgaggcaggagaatcgcttgaaccagggaggcggaggttgcagtgagccgagatcacaccattgcactccagcctgggggacaagagcaaaacttggtctcacaaaagaaaaaaaaaaaaaatttagaattagcttatatagtcatttgaaacttaatcaaaatgccaagttattttttcatgagaatattaatatcagtttgtggagaattaagatttttaaatagcaagtcttataaaaatgtttgactttttaattttatacactagtctgctaggtgctgtacagtttagaaaatgtgtaggcttattaagaaacttgttatctaatgtaggagctagaacattgctgtaaataatttctacaggataagattcatcaatgagaagatcaaataggacgctcagaagaaagttgtaaaacagtcaaaaaatatggaagtggaaattgatccaagtagaagttaatggttggagccctagaagtagatgttgttacctatggagttagcgttggaaatagaagatccatgtgtcccttgagaaagaattctagatttaacaaagctctaggaacctagggaggagtttgtgaatcttcactttttcccagctatcagttgatcttagctgccttcaagtatttttatttctgtctctcctaccacttttcctccctaccaacttgctaattcacccccttcttaatcttaccttaaccttgtacctttgtacttgaaaggtggtctctgtttattcctttttcattttaaaataattaattttcattaaagtaatatatttacagagtttgaaatcacagtgttataaagcttatattgaaaaacagcagcccagaccaggcgcggtggctcacacctgtaaacccagcacctgggaggccgaggcgggcagatcacttgaggtcaggagttcgaaaccagcctggccaacatggcaaaaccccgtctctactaaaaatacaaaaattaaccgggcatagtggcaggcgcccgtagtcccagctacttgggaggccaaggcaggagaatcgcttgaacccaggaggtggaagttgcagtgagctgagatcatgcaactgcactccagcctgggcaacagagcaagactccatctcaaaaaaagagaaaaaagaaaaacagcagcctgctttttcacatatacattcctaccatgactgccccagtccctctcatcaaagataatacattttcaactcttactttcattcttctgatacctaccttcaaattttgcatagtatgttttgtctttctgtgatacatcaaactataaaagtatttcttgatgtctttttctgatagttgagggctggtctctcgtaatcactgtatgtatcttgcctatagcaatatattcatagtttatatcctgattacacaaatgttgttataactttcctgttacctacttaatgtgcatccccattggtgttatgccttatgtttatttgtattgtagtttgtactttctattttcatatctttgcttaataatagtcacttaggagtgtttttacatattcttcccaagttcaaatactggattgaaaataaacccatcaaaactgagatgtcttttttatgtatcagttttacattttggaacaattggtttttttaagacaaaactattgttattttttttttcgagacagttttactcttgttgcccaggctggagtgcagtggtgcaacctcagctcactgcaacctctgcttcagcctcccgagtagctgggattagaggcacctgccaccatgcccggctaatttttttatttttagtagagacgaggtttccccatgttggccaggatggtctcgaattcctgacttcaggtgttccacccaccttggcctcccaaagtgctgggattacaggtctgagccgccgtgcccaacctataatttccttgataacaaaagcatatctattacatttctgttatgattattcccagatagtctcaactactcaaattataaagaaagatgtgggaggtaggtaattgagaactgtgatatataaacattttaacagactcctgacatgtgataccactcccccaatagccacccacattccttataagcctttataaaaaggacagaaatgcccttttgcacatttgtgccctgcacatactataactaaaattacccttgacccaaaaacaaaacaaaacaaaaccacatgtatttatttatattacccaaaggtatagccatcctctaacataaaaaacaaggcatacatattaaataataatggcatatttgttaaaactattcttagaaatcaatgttttaataccttatgttagaaatcatccaggttttcgaggattatctattaatttttcttacttaatgtccattttcttgaagttgactaaaaatcttgactactgtatttaaactgacacactacagagcaacacagttactttttttcttcttcttcttttttatttttgagatggagattcgctctgtcgcccaggctggagtgcaatggcgtgatctcggctcactacaacctccgcctcccgggttcaagcgattctcctgcctcagcttcccaagtagctgggattacaggcgtgcgccaccatgtccagctaatttttgtatttttagtagagacggggtttcaccatgttgcccaggttggtctctaactcctcacctcaagtaatccacccgccttggcctcccaaagtgctgggattataggcgtgagccactgcacccggcccaacagttacttggatgtcaaaaagtctgacagaactataatttgatttggtttaacacataattgtatagtttttattattttattttattttattttattttattttgagacagagtctggctctgttgcccaggctggagtgcagtggtgcatcttggctcactacaacctccaccacacccgcctctcccaggcttaagtgaccctcccacctcagtctccctagtagctgggactacaggtgcacggcaccatgaccggctaatttttgtattttttgtagagatgggattttgccatgttacccaggctggtctcgaactcctaagctaaagtaatccgcctgcctttgcctcccaaagtgctgggattacaggcgtgagccacagcacccggcctagtttttataatcttaaaatttacattttgcactgataaaatcaggaggaagatgtatagctatttttaaaccagaattattaagccagtctttttaaaaatttctgtttttgagctagcagttcttgtgaggttgtggggttatttttgcggggtgcgggggggtacttgtttttttttttcttttttttttgcaattttataactatttgatgtatttgacaatcagtgattagttctcatccacattgactgtctgtagatttttgaaagtggtaacagatacatagataaccaaagtatagagtttatttggtgaatcttcatccccattacgtattctggacaaccgcacatggattcgttatgggacattccttattcctttggcccagacagctttgttgagcctggtatcagtgcgcacatctggagttcccatctccttcatggcaaatttctgaatctctttgagtgtccgaggggcacgcttcttgaagcccactccatggatgcgcttgtgcatactgatggtgtattctcaggtcaccaccttgtggatggcagaacggccctttttcttctcaccacccttctttgtgggagccattctgccggatccaagttggaaagacttgtttattttttaaggctagcacattcaaactactagaagttttctgtgactgtctttgcactacaatcacacacttggatagcccacaaagctgaaaatatttgctatcttattctttatttaaaaagttgcccaacccctgctcgctatgaaccagagtagcactcctttaattttgttgttttattttcagctttattaaggtataattcacataccatatagttcacccacataaaatgtacaattcagtgatttttaatgtaatagagttgtataaccatcaccataatcaattttagaacatttttatcacctcagaaaaatccctgtacactctagctgttattcccaccccctccagccccaggcaaccatgagttgattttctctatggatttgcctattctggacatttcatataaatggaattgtacaatatgtggtcttctgcaaattccctatttcataacttaatgcttttcagggttcatccgtgttgtagcatgtatcagcatttcattcctttttattgccaaatactattccattttatggatatagcacatttatccattgatcagttgatggacatttgggtttcctcttttgggctattttgattaatgttgtatgaacatgtctataagtttttgtgtggacataagctttcagttctttcaggtttctacctaggagtagaattgctgggtcatatcataactctgtgtttagccagttgaggaactgctagactcttttccaaattggctgcaccattttacatgcccaccagcagtgtatgatggttccagtttctccacatcatttgctaacacttgttatcttttttttttttttttttttctgagacagtctcgctctgttgcccagtctggagtgcaatggcacaatcttggcttactgcaacctccacctcctgggttcaagcaattcccttgcctcagcctcctgcgtagctgggattacatgctcatgccaccacacccagctaatttttgtatttttagtagagatgaggtttcaacatgttggccaggctggtcttgaactcctgatttcaagtgatccacctgcctcagccctccaaagtgctgggattacaggagtgagccaccacacttggcctggttgtttttatttatttattaatctttatttttaattttttgggtacatagtaggtatgtatatttatgggttacatgagattttgatacaggcaggcaatgcttatatcaggagaaatgggatatctatcacctgaagcatttatcctttgtgttacaatcttattgtactcttagtttttaggggaatttttttttttttttttaagacagagtctcactctgtcacccaggctgaagtgcagtgctgcagtgctgtgatctctgctcactgcaacttctgcctcccaggttcaagtgattctcatgcctcagcctcccaagtagtttggactacaggcacataccaccacgcccagcaaatttgtgtgtgtgtgtgtgtgtgtgtgtgtgtgtgtgtgtgtgtgtgtgtgtgtgtttagtagagacagagttttaccatgttggccaggctggtcttgaactccggacctcaagtgatccacccaccttggcctcccaaagtgctgggattacagacatgagccaccatgcccagcctcttttagttatttttaaatgttcaattaaattatttttgactacagtcaccctgttttgctagcaaatactaagtgttactcattctttctatttttatatgtgtttaaaaaaaaatttttatatgaacctttttttaaaaattattgtataaattctaggtgtacaacatgatgttttgatacacatacatattgaaataattactatagttaagcagatcctatcaaataactataatcttttcttctttctttttttttttgtttagggtaagagtacttaaaacctactttcctgacaaatttctagtatacaatagagtattactaactatagtcctcctgctatacattagatttctcatgagctttttttttagtttttatcgatacaaattatacatatttatggagcacaagcaatatattgatacattcatacaacgtataaggatcaaatcaaggtatttagatacccatcactttgaatatttatcaattgttttatacatacatatatatatatgtatttttttttcttttactaatagaatgtacccagtgtcattttttgtgtatgtgagagagtttcactgtcagccagactggagtgcagtggcctgatcacagctcaccgcatccttgaactcccaggctcaagtgattctaccacctcagcctcctaagtagctaagactgcaggtgcatgccactatacctagctaattttaaaactgtttatagagatcggggggggtctccctatgttccccaggctggtcttgaactcctggcctcaagtgatcctcctgacttggcctcccaatgtgctgggattacagttatgagccgctatggcactgctattaagtttttttgcttccttgttaattctggatattagtcccttctcaggtgaagagtttgcaaatattttctcccattctacaggtctcttcactctgctgattgtttcctttgctgtgcagaagcattttagttcaatatagtccaatttgtctatttttttgttgttgccccttattgaaaatatctttgaggtcttatctaaaatatatttgcctattcttctgaagtgtttcccctatgttttcctgcagtagttttataatttggggtcttatagttaagtatttaattcattttgagtttatttttgtatatggtgagagatacagtctagtttcattcttcactatatggataaccagttttcccagcaccatttattgaacagcgtgtccttttccctatgtctgttcttggcacctttgtcaaccatcagttgactataaatacatggatttatttgtgggttctctcttctgttccattggtctttgggtctatttttatgacagtaccatgctgttttggttacgacagctttgtagtatattttgaagtttgattcttccacttttgttctttcgctacagattgcattggctatttggcattttttatggtttcctacaaattttaggattttttttcctgttcatgtaaaaactgactggcatttcagtcgggattgcattgaatctgtagattgcattgaatctgtagattgctttgggaagtatgttcattttaacaatagttcttccagtgcataagcatgcaaatatctttttatttgtttgttgtcttcaatttcttttgtctgtgttttgtagttttccttacagaggtctttcacttcatggttaaatttatttctaggttgttttttgtagctattatattaataaatgggattgttttcttgatttctttttcagctaattcattattgtggatgtatagaaatcctttttttttccctttttgagacagagttttgctctgtctcccaggctggaggagtgcaatggcatgatctcagctctctgcagcttccacctcctgggttcaagcagttctgcctcagcctcccacgtaggtgggaccacaggtgcctgccaccacacctggccaatttttgtatttttagtcaagacaaggtttcaccatgttggccaggctggtctcaaactcgtgacctcaagtgatccacccacctcggccttccaaactgctgggattataggcgtgagccaccgtgcccagcgtactacttatttttgtatattgattttgtatcttgcaactttactgatttcattgatcagttccaagaatttctggtggcatctttaggtttttaaatatatgtaagatcatgtcatctgtaaagggacagtgtgactttctattatccaatctggatgccttttatttctttctcttgcctgattgctctggataggacttccagtactatattgaataatagtggtgaatgtgggcttctttatcttgttccagttcttagaggaaaagctttcggcttttccccattcagtatggtgttagctgtacgtttgtcatatatggtctttattatgttatgttttttaatgcctaatcgttgagaggtttttataatgaagagacgttgaagtttatcagatgtttctctgcatctattgagctgatcatatggtttttatccctcatcctgttgatctgatacatcatgtttattgatttgcttatgttgagccatccttgcacttttcaggaaaaatctcacttaatcgttgtatattatcttgttgttgtattattggatttcatttgctagtatttcattgaggggttttgtgtctatgttcatgagggatatcacctctttttgttgttgttgttgtgtccttctctggttttggtatcagggtaatgctggccttgtagaatggattaggaagaattaacttctcttccattttttggaatagtttgagaaaaactgaggttagttatttgtaattttggtaggattcagcagtaaagccctttagtcttgggctttttttgttgggagacattttactattgcttcaatctcattactcgttattggtctgctcaggttcttctgctctgtttcttcctggttcagtcttggtaggttttcatgtatccaggaatttttctgtttcctctaggttatctgatttgttagcatatagttgcctgtagtagtctttgatgatctttaatttcttaattgacccaatgggcattcatgagcaagcacattgtttaaatttccatttatttgtgtggtttacaaagtttttgttattgatttctagttttattctagtgtagtctgagaagatacttgatatgatttcaatttttaaaaattagttataacttgtcttatggcctaacgtatggtctcttcctggaggatgttccatgtgctgataggaacaatgtgtattctgcagctgttggataaaatgttcagttagtgtctggtaggtccatttggtctaatatccagtttaaatccaaagctgttgattttctatctagatgaactgtctaatgctgagagtgggatgttcaaatcccgtactattattttatgggagtctacctttttttgttgttgtttttttgagacagagtctagttccgtcgcccaggctggagtgcagtggcacaatattggctcactgcaacctctgcctcccaggttcaagcaattctcctgcctcagcctcctgagtagctcggattacaggtgcatgccaccacgcccagctaatttttttttctttctttttttttttttgacagtcttgctctgtcacccaagctggagtgcagtggtgcgaacccggctcacttcaggctccgtctcccaggttcacaccattctcctgcctcagcctcccgagtaggtgggactacaggtgcctgccaccatgcctggctaattttttgtatttttagtagagacgaggtttcaccatgttagccaggatggtctcaatctcctgacctcgtgatctgcctgcctcagcctcccaaagtgctgggattacaggcatgagccaccgcgcctggccacacccagctaatttttgtatttttagtagagacagggtttcgtcatgttgggaaggctggtctcgaactcctgacctcaagtgatcctcccgccttggcctcccaaagtgttgggattacaggcatgagccaccatgcccagccctatctctctttttagatctaataatatttgcttatatatctgggtgctgcagtgttgagtgcctataaatttagaactttatatcctctggctgaattgacccatttatcattatataatgaccttctttgcttcttttgcagttttttacttaatgtctgttttatttaagtatggctactctcacttgcttttggtttgtttgtgtgcagtatttttttttcatctcttcactttcagtctatgattttatatataaagtgagtttctcacagccagtatataggtgagtcatatttattttatccattcaaccagactgtatcttttaagtggggaatttgactgtttacattcaaggttattattaataggtgaggatttattcctaatctgttaattttttatggttgttttatatcctttttctttcctcttatcatttggtttggtggttttatgtaatggttacatctgagtcctttctctttccatttgtgtatctgctctaccagtgagcttcttattttcatttgtttaatgatggtagatatgtcttttacttccagatgtaggacaccctttgccatttttgatcgggccaccctagttgtgatacattttctctgggaaaaactttctccttcatttttgaaggatggctttgctaggtacagtattcttggctgacagtgtttttttagcactttgaatatatcatcccattctttcctggcatggaaggtttctgccaaggtatctgctactagttctgatgagggttcccttgtatgtgacttgacgcctgagggttcccttatatgtgacttgatgcctttctcttgctttttttagaattctctgtctttgacttttgacagtttgactgtaatgggccttggaaaacctttttggattgaatctatttgggcatcattgagccttctgtatcaggatgtctatattgcttacaagacttggaaagttttcagttattttgttaaataggtttttatgcctttgcccatctcttctcctagaatacccaaaatttgaatatttggttgctttatgatgtcccatatgtcatctaagcttttttcagttttaaaaattattattttttactttttcttcctggattcttttaaaaaaccctgtcctcaagttcagaaattctttcttctgcttgatctagtctattgttgaagctctcaattgtgttttttatttcattcattgaaatttgtcagtttcaggacttctgtttggttctttttcatgatatctatctgctgaatttctcattcagatcatgaattgttttttctgattcttttggtttttatccatgttctattgtttcccactgagcttctttaatatcattattttgaattctttttcaggcacttgatagatttcttgtttgttggaatctgttgctggagcattattgtattactttggagatgtcatggttccatgctttttcgtgtttcttttatccttacattgatatctgtgtatttcttgttatggtcattttttccaattttatggatttgttttcataaggaaaacctttttcctgtagatgtatttatagtgttggttgggtaggttgctttggctttgttataggtggatgcagtggtataatctccatatgatttctctggctgcaatcagtgtcagcagtgtctgtgagttcctcagtggcttagggcttggttgttagtggaagctgtgatgaggcttttctcattgttagcagggccaacaatggtgataggatgaggggtatgccaggtaaaggggagatccatgtgggaaggccctgaggggcagggagaacttgaggtgcttgaaggactggggcttcttgagcaagtggaagtggagtataacacaaggttgtagaggtaggcaagagcctcattattggagtcttcttggtaattaccaaggagtttagattttcaggagggcaaagtgagaccaaatatcacaccaggtgctgaatggattagagggtgctagaacatactggggaaaccattaggagattcctgtagtggtctaggaaagaggggattcagtaattaaatgaggacaactttaagagatttttagggactcacccagactaagtttggccaatgattgtgtggagggaatacttaagatagtctagctggctttattttgatgtcttcaagccattttatttgcccaatatctgtttttgctatgacattttttcataataatagctaccaatactgagtgcttactttatatcagattatttatatacgttattcctcatctttttagcaatcataagttaagtgtcagtcccattttaataaacaaggaaaagagggctcagaggttgccttaaagcatagaactggggctcactgtttatatgttgacatggagttccattcttctcatagagtacatttcatcctatcttaactctcttgtgtctcaaacttgagccaccttccttctcaatcactgctatgacttgaattattcatttctttctcccaaggtcaacatcacagaattccagagcaaattattttcagtgagttcctagcccatatcatgctgtatgcacagaagagatgtacctgtctactcttcccaccagttgtgttcagcatattagatttgtcggaggctggtgatttgccagtataccattgcacagtcactgaactccacccgcccccgacatttaaacctttcaacacatttgttattcttaacagtcctttcatgtaggtctgacagttatctacgaattgcaaaacatacagtatcatactctgtgcatgtgagcatatgtttatgaacgtgtatataattagaatatctcacgcatggtgcatgccctggagcagaagcggcatcctgctggcctgtcctcctccatggccctccagcttaacccctgcctgggcatgctgatggccttgcagtcggagctccacaagctgtacgacgaggagacacagagctgggtctcaggcagcgcctgtgggggatctggggtgggggcaaaaaaaattttttttttttaattagaatctctctataatatggaggatggtgctgaacactgtgtattcaccaaggcttaaggtgactctggttcagaccaaaatttgaggatcatagaggtcatctactttctgaatccacatcctcagcttcttttattacctctcctaatgtctgtgcttttcttgtcagttttacagattgcctctccacctttgaaaactgtgtaatttctcagatattcttttcagtttaattctcccatttcttttttagaagttttaacttgcccagaataggaaaatttatttgcctttgtattttctttcagatctggaatcaatgtgtgagaccaaaatattatctctaaagaagagacatttcagtcaagtaataattacccgtgaagacatgtctacttttattcagcccacatttcttattccacctcaaaaaactatgagtgaagagaaaccatgggaatgtaagatatgtggaaagacctttaatcaaaactcacaatttatccaacatcagagaattcattttggtgaaaaacactatgaatctaaggagtatgggaagtcctttagtcgtggctcactcgttactcgacatcagaggattcacactggtaaaaaaccctatgaatgtaaggaatgtggcaaggcttttagttgtagttcatatttttctcaacatcagaggattcacactggtgagaaaccctatgaatgtaaggaatgtggaaaagcctttaagtattgctcaaaccttaatgatcatcagagaattcacactggtgagaaaccctatgaatgtaaagtatgtggaaaagcctttactaaaagttcacaactttttctacatctgagaattcatactggtgagaaaccttatgaatgtaaagaatgtgggaaagcctttactcaacactcaaggcttattcagcatcagagaatgcatactggtgagaaaccttatgaatgtaagcagtgtgggaaggcctttaatagtgcctcaacacttactaaccatcacagaattcatgctggtgagaagctctatgaatgtgaagaatgtagaaaggcctttattcagagctcagaacttattcaacatcagagaatccatacagatgaaaaaccatatgaatgtaatgaatgtgggaaggcctttaataaaggctcaaatcttactcgacatcagagaattcacactggtgagaaaccctatgactgtaaggaatgtggaaaggcttttggtagtcgctctgacctcattcgccatgagggaattcatactggttgaatgacagtaaagtaagaccattttgttaacctttataataatttttttaaaacaggtaaggagaacaaattaggatacatattatcaaaggttctcctatgtattcgtttttaaacgatacgataacaaagtaccaagtaccaaaaccttggtggcttaaaacaagagaaatttattctctcatagtttagagcctggaaatctaaactcaagggtgctgatcgttttggttccttctgaggactctgaggatctgttctatgcctttttcctaacctctgttaacagctggcagtccttggcattccatggcttttacatacaccattccaatctctgcctccatcttcacattgcattctcgctgtgtatctctgtgtatgtcttttatttggacaccagtcaggttagattggggttacctggtgacctcatcttaacttgattatatctgccaagaccctgtttccaagtaaggtcacatttaccggtaccaggggttaggacttcagcatatctttttaggggatacagttcaacccataataccctgttagaatgattttgtctaatatatttgtaatttccttttatacataagttgttagtcaaatttattttattttattttattttgagacagagtctcgctctgttgcccaggctggagtgcagtggtgtgatctcagctcactgcaacctccagctcctgagttcaagcgattcttgtgcctcagcctctcaagtagttgggattacaggcatgcgccaccatgcccggctaattttttttttttttttttttgtatttttagtagcgacggggtttcaccatgttggccaggctggtcttgaactcctgacttcaagtgatctgcccgcctcagcctcccaaagtgctgggattacagacgtgagccaccgtgatggccaaaacagactttataccaacaaaaattaaaaaggacaaagaaggtcatttataatgataaaggataaattcaacaagaagataaaacaatcctaaatatgtatgcacccaacactgcaacacccagatccataacacagatactactagacctaagaaaagagatagacagcaatacaacaatagcaggggacttcaccactccattgacagcactagacagatcactgggacagaaatcaacaaagaaactctggacttaaattggactctacaccaaatggacccaacagacatctgaagaacattctacccaacaaccacagaatatatactcttctcttctgtgcatggaacattctcaaaaataggtcatatactggaccacaaagcaagtatcaataaattttaaaaaaacaaaatcatatctaacatcttctctgaccatagtggaataaaactagatatcaataccaagaggaactctcaaaacagatacatggaatttaaacagcttgctcctgaatgatttttggatcaatgatgaaactaaggtggaaatttaaaattttttgaaataaatgaaaatagagacaaaacacatgaaaacatctgagatacagcaaaagcagtgctaagagaggattttatagcattaaatgcctacaccaaaaagatagaaaaatctcaaatgaatagcctaacgtcacatctcaaggaactaggaaaaaacaaaacaaactcaacccaaagctggcagaagaaaagcaataacaaatatcagagcaggcaaaaatgagactgagaacaaaggaatgcaaaagatcaataaaagaaaaagttggttctttgcaaagataaaactgacagaccactagctagattaaccaagaaaaaaagaagattcaaataaatacaatcagaaatgataaggtgatattataactgataacacagacatataaaatatcagcagaaactatatgcacatattagaaaacctagaggaagtggataaattcctagaaacacataaccttccaagattgaaccagggagaaataggaatcctcaacagactactgagtattgaaattgaatcagtaatagaaaaaaatcttgcaaaaacaaaaagcccaggaccagacagattcacagctgaattctactagacatgcaaggaagaactagtaacagcactattgaaactattccaaaaattataggagggaatcctccctaactcattctacaaagccagtatcatcctgatactgaagccaggcaaggataaaacacacaaaaaaactacaagccaatatccctgatgaaaatagacacaaaaatcttcagcaaaatactagcaaaccaaatcaaacagtacataaaaaagatagtaacagcacagtcaagtggattttattcctggggtgtaaggatggctcaacatatgcaactcaatacatgattcatcacatacacagaattaaaaataagccaggcactcacacctgtaatcccagcactttgcaaggccaaggcgggcagatcacatgatgtcaagagtttgagaccagtctggctgacatggcgaaaccctgtctctactaaaaatagaaaaattggctgggcatggtggcaggcactgtagtcccagctacttgggaggctgaggcaggagaattacttgaacctgagaagcggaggttgcagtgagctgagatagtgccattgcactccagcctgggcaacagagcaaattgcttgaatgtgggaggtggaggttgcagtgagccgagattatgccattgcactccagccgggggagcaacaaagccagactccatctcaaaaaaaaaccaaaaaaaatcctatttagtacaaggtacattatttaggtaatgagtccattaaaagccaacactttccccactacactatatgtgtatgtaacacaactgcccttgtaacttcctaaacctataattaagaaacaataaaaggcaaattaagaatgcttttttaaaaggtgggggcattatgctaataagttactgtggatttcagagtgcagagtagaaagatcacaagaatttagtgtggtaggtgggaacagaaaatgggtgtataaattttattgacgtgggagtactggatattgtagagacagatatcatcagggcaaggagattaaagatttttgcattgacggtttgacactatattgtggtaataacactgtatgtgttgggagatagaacaggaaacatcttccctggaatatgtatactattaaatgttttatcaaacttttgatcaaacaagacagcacaatttataatttcatttctatttctatgttatgagaaactgatcatttattcaaatgtttaacaggcatgttcatgttactataaactcttctgtttcaccatca

SEQ ID NO: 746 - DNA, 26099 bp, Homo sapiens
gcgctttgtgcaggcgaggcgcctccactatggccccgcttgaccccgtgcgcaggcgcggcatcccacccgccgcggttcctgccccccaaagctcgaccccggtgtggtgcgcaggcgtagtctgcgcggggactggcgggactgcgcggaggcgactacaggcatggcggtctgggtcctgtcgcgcctgctgagcgctccgcgcctggcgctggccaaggcggtgagtccgtgccgcggaccggggcggggcaggcgggggccgaggcggcggtaggagcgggacggtccccagcgggcccgagcagagcgggcgccaggtccttgcgccccctgtcccgggatctggaaggggctgggagagccctgcgccagtgcaagggggagccgtggggcggactcgggggtccggggagctcggtccttagcaggtagtccggtgaaggtcacgaccccgcgggcttgctgggcgtcccctccgccgccttggtccgggcctggggtccagagacctcccgggctgaggtagcccctcgcctcagtgcctggcgggtggacttggggaggagtcgtgtctgcccaaggtcaccagagctccttgttgggcgaggtgggtggaagctgttactttccctgtgtagatgaagaggtgaacagcgagtggaagagtctggaatatcagtctcccctgctgatgttcctccacctgccgtgctcctgggtctgagccggagcacaggtggtgagggccccgggaacatgggacacgggggacagtcgcagatgctgacattggaggtcctctgacctgcttgtaacagcaggtgctcaggggcagaggggaaactgggggataccttcggaagcttccctctgaagaagagtagctatggtccttacttccctcttagatacggtctttacttccccttttttttttttcttggaggtggggtctcactctgtcgcttcgggtggagagcagtggcgcgatctcagctcactgcaacctctgcctcccaagttcaagtgatttttctgtctcagcctccctagtagctgggattacaggcacccgccattatgccccgctaatttttgtatttttagtagagatggggtttcaccatgttagccagacaggtcttgaacccctgacctcaggtgatcaccagcctcagcctcccaaagtgctgagattacaggtgtgagccaccacgccgggcctacttccctctctctctgacctgcagcacagacaccctattggggaaggtgggctggtggaggcatgagcaccttgacatttcacctgaaatcttcctttccacaggtcctgaggcacgtgaatggccaggatcagattgtgcccggcctgtacgcctgtggggaggccgcctgtgcctcggtacatggtgccaatcggctcggggcaaactcgctcttggacttggttgtctttggtcaggcatgtgccctgagcatcgaagagtcatgcaggcctggtaagtgttttcttcaggagccagactatttgagaaggcgcaggaagttagaaagtcttttttcttttttttgagaaagggtcagcccaggctggagtgcagtggcacagtcatagcagcctcaacctcccgggctcaagcagtcctcaacacctcaaccttcagagtcccaagtagctgggactacagatgtgcaccaccacacccggctaatttaacaaaaatttattttgtagagacagggtctcacaatattgcccaggctggtcttgaactcctagactcaaacagtcctgcctcagcttcccaaagtatcgggattacaggcatgagccactgcacccagccaggttacaaagccttgatttcttactggaaatttgcttagtgatcatatagaggtagtctgggtttttcccccagaagtgattaaactgagaaatccagaaattatatggtggtaatgttgagactagatagaggctggttggggatcttaacagttaaggtgacatttttggggttacgtttttttaaaaaattattttgcagtcgttatgttctgcttagaaaaagcactattaggaagttgttatttttacttgcctgataaaaatcactgatttgcaatgaaatatcttaaatagttggcatgaatgaatatgtgacttcttggtacttagaaaagtaatttaggccattctagaaacaaagtacagctagcctctattagaggagaagggatgacttacagtgaacaggattcccaccctttacggacagattggatttcacttgctggttttcttttcatgatagcgtcaaataatgtgcagtaaaggaaataccacgtgtgggagtgtgagtcttacgtgcactaagaacggggcagttagcatcgctcctaactccagacatcttcacggtggtcatgcagcctcgtgtgctcagaacagtgtgaggtggatgaggcactggtggatgtttgcgtggcaaggatggtgggaccccaggcccatgttcttcccgttacctttctctggtgttaactgttagcatcatttctgctgtttttatacaacaggtgctttttgtatggattcaagtgaaataaaaactagcacggccgtaacttataaacatgcccccttttgtatctgtagttagaaaggtgcagatagtattaaaagggtagcttacttcagacactctgtctctggatctgaccactgctcgggaggccagcacacgcagagctggcgtctcatccccagccgttgctgatcatcggcgaaggcggagttcaggtccatcgttcctgacgccgcaggtagtgcttatctcactccatagccccgcactttgtagcggtgaggaccgatatcacttctctcagagcaatgtagaaattttgagctgctctttctttgaaaatgcaaaaaagaacattttgtaagaataccctatactttacatctgagaaaccgctcacgcatgcagcatctcacgcagaatgctgtggagtcagactcaaaaggctgcacgcctgtggttctgttgatacgacattctggaaaaggcacatctagggaagaaaagggattgctggttgccagaggctgtttcctgattgtgctgatacagacacaactctgtgtgtgtcaaaatttgaaaaaccctacactaaaaatgatgagtttattttactgtatctttatgctttaatttttaaaaatgaaaaggaaagaaaaaatggttgtagcatcactattctcccccaagcccccctgcaaaaaaaaaaaaacacatatatatgtgtatatatatgtgttttttttttgtttttttttttttttttttcagagatagtctccctctgtcgcccaggctggagtgcagtggtacgatcaggtgcacgccaccacacctggctaatttttaaaaatgtttcattgggatagggtctccctgtgttgcccaggatggtcttgaactcctggcctcaagaggtcctcctgtctcagcctcccgaagtagttacatgcgtctatacatatgttaaaattggtagaactgaggctgggtgcggtggctcacgcctataatcccaccgctttgggaggccgagacaggcagattgcttgagctcaggagtttgagaccagcttgggcaacatggtgaaaccccgtctctaccaaaaatacaaaaattagctgggcatggtggctcacacctatgtagtcccagctacttgggaggctgaggttggaggattgctggagcctggaaggcagaggttgcagtgagccgagatcacaccactgtactccagcctgggcaagagagggaggagacactgtctcaaaaaaaagaaaaagtaaattgtagaactgtccacctaaagaaaaaagtcaattttactgaatgatcaatttttaaagcattattatcaaaaggaggagaaacaccagcgagcctagaagcatttgagcagaacctcaagagacccatagcctggtcctgtggagaggtggtgggcggggtggggcctgtttgactcctgcatttcatacatcctacctcctgcatgtgttacctgttgaagaaaatatatataatgttataaaaaaaaactttaaagtttttttcaagacatcttagaaacacaagagttgcaaatcttggctgtgcacagtggctcacacatgtgatcccagcactttgggaggccgaggcaggtggttcacctgaggtcaggagttcgagaccagcctggccaacatggtgaaacccatctctactgaaaatacaaaaattagccaggtatggtggtgtactcctgtagtcccagctactccggaggctgaggcaggaggattgcttgaaccaggaggtggacgttgcagtgagccgagatggtgccactgcactccagcctgggctacagagtccatctcaaaaaaaaaaaaattgcaaatcttttggacaagagtccaaatcagcaggtgactttcatgcacacagcggccaccttcctccccttgatgtgaaggacagtggggtggccggcccctcgggaccaccatctggaaggtgtcttttttttcccttagtggagtgacacttatatacacttaatgtatatacatttgtatacatttaattttttttttttaagacagagtctcactctgttgcccaggctggagtgcagtggcgtagtctcagctcactgcaacctccacctttcgggttcaagcagttcttgtgcctcagcctcctgagtagctgggtttataggcgcgcaccaccatacccagataatttttgtgtttttagtagaaatgaggttttgccacgttggccaggctgctcttgaattcctgacctcaagtgatccacctacctcagctttgtaaagtgctgggattacaggcgtgagccaccgcacccggcctacatttaattttttaattttagagatgatttctagtttattcactctaagatcacttaatggatatctactgtgtgccaacaattttgcctttatgttctttaaaattggccccaactcaacagatggcctcagacgtagggtgggctggtagtgtgttagctcaggagtcttacacagtttccaagctccttgagtggctgtgctacatgtttctgtgtcattctaaatccatttggttttttaaaaaagttttcaaaagtaaaattctagcttttttttgttttaggagataaagtccctccaattaaaccaaacgctggggaagaatctgtcatgaatcttgacaaattgagatttgctgatggaagcataagaacatgagaactgcgactcagcatgcagaaggtaagagcctggactcgctctggagtgagcaggcgggctgcatacctggccctgcactggttttgtttttttaaaactagatctagggggatgcaggtgcagttttgtgtggatgtactgggaggtggtggagtctgggcttttcatgtacctgtcacccaagtcgtgtgtgttgtacccagtaggtaattgttcaaccccacccctcccgctttttggagcccccagtctctgctagtccactccatgtgtactcaccgttcagctcccatttccaagtgagaatgtgtgacacttgaccttctgagtcacttcacttaggatagtgacctcctgatccatcctgcagccatcttctgtggctgcagaagacatgattgcattctttttttatggccgagtagtatttcatggtatatatgtaccacattttcttcatccggtcatccgttgatgggcacttaggttgattccatgactttgctgttgtgactagtgctgcgataaatacacaaggctgcaccagaatctggaggtaaacagcggtaggacgtactcctcaccgtatcaagaatatgaaagagaccaggaggcctgaactatacagaagtgcacttcttttccacatagaaggtcagcagactagggcagaattagtgactgcttggcatccaggacagccttctgtggttcactcgtgtgtgcttgggtgtgacctccgtgacctgaccgtcgatggctgtcatggatgagtcacagcgtggaggagagggaaccgcaggaccgccggagaagctcagtccccagcagggcagctttctcttagaggtttcctggagttcaacacaacactggtgcttacatctcaggcccggatattgatcatgtcatcatgcctggcttccagcagcttggaaatgtctttaagctggacctgttgctggccctaaatatactcggaagagagggagagtgggcggcgggtggaaactgatctgtggcctgtgcgctgggagtcggtccagtaggaccatctgtgatgatggaaatgttccgagtgtttgccatccagtatggcagccattagccatggggccgtggagaacctgatatatagtcagtctaagaaactgaattcctctaataacaaggattcttgtccatgaatgagatctcttgtctactatttgcaaggatttctgcatattttctaaaaagaagtctattgctttagtcctattctgaaaggcatttggtgttagacacaagagaacaggttccctgctcacattttcagaggcctgtgcccttcagtcttcaactgaggctgggcttgagggaggctttgtggaacagtgagaagaacagcatgactaaggcacagaaggctgagtgatgccctgcagtacttttgtagggttgaaggccagctgggaaagaaggaaccattgcattagagaatgggaacatgccttcagatacagaaatggcaaatccatgagatagtttgaagtgagaatactagaagcattcccaccatacaagttgcgtcttggtgcctgctgtatcccaggctccatgagatgctggagtcggcactgaacaaacagagcttcctgtactcatggaaatgtgtttcgttgggggaagggatttttctgctgactccggccattaatagtaagaagcaaaaaaagaaatgaggtaaattgttgggaacagggccccaaatgtggccataaactggctcaaaactggccataacaacaaaatctctgcagcacagtgacatgctcttgatggccatgatgcccacactggaaggttgtcagtttaccagaatgagggcaaggaacacctggcccacccagggcggaaaactgcttaaggcattcttttttttgtttgtttgtttgtttgtttgtttttcaacttttttttttttaattgatcattcttgggtgtttctcgcagagggggatttggcagggtcacaggacaatagtggagggaaggtcagcagataaacaagtgaacaaaggtctctggttttcctaggcagaggaccctgtggccttccgcagtgtttgtgtccctgggtacttgagattagggagtggtgatgactcttaatgagcatgctgccttcaagcgtctgtttaaaaaagcacatcttgcaccgcccttaatccatttaaccctgagtggacacagcacatgtttcagagagcacagggttggggataacgtcacagatcaacaggatcccaaggcagaagaatttttcttagtacagaacaaaatgaaaagtctcccatgtctacctctttctacacagacacagcaaccatccgatttctcaatcttttccccacctttcccccctttctattccacaaaaccgccattgtcatcatggcccgttctcaatgagctgttgggtacacctcccagacggggtggtggccgggcagaggggctcctcacttcccagtaggggcggccgggcagaggcgcccctcacctcccggacggggtggctggccgggcggggggctgacccccccacctccctcccggacggggcggctggccgggcggggggctgacccccccacctccctcccggacggggcggctggccgggcagaggggctcgtcacttcccagtaggggtggccgggcagaggcgcccctcacctcccggatggggcggctggctgggcagggggctgacccccccctccctcccggatggggcggctggccaggcggggggctgaccccccctacctccctcccggacggggcggctggccgggcagaggggctcctcacttcccagtaggggcagctgggcagaggcgcccctcacctcccagacagggcggctggccgggcggggggctgaccccccccacctccctcctggacggggtggctggccaggcagggggctgaccctcccacctccctcccggacggggtggctgcctggcggagacgctcctcacttcccagacggggtggctgccgggcggaggggctcctcacttctcagacagggcggctgctgggcggaggggctcctcacttctcagacagggcggttgccaggcagagggtctcctcacttctccgacggggcagccgggccaagatgctcctcacatcccggacggggcgacagggcagaggcgctccccacatctcagacaatgggcggccgggcagagacgctcctcacttcctagatgggatggcggccgggaagaggcgctcctcacttcctagatgggatggcggctgggcagagacgctcctcactttccagactgggcagccaggcagaggggctcctcacatcccagacgatgggcggccaggcagagacgctcctcacttcccagacggggtggcggccgggcagaggctgcaatctcggcactttgggaggccaaggcaggccgctgggaggtggatgttgcagcgagccgagatcacgccactgcactccagcctgggcaccattgagcaccgagtgaaggagactccatctgcaatcccggcacctcgggaggccaaggctggcggatcactcgcggctaggagctggagaccagcccggccaacacagcgaaaccccgtctccacccaaaaaacacgaaaaccagtcaggcgtggcggcgtgtgcccgccatcgcaggcactcggcaggctgaggcaggagaatcaggcagggaggctgcagtgagccgagatggcagcagtacagtccagctttggctcggcatcagagggagaccgtggaaagaggggagaggggagagctgtttgtttgttttagagagggtctcttaaggcattcttaaaccacaaacaatagcatgagcgatctgtgccttaaggacatgctcttgctgcagataactagccagagcccatccctttgtttcccgtaaggaatacttttagtaaatcttatgactggcttgctctcaataaatgtgtgggtaaatctctgttcaaggctctcaactctgaaggctgtgagacccctgatttcccactctacatcctatatttctgtgcgtgtgtctttaattcctctagtgccgctgggttagggtctccacaaccgagctggtctcagcaagtggcgcccacacatgggggctcgaatccaggtcgaagggtcaccggagcgacagaaaacttggaactaagctggaggacaccgagtactcttatgcagtccccatggtgagtaagaaggggagctcagaagcatcagggtaacgatgggacacgtgtgggctctggttctaagccggaggacacccaagtactcttacccagtccccatggtgtgtaagaaagggagctcggaagcatcagggtaacaatgggacacgtgtgggctctggttctaagctggaggacactgagtactcttacacagtccccatggtgagtaagaaggggagctcggaagcatcagggtaacaatgggacgtgtgggctctggttcgttccaccttggaaccttttcacgctaataataagggggaaggagagtataacgaagtaacagaagaaataacagagcaggtttgtttgccaactaaagctaaagcggcaaaggagggagaggttcatccctacccttctgcaccccctccttattttgaagaaaaagagtggcctgaccctccagatctttcatttccagaggacagtgggcgaaaagtagttgctccagtgactgtccgagcagcaccttgagcgacccctctcagttctattcaggtaggaattcagcaagctagatgagagggtgatttagaggcttggcagttccctattagaatacaccccgcagatcaacagggaaatatagccacatttgagccttttccctttaaattacttaaggagtttaaacaggctatcaatcaatatggaccaggttctcatttcgtaatgggactgttaaagaatgttgctgtttccagtcggatgattcctactgacggacactcttactcgagcttgtctaactcctgctcagttcttacaatgtaaaacttggtgggcaggtgaagcttccattcagcctacttgcagcgcccaggcccaacctcaaattaatataactgcagaccaacttttgggggtcagcggctgggttggtttagatgcacaagtggtcgtgcaggatgatgccgtagaacagcttagaggagtgtgcattagagcttgggaaaaaatcacttcaggtggagaacaatacccttcctttagtgcagtaaaacagggaccaaaagaaccgtacgcagattttatagctcagttacaggagtctcttaaaaaggtgattgcagattcggctgctcaggatatagtgctgcagttatcagctttcgacaatgctaatcccgattgccaggctgctctgtgacctatcagagggaacgcacacttagttgattatatcaaggcctgtgacggtatcagaggtaatatgcataaagctactttgttggtacaggcaatggcaggactgagagtggataaaggaaatcctttgttgcctggagcttgttttaactgtgggaagcatggtcatactaaacaagaacgtagaaaaaatgagtgagtcaggctgccagataggggaaaaaagaaaactgctgagcctgaaatatgtccaaaatgtaaaaaaggaaaacgttgggctaatcagtgtcactctaagtttgataaagatgggaactcgattttgggaaatgccatgaggggcccgtcctgggtcccgttccaaaccggagcgtttccggctcaggccattccctcacccctgtacaatgtctgttccccgccacagccagtagtgccacagtagatttatgctgcacattagctgtgagacttctgcctggggaacccccaccaaaggtcccagcaggagtctgtggacccttgccagcggggacaataggattacttttaggaaggtctagtttaagtttaaaaggagtacaaatacacacaggagtcattgattcagattacaatggggaaactcaaagtgttatatctacttctgttccctggaaaacagagccaagagagcatatagcacagctcctgattgtgccatatgtggaaatggggaaaagtgaaactaaacgaacaggaggaagtacaaatatacaaagcaaagcagcttattgggtgaatcaaattactgataaacgtcctacctgtgaaataactattcagggaaagaaatttaaggtttggtagatgcaggagcggagatttcaatcatttctctacagcactggccatccgcgtggccaattcaacctgctcaatttaacatagttggagttggtaaagcccctgaagtatatcaaagtagttatatttccattgtgaagggtccaatggacaacctgggactattcaaccaattataacttctgtacctataaatttatggggaagagatttattacaacaatggggagcacaagttctaattccagagcaattatatagccctcaaagtcagcatatgatgcatgaaatggggtatgtccctggtatgggactaggaaaaaatttgcaaggtttgaaagaaccacttcaagtggaaagacagttcctgccaaggtttaggatattattcttgatggcagccattgttaagcttccagaacctatacctttaaaatggttaacatataagccaatttggatggaacaatggccgctgagtaaagagaaactggaggctttagaggacttagttaatgaacaattagaaaagggacacatagctccaacattttccccttggaattcttcaattttcgtaattaagaaaaaatcaggtaaatggagaatgttaactgacttaagagccattaattcagttatacaacctatggggacattacagccaggattgccttctcctgctatgattccaaaaaattggcctttaatagtcatagatttaaaagactgtttctttactatccccttagctgagcaagactgtgaacggtttgcatttacaattcctgcagtaaacaacctgcagcctgctaagcgttttcattggaaagtgttgccacaaggcacgttaaacagtccaacgatttgccggatttgtgtagggcaagcaattgaacctcctcgtaaaacattttcactgtgttacattattcattatatgaatgatatactttgtgctgcccctactcaagaaatattactccagtgttatgatcacttgcaaaattcaatttctggtgctggttaaattatagctcctgacaaaattcagattactactccttactcctacttgggaaccttagtaaatgacactaccattgtgccacagaaagtagccatacgtagggatcaattgaaaacattaaatgactttcaaaaattactaggggacattaactggatacaacctgctctaggcattcctacctatgccatgagtaatctgttttctatccttagaggagatcctagtctcaccagccctcggtaattaacaagagaagctgaggcagagctgcagctaatcgaaaagcaagtccataaagcccaaataaatagaatcgatccagagaagactcgagctgcagctgatcgaaaagcaaggccataaagcccaaataaatagaaacgatccagagaagactcgagctgcagctgatcgaaaagcaaggccataaagcccaaataaatagaaatgatccagagaagactcgagctgcatctcatcaaaaagcaaggacataaagcccaaatcaatagaatcgatgcagagaagactcaagctgcagctgatcaaaaagcaaggccataaagcccaaataaatagaatcgatccagagaagacttgagctgcagctgatcgaaaagcaaggccataaagcccaaatcaatagaatcgatccagagaagactcgagctgcagctcattgaaaagcaaggccataaagctcaaatcaatagaatcgatccagagaagactcgagctgcagctgatcgaaaaacaaggccataaagcccaaataaatagaatagatccagagaagactcgagctgcagctgatcaaaaagcaaggccataaagcccaaataaatggaatagatccagagaagactcgagctgcagctgatcgaaaagcaaggccataaaactcaaatcaatagaatagatgcagagaaaactcgagctgcagctgatcaaaaagcaaggccataaagcccaaatgaatagaattgatccagagaagactcgagctgcagctgattgaaaagcaaggccataaagcccaaatcaatagaatagatccagagaagactcgagatgcagctgatctaaaagcaagtccataaagcccaaataaatagaatagatccagagaagactctagatttgctaatttttccaactccacattcagctactggtgttattgttcaagagcaagatcttgtagaatggctttttcttccacatactaattcatggcctctaactccttatttggatcaaattgctactatgataggaaatgggagaactcggattgttaaattacatggatatgatcctgaaaaaattgtccctctcacgaaggcacaaatacagcaagattttataaatagtcttacttggcaaacccatttagctgactttttgggtattctcgataatcattttcctaaaatgaaactgtttcaatttttgaaattaactaattgtattctccctaaaataactaaaccaattgaacgtgtggagaatgtttttacagatgggtctagtaatggtaaagcttcttactctggctcgaaaggtaaagttttccagacaccctatgcttcagctcaaaaaacggagcttgtagctgtaattgaggtattgactgcttttaatatgcctattaatgtgatttctgattcttcatatgtggttcattcgacacaattaattgaaaatgctgagttacgatttcatacagatgaacaactgatgactttatttatgcaattgcaaacagcagttaggagtagaatgcaccctttttacatcactcacattagggctcatacacctcttccaggacctttgactgcagggaatcaaatggctgatcgcctagttgctactgcaatatctaatgctggacactttcacaatttaacccgtgttaatacctctggtctcaaacgcagatacagcagtacctggaaagaagctaaagctattatccagcgatgcccaacttgccaaatggtacattcctcatcttttacaggaggagttaatcctcgaggattggaacctaattctcaagctctagctaaatttttctctatacggaatattaaacacattactgatatcccatataattctgaaggacaagccatagtggaaagaatgaatctctccctgaaacagcagttgcagaagcaaaagggggaaaacaggtactacaggacaccccataagcaattgaatcgcattattaactttaaattttttgagcctgcctaaaggccggatcttatcagcagctgaacagcatctacagaaaccagctgcaaagacagaagcagaacaactggtttggtggagagacctgataacagaaagttgggaaataggtaaaataataacttggggtagaggttatgcttatgtttctccaggactgaaccatcaagacacctgaaaccttatcatgagcgaatgctgaggaagagattccgggaggatcccgaggacccccccagttgcagccatgtcaagactgatgctgaggaggaccccaactgtcacgagcaacacccgtcaaacacagccatccacctgaggtcagatcaagaagctgtcacagatggcagaagaaaacctgaggtaagtgggacaaccagtcaaaatgagtaatttaatggtagctatgatagtggtgatcaccattgccatgagtattccttcaacaagggctgacacagagaacaattatacttactgggcatatttatcaatcttggctggcaagaatgcctggatgtaatcactctatgacacagttacacatgctttctgatctcagtatttaccatgataaatctgctcctataattgaggcataccgccctcaaaaacctatctgtaaacaggattggacccagtcagagaaaatgaacgtacatgtttgggaagattgcattgcagaacaggcaggggtgctggcaacgattcctatggaatcattattgattgatcccctacggggatgtttagcttgaattgcacctctcagtctgtgtgccacggccccactatgttcagctggtctgaacaaaatggtcagatggtagaaatgataagaaatacggcaagaattcctattatctggaaccatggcggtgtagtggcacctcaacctcaaatgatatggccctttgtaggagctaaacataaggatttgtggaaactgttaatagctcttaataagatcaaaatttgggaaagaataaaaaagcatcgagaaggacactctacaaacttgtctttggatattgcaaaattgaaagaacagatatttgaagcatcccggcacacctgaccttaatgccaggaactggagtgcttgaaggagctgcagacagattagcagctggtaacccattaaaatggataaaaacacttggaagctctgtgatttcaatgaagattgtgcttttaatctgtgttgtctttgtatagtctgcagatgtggatcctgactctgcaagaagtagcccaccatgacaaagctgcctttgcttttatcgctttgcaaaacaaaggggacatgttgggaacaggccccccaatgtggccataaactggctccaaaactggccataaacaaaatctctgcagcactgtgacatgctcgtgatggccatgacgcccatgctggaagattgtcggtttaccagaatgagggcaagggacacctggcccacccagggtggaaaaccgtttaaggcgttcttaaaccacaaacaatagcatgagtgatctgtgccttaaggacatgctcctgctgcagataactagccagagcccgtccctttgtttcccataaggaatacttttagtaaatcttaccactggcttgctgtcaataaatatgtgggtaaatctctgttcaaggctctcagctctgaaggctgtgagacccctgatttcccacttcacatgctgtatttctgtgtgtgtgtctttaattcctctagcaccactgggttagggtctccacaaccgagctggtctcagcagtaaatattgaaaaggaatagatacaattgtcattatttacagatagaatttccaaacaattcccagggaataaactgaaaaactaacagaaacaaaacaagaatgtagtaaggtgtctgggtaagagatttgtatctaaaaatcagtagctttgcaatgtgcaagcagtaatctgcttagacatcagtaaatacctcattcatattttaaacaaaaaattaaaaatgccttgaaataatgtaaccagaaatacaaaaaaaaaggatatgaaaacgtggctgctaatggacatgaaagaatgtaatactagattctgagatgcaatttttttcatttgttcttcctgaaaaatcattaggttgatgtgcattacagtgttacgattatgtatgagtctaaggaaaatcagatgaaatttccaaattaaaccatgaaggtgcattggtagaggaagagacaattagggtcagtggagcaaagcacagttagagggagaagcaaggaggaggagggatcactgaggtggtgcctgtctgtcccacaggaagcaaaagctgacgcctacttcccagcatacctaagtaaacttcaggcccactgcatagcacatgtctcatcacagtaaaactatgaaggaactcagtgtacaaggagcttctacaagataggcagaagacagtagccagatgggcctagggccccagccacccacgcccctccctctccttgaagacctgtggctccaacaccaccatcaccagggctctgctcagctcctcctagtgtgtatcaccacagggctgctggcttgtgtcacgttcaccaccagaccccgcgtcaggagtcccgccaggggtgtggggaggcagcactgcctggttggccgtggagctgtatggaacatggtgcctcacaggcagtctgcttggagtcctggaccctggctgtatcccgctggaaaggatgtgtgtgggtctaagatgtgtatgtaatagaaacatttatttattcagaagctttagtcaaaacttcatttttaagttcagagtaataaactcatagtctgaatttcctaatttttctgtttaatttacttaacttttaaatgaaatgcaaaacaacaggtctaaaaattaagcagttcttgatatggctgcttctatggattaaaagtttacaaataatattttgtaatatcaaaatattaaatgcaaaatcatgctgccgtgttccgtgtgggaagcgtgttgcaagaaggttgtgggaaaatcagcaagctctacggagacctaaagcacctgaagacgttcgaccggggtcagcagacagtgggctctgtgcacactgttgggccctgccttctgcagggtgggctggtgtctgtcccgtcagtgctgacttagttccgtgcttgctgtctggatgggtcctggcccacagctataaagccacaaccagtgactccatggactagcaggcccaggctgacagctcggagggcccatgtgactgggtcccgcctgcccctgatggaactttttgtgtccccaggaatggtctggaacacggacctggtggagaccctggagctgcagaacctgatgctgtgtgcgctgcagaccatctacggagcagaggcgcggaaggagtcacggggcacgcacgccagggaaggctacaaggtcggccttctcaccacgcccacctgcacctgccttttcctcccgcctggtgggactcagccccacccctgcattttctctgcattttatttcgttgccccagaagtaaatccaaaaaatccctttttccccctggtaactttgatccctgggttctcgccatcttctggatcaccgtgaccttttccttgctttgggtcggcatccactgatgccagcagtggcatctccaagccaatgtgctttgctgttagaaggccaaggttagaagtgcagctagagtggcatgaccaggaagtaaatgccagtttattaaataacgagtaagccactgtttcaagcctgccctgtggaggaaatgccagtttattaaataacgagtaagccaccatttcaaacctgccctgtggaggaaatgccagtttattaacgagtaagccaccgtttcagacctgccctgtggtttggaaaaggtatcatagagcctgccctgtggtttgattatagagcctgccctgtggtcacttgttcttcagatgaactgatttttgtgcagagcacacgtgttggattctgcctggtaagagtttttcccatatgatagcaaaaaacaacagaaagggaagcttggggtgcaaatgcaagttcaggataaaccacatcagcaaaaggacaaaggctccacaaggcaggcgcacaggctggttcaggaccgtgtgtaggcggctggtggcagcctttccagtcagctgaacatggtgaatgggaaaatcatttttattcaccatgaaattttactgatttaccctccactagaatatgctaatggctgtgatcactgctcagaacttgctcttgtctccttgtacgtattaagagtttcctgcaaagtatgtgaatccgtgtttgccagaatacagaataataaatttattttactttttttttaagatggagtctcactgtcccccaggctggagtgcagtggcggcgatctcagctcgctgcaacctctgcctcccaggttcaagtgattctcctgcctcagcctcccaagcagctgggattacaggcacgcaccaccatgtctggctaattttgtattttcagtagagacgggtttcaccatgtttgccgggctggtcttgaactcctgacttcaagtgaaccgcccacctcggcctcccaaagtgctagggttacaggcatgagccactgtgcctggccagtgcataaatttagttggtgacagcgagttttaattagaatagaagccaggtgcagtgcctcacacctgtaatcccagcatttgggaggctgaggcaggccgatcacttgagccccagagttctagaacagcctgggcaacatggtgaaacgtgtctacaaaaaaataaaaaatgagccaggcgcggtggtagcgcaggaagctgaggcaggaggattgattgagcctgggaagtcaaggctccggcaagctgtgatcacaccactgcactccagcccaggtgacatagccagaccctgtctcaaaaaaaaaatttttttttaataaaaacaggctgaaagaaaagattgaggtagtctcccagcacatggagcaaaaagacaaagtatttgataaactcttaggtacataaaggatgcttaagggaacatgcggacatggattactgtggactcactgctggctgcacaccccctggccagccatgcggcctccgtgggttctgaacatgttgatggtgccaacctcctgggctgaagtggaaatggaatgagttctagggcatctgtctcttagatcatgttaatgtctgctgtgttttttctgtattgctctgttagagtaataagaaacgtgatggtgtttctggcctcaggtgcagattgatgagtacgattactccaagcccatccaggggcaacagaagaagccctttgaggagcactggaggaagcacaccctgtcctatgtggacgttggcactgggaaggtcagtgtggagctcgttctcaccacagcccagcacccacacggccccgcccaggcctgcgggctggccttgctgatggtgaacagggaggagcaggccagatttaaatcaactcccgacagatttgaggcaccgctgaaaaaggcactctgacagcagttgggctttgggctggaaacagaatccagttcctgcaggtggttcagaggagccttaaggaagggttgctccgtggtgtgggtcagatggacgtcactaggcaggagcaagtgtccaaggcctggtggcaggggaggagatgattgtagacctagtgagaaagtcagcatctgtggggtggggacacagccactaccagaaaccagtcccacgtcaagggagcccagaagagacgcctcccctctcctcccacgggctgggccaactggaagcatctgcaggggagctgaggggatgtggtgcagtctttagcatcccctgggcactgagcaagcagagaagggcagaaatggaggtggggttggggtgagcagcatcctgggaacagccagccgagggtgtggtagggggtcgcagccttgttccacacaagcacagttcacccgtgtggcatttccgctgggcattaagattcagaaacaatgaagatagaaagcttttacccttaaacttttcatagcttgtaagagtcgtataatcacttagctgtgtctgtggaagttacctttggactctcactatcatctagtgtgtctgtgattcgggcagtaggtcattttcaggacttctcatgaaggccatttcctgatagtgtatagaaatcacacttcactcgcttagcacaagtctatttttaatgtttccgggttcgggttttttgttttgtttttgtttttctgagatagagtctcatctgttgcccaggctgaaatgtggtggcttgatctcgtctcactgcagcctcaacctcccccaggctcaggtgatcctcccacctcagcctcctgggcacatgccaccatgcctggctaattttcatatgttttgtggagatggggtttctccacgttgcccaggctagtcttgaactcctgcgctcaagtgatccacctgtcttggcctctccaactggcatgaaccaacacgcccagccagtttcagtgatttttcaagaaatacatactcattttagaaagtacaaagagattgaaataagagctcactaaccagagacgacccattatggtttaaatttctttgtatatgtgcctaccttttcctgtgtgtgtatatttaatacacagcttgagtattccttctctgaaatccttgggaccagaagcattttggatttcaggcttgttcagactttggaatatttgcattatacttactgtctgagcatccctaattggaagatctgactccatagcacatttcttttgaatgtcatgctggtgctcagaaagtttcagattttagagaatttcagatttttggattagggatgttcaacctatataaatactaaactttgaagtagaaaaactggaagtagatggtttaaacataaagtgtcttggtatagacaagggttctcccactgctcatgacgggagcattattgtaaagcactgagaatctggtacagtgtcattttcgttgctctgttccactctacgaatctgccatcatttacagtcccctgttgtgcatgtagatcatttttgaatttgttattggaaaatactgcagcaaatacctttaagttcacatgctgtaaatctacttttatagttaaaatttttcaaaaggaacacaagagatggttttttgtacatttttgtgcttaacttaccactgactcttcttttcatggtcaccctgggatatagacccgtaatcgacaaaactttgaacgaggctgactgtgccaccgtccccccagccattcgctcctactgatgagacaagatgcggtgatgacagaatcagcttttgtaattatgtataatagctcatgcatgtgtccatgtcataactgtcttcatacgcttctgcactccggggaagaaggagtacattgaagggagattggcacccaggctgggagcttgccaggaacccagtggccagggagcgtggcacttacctttgtcccttgcttcattcttgtgagatgataaaactgggcacagctcttaaataaaatataaatgaacaaactttcttttatttccaaatccatttaaaatattttactgttatgactttagtcatatttgttgacctaaaaatcaaatgtagtaatctttgtattctgttacatcaaaatccagatatgttcttgtagtttctttttttttttctttttttttttttttttttttgagacaggattggtgcagtggtacaatctcagctcactgcagcctcagactcctgggcagctcaggtgatcttcccaactcagccttctgagtagttggggctacaggtgtgcaccaccacgcccagctagtttattttgtaattgtagggacagggtctcactgtgttgcctaagctggtctcagactcctgggctcaagtgatcctccctccttggcctcccaaagtgctggaattataggtgtgaaccaccatgcctggctttgttgtagtttatttctaagttcaaattaatgttggtgcctgagagcaaatggagaaaacgaacatttcctcctttttcttggcagatggtttactaggtgagtgtgtcctcgattattcaaatcaggggtccccaatccccaggccacagattgttaccagtccatggcctgttaggagccaggccgcacagtaggaggtgagcagtgggccggtgagctactgtgtgaactccaccccctgccagagcattactctgtgagctctgccccctgcagagcattactgtgtgagctccgccctgtcagagcattactgtgtgtgctccgccccctgccagagcattactgtgtgagctccgcctcccgccagagcattactgtgtgagctccgcctcccgtcagagcattactgtgtgagctccgcccatgccagagcattaccttgtgagctccaacccctgccagagcattactgggtgagctccaccccctgccagagcattactgtgtgaattccaacccctgccagagcattactctctgagctccgcccctgccagagcattactctgagctccgccccctgcaagagcattactctgtgggctccgcctcctgccggagcattactctgtgagctccgcctccagtcacagcattactgtgagctccgccccctgccagagcattactctgtgagctccgcctccagtcacagcattactgtgagctccgcctcctgccagagcattactgtgtgaactccaacccctgccagagcattactgggtgagctccaccccctgccagagcattactctgttagctccaccccctgccagagcattactctgtgggctccgccccctgccagagcattactctgtgagctccgcctccagtcacagcattactgtgagctccgccccctgccagagcattactctgtgggctccgcctcctgccagagcattactctctgagctctgcctcccaccagagcattactgtgtgagcgccgcctcctgtcatatcattactgtgtgagctctgcctcctgtcacagcattactgtgtgagctccgcctcctctccaagcattaactgtgtgagctccacctccagtcacaacattactgtgtgagctccgcctcctgtccaagcattactgtgtgagctccgcctcctgtccaagcattactgtgtgagctccgcctcccgtcagagcattaccgtgtgagctccgcctcccgtcagagcattaccgtgtgagctccgcctcccgtcacagcattaccgtgtgagctccgcctcccgtcacagcattaccgtgtgagctccgcctcccgccagagcattaccgtgtgagctccgcctcccgtcacagcattaccgtgtgagctccgcctcccgccagagcattaccgtgtgagctccgcctcccgtcacagcattaccgtgtgagctccgcctcccgccagagcattaccgtgtgagctccgcctcccgtcagagcattaccgtgtgagctccgcctcccgccagagcattaccgtgtgagctccgcctcccgtcacagcattaccgtgtgagctccgcctcccgtcacagcattaccgtgtgagctccgcctcctgtccaagcattactgtgtgagctccgcctcctgtcagatcagtggtggcattagattctcataggagtggaaccctgttgtgaactgcgcatgcgaaggatctaggttatgcgccgcttatgagaatctaatgctgctcatctgagctggaaccgtttcatctccaaaccatccccaccatccccacacttgtccgtggaaaaagtgtcttccatgaaaccagtccctggtgccaacaaggttagggaccaccagtttaaataaccaaatactaaaagaactggcatagaagtaaatgggctgctgctttatttttagactgttctttttagagaacaatgacaattatttccaagtttgtcattagaaaataatattaggttggtgcaaaagtaattgtggtgtttgccattactttcaatggcaaaagccatgattactgttgcaccaacttaatatgataaatttgttccttaaagtgtatttttggtaagaaaaatctttgcttttcttctattaattttttgtttttgtcttggtagagacagagtcttgccatgccggccaggctggagtgcagtgctgtgatctcggctcactgcaacctccacctcccgggctccagcaatcctcccacctcagcctcccaaggagctgagactacaggtgtgagccaccatgcctggctaatttttatattttttacagagacagggtttcaccatcttgcccaggctggtctcaaactcctgggctcaagcagtcctcctgcctcagcctcccagagtattgggattataggtgtgagccactgccagaaaaacttttcctaagacaaggcaggttttacattatatttagattttttttaatgatgtcttttttggcagtgcacagccagagaacaacacatcacacacaggaaacagttgtgctcatgtgatgggggcctcagcactaggaaggagtggactattggcacacgcagcagcttgaataaatctgaaagtcactatgctgtgtaagagaagccaaatttaaaaagtgcatgctgtgtacagagggtgtcaagaatgcctcctacgtgacggaaagcagatccgtggttgcctgcagactggcaggagcagattccaaaggcacaggaagaagcttgtgggtagaatgtgttcattaccttctgtgcattataccataaaaaagctggtcacaaaaatgcaaaccaaaaacaaaggtgaaactaggataagatttctcacctgtgtgattggtaaacgtgcagatgtgccgtcatgctttgtttatgaagctgtgggatacaaggactctcatacgtcactgtggaatgcagaatattgcagcctcat

SEQ ID NO: 747 - DNA, 8460 bp, Homo sapiens
gccgcgaggagggccccattcaaaagtagtcgctattgtcgccgtgggctgagctcgccgggccggcccctccgtggggccgcgctgggacgcacgcgggtggacgaggggaccgatcccgggcgcccatggccggggccgccatggccgagcggggccgcgtgcctccccccgcacccgcgcccagcacggaggggctgccgcgcgccttcctgcagagcctgcgcaccctgttcgacatcctggacgaccggcggcgcggctgcgtgcacctgcgcgagatcgagtcccgctggcagggcaccgacgcgcgggagctgccccgcggggtgctggagggcttgcgccaggtggccccggccagcggctacctgaccttcgagcgcttcgtggccggcctgcgcacctccctgctgagcgccgacggcggcccccgggaccccacgcgcgccccggcccggcccggggatcagccgccgccgccgccgcagcgcctggtgttcgctccggccgacgagccgcggacggtcctggagaggaagcccctgcccctgggcgtgcgcgcccctctggccggtcccagcgccgccgcccgcagcccggagcagctgtgcgccccggctgaggcggcgccctgccccgcggagcccgagcggtcccagagcgcggcgctggaaccgagctccagcgcggacgcaggtgagttccggacggcccccgggcaccctcgtagctctcccgggcccgggccagaaaccgcagtcccacagctgctgcccgtgcatttcccacaagggacgggaccggggagcggctcttcgtggactccggatcctggagggcgcctcggcgggtctggagggaaagggcttcatgcttgtcgcggtgagcccaggggcttgcttagggaggcaagccagaccctctcctgccacagcataaggccaccagggccggggggtggcaggtgactcagaaaacccaccgggagcccaacctgtaccaagcctgagcttgggctctccatctccaataccctttccgcacctggggacacctgggccctcagcctcctgtctgtggctgctcaggcagaagtgcttccttctcaaagaaagggtcccccttctcagtgtgacagcttagccaggggggctgggcccactgaccccactgaggcctaggcaggcgggggctgctgctggtggcccaagaggacctggccctgttgccaagatgggcaggggcgtgggtggatctcctgcaccccagtggggctgtactatggcagatgccatggagggacataggccgtagtccctggggatggctggcacactcctctcctgccttccggtccagttggcagtgatgggagattgctgaatggtcccctgtctcccccaacccagtgcctgccttgggaacaggacctgtattatggctggggttggggggccaagctcccagaggggccccaggccccacagcccattcggcctgtgcacccgttctgccaggggaggcctgcccaccggtggctcctgccggtccctgtgctgcctgctgctctgccaccctccctgtactgctcccccacctcagccatattctccagccctacagctggtgtttggagccacggcggccctggcctccctggtgatctgatccagcagccacaccaggctgggggacccctagttctatggtgagggaaccttcagagggtatctggctccaaatgcagggtcagcgtcatccatgtggccatgcagtttgaaatcagccatgggattgcacgctgtggccgggcctggggtttggaggcctaagcctgtggtccacccctgctctgctctgatgccccatgcggcactggctcacgtaccacatctccctgaaggccacatggctagggctgtagctgtcaccctctcacaggcaaacggagggccagacaaatggcgtgacatatttgattgacacagctggcttttggggtgtcaaatctggagctctgaggtcaccccaactcccagaaagcctgccaacacacacagccttccaagcccccagcccagatgttcagggcctctttccttgttcccacctgggactgcgtgtttgctccaggctggctgtggccctggaggtgtggcctgctggctcagggccctggaggggcagagccaccacccccacctagaggccatctagctcatcacccagcacgctgctatctggggacccaggagctgctctatggactcaactgtacagaccgggcccaggtgtcctgggacttcctctatggcctccctctgtctgtaccctctctgctcccacctcctgaagggctgtgtgctcttccactgtcttgccccagagctgccagccgctcagcaccgcaggctggagtgcgaattcgggcctgcctggagccaggctctctgccgtgcctacctgggcccaattcttgcatcactccctgactcctgtggccaggtgccaggggcatggcctctaaggatgtgcctggtgctggggctacagctggaggccgaaggaggatgccttcctccacacctgtacccacttctgtagcctggggaggtgcacctactccctcaccaggaagctgggccggagtggcaccaacgcgatactcttggctgcccccagggggagccctcaaacaaacttcagagcaggggtctgtgagcaccaggacgtgcctgacttgtcagttgggtgcaccgcctggcgtatcacacacgcgggacttttttttttttttttttttttttttttgagatggagtcttgctctgtcgcccaggctggagtgcagtggcgcgaatctcagctcactgcaacctccgcctcctgggttcaagcgatcctcctgcttcagcctcccgagtagctgggattacaggtgcatgccaccacgccctgctaatttttgtatttttagtagagacagggtttcaccatgttggctaggctggtcttgaactcctgacctcaactgatccccccccgccccagcttcccaaagtgctgggattacaggtgtgagccaccgtgcccggcaagggatcttttttttttttgagacaaagttttgctgtgttgcccagcctggagtgcagtggcgcaatctgggctcagtggaacctctgcctcccaggctcaagcaatcctcctgcctcaggctcctgagtagccgggaccacaggtgcatgccactgcaccaggctaatttttgtgtttctaatagaaatggggtattgccggccgggcacagtggctcacgcctgtaattccagcactttgggaggctgaggtgggtggatcacctgaggtcaggagttcaggaccagcctggtcaacatggtgaaacctcatctctactaaaaaatacaaaaagtagctgggcatggtagtgggtgtctgtaatcccagctactcgggaggctgagaccggagaatcacttgaacctgggaggcggaggttgcagtgagccaagatcataccattgcactccagcctgggcaacaggaacaaaacaacgtctcaagaaaaaaaggaagaaatggggttttgccatgttgcccaggctggtctcaaactcctgagctcaagcgatccacccgccttggtccccaaaagtgctgggattacaggcgtgagccactgtgcccggccatgcgggactaactttctatcagagtcaccatcctgggaaaagttaggtttccgtcattcacacccacatctcctgctgccttgcaggaccccgtgcagatgggagaggcgtagtcaggaccagaacccccccgcccactcctcccttacccagctgccttggagacccagggtgtgcctgccatgttctgggcactgggtgtgcagaagagagctggataaggcctctggccccagagagctcacggaccgatgagggggcagggtgtgtgtttgagcaaacatgcgggcttggcggcacagccctccccaagccagtgtgaggagctggaaaggggagagggaccaaactccagcctggcacagaggctacacgtgggccatgccaggctggtgcccgagacctcgagggtgggctgagatgtggaggccgctgcacctcagcagagcctggccaggcaggtctggaggtgagccaggcccatgcctctccataacaggtgcagtggcgtgcagggccctggaggcggactcaggggatgcccggcgggctccccgtgcccgaggggaacgtcggaggcacaccatcgccagcggcgtggactgcggcctggtgagcagggactggggctctgtggggctctccatcttgcctggaggctggaggccgggatgggagcaggggggccttgagcctgggggagtccatggcggaagtacagtcagctctggacatctctctccctacctgggcttgactcccctggagggatggcccagggtcaggcagagggaggtcaagaggtcgtttagggcagctatggtggctgcccagcccgcctcacgaggttgctgctgcaagccagtctggcttcccagctgtgtgctcaccacaggcagacttcgggagggtgggctcagctgaagggtccgtcacccctcccccagggaagcctgagtggaggggctaagaaaggccaagacccctcagcaggaggaacggggctcctgctccaaatgggcctatggggctcacacatgcaggtgtcagcagaagcgtgcgtccgtgggtgtttgcaaacgtgtacacgtgctgctgcatttgtgtctgtggctctggtgcccacccacaggtgagctcatgcatgtgtggacgtgtgcgtgctcactggggccaggcattccatgtaaatgcacgtattgcagctgaagcagatgaaggagctggagcaggagaaggaggtgctgctgcagggtttggagatgatggcgcggggccgcgactggtaccagcagcagctgcaacgagtgcaggagcgccagcgccgcctgggccagagcagagccagcgccgtgagtgccacagccctgtccccagatccccacacatggggaccccagctcaccccaggcacccttgggcattgtggctgcccctattcccggacacagtggctgtcgattccacccaggatgctgagacatccctttctccgcctgtggctgccccactcctagggcctaaggtgtcttgggcagacctcccacctcagcaatgcccctgggaccctctaggctctctgcagcatcaggaggcaggagagccacctgtgggaacccctatcaaggcaccttgctggccccggctggacctcctctctgaccgcttgtcctctgctttcttcccaggactttggggctgcagggagcccccgcccactggggcggctactgcccaaggtacaagaggtggcccggtgcctgggggagctgctggctgcagcctgtgccagccgggtgagtgtaccccaaacccccacacccacgctggggcccaggccagtttagtgcttccccgccctcgtccaggcctgcctaatcctgccctcccgcaggccctgcccccgtcctcctccgggcccccctgccctgccctgacgtccacctcacccccggtctggcagcagcagaccatcctcatgctgaaggagcagaaccgactcctcacccaggtagggcaggcgcgggaggggtgcaggggtgggggtgaggccccgcaggccttgaccaactgtgcacctgcccaggaggtgaccgagaagagtgagcgcatcacgcagctggagcaggagaagtcggcgctcattaagcagctgtttgaggcccgcgccctgagccagcaggacgggggacctctggattccaccttcatctagtccttgtgggccgcgtgggcccccagggccagcctggcactcagcccttcgagggtgggcgccccatcgcacccaccctctctggctggagacccccggcaggcccaggcacagtcccggagtgggcgccttcctgccgcccttgccagatgggctccccaggcctgcccccggctggtccccgcaccgagcgcttgactccgttttggctcctggtgctgacatgggctggggctctcttgagtccgcatagtccgcagctactactgccgctgtcagtggacagtggggtacccctccatgagttagcgtccccccgtttccagcggtgccgccctgggtcccatcttcagggaaaggcactgcccacgccaggctgcacttccaacaacgggcagcagagggcgcggggcggctccgacgcgggtccaagggcagcttcccgctcaaccagggcaccaggacgaggtggctgtagctcggacggacggaagtagatggagggggtggggacggcctgtaagcggggggtgcctgcctggctggggagccccagggatagcggtcggacttcaggttctggccaaggctgagggaccctggctgcagcggatcggcacgccgggtgggcgagagcttggcctgcatgtgcctcccacagaccctggggtgatggccttccccctcttggccgggacgttgccccacgttgagtcccacacaacatcctgtgagcctggctccccaggagggcccccagacagctcccaggcacgtcataggcaaagcctgttcccccgactcaggatttccaaggcctggggtcctgctcacccccctttgctctcacgcccagcctgtccccaggtttcagctgggagaggccacctccctcagccaaggaaaacgagaacccccagggtacaggaggaggctggggcaggtccccttgggtgtcactccctcagcccctgcccaggcccactcccgctggtgctggagtacgcactggtgggggggccctgctcagcccaacctggagggtcccagtgtcaccagaaccaggggcacggcaacagcatcgatgggttctgcagcccagggcccccgatgcggggtcagtgcgtggggggcgcagggcccccgatgccgatgcggggtcagtgtgtgtggggcgcagggcctccgatgcggggtcagtgcgtggggggcgcagggccccctcgtgtccagggcactttggtacactgtcccacaaggcacctgtctcagaggaggggccctggcaggcagcgtggcaactcccttccggagcccagctccatgctaacctgcccacagcaaccccacagagccacattccctgctgcacctggtctgcaggggtgtcccaggacaggcccaagtcagcccagcatgcagctgccctcctaccctgaagatgggagtgggctttccaggggacataaggatgtcaggcctggacctcctgggcaggaaagggtgcaggtcctgagggcctgtgccccacagccccagcaccaggtggactgcagcgcagtgggtgggccagtggcagccagggagaagccccccgtcagcaggctggggtctgcccaccagggcctccccacgtctgcctttgagggtgcctgccatgccctgggggatcctggcatctttactggactggaagcaggagacagaacagtgtctgtcccggggtgacttcatcaggagaccgcccacatagagctggaccccgcagctgaagcggaaatgtgagacaggctggcacctccggaaaaactgcctttcagccttggtgttccgtgcaaggtgaaaagaaataggtcctcccagtttacagcttgaaatcaggctagtgagtggccctggagaccacgaggggagaatttaaaggccccggctggcagggtctaggtggctggcagaggcacatgcagaccctgcctggagcctgccctaggacgctgggcgggtcagtctccgtgcaggatgtgagcagcgtccctgggctctatccgcgaggtgccagtagcgtgtgcaggtacatacacgtgcgtgcacactgtgatgacacccggaaatgtctcaggatgttgaaatgtgtccttgggggcagaagtgtccccagttgagaatctgccccagaggaacacacccacaccaggcctcaggattttgtgttgatcaagttccaaggaaaaggaacatctcagccgggcgtggtggttcacgcctggaatcccagcacttgaggccaggagttccagagcagcctgggcaacgcagtgagagaccccatctctacaaaaaaaaaaaagaaagaaagaaaatgagagatccaggtttaaaaattcataaacaccacaaggaaacaatacactatgagacccagcagaagcaacagattgactctagacccagatactagaattatcagagagaatataaagtaacagtgttttatatatctaaagaaataaaagagatttctggaaacatg

SEQ ID NO: 748 - DNA, 2921 bp, Homo sapiens
atggcccgagagctgagccaggaggcactactggactttctgtgccaggctgggggccgcgtgaccaacgctgccttgctgagccacttcaagagctttctccgagaccccgacgcgtcccccagccagcaccagcaccgccgcgagctcttcaagggcttcgtcaactcggtcgccgcagtgcgccaggaccccgacggcaccaagtacgtggtgctcaagaggagatacagggaccttttgggggaggaggggctgcagcgaccccgcgagccgcccgcggccgcccccagtgcagggggagctgcgccctgctccccgcgaggcgcgcgccggggggagccgccccagcagcagcccaggcggcggcggcgcgagaaggagccggaggaggagccagcaggtgcagcagccagagccgccgacgcagcttgcaatggactcccgggcagcgactcccgtagggcgcccgggaagggcggcggatcgaagggcagtcccggacagaggccgccggtgcccgcagctgcagcggcaggggcccaggcgagagcgagctgcgcggcggcgaagacgcagggccgctgctgctgggaatgcctccagaacaacctggctgtactgccgggagagctcggcgcactcccgcactcggccaccgcggaggagaagccggcacgggctctgcctgcccaggatgaccgcggggcttccagggagcgggaagaaggcgcgctagctgagccggcgcctgtgcctgcagtggctcactcgcctcccgccaccgtcgaggctgcgacaagcagggcttccccgcctgctctcctgcccggccccgctccccgcggagaccggccggagctgctgacccccagctccctgcattattcgaccctgcagcagcagcagcagcgcactcgagagtgggtggccaggcacccgcaggtgcccgaggcccgtgatcagggccctatccgcgcctggtcggtgctgccagacaacttcctccagctgcccttggaacccggctccacggagcctaattcagagccgccagacccctgtctttcctcgcactctctctttcctgttgttccggatgagtcctgggaatcctgggcggggaacccttcattgactgtctttcgcagcattcgttgtcagctgtccctccaagatctggatgactttgtggaccaggagagtgatggcagtgaggagagcagcagtgggcccaaagactccccgggggcttctgaagaggggctgcaggttgtcttgggaaccccagatagggggaagctcaggaatccagctgggggcctttctgtatctcggaaggagggcagccccagccggagccctcagggtctcagaaacagaggggatggtcacatctctcagcaggtccctgcaggggctaatggccttgcaggccaccccctgaagcctttgccttggccagttcctaagttaaggaggtccctcaggaggagctctctggcagggagagccaaattgtcctcctctgatgaggagtacctcgatgagggcttgctgaaaagaagtcggcgcccacctcgatccaggaagccctccaaggcaggaacggcacccagcccaagggttgatgcaggtttatcactaaaacttgcagaggttaaggctgttgtggccgagcggggttggcgacacagcctgtgggtccccagtggggaggggtctgcagccttggccccccacagaacttctgagcacaaatcatccctggttccactagatgccagggagcatgagtggattgtgaagcttgccagtggctcctggattcaggtgtggactttgttctgggaggaccctcaactggccttgcacaaagactttttgactgggtacactgcgttgcactggatagccaaacatggtgacctcagggcccttcaggacttggtgtctggagcaaagaaggcagggattgtccttgatgtaaacgtgaggtccagttgtggatataccccgctgcaccttgcagccattcacggccaccagggggtcatcaaattgctagtgcaaaggttggcttctcgggtaaatgtcagggacagcagtgggaagaagccatggcagtatctaaccagtaatacctctggggaaatatggcagctgttgggagctcctcggggcaagcccattttccctgtctatcccttagttggaagttcttcccctaccagaaaggccaagagcaaggaaatatctagaagtgtcacccgaaaaacttccttcgctgcactactcaaaagtcagcacaacaagtggaaactggccaaccagtatgagaaattccacagtccaagggaaagagaagagtatagtgactgaggtgggtctctctgtccaacatgcaggcagcactccctcatcctgctcagtgagagaattcagggggaatagaaaagctgctgagagttggtaaagaggatggtcgagtgagatggtgttgacctccctggatcttatgtcactacatcctggacctcaagagggtcatccaagctttttgaaagctgaactccttgactggagaaacctagacaagaggcggggccaggtgcttgatatctaggaggcattcttcctcttcccttgccaccatggagctgggcacagtaagccatattgtttcctgaagcaggagtcccaggccttggctagagagggaacagatgtctaacaaaaagagaagcaattcgaggaattgatgaagcacaattaaaatcctctctggctagtagctctctggcttctgttcatttgaagaataaatcttggctgacagtgggaagcaccaggtttgaaatcagatggctttatttttctttttttggcatttaaatcagtgaaataaaattattactgga

SEQ ID NO: 749 - DNA, 35594 bp, Homo sapiens
gtctttctgttcactttttttcacaaaatcatccaggctcttcctactctcctctcttaccacctctctcttcttttttttttttttttagttatttcacagatgccactggggtaggtaaactgacccaactctgcagcactcagaagacgaagcaaagccttctacttgagcagtttttccatcactgatatgtgcaggaaatgaagacattgcctgccatgcttggaactgggaaattattttgggtcttcttcttaatcccatatctggacatctggaacatccatggtaaggcacctgcttaggttatttctggttttatttctcagggggtcttggaggcaacattctcccttgctgaacttagtacggtgtaacgtttatacgaagtgggtaatcgtagatgaaaccaagctgttacatttgcttaccgaagacatcgtagagcataaaccaaattagaacatagtattcacctgcctaatcataggcatcgcatcaatagcttggctgactttcttaaaaacatgttgatggtaggaaaagagaactgagtagatgttataaatagttaagtacaaatctatcactacttcttgcaaaaatgctctggctgccatactgataatgaatagatagctcgttctttccaaactgagtgcagtagagtgctgcagtgctcagttgggtaggacagttgttggataatcggaattatacatatctccatggttaccctcaaataatattacctctaaataaaatctctatacttgcttcattgggatgtatgccttgagaataccgattgagaaaatgctacaaaatataggagcagaacttttcgtcattgcttctattttgttgaaagggaatggttcctacttggttgtcaattgaacacagaaaataagttggattctgcaaagatgatatttagccacccctgcaaagactttatacaggcaaaaaaaaaaaaaaaaaaaaaaaggcaatttcttttttattgtaaagtcgcttcctaccttatattgcataggaacccacatattatcaagaggaaaagcctatgagtggctcatcagaagcttctgatttttcaggttttatttttttatttttttgagacaagagttttgctctcgtcacccaggctggagtgcaatggcgtgatcccgcctcactgcatcctctgcctcccgggttcaatcgattcttcttcctcccgggttcaatttattctcctgcctcagcgtccctagtagctgggattacaggcaccttccaccacgcacagctaatttttgtatttttagtagagatgttggataaccccaattatccaacatctgtcctacccaactgagcactgcaacactctactgcactcagtttgggaagaacgagctatctattcatcatcagtgtggcagcctgagcattttcgcaagaagtagtgatagatttgtacttaactatttataacatctactcagttctcttttcttgccatcaacctgttttttaagaaagtcagccaagctatggatgcaatgcatgttgggcaggctggtctggagctcctgacctcaagtgatccacctgcctcagcctcccaaagtgctaggattacaggtatgagccaccatgcccagtgatttttcaggttttaaatattctgtcttattattccctacaagcacacatttatcagtttggctactgcaattttaaattagaaaatctggccactgaggttctatggaaagtctatctataattttaaactgtgtagtttggaatatgtctctatgatgccaggatgccacacaaccaagtgcaaagtaaaaaagtccttagttactcaaacatctttatgtttgtaagtatctagtattaagtcaactaggtgcttagatggttgactgaattttccaccttccatcagatgcctacagtcacatagctacaactggagtcaaatattattaaatagatttcttccccatttgaaggatacataaactactctctatgaaattaagaacaatgagtttcagtgctaaaccacattgatggtggggtaagacctttatttctcccaatgtgcaacctagcatttgcaaaagtgaacttggctgttagaactgggttaatttactggctctgccacttactgtatggcattgattaagtctcttctcttctctttagtttcctcatttgtacaatacaggtaataattgtacctaaattatggggctgctgtgaagactgtagatgcaataatatgggtaaagtgcctcgcatagtaagtgcacgtatttaaagctcagtaaatgttagtggtatttttcctaaattattttcaccatgcaacctctatgtaattaaatgagaattatgttttaacattattatttaaaatagttgagtttttaaagttaaaaataaaataaataagtacaatatattttgcaatatatttagcccaaaatatagtgaatcaaattattcagaaaatgaaatatggctgggagccatggccctagcctttagtctcagcactttgggaagccaagacgggcagatcacctgaggtcaggagtttaagaccagactggtcaacatggtgaaaccccgtctctactaaaaatataaaaatttgctgggtgtgttgggaggtgcctgtagtcccagctactcgggaggccgagacaggagaatagcttgaacccaggaggcagaggttgcagtgagctgagatcacaccactgcactcaaaaaaaaaagggaaagacttgagtgaagtactggtcagatatataccagttgatataatggattgcagcagcagttgcattaaattaaagctataggttaagagaaggaacatttggtgaaatttgttctcccaggcagagctgatggctccatttcttaaaaccacattaaataccttatatcttggggatttcctgtgatttacttaattgctgagttctttacagtaatacattttcagtgtttaaagatagcctttgaagattttttccccctacttcaaagcaatgtgagatccgtgtccttgttcctaggagtgaggctgcatatataataaggctggaaaaaatgtaatgttctctacaaacttcctgtttaaggtccttctttattacaaaagtatgcttgcttactttttgtgtttctctaaaaaattagagaaacttgcccctcagtgtgtggcatacagtttctgtcctgatagaagtaataaaaatgtcaatatcttcccttcatgggcagatcatgctggcaagatctagactgcaagtggaagtgtctctgtccattgcctgccctgtcatcctggaccatttgtctgaggctgccctagaccctagttcagttgaggatcaaccaaggattccacttttaggcaggcaggaacactgcagttaatgtctgggtatcaccaacaccatatatgatgcagaataaaggcagttggaactgtttgattgattactggttattgtgatttttaaaaaaagcaatcctagtctggttcagtaagggaaagacacctgtattctggctcttttgagaatacagtggttagggctatgtctccattttggtctggcttgtgtcatttttttccctttattatgatggtccagtatggtccatggaccagcttttaaacaccgtgttccacatcccacacagattgttttgctctactacaaactggccatatctttgggtcaaaaaatatcattccttgaagttcaggttttgtagcacagtatctttataaggcatatttctatggcttcagctatttgttcttattgaaatgtgcatatggaggaatgctagagatagagctctgtcttctgccaagtgcctatgtattgttacaacaatgcctgccatatattaaataaatgtttaggaatgcattctgtggttacaggacttcttgaattaaagcatgaaaagattaaccttgtgctcattgcagccttgaatatacttttcctatcacagagaagtttttaaatttcttgcttcctctgtcctactaccaaagtttcctctattgtaaagttgacgtcaaaactatttatcttgcctcattgggactttcctacttaatttccattatttgtgagtttcatctttatgtagagttcagaattgttaaaagaaaaatatttacaggcatttgtaatcaggtccaaaaaataatcattttcttttttccttggagaagctgtgtggtatagtggctaagatcagggactctaaagccagactccatggattagtatcctatgtctgccatttaatggttttgtgactataaaatctctggttctcagttttctcatctaaaaaaatgggagaataatcttataaggttgttgtgactattaagtgaattaattctgtaaaacacttagaatagtgcatggcatgccattcagtgctgtgtatatttagctaattttttttcttttagtccaacatttcattagtttaatagtcctgttaaagtaacattgggtgacaattgggaatcaaccacaaataaaaatttggagttcacaaaagtcttctataaattactcttgatattattatctactcttttttttctttatttcttctaaaaaaggaaaacaggatacatgtgcagaaatgtacaggtttgttacataggtatacgtgtgccatgatggtttgcttaacctattgacccatcctctaagttccctctcctctccccctactccccaacaggctctggtttgtgttattcccctctctgtgtccatatattctcattttcaacttccacttatgagtgagaacatgcagtgtttggttttctgttcctgtgttagtttgcttaggatgatggcttccagcttcatccatgtccctgcaaagggcatgatctcattcttttttatggctgcatagtattccacggtgtatatgtaccatattttctttttccagtctatcattgatgggcatttgggttggttccgtgtctttgctattgtaaatagtgctgcaataaacatacgtgtgcatgtgtctttatagtagaatgatttatattcctttgagtatatacccagtaacgggattgctgggtcaaatggtatttctggttctagatcgaggaattgccatactgtcttccacaatggttgaactaatttacactcccaccaaccgtgtaaaagcattcctaattctccacagacttgccagcacctattgtttcctgactttttaataatcaccattctgactggcgtgagatgttatctccttgtggttttgatttacatttctctgaccatcagtgatgttgagcttttattcttatgtttgttggtggcataaatgtcttctttttttttttgagatagagtgtcgctctgtcgcccaggctggagtgcagtggcgcaatctccgctcactgcaagctctgcctcccgggctcatgccattctcctaactcagcctcccgagtagctgggactacaggcggctgccaccacgcctggctaattttttgtatttttagtacagaaggtttcaccgtgttagtcaggatggtcttgatctcctgacctcatgatccacctgtctcggcctcccaaagtgctgggattacaggcgtgagccaccgcgcccagccagtgtcttcttttgagaagtgtctgtttaggctgggtgtagtggctctcgcctgtaatcccagcacttcaggaagctgaggagggcgggtcatttgaggtcaggagttcaagagcagtctggccagcatagtgaaaccctgtctgtactaaaaatacaaaaattagctgggcgtggtgggacacgcctgtaagaccagctacttgggaggctgaggcagaattgcttgaacccaggagactgaagttgcagtgagccaggttgcaccactgcactccagctgggtaacagagtgagactctgtctccaaaaaaaaacagagagaactgtgtgttcatatcctttgcccactttttgatgcggttgtttgtttttttcttgtaaacttatttaagtttcttgtaaattctggatattaggcctttttcagatgggtagattgcaaaaattttctcccattctgtaggttgcctttttgctctgatgagagtttcttttgctgtgcagaagttcttcagtttgttgcaattgcttttggcatttatgtcatgaagactttgtgagaaaaatgccaaaagcattatctactcttatccttggtcaccaagaaaagctaatagtgcttgagaatcatgcgcttgagttgtattgtgtcagtgaattgtatcatatgcgatttgcttcacttttctaatactctccattctcttacctcaaaataagctcaatattttgtacctttctggtatactctcatggttatggacctgatttacatgtttatctcaatggaagaagtggcttgtgtgcagcatgtgtctgtgtgtatgcatgcagaggtgtcatacaatttgagattcacttagaacagagtccagaagagtgttagatcagtcccaggaaaacatcaagtttagctggcagagctctttaatttcttttttctgccttcttgataaccatgttcatcttataagcacaacctggaactcacacacatcacaaatggcctattatccagtatttggctacaagggaggctggggcattgagatttttatctggggggttatggccccacttcattttcctctataatattagaagatgagaattaatattggaagacatttagcagattctgtccacataagtattgtttagtatcttcaagggctttgaaaatgccagtgaatctcagtgtgatgtctgtggtagaatgtattagagatgtgaggaagtatctgggaagaaagtagagatggactttccctttccaatcataatacataagccacacttaatctgaacatcacaagtaacaatccttccactgaagtcaatatttagaaatactcatgttggtttctgatcaaatgccagaggcactcactgatgctactgtcaacagcttctcaggtatgctgtctacatttgctgccctatgtttcttcctgaaatccctgtgacaaaggtggaaaatttagcctctctgaaggacagggcctatgtgtaacaggcaatcaaagtctctctaaatcattgttctttaggactcattaagttgactagaagcttttactattcaagggcgataattacatgttgaccaactaaaaccaccagaaactcatccttgttacacagagtagacagggctctaaggagtgcaatgcatatgaatcctctggcctagagaagcaaagtcagtgaccagtagggtagatctgcaaggggacatttgtgacttggcagagatgtaatgaagaagtcctgaaagcaagcttagaaaattatcaaaggacaaagtttttttcaatattctagttttgaccaaggcaagccttgctggttaatatatttctgtagagtttcctctcccacataaaagaagagcatgcttatattggatgtgctgcctttcttctctctattatatagatatatttttgcctggtgtatatactagttattatgcaccactgctgatccctagaatggttgttgggggtaatttttcacagcagagtcttctgtgtttccatcttgtctttaccattcataggctttacacctctggacaatgactcaacttctgtgtgatttccctaaattcatcctatcagaaaacataataatatctggtactttatgttgttgttatgtgccaagcatagtgctaagaatatttcctatatgttctcatttgctttcacaacaaccctactggataagagcttgtgctttggagttagccacacctgggttaaagtcctagccttgactcttcctcctaccagctggtgatcttgggcaagtggcttatattctctaatacccagtttcctcaacttaaaaaaataaaggccataatagtaattccctcataaaatcattgtgagggtcaaatgaaacaatacatgtttggtatctaaaagtgcctacctcataataagaactttgaaaatattagtcatattctttttttcctcgtgttaagatggatctaggttgggtctacagtatatagataatgtgaggtggagtgtacctgtgggcaagtggcaaagaatgtgtagcagtgattctagaggtgatctcctaaatgtaacttaaactttccattgggcatctgacctcatgacctctaaggttctcttcttgttctactcttaaatatctcaaggagaggaaatgacatggggactttgtaagctttgctaaatgtcggaaaaagcaatgacaaatactagaatgactgattttagacaaaacaagttcagaattatttcaaacatgataaaatcaagagatacagagcttaaagtcttcagtggctcaatacaactgcattgaagagatcagtcttcaaatttacttgccaaatagtcatactacactaacaatgagaaattctaactgtagaagaaattgctttaaagtgtgctaataccatatgaaagtaaacttaaagaaaaatttcataaatgaatataagaagatatgtttttataagaaggggatttttaagaggaaataataataaaagatgattgtgaaaatgctctcaattttcttgtttcatggttgctttttttttttaaataatgggcataaatgtagatttatgccctgtgtattcttggcattaatactttccagttccatttttgtgaaggaaattttacattgtgtgtgtgtgtgtgtgtgtgtgtgtgtgtgtgtgtttacccagggagaaaatggctcttcttgtctaaagagcaatatcaggtgatatccacagagaataagttaaatctactattgcatactacatccttgtctgtgatctgtattgtctatgatctgtatctttagtgttgtttttcaggaaagacatatgtaaataaactttcattttacagaagggactgagggccagtcagttttcactgtactcgtgagaacaatcacagggttttccttaaagtaacaatagtcacttttacaaaagaagctctgattttaacatatgtttgtgtgtgtcatacttacttaattttctccaggtattcctagtacttctgagaatatctgacttatggagtggtttatttaccacagagttaaagtaatacctttaatagacattacataatacattaaatgaatactttctatatgaggtggaactcccccaccctaacctcatgtcaccacatttctgattttgtgagtgtatgtgagctagtttatgatgggaaagtatgctacctgggttttctgatgtcgtccgtgtgatttcccaaggtatgcaagtcaatgtcctcccaagatccttgaagtatggttccatggctgctattgctgtgtgtggatttgccctgactatgtacaaaccactgccttatgggatccctaaactctaatttcaagggaagatttgagagacagattatttcccttccctggtggccatcatctctcccctcctctctaccattccagccttctaaagtaaggcagaacataccatctggatgcctttttgctcctgagtgtaaagacttcattccttctgtagcctccccagcatgcgtctgaagttttggtttgcttgttgtttgtctgtgatagtattttctgatagaagctaaaatcctggttgatgtcacagaaaattattggtttattataccgttagtaatcattttagtttctcaaaaaatcatttgtttaatttctatgttaaactctgacactttcttagctcaagttaaggcaatctgcattcattacagtcattcatttatttgaatggttgcaaccactttgaagtttccataaatttgtaagaatttttcaatggagacatagtgaaactcaggtgagattttcctcatgataatggttataatcaaaacatatggtatttaaaaataagaaataatgatattttataaaatattcataatcataaccctctttttttttaaatggctgattggtttcaaaaattacctactctcttcagctcagcaactacacttgctcagctgggagttacgagactatacagttgtttgtggctggcactcctttctgatcagctgatctgtgtagctggatggccatggagtgtcacttgttaaatatttttaatatccacccctgagtggacataaatcaggccttttcaaactgaatacttgtaaagtctagcttttctttggtagttataacttaaccactgtaaggtatgttgagctgcatatgttcttcacctcagtgccttttagcccacctctctaagggcttagctgtctctgctgtgcaaccagtactacatagaaaggtaacacaccatcaaggaagtagcagactagatagaagacagaaacatgaacacatatgtagttataaagagtgatgcatgtcggctgggtgcggtggctcatgcctgtaatactagcactttgggaggccaaggcgggtggatcacaaggtcaggagttcaagaccagcctggccaacatggtgaatccccatctctactaaaaatataaaaattccccgggcgcagtggcaggtgcctgtattcccagctgctccagaggctgaggcagcagaattgcttgaacccggtgggtggaggttgcagtgagctaagatcgcgccactgcactccagcctgggtgacagagcgagactccgtctcaacaacaacaacaaaaaaggagtgatgcatctcacacaaaatagcatcagacatttgctagggagtggggatatgagggtatggtaagtttgcataaacttactgggctaggcccagtgcggtggctcacgcctgtaatcccagcactttgggagcccgaggcgggcggatcacgaggtcaggagatcgagaccatcctggttaaccgggtaaaaccccgtctctactaaaaatacaaaaaattagccgggcgtggtggtgggcacctatagtcccagctactcaggaggctgaggcaggagaatggcgtgaacccgggaggcttgcagtgagcggagattgcgccactgcactccagcctgggcgacagagcgagactctgtctcaaaaaaaaaaaaaaaaagaaaaaagaaaacggaaactgtgacagtgatgtggagaattgaggtggagggagggaaacaaggccaagtttggaatgtagaagaccatttggtacgctgtgacaataatccacatgaaacagaatgagatccaaattaaggcagtgtcatggaaacaaatatggaagacattttccatcctgaatcaattgaacttcatggctgatggaatgggacggtgacaaggaaggagactaagatggctccccaggttctggctaatgtgattaggtagatgatggtattatactgtgataatgagaggaggaccaaatttgcctgggggttggcttggaggaagaaagagatttatcttcccccatgaagcctttcctgattgacccagccagaaagactgtcttcctcttgagggatctgaaagctctgagagattatatcatatccaaaataatacaacaaaaatctaatggcaaaattgaaaagtggtgtaagactttcagcctcttctttgtgctagaaactgtctcgttactaatgtgtcaaggacagtgggatatccagactcctgggtgtgaacaagtggctccattgtctgtattgaatttaaaaacaactaaaagttgatttcctttttttttttttgacacagattttcgctcttgttgcccaggctggagtgcaatggcacgatctcagctcaccgcaacctccgcctcctgggttcaagctattctcctgcctcagcctcctgagtagctgggattacaggcatgcgccaccatacccagctaattttgtattttttaatagagacagggtttctccatgttggttaggctggtctcaaactcccgacctctggtgatccgcccgccctggcctcccaaagtgctgggattacaggcatgagtcaccacgcccggccggtttccttttaattatcaccacatactagcaaacatgaacaatgtcagaggtgaaatatttacccttcaaaatatttttggtctaagttctaaatactatggttactgttgagttttatgatatatatgtaaacttcaaattagcacatttgtagtatatatcatttgacaaacattgcattctacttgcaagttaactcagagaacttcccagttatacagctggccttggacatataccattcagctacttgtgttcattttgatagcaaatttataaagtccaggatcactccagtttcctccaaggacactttgtgtcctcatctctgtggtactacatactccagcctttcaacattcaattttaaataaacaataataccacagagaatgctgagacaaagaagcagaacaggagctgtttcatttttgtcatttggtgcaaacttcttgaatttttatttgtgtttaaaatttaaaacagtgaaaaggatacaaactgtgatatataaaatcttcggcttggcaactttatttcatgcataaaatgttagattgattaatatttttacaattgaaatttttttaatgttgttttaaaactaactttagaaaataaaactttagtgttacaatttagtagttacctaaattgtatctttgcagaatttcagttttaatacaatccatttattagttattggacaactatttacataaactattatatcagactataactaaagaatcaaagttcatactgtttaggtggatataaaaatgattgaataaatacctgtgcatttttctttttttgtattttaatttttttaaaacattttttcatttgtatggttttatacatgaagttcagcacaagaaaatattcattgtctatatttcttttctggccattttattacttgttttatctcatgattatttctgaaaatatttttatgtatagagaaaggggttgctcaaatgatgtactctagacctaaaataaaatatcatcggtaccacctgatcgtggaatatatataccactagtggttttgataaaaattttaaacatgaaagaatttctaaacctatagtgacttaacaagggatatttcattatataagagcctgggggggagtagaagtttttattctttgtttgttggtttgttttttgagatggactctcgctctgtcacccaggctggagtgcagtggcgcgatctaggctcattggaagctccgcctcgcgggttcacgccattctcctgcctcagtctgccgagcagctgggactacaggctcccgccaccacgcccggctaattttttgttttgtatttttagtagagacggggtttcaccgtgttagccgggatggtctctatctcctgacctcgtgatccactcgcctcggcctcccaaagtgctgggaccacaggcgtgagccaccgtgcccggccagaagtttttattcttttactgcatgtatttattttaatcatttttagcattgaaaatttcctgtcatcagatatgaatgcttgagaaaaacagcagagataataagagcaggaataaaaataactgatggttccggctacttgggaggctgaggcaggagaatcgcttgaacccggggatggaggttgcagtgaaccgagatcgctccattgcactccagcctgggcaacaagagcaaaactccgtctcaaaaaatacataaataaaaaatgaaatcaaataactgataattggaagttgagtaacagccaaaagcaactgtgatagttattcctcttcgggaaatatttatttgataagacaaacttttgggggatagctttgtgtgtcctaagtatcataagatggatatgcataattcagaacaggcagaaaaggggtgttaacaagcttgtcagatggacaattagaattgtgctatttgtcggccaggccggtggctcactcctgtaatcccagcactttgtgaggcagaggcgggtggatcacctgaggtcaggagttcgagatcagcctggctaacatggcgaaaccccgtccctactaaaaatacaaaaattagccgggcgtggttgtgggtgcctgtaatcccagccaccggggaggctgaggcaggagaatcgcttgaacctgggaggcggaggctgcagtgagccgaaattgcatcactgtactccagcctgggcaacaagagcgagacttcatctcaaaaaaaataaattaattaaaaaaaatagaattgtgctatttgtctcagtgtgtcatttttacactacaaacatcagtgttagcctctgagagataggaggtattataataccttgtttgtgcacagagggagtactcttgatttctaatgcctgcttgcaagcctacattcatcatcggttcattcctccattcaagaaaaattcctgtgccagtcagtgtggttgtcaatgatcattatcctgctgataagaatatttaggaactgcaatgtttccataatcctattgtgaatcagtgatgccaccaacacaaaaagctagctcttttctccacccctaacccactttgcgcactgctccggagcatacagtcacaaaagacagaacttgaagtgatgtctaattgtgccactaacatcaagtgatagccctatggctaaatagaaaggtaatatattgtgataggaatagaaattgcaggctagaagtggtttcgtagtttcagtcacacattaaggaaggtgaagttgtgtgtgtttgtgtggtcaggggatggtgagttagaactttcctacttttacagttcaatcctttcatcttattttgaagaaactgaggaccagcaaaactgggggactatcaaattcgctcaatgtgttagcatttgaaacagacatgttcaaatgaatagtctcatttgtagctatttccgtgccctttataaatatccccccaaaattaggcattgtattttctcatggtggataagcaaagtttaaactcctgcctaatgcttattccatttgttctgaaacaaccagtggtctccatatcactaagtcagaaaaccatgatccagttgtgtatcaatgatctaaatctatcatgagattcctggtccctaagacttttccgttccatttcctcactcttaaaatacctcctctgtcccatgcactgctctgattgccaaagggctactcattcaccaaggttcagctcaagtatagcctttccatgaagctttgccccggctgaagttaaccttctgcagacccatgcaaagttgtttgtatctttttttttttttttgagacagagtcttactgtgttgcccaggctggagtgcagtggcatgatctcagctcactggaacctccagttcctgggttcaagcaattctcctgcctcagcctcttgagtagctgggattacaggcacgcaccaccacacctggctaatttttgtatttttagtaaagacggtgtttcaccatgttggtcaggctggtcttaaactcctgacctcaggtgatccacctccctcggcctcccaaagtgctgggattacaggcgtgagccaccatgcccggccttgtttgtacctctttacagtgttatataacactctcccaattgccattcatttttatttcccattagaaggcaagctccacaaatgcagacatcctatctgatttattcctaggcttcctaacaaccagcatgcaacgtccctcaaggcttgctttcagctcagtaaactgaaagaaataaagactggtatatagtaaattgattctagaaaagtgtctagaaggtaaattgattctggccaggtgtggtggctcaagcctgtaatcccagcactttgggaggccgagatgagctgatcacctcaggttgggagttcaagaccagcctgaccaacataaagaaatcccgtctttactaaaaatacaaaatcagctgggcgtggtggtgggcgcctgtaatcccagttacccgggaggctgaggcaggagaatcgcttaaacccgggaggcagaggttacggtgagccgagatcatgccattgcattccagcctgtgcaacaagagtgaaactcttgtctcaaaaaaaaaaaaaaaaaaaaaaaagaaaggtgccctctttgttagatactcctggggcttaccaattaaatggtaaactctttgagggtaaaagatctttgtctataaccatctcattgttttttataattctagcacagacttagaggctccataaaccattattgacttatccaagaaaatgaaaagggaagttaggaggctgagggagtctattaacttcagggagaggaacggacttctggaaacaagagtttcacttgacctttctgcctctggccttcttactttttttgtcctaagtctaaccacattcaggtacacttccttttggtaaaatattttaccctttctcttcatttttttgaaaacctcatccttataacttacctttcagtttggtttcattttagttctaaacttttggaagcaactgaattaagaagtcttaaagtgaacttgcttgaggtctcaaagcaattataaataaataaatattaagaggttctaaaagttgtctgcaggtcctttttctcactctgattcctggaaactcaatcaggtttctattattctgagcagagattcatgagatgtgagcaggaagggtttttaagtaggatgtgagtgaaaggtgtattaggtgtgaggaaatagataaaatgagaatatttatgctggcaagggtgtagaaataaggtgaaaccttgttctggatagacatgtatgagaaactcagggtcaaaatttgctccttggttcaacatctgacaagctgtgtgatcacaggcaaggcctttagctgtctttgtatttaaaagagagttttggctatcatctctgttacacttatgtcattctaatgtatgatactgtacatctattcagaagaatgcatgaaaatgagtgaaataaataaatgaaggagatgaactagacattgctaagagagacggtagttcaaaacatagaaagaaaggctaagaaagaactgtaagagtggagaaaaaaataatttaaaagaaaatacttttaggatcacgtgcttagccttaactttactggaaaataaaaaaatacaaatcaacaccaagtgcataactaaaaggaaatgagaaacaagccattggaaactggagtaaaggccattcttgtcatacagttgctaagaacttggtggaaatgtatctatgtcttaggactttacggaaagcagaaattaagagcaataattcaggatatctggtggaagaaatatctaagccgcaaagcatttaggctgctgtgtggctacttttaactgcatacagtaagaggcaggagggaaaaaaatgacttaaaaatggaatttataattaaaagagaagcagaatagaaagatttggaaaattcactgcctagccatataaaaagtgaaaaggcatgaatgggagaaaatactaagggtgtggcctagtgaccattgttaaagagattaatatggatagaagggagtgaagtactattcaagaagttgagaaaaaggccctgaaggcatttcaaagcctttgaggctgcccctcccatcataggctcagagctcagagggcaaattgatttcaggggaaactagaatgccctttacaggcttgctgcccagatctgcctcaggtttctgttctctgaattccagcacagtgctccttagctgctccagccatggctcaagtgagcccaggtgcagttcaacccaccactccataaggtgcaattggtaagccttggtggcacccacttgctaagtgtgcaggctagcagaatgcaagaggtgtggaacacaacttcctccatgtagatttcaaaggatgttgtggacagcctgagggcccaggaagagtccactcccatgtcagtgcctagtagagccatgggagtggactgccactgagaccccagaactgtggagctattagcctgaagcattagcctgggagagctgcaggtaggagtctccaacttgtgagtgctgaagcatcaaccaagcccagcaatgccattttatttctctgttgggttttggacttacttaggaactgttactttctcatttttgcctatttctcccttttggaatgggaatatctatcttatatctgtcctaccactatattttggaagtagataacttgttttgatttacatgatcatagttggagggaatttgcttcataatgaatcgtgccttgaatcttacccatatctggtttagataagactctgaatttagtgttttgaattgattctgcaataaattaaaacttttggggctattgagatggaatgaatgtattttgtatgtgaaaagaacatgagttttgggggaccaggggcagaatgctatggtttgaatgccccctccaaaattcatgttgaaattttattgctattgtaacagttttgtgaggtggaacctttaagagatcagaggttatgaatgtattaatgcccttattgtaggaatggattcgttatcacgggagtaggcacctgataaaaggataaattttggcccccatttttctctgtcttgtgtgctcccttccactttctgctttctgccatgagataatgcagcacaaaggcctttgctagatgctggcaccatgctcttggacttcccagcctacagagccatgagccaaataaaacttctgtgattcaaaaattatccaatctcaggtattctgttatactagcagaaaacagactaagacagtgtctcatgtgtccgtgtgtagagaccaccaaacaggctttgtgtgagcaacaaggctgtttatttcaccttgcaggcgggctgagtccaaaaagagagtcagcaaatgatggtgagattatcattagtacttataggttttgggataggcagtggagttaagagcaatgttttgggggcagggggtggatctcacaaaatacattctcaagggtggggagaattacaaagaaacttcttaagggtgggggagattacaaagtacattgatcagttagggtggggaagaaacaaatcacaatggtggaatgtcatcagttaaggctattttcacttcttttgtggatcttcagttgcttcaggccatctggatgtatacgtgcaggtcacagggtatatgatggcttagcttgggctcaaaggcctgacagacagaggattaaatgatttatttcattttttaaacatatttattatatgcctaatatgtatgagacattctgctagtaaggcttaattactagaaattggggggttgtttttgaaaattaccaaataatgcttgagaactattgaagtcacatatatatggtacttccagaagaacatatttgattttagttttgtttttatcttttagggaaagaatcatgtgatgtacagctttatataaagagacaatctgaacactccatcttagcaggagatccctttgaactagaatgccctgtgaaatactgtgctaacaggcctcatgtgacttggtgcaagctcaatggaacaacatgtgtaaaacttgaagatagacaaacaagttggaaggaagagaagaacatttcatttttcattctacattttgaaccagtgcttcctaatgacaatgggtcataccgctgttctgcaaattttcagtctaatctcattgaaagccactcaacaactctttatgtgacaggtgagttctcaacacctagaccatctgatatttttcttataatgtttccaggaagaggggggttcagtttctcaagtgattatgttagaaagccaactcctatagcacatctgaaatctgctacacctcacagattgttatgtgccagtgtgtacatatgtgtgtgtatgtgtgcgtttgaggtgagtgagatagaggagagtagagaaatagatagtaaaagttattgtttttgactttagggattataaaatttatttgataagtccaaaagtagaccactgaaatattgaaaaaattataaagtgaatacctatagttgcgaatagctctgtgattgcttgtccttctttgttgttttttttttctctttttcccatttttctcttctttacttttgttcattacaatttcttgaagttatgtttgtggtgcttaggcaattaaacacttcttaatagttcacagtttgtttagaggaaaaacagcaaacaactaactgacttcctagtgattttctgggaatattcagagcttcatctctcttccctgttccccgaaagaggcctttaatatgctttgacaactgaggaaggacagatagaagttaagcttggggaaaccaagctgaataaaacatgaaaaaatacatagggggggagtaggtaagagtaaaaaatacttggtttataaaaattttatagccaacatcatattcaatggtgaaaggcttagagctttccccctaagaacaggaacaagacatggatccttgcttttgccatttccatttaacattaaactgaaaattctagccagagcaaacaggcaagaacaagaaataaaagatatctaacttagaaaaaaagaagtaaaactttattcacagatggcatgaacttatgtgtagaaaaattcttaaaaatttgtttaaaactattaaagctaatacatgaatttagcaattccacatgatacaggatcaacacacaaaaatcagtgatatttctatacactagcaataaacaatccacaaagaaaattaaggaaacagttccatttacaatagcatcaaaatgaataaaatatttaagtacaaatttaaccaaagaggtataagagttgtacactgaacaaagaaagcatggctgaaagaaattcaagaatatgtaaataaatgcaaagacattctgtattcatggactgaaagatgtaatattgtaaagatagcaatattccccaaggtgatctacagattcaatgcagttccactaaaatcctaacagctttttgttgctattgcagaaataaaaaagctgatcctaaaattcacattgagttgcaacagacccagaattgccaaaacaatcttgaaaaagaacaaaactgaagctaagacttccctatttcaaaacttactacaaaatgacagttaaaaaaaaaaaaaaagaatagtattgtcatggatagacaaagagatcaatgtaaatagaattgagagtccagaataaactccatacatccgtagtcaattgatttttgataagggtaccaagattattcagtggggaaagaatagtctcaataaatggtgccaggataattggatattcatatgtaaaagaattaatttgaaccctcatctcactccatattttaagcaatcaaaataagtcagacatttaagtagaagagctaaaactataaaaactgcattatataaaacaataaaactctgatttcttaggagaaaacatagggataaatgtttctgatcttggatttagcagtgttttcttagctatgattacaaaagcataatcaacaataacaccaaaaatagataaattggacttcataaaaattaaacacttctgtgcatcaaaagatactaaaattcaacaacaaatagactggcaacctaattttaaaatgagcaaaggacttgaatagacatttcatcaaagaaaatatacaaatggccaataaacatatgaaaaaaatgctcaatgtcattagttactggagaaatgcaaatcaaagtcacagtgaaaacccacttcacacccatcgaatgactagaataaaaaaaaaaaacacagaaaataataagtgttagcaaggatgtgaagaaatagaaaccctatccattgctgaggagaatgtaaaatggtgcagtcactttagaaagtggtctaacagttcctcaaaatcaaaagataaaacctacttgtcacagtacccagtaattctattcctaggtaaatactcaaatgaaattaaaatatatgttcacacaaaaccttgttcctgaatgtttatcacagcactattcacaatagccaaaaggtagaaacaacctaaatgttcagctgatgaatggataaaggaaatgtagtttatccacacacggaatattattcagtcatgaaaaggaatgaagtactaatgtatgctacaacattgatgaacctcagaagcattacgctaagtaaaagaagaaaaaggttacatacaatgtgattctgattatatgaaatatccaaaataggcaaatccatagagacagaaagtagcttggtggttgccaggggctgaggaaataaagaatgtgacatgactactaaataggtagagggcttccttttggggtgataaatatgttctgaatctagatcgtagtcacgtttgcaaaacattgtgagtatcttacatgccatttaattgtacattttaaatgattaaattggtaacttttatgttatatgtattttaccacaataaaaatatatttggatcaaagaagagtgccctttaattataagaaataatgtggagtttcttttgttgctcataaattgacccttaaagttactgggaaggagaaatttcaaaagagggttattgcaatagcagcatggctgaactctggatgcaacctcgtacagtttagttcctttatggacatcattcacttgaatgcatacattttacaactgatctttttaaaattaatttgttactttatatgcttacttttgagtgtctttcaactcccttaaagtagcccagtgaaggaatccattgaaattcttttaaaatgctttaggttagtttaaaatttcttacagcagcaccatgaaaaaatgcatagcagtttagcagtagctacaaccctcaattatgaaatatagaagaaatcgatggcagagttagggactctgcttttgcaaatatagcgtgaagctcggtgctagttacttgtgaccatccatgcactggcttataaacctcttcaggatggaagctgtgtcttaaacatctttgctctgtatgatggatggcagggtacctggcacatggtaggggctcactaaatatttctttgtaaatgaattaaagaacatagtatatgcaaagcacaaaaattgtcttcatcaacctggagaaggctatattaaggatgtatggaatgaacactttctggaaagaattgcattattaattcacattaatgagacaaaatattgaatttttaacaaatactattttttaaacaggtaaaataaattacaaaaataaggaaaatctgcaaaatattaattctagaatgatatatactattgaataaataagtgctattaactaatttatataatatattaacataatgtataataaaattaaattttgaggcattgagtccaccttccttggaagagaagccttgtgtaattcagtctttctttatgggaactaatctacttctatacgagacatgaatttagccaaggtcagatgaaaggtcagaagttaataattaattgtgatacaaaagtctgttacacaaaagtagcattgcaatttctgctctatcccatatttgggtcattcatgatgactaaagataatctgtagtttgtaaagtgcataaaggtgcctgttctagggatcaagttggggctgagattaggatcaacaatctatctattttgtggaggaaagaacccaactttaggggaaagggaataacattccctcctaaatcctgtgccttggggggttttatggaacaaagtatgtgaagtatgaagtggtgaaagagaaagtctaagagctaaataggagacatgaagggccttgtcagtttctttttgaacatttctactctcttagtttcctactcacctatccttcctatcactcccttccttatcagtttgttaattaatgctcttgatcctcatggaaaatcccagagaattttctttggcttcctactcttgtctctccacaacattccactctgtgatgtgtttcctccaattgcttctataagcatctcgcaccatcattatcttccttctaaataattccaattaattctatgattggactctttgtctttagtatttccccattttggtcaatttcagccaaatacacttaaattacctcatacacttccttcataacaacactctcttgcatagcatccccagtggtcacaatattgggctcatctttgttaaccagcattcaaagtcttccacagtttgatcccaccacctttctagattgtttctggattccatatacagcctctcaattgcagcctgacggccttacttgccataaccacatctccatcattgccctgtgtatgctgctcttgccacttgtagagcacccattcatctgtctccacctatggaaattctacccctcctttcaatctcagctaattttccaagttcttaaggaagcttttcatgatcacctgaggggaagggatcactcctttttaccaatttttatgccatttaagtctgtgcctctcatttatcatttcctttcactgtagtaatgtgtggaaatgtcttttaggtcccatgaaagattataatgtcctggaaggctggaatttgtgtaatatttcttttttttttttcttttaacttccttcacaaaaggtaaattgtttaggaattaactttaatttaaactctgtgtggatttaaaactaatttaatctaggtgtgcatttttctttagtgaagtggtgaaaacaaaaataacagggagggtcaaagaaaaattccttttccttctgaacctgaaagtgctcagtgaactaagtataaggtgaggagaaaaatatattttggaaatatgtttaaggaccatgcttttcataaagaaattttggaggtctgataaaaaatattttattttttcctgtgaaatatatttccgaagtgattttggacattttcttgtttttataagtgactttcttttgctgtttatgttcaagttaaaagttcatgtaagaacaggactgtgacagagttggggcttggatgctcttgggaaagcactattctcccagaatgaagaaaagcaccttgcacaacaagccaaagtcctaggggaaaagttgacagagctggggaacagcccttgaaacatccattggcctgccacttcacccttcccaaacttcccttggtcagtttcagattaagaacttccccaaggctgggcgtggtggctcacatctgtaatcctagcactttgggaggccaagacgaacaaatcacttgaggtcaggagtttgagatcagcctggtcaacatggtgaaaccctatctctactaaaaatacaaaaaataaactgggcacggtgggaggcgcctgtaatcccaactactcaggaggctgaagcaggagaatcacttgaacccaggaggtggaggctgcagtgaaccgagattgcaccactgcactccagcctgggtgatagagcgagactccatctcaaaaaaaaaaaaaaaaaaaaagaagaagaaaaaaagaacttccccaaaatgtgatcattatctgtggcaggaaagtgggtgtggagtgagagggcaggaagtccttgtgggcttccaccctgatttggagcacctgctgaatgtgcctcttcttattccaggtgccagagatatcattgtgcagactatactgtgtccttatgcttaaggaatggggaagaggtgatcaaagcagacagacaaagattgcgttgtatttacagtctttcagtgagcttcaaaataagcccagatatttactttgtgtcaatgatcgtggggttgatgttccacaaattgtgcttactgatcttgagatagattgttggattctctggtagtgtgcaaacactggaatcctccccaaggctagctctggttttggacacgtgagagtacaccctcatcattttctcaatcaatttcagttatttaccttgtttctctatttcagaacaaactcaaaataagttagggggagttttgagtttgttctgaaatagagaaacagtttgttctgaattagttttatttgatcaaactaatcaagtaaaattaaggaaattaggtttttttggtggttaaagaaataacagaagttggatcttcttgatccagcagatctgtttgtattagggtatctgttgtagaaaccttagtccccattgctatccaagaccctcccccaggcagctgtttctggcactcctggcagtggtttggctgctcgctaacctaaacagcagctgcaacatcaatagacaacatttgttaccactctgaataaccaaaccactttttgtgcaacttcagttgcctctaatcatttttaccccaaacctaagcatctagccaaacaaaataacattataatataattaatagaattttttttttgtttgagatggagtcttactctgtcacccaggctgagtgcagtggtaccatctcggttcaccgaagtctccacctaccgagttcaagcgattctcctgtctcagcctcccatgtacctgggattacaggtgcataccacgcccagctaatttttgtatttttagtagagacggggtttcaccattttggccatgctggtctcgaactcctgatctcaagtgatccgcctacctcggcctcccaaagtgctgagattacaggtgtgagccaccaggccagaccttagaatatcttactccagtatttttcatactgtgttaactgtaacccaaaattaaaaaaaacaacaacaacaacaacaaccagatcttacatcacaacccataatgcacacaaatataaaaaagtttcataaggtcatacttaaccataagacagagtttctccattgacactttggtctggataatgttttgttgcactaagtgggggttgcatcctgtatagtgtagggtgtttagcagaatccccggcttctactcactggttgccagcctccctccccctaccttgttacagccaaaaatgtctccagacattgccacacatgttccctgcttgagaaccactgctctagtgtgtgtgatgcattctgatgatttctatcctcttctgtttcattttttaaaatgctatttgtgacatactaaattgtttcacaacctgctaatgagctgtgaacaactgcagacaaacagggcctcaatgcgtattaacattgatcaatagtaatgcgcattagctgtgtgccatgcagagcacttttaaggctatcaaaagtatttgatatttggagattctgataagttacgagacaaggaaaggacattgtgttgaagaaacttgaatttcctgttacaaacatgttggcttgagttcccattgccactcactagctatctgacttggagcaactcttgggacaaaataaagacaatggttttcctacttaagtgatgaatatgagagttagatactgtaaatagaaaggcttaatgaagtaccttctgacagttatcatgaagattgttctgtggaagattaactctatcagaataaagaatttctgcaaaagataaattatcgcagagccacgtctgctcagcaagaaagcaagaggtggctgagggcactgggattcttgaggaatgcctctgaaggggaaatggaggcattggcctgaaatctccttcactcaagttctgacaatgcagaggggtgccgctgatcccaatatatctcagatttcctaactctctttagcatttactaacattccagatgtaaaaagtgcctcagaacgaccctccaaggacgaaatggcaagcagaccctggctcctgtatcgtttacttcctttggggggattgcctctactcatcactacctgtttctgcctgttctgctgcctgagaaggcaccaaggtgggttctattttccctctgcccccagtaccacacatttggggccattcttatttctggggctaaaggatttttagtttcttcctgttgttttctttcccaatcctgtaaaccatggataatgatttcctagaagacaactcatatttgcgctaaaaagctaaataggttggttggggctcccttgagtcacgggagaggcatgctcaccacgcacagtattccagctagagttgtggcgagcatagcacattgctgagacttcatcattctctttgcatcaatcttaggtttgtgtgagaaagagctcttctaaaccttaacaggattggaagttgaaacaatctctcagatcaagatatctgctttattttgtattatcctcttttcacagccacaccacatcatgccaatcccacacacacccttatgtaactgaagaaccaatgtccccagagaaaattaatatgtctgtattttctattgccattataaacatatgcttgacctgaattcttacccaacaataatgcatatgaaaaatgtgggtttggctatgatgggaatggtgtgatattttgaaaataattcctttctacttttgcaagaactctctcaatgtcatgaccaaatatgttaagtaagagaggaaagcatagagaattctgatctagctttggcctgaactacttcagttttctctttcctttttcttctcctccatcctctcacattcctgttttcacaacaccagctacagtgtagctatagaaactgagctagatagagcaacacttattctgtgtgacacaggaataacctttgactgggcaaaagtgcttctggtattttggagtgagaacttctggagttcagaaccttctctggattctgaagaattctctcttaccccaattcttcatctgcaactccatggctctttctatggcctctctgtatctttcatcatctttcttgagactgctggaacctctctcagaacttcagaaaaggagtcagggataaatcttttgatttaccacatccaaagtgaactaggtagtaggagatcttggctacataggtgacaggacagcagcatttctggcattgagtatggaatgtccccagagcaaggacttccagtctcttccaagtgatatactagatccctccccttccttttagatatgccatggggctatgtggactgaaaagtgatgaaccagagagagagctggtcagtgtgaattatcacaaacaagtgtgtgctaggcaaagcaaattaacaagccaaaactaacaacactatccctggcattcaacaggataagcatgggtggcaaggtggtttacttctgctttctttactccttttgattacttctttttctttttgtcttccaggaaagcaaaatgaactctctgacacagcaggaagggaaattaacctggtaagcttgatgtagctgttgaaacaaatgcaatttgtgttatactgtgtttatttatttattcaatgaatttatataacaccatgtgccaggcattattctatgtactatatatatatatatatatatatatatatatatatatatatacatagacccatttttaaaaatgtgaattttgcattctgctctctatgcagcaaagactctttagggttaacaagtctcgtaataagtggttctttggaagttcatggaaggcagtctagatccaagacagaaaagtcagagactgaaccatacaaacttgactctgctcttgcctgttatgtggcttcaggctattcatttattttttatgtaaacaccttaaggtctttctggaagagagtagggagctgatgaaagaatgaacccacaaataacctcataaaatgattagatatcttcataaatagcaccagcaaaatagagacatgatctttggcttagttattacacagaggtccctggcaatgtgtatgggctcatcaaggaagggaccactcagactaaaggaagggaattttggagtcaatctttcctataaggtttggaatgtaaatgtaggcttttcttttgagttgaatgttgtggagatattagaactaaaaaagaatgcaagatgaggcaatatatttgtggaaaagcattctgaagctctctaattaaaactaaacagtcataaatgagatactgcaaaggaacttgatgtgtgtgtgtgtttcaataaggaggaatagtgataaagaagtagtaaccctcttaaaaattccacaaaagacaaaatcgatacagccaataattctatatataatattaaatggcattcaacattccccaccaagctgcttaattttaaaccagaccaaatacactcaacttgacaaacttctattaagttttcattagcatcagtaggcactgtgtagggtgctaaggctttgttccctcaaatagggaaattttcttaaatattattttctttctatagtaaataataataaaaatttcacttgattacaataaggccagggagctatgaaattatttaagataaaaatctaaataatttactgtgcaagtaaaacccaggttggttaagctgtggacattgttcttcctgggtaggctggataaattatgatttgaagcttaattcaaaagggtattttctgtatgtgcaattgtctgggaagtttgttttaaagcgtttttgctattaacaggaatttgaagatttttgccccatttcagttgtctagcatttcagaaaataatcaaaaggataccatattatacccttggggctaaatatttcttaacataaaactagtttgggaactgtggagaaatcaaagtacagaaaggaactggtataaacatgacaggaaaggaactggtacaaatgtaacaggtacatataaaagccaaagctctgatcttaatccaaaacggtcctttgagggtataaagtgcttgcctaataaaaaccactgaattgtacacttaaaagggtgaattttatggcatgtgaattacatctaaacatatactataaatacaaattttaaaatgctttgtatactgtaacctgccataggaatgtaaggtgggattgctgtttctggctttatcatctctatccaccacattgtggtgcattggccttgtggcacccagccactttgacggggtgccacagcaggggtgctgcagagcactatattttcttttgctccattcattttaacaaaatttttcatggaaatgagccatttcttgggatgagagacagggaacccaattgacaggcttaaacagattgaaaagtatcacaggatctttgttgatatattgaggactaaaggctatttttcagttcacttgacagtcttctttagtgtgccacctactgacctcaaccaggctcttttcagtggagttgggagtactttttatcttagccaagcagcctctgcctctttcagtcgctcagccttactgttatttttgggcagccaccacatcagagggtggcactgtatcaggaattcttacatagcttctcagggtaaagccagacatgcttgcatgatagagctctgccaaggaaatctgccatagacatcctactgcacacatcacaatgaggatgacaaaggaccagacaaagtatgttgactttcaaagacagtggacttgataccttaaaggagttaggccagatgtcaagaacggaaatcgatgggcaaaacttgaatttaaaaaactgaaatagcccctagaatgaacacatcttctttgtcaggtgaacctttgtataggtaggagcggctaataaataactgaagagtgagaaaacatcaggactaattttactttttgtttttacaaattcacctctttcttagaagctctaagatatttggctatatttgaaacggtaagaattttcttgccgggagtggtggctcacgtctataatcctcgcactttgggaggccgaggcgggcggatcacgaggtcaggagatcgagaccatcctggctaaaatggtgaaaccccgtctctactaaaaatacaaaaaaaaattagccgggcgaggtggcgggcgcctgtagtcccagctactcgggaggctgaggcaggagaatggcgtgaagccgggaggcggagcttgcggtgagccgagatcgcaccactgcactccagcctgggctataggcaagactccgtctcaaaaaaaaaaaaaaaaaagaagaattttcttttgataggaataacaactggaatactgttttggaactttttctaagctttatctttccaaaactgacatcaattttttaatttaaggtctcaaattataataatatatcttggctaactcataatatttattgtttctgccctcttagggggtatttgttctgctttatccttaatctttttattctaaactgcattaaatactattcatcatgttataaactgcctgaagttttcataggatattttttgctttttccatcaatttgggctatgctttttatcttgaagggggattaaaaaatgttctgtgacctcaaaagtgaccagtaataaagcacaaaataactatttaggggtgacatagtgattctcaagcctttcatcctttaataattgaaatttagctgaaagtgtagatgtcagcagagtatgtgaggaacagtagattatttctcacaatggacatgactccatttaagcttttcattcatagtttgctaatgaatatgcactaccatggccgtaagtgtcacttaaaaccatctttttttctattgtaggttgatgctcaccttaagagtgagcaaacagaagcaagcaccaggcaaaattcccaagtactgctatcagaaactggaatttatgataatgaccctgacctttgtttcaggatgcaggaagggtctgaagtttattctaatccatgcctggaagaaaacaaaccaggcattgtttatgcttccctgaaccattctgtcattggaccgaactcaagactggcaagaaatgtaaaagaagcaccaacagaatatgcatccatatgtgtgaggagttaagtctgtttctgactccaacagggaccattgaatgatcagcatgttgacatcattgtctgggctcaacaggatgtcaaataatatttctcaatttgagaatttttactttagaaatgttcatgttagtgcttgggtcttaagggtccataggataaatgattaaaatttctctcagaaacttatttgggagctttttatattatagccttgaataacaaaatctctccaaaactggttgacatcatgagtagcagaatagtagaacgtttaaacttagctacattttacccaatatacaaactcgatcttgcctttgaagctattggaaagacttgtagggaaaagaggtttgtgttacctgcatcagttcactacacactcttgaaaacaaaatgtcccaatttgactaaccaaccataaatacagtaatgattgtatatttcaagtcagtcttccaaaataagaaatttttgctgtgtcagtctaagaatggtgtttcttaaatgcaaaggagaaatcattttaggcttgatgtaagaaaatgaaaataataaatggtgcaataaaaatatagaatataccaattggatatagggtagatgttccacatacctggcaaacaaatgcttatatctactctgttagattgataagcaaatataggtattaatggagcagtcaacgtatagcacatttatgaggaaagtagagactcactgggtcacatagactaatggataggaatgtgacataatgctgctgaattaatatacttatgggcatctgaatagtttaaaagttagtcagaataggtatcactgggcaagtgaagatagcttaaactgcttcatgcttgacttgatagcaagttaaagtgcaattaatggaatggaggaaaacccagaatatttaattggtctgtaggggtcaatttgctttcattcaccacatctgcatcttgctgttcttcttactaaggaatcagggcaaatcatctgtagtgacatattttagtttgctaatcatttattttaaaatactgaggttgcagccacttaagagtatagcaaaagatggattcagatttttggactttccaaagtacttgagttaaactatttcaaaaatagcctataattttattcaacagtttgaggctattcgaattctcaggtgctgctactgaataatgtaatagtcttcatacaaagtggatagcaaaggttaaaatccatttcaacaaatatgtgagctgagctgctgcacaaaggaatgtgatgtgtgtgtgtgtgtgtgtgtgtgtgtgtgttaggtggggtgggtgacaacagaaatggtgcacgagaaactgatcaaattgacattatattttcagtttgcttatgaagctcaaaatactagagtaaatgggtcattaaagaaaataatatgtgaaattatggagtttagaatacaagtggggtatatatacaaaaagacaaaactgaggttttgtggtggagagattttcttaagtaacactggcattaagttttagctccttagatttgggggtgcaaatattcttttgagtcactgttattttgccaattacacctagaatttcaagcaaccaattcgagataggctgttttagccaggctgcatttgtggacaacttatgtaagaaagacatgttagaatagctgcttgtggtattcttaaaaatagaaacaggaaatatggggaggatacatttagctgtcctcttatcagatgaacacacgaaattgaacagttccttcatgattctctcaaacttaaaagcaaaatatttctgtcttatttaaaatatccttagtatgtcttatagtaaagataatgctgataatgatttcatctctaagatgtattaatatatttgtactgtttgccaaaatcacaaatcatttatgtttttattccttttcaaaatggtgtcagagacatacatgcattttcccaaatgactctacttcactattatttacatggcttatttcattagtttatagagggtttgagaaaaagaatatgtagataatttaatggtttttcacaaattttaagcttgtgattgtgctcaatgagaaggtaaagttattaaaacttatttgaaatc

SEQ ID NO: 750 - DNA, 70360 bp, Homo sapiens
gcggtgcaggcgcgcgcccaacggctttgcgaggctcactcggtctgagaggtcggaggctgcgagtgtcgctgctgaaggctgtggtggactgggctggatcgcggattttggattagataatagatttgggatcgcggattgggggttggatcgcggatttggggttggatcggggatttggggttggataggggatttggggctgggtcggcgggggcgtggggggaggtgaaaaggtaacagggagctgccccctctcaagagccggtagttgggagtctgagaagtcaccaccatgaagttgttcggcttcaggagccgcaggggccagacggtcctgggctccatagaccacctctacacgggttccgggtaccgaatccggtactcggaactgcagaagatccacaaggcagctgtcaagggcgacgctgcggagatggagcgctgtctggcgcgcaggagcggagaccttgacgccctggacaagcagcacaggtagcgagggctcagcccggggtggcagggggtccccaggtccggctttctggcagcccctgggacgggggccttggaggtcgccgggcaccctctgagcggcggagccaaacggaccctcagctgttttccatccctcataattccctggctggagcagttggtggagaatttgagtgatttaactcacaaagttaagcatatacggtgttgataattttaacgtacacgtttaaaacatggtttatatacattataggaggtgcctaatgagagaactcattcccctatcaaaaatgccgtgagttattttcagtaggcgaaaagttctcagataaaactgtccgttttacatccgtatccccctgtgtaggtaggttctttactgaaggttcttagagagaaacttggaagtgggaggtgggttctgtgttcttgaatgggaagacacattttcctcagaatgtgagctctttctgtgtttatcaattttacatagacagaatgaaaatatcaaggttttaacatttttgtatgacacctgctgtctttcactattgtgatgacatttaaaaaaatttcataatggagtgaaaaaacacttgctgctctagatatcaaaatgtgctattaatttctacaattaattgtttactaacagctgaaaagacaaacgcatagaacagaataggcaacccagaaacactgaaattatgtaagatatacgtaaggattaatgagtaggaaaggatgaattattaatgaaaaaatgtctgctgtttgaagaaaactaatgaaattttatgtcacaaacatgagttcctgatggaatacagattgaaatttttacatatgaaaatgagtaaagtaccggaagaaaacacaaacgcttattttacaggtacactttatgttcacaaaagccttcctaagaatgacctcataagaagacattctgaaggttgatttagcaaactaaaaattaaaactgcctgtgtttcagaaaaaaaaataacaaaagagagcttacttgaaaaatattaactatattatatatatatatattcagatgaaaagtgtgttttcattttagagggaattcattatattctttttctttttttttttttttttttgagtgagagtctcacttctttgcccaggctggtgtccaatggcacagtcttggctcactgcaacctctgcctcccgggttcaagcaattctcctcgctcagcctcccaagtagctggggttacaggcaggtgccagcatgcctggctaatttttctatttttagtagcgaggggtttcaccatgttggccaggctgatcttgaactcctgagctcaagtgatctgcctgcctcggcctcccaaagtgcttggattacagacatgagctaccatgcccagcctatattgtttattatatatcatatgatatatatatattgctgatacatataccatatatattattacagatataatctgttatatatatatcagttatatatacacattagatgaaaagttgtatgtatatatacacattagatgaaaagtacattttcattttacagggaattctttcaaatcaaatcatcaaaaactctaaaatgggcaaagtacttttttccagatctgcaagttatttgtgtacatagcaaaaagtccttcgcatttctggtataagaatttaaattaaaggaggaatgaaagttttctatccacaatatttgcgaggacgttttgtactcctgcttaaagtttaagttgctgattacttttcaaatagataatttggtggtaagtactacatttaaaaaatatgtatgctctttacccatcaattccattatactaaaacacccttaggaaataaagatacatgcactttatttttcacagcacttattttaaaaagaacccatagaatggatcctataaataaatttcagttgcatccataggatggaataatatgtgaccattgaaggtggcaatagatacagaagtatattgatgtgcgaagatgtattttgttatagctagtgaggaaaaaaaatcaattaaattatacatacacacaaacatactatggtcttgttttagcaaaaaatatgtacaaaatataaaatttgtaatttctgagcatttgtattttaagtaaagttcctttttcttacctgtgattgctgcagtgaacatgtacaaaacttctagtaaagtttattaataaaggaataatcctcgggaagagaggaatatgaatcttacagtattaaaaataatttctcactttctattttttatcattattgtgtgtattgttatcttctttgaacttttagcctcttcagaagtaaaaagggaatgtttttatctgtttccagattttattatctatatattttatatgtacatatgtttttcttatatattcattcaatttatgcaaacaatgatagattatttcattttaattgtattctttaaaaataaaaataacataaataattactattgcaaaaatattgctttataggagttatttaaaaatattgaactccccaactgtatttatccattctttcattccatttattcatcaaacataacctgagtacctgttatgtagcagacatattctactatctctcaggacccttctatccttaaaaacttcatgtttacctgccctgcctgcacaagttgagagatttaaaataggaatattgggacttaatctccttgaaactttgtctcccacctttcaaacaaaagcatttctgaagttagaaaatagtagaagataacctttaactgcccattcaaaagtttatcagtcttaaatactaatattaatcattggaaagtcttatttgcatatattctgtaagtataaatattgaataaaatgagccatatgtattcatttgaatcatgagtttcctttggcttcagtttgtttgaaaatcaaggaattaatttgtttaaaaaatgcattattgttatttcagtgctctatccccatagtacctttaagaactaaaatgtatttacatgccagttgtatgcctagaactgccctagacctgctgagtataccatattctacttaatgtaaggtctcatggattgtgtgatgccccgctattttatatatcaataagataatttttaaaatgctaccaattatagttataataatatgtgtcattccaatgtcagaagtattaaaatgtgacctactctttaagccatcctgcaaagtaggtataattgtatcttttacctaattaaaatgtttttgttaagtagtagtaatagtaacaattataatatctggctgggtgcagtggctcacacctgtaatcccagaattttgggaggctgaggtgagaggattgcttgatgccaggagtttgagaccatcctgggcaacaaagtgagattcttactctacaaaaatttttaaataaatagctgggcatgctggtgcacatctgtagtgccagctactcaggaggctggggatggaagatcgcttgagcctaggagttccaggctgcattgagctatagttacatcattgcactccagcctgggcaaaagagtgagacttagtctcaaaaaataaaaatcttacaattattgagttattgtaggaactattctaaatacatagcttctcatttaagcatcatgatggtgtcctatgagatagctactattgtcctctttcttaatgaggaagttgagacacagaaaggctaagcaatagttggtaagtgacagggtttaaagaaggactcaagccctagttgaactgaatccaaagactgagctgtttctattcaaataggctgctgttttcattaaggcagtgagcaataagagctagtaaatattgtactttcttcaaaaaaattaagtgtttgttttgaaggcagaggaaaaacatgctattcagtttttaattacatgaatgattgtatgttttgagatgttgcactacagtttcctaaaaagtcctgttactctcgtagaactgctctacatttggcctgtgccagtggccatgtgaaagtggtcactctcctggttaacagaaaatgccagattgatatctatgacaaagaaaatagaacgcctttgatacaggtatattagagccaactcttttagcatgacatggatttgatttgcatatatagaattaaaataaattgatctcatttaaatataactagttggtgaaacctgtggaatgtgtattttgaattcttggaatttacattctgtttcttggtctaacacggacaggctgtccattgccaggaagaggcttgtgccgttattctgctggaacatggtgccaatccaaaccttaaggatatctacggcaacactgctctccattatgctgtgtatagtgagagcacctcactggcagaaaaactgcttttccatggtgaaaatattgaagcactggacaaggtatagatcaatcaactttctttccaaaatatttgttttaacattgacataggtaagggtcaattttttatatttggaagctcaaccattccctgaatgcaaatgcaaataattttgaaataattgtctaagattttattttaaatattgatacttttaaaggagcattaaagggtacagctttataaaacgcactttggaaaatatttgtgaatttgttaaaggtaaaaccttttcaactttttttctatgcagggttatctttcctttttttccccgtaattagcgtaaaacaacacaggaaagaaaatatgccctggaaataggctttatcttaaaactcaaacaaaactaaagcaacttacaataagtggacatgttgctgctgctgataattttctgaaaaactgatgtatcatctctcagtggcacaaggcttaagagggaaaaatgggaagggaaaaggagagcaatcagaaatatgcaggtcacttggaaattaggtaatgagggaaaatgctatgaagagttttttttttctcttagtttgttgttgttccagtttatgtgttgagacaaggcactccttagctttgggtctaataattttttgtttgaaaatgagagtgagttgaaactcgcctagagatgaattttaggaagactttgaggaaaccagattggcagtgaatatgtggtggtgaagtgagaaacacttcagcagaaggtggaacaaattattaactgacttattgcccatcctggcagaaacagccacttagataagagtctaaagactcctctcaaacctagaatgtcttggtgggaaggtgggagataaggagcttgtaaatagcaaaatcaagtgggattttgagtttacttgtttgtgttctacccatacccaggaaacttaactggagctttaataaatgacactatctcttactcttttctctttttggccacatgtccaactgataaagggaactagccatgcgggtgagagatgagactgaagtgattgctgcactaattctcagaattgtgcattacagtgacctgaggacattttgttaaaaatctacaaatgtaggctttcccctgaggattttgatgtaatagaccttataaggcctgaacatttttaaaaacattttcttgaagctgggcacagtgacatgttcctgtagtcccaggttgagcctgagtttaagttcagcttgagcaacatagtgagactcttgcctctaacaacaataacaccaaaaaaaacaaaaaacaaaaaacaaaaaaaaaaactctcaagtttcggatacactcctgattaagaaccccagaacagataagtgcaacatataatttctgtatctcaaaaacgtaagaaatctctagaagaattggcgtttgataggtgctacttccttcgaagttctccttttcagtaatattagcctgacttatctgtctttctctacatcagtgactaggaagtgaaaggaaatattactggtaatatctctcagcttacagaataacacctttccttcccaacattaatcattcactgacattcagagagtttttagaaatttgcttatgggtaatctttcaataagtagaggctgaccctttcatgatttgatgtccctttgtcaccatgcacgtgattacgtgtcaacaaatgttcattacaagttgggctttctcaattagaatagtagcaaatcctgaactattttttttagttgaagttgtattatgaactagctcagtatgtttgttaagtttatagagctttagcataaccaaaatgtcagttttaaacactgaagtccatggagttaataaaaatacagatatgaattcttttaataatttagttttagcagtcctatgaaccaattatctatttggttaacaatctgggaaaattatatacaaatatattttaaatgaataaatgttggaaaaattcttgaagcaggtattatgagtctttttaagcaatttttattatatatgagagcctgagtttttggtaaaacatatgatactagagaaagaaaatattttacatgcaaatacttggattatacacaaccatttagtaacacattaatagcgaatataaaaacacaagggctctattctaatgtggtacacagatttgtttgtttgcctctataagttgaatcaacatgtaaaatttagaagactggtgtagaaatctggacttcaggcttattctaaaaaatcaaatctggtgtcccctgagtttctatcactgtttggtctgctgtgcagaggttgcccctttagagaaggcgtgtattctccagtttgctgctgtgcccaccttagtacttcctttactcaggcaaccttcctttgtgcttgtaagtatttgagtttacaactcctatcttatagtatattttgataaagatttcaaggtttttaagtcagcgtgtatttgttataatatatagtctatagagtatataaatccctcagttatgaagttgaattttggaatttagaagtttttgaaactcttttctttatatataccacaaataattatctgcccctaagaatgcctagaagactttttaggttattcctggttatagttggataatttatgaatattgcagacattacatctttctcctcagcgctcttccttagaaatgcaagtgacttactggcttttattatgccagaaataattcatatggatcagtatgagaacttttattgataggccattatgtttttatttctgatttatattttgtctaaaataaaaaataattttaagtagccctttaagtggaagccaataaaaatggatttaaaaagtagagctgccctggagtcccgggattaccattataattgagaatagtatttcttactgagttttggttttttaaatatttgttcttaagttttttaaacctatttctcttacacagaacatactgagctttctaacagtaaagataaaaatctattctcttgtattagggaaaaaacccatggactatctaataataaggaaaataagtgcatttgaagccaatctctcttaattcaaagctcatttccatagtgacccatttggagcaggagtgcctgacattgacatctgggatcctgacaccattgatagaagtgaatcaagcaagtttgtgccacccagaagaaacctccacctgcattgggaagctctggcaactgtacccctaaaactcttaattcctcaaatgttaatgtttgccacaaatagtattgtcaaatggggattaggtacaattcaagagatttcttgattattggacataacatacagttttataatacttctcaaatgcagatggtcatggagtccttctcttggggtataatacttctggtaaagcaaatattctttggaatatagtttaagaaacactgctttagtgagaataatttagatcattaatttatgtaaaaaacttaaaatgtttgctactatgtcttagggttttgggggtatagagacaaaagatacagaccttgcctcaagaagctcttggtttcagtgggacacagtgaaatgattacaatgtaccatgctaagtgctgtgatcaaagcaaggattcttgggactggtaaatgtctaaagtgagttttggcaatgaccacagttaatccggggagacagaggaggattgtttgcaaggcaaagagcagcacatcagaaagcacagagtgagaaggaagggactgcttttcttttacttcctttctatattgtatgttgaagttcaaagcaccttagagaagattttcagttcagttgagaaatatgtaattttctgaattactaattttttctgctgttttataggacagtaataccccacttttattcgctataatttgcaagaaagagaaaatggtggaatttttattgaaaaacaaagcaagtacacatgccgttgataggctgagatggtacagtagttctttttttttttaaataaaaactgtgtattctagagtggtaacagtcactgaagtcagaaatattaataagaagattaacgtaattattggcatatagtgaaaaatatcaccatgaataatcagatagatcagcaaatatttggactgagtaacataaagaacagtatatagtaggattcatcttctcctaaatatagagtgtttgttatttataattggatgtttttggtactgtaatcttgtattagctaaagggttttgtattagctttattaagtttttttggagatgcaatctggctctgttgccaggctggagtacagtggtgtgatggctcactgcaacctccacctctcaggctcaagtgattctcctgcctcagccttccaagtagctggggctacaggtgcacgccgccatgcccagctaatttttgtatttttagtagagatgggatttcaccatgttggccaggatggtctcgatctcttgacctcgtgatctgctctccttggctcctcaaagtgctgggattacaggcatgagccactgcacctggccagttttattaatttttaaagtgtggacttttagtttatgactactagcattgtcattattattattgttgttgttgttgttgttgttttcagcctgcagatagctcttatctgacccctagctgatttgaattatatatcagactaggaaagcaatggcgaaatcttcatctaaatctttacctactttagataagtgacctcagcacagtttcttggccatcaaaggactatgagttagcaacttgtattatgtcataccccagtgggacaagaggcttccttgttgtccttttctttcagccttggtgataatttacaaagatgaacacttgagcaccctagatgcttatagacccaagctagtacatgcaaaatgttattatgtctacactgacaggtggatattaaattggtaaagtgtatcaaactagctgtttaaaaaagtctctattaaagttcttgagtggagtgatttctttgttattttagaacagccctcatgcttgctgtgcactatgactcactgggtattgtcaacatccttcttaagcaaagtattaatgtctttactcaagacatgtgtggacgagatgcagaagattacgctatttcttgccgtttgacaaagtaagtgtttatgttaaaaggccagttaatattgaattgaagtttaaaataattgcaactattccatcttatacattaggtgagagttcctagtttggttcagatagtttgaaatagcaatgagttagtctaccttttagccagaaatcaagcagaaatctagattagttagaagtagagtgcaagatattttcaggatttttaagacctttatccctagggatctcaatgttgttcattttatcctaagtataatccccatgcatgggataaaaagagccacattttttacttcttttcctttcttttcttttctttttttttttttttcttgaaacaaggtctcactctgttgccctggctgctcttgaactcctgagctcaagtaatcctcctgcctcggcctgtcacagtgctagccaccatgcctggcctgacttttctaattagttattgggtcttgaaatgtccaatttagcagaaaatcttgtattttcccctggggctatctcctgtgtcttccttctttgaattttccaagaagctaaggagtttcctaagtccaaggaagggaatctttctttacaagtcagaagaagggggaaaaaggccattctgatcattctgttgtttcaatggactcatttcctgtattgttgccattgtaactagtcctgcaatctgataatgattgacctttgccaccaggatgacttcactcattcagacccctcggtttttgtggtgattcatacatacagttcaaagctatggtgtttattaatttatgtacttatgctcagtcattgttccctgatgccagcaccctgatctggcagctaggcctcctagctttacccacacaaatattgagcaagttgatcctcaccctacactaaaaaccttatttggagcccacatcttagctatacttagcctaggcattcatggtaagttatcctttgagacccgtgtttgtctgttctttaaccaacattagttgggattgctctcaacagtcagggatgttcaaataatgttgcaggaaaagattagggttccctttcccttttgctatcagatctgtaccttgaggcttttttacatcctgtggagcagctttggttagatagcagaaggttccatgttatctttccaccgagtagtgggaaccaacttgcagttggcccctcaagtaatgtgtctctatgataatgaaaatctgggctaatcacaactcttcctggagttttaaatatattttaaaattctacctcacaggaagccattcaataaaattctctgaatctaaagtaggtgagttggatttaacagagctaagcctcatccatgactcaggagtgtccatgtatcaaacagggctttgtacttgtttcagcagcacatattttaaaattggatcaatacagagcagataagcatggctgctgcctagggatggcacataaattcagaaagcattccatattttgcatagttccgggaaggtcatttgactatttgtcgagtagctccaaggaagcagtgtgagtgaaaccaaaacagaagacacccaatattgaaattgtgattataactgtgaaactactgatgtaaggtgatctctgaaatgagaacagagctgagtaataaggggatgttacttgttgccggtacatgtcttggaaatgacaaaatgtcaacttgcatttccttcatggaactgaaaagcaataaaagcagggttttgtcttgtatgttagttggagaggaccatggagatccagtgtcctagcacagatctgctggctcagagtttgaggaggtagagaaagagtggtagttgtccaagcccaggttttgacacctattagttttctgcccttggtgtgattgatgagctcagtgatgggagacaattaggtaatctattttaatcagatgagttatgaattaggtaaaatgccctgaattacaagccacaaagaatacaactaataaccaaaattagcacttaataacattttctgcaaactgcaacaattgaatattagaacttatagaaaaacacacaccaagcaataaagttcaagaataaatcatttcattgctttactatttcctgaacatttaaacatgtaatcttattacatcttcctaacaacctactgaagtaaggtagcaaaatccttattttttagaagaaatcatggatcctaagagaagcaacttgtctggaaacaaaatatcgattagttacagagtgaggacttattctgagtgcaggacatgttacatgatgtccagctaactagagttcatttactgagctatgcttcctccatttatgagtacttcactttttttcttctttaattataagcttaataagcttgtaaggtttaaaaatttgaagtgtatgggacattaaaattctgatattaggtctgatattgcctgaaatggttttagaacttaatatgtttggtaaatattttttatttcagtattaaaatagcaattttatttattacttttgtatacatagaattcaacaacaaattttggagcataaaaagatgatacttaaaaatgacaaaccaggtaagacttctgatagtgaatttcttattactcttggtggtcctactcttgataagaaagtaaaaagtaagatgtaagattaaggtagtgttaataaaaaaagaccagtttaaaaatatatgtaaattaaatgtgcatatatgtatatacatttgtaaattattttttaaaatttaacttctttagtttgaaattcagatttatttaagaaggtagttgtagctaacttataatctcaaacattattgcctgaaaaaattcctttatttaattatgatccctaaaatcctatataatatttttgcataaataagaaaaaagatttttaagttagtatgttgtatgtttcctctatagtcacattataacaaattggacttgttatacaaatggatcttctatttcatttttataataaattgtttatatttagtaaacaaataattacagttgacccatgaataatgtgggggtgagggactctgatccctgtgcagttgaaaatctgagtataacttttgatttcttcaccttagctactaatagcccaccactgactgggagccttcctgataacataaacagttgatggacacctattttgtttgtgctgcattattatatactgtgttcttgcaataaagtaagctagagaaatgaagctgttagaaagaaaatcatcaggaatgatatattgacttttcataaagcataagtagatcctgacaaaggtcttcaagatcttcaggttgattagcctgaggaggaagaggagaggtggatcttgctgtctctgggttgcagaggcagaaaaacatcagcatataagtgaatcgctgcagttgaaacccttgctgttgaagggcgaactgtattacatattgatttgtgtcactaaggaagtaactatctttagaaccaggaactcagcaattcctttctggtaccataaataaatggcaataagaactgtaaaactgaaccagcatgcacccatacaaataagagattattttttgaggatagctactgagcacagaagacagaaaagcaattccttcatgagaagcacaagttatattacacattcttacacaagcaaaatggttttatctgtcatagtttgtacacatacacacatgcacatatacacatacatatgtgcgcacgcatgtgcacacagacaccaagttaaaagtcctgctgattcttaatgaccaaatccaactgttcgtggggagtggcagataacacttcctacagtttggatgcaattcttttgactttttgacttgttctgtaatgaactgcctttaatgggtgaatcatgtttttagttttataagaaacaagaagattagaagcaagtaaacaggaactctatgatcagtagtagactattatagtatattcaatagtcatatgtttttctccagttatacaatttacttgaatgatgcacaattaatcaattattattattataggagatggggtctctctatgttgcctaggctagaataaagtgtctattcattggtgcaaacatagctcactgtagccttgaactcctgggctcaagcagtcctcctacctcatcttcctgagtagctgggactacagttttgtatggttatatctggcctgatacacagttgtttatttatttatttttgatacagtgtttccctctcttccctctgttccctctgttgctctgcactggagtgcagtggtgccatcttggctcactgcaacttctgcttcctggccttaaatgatcctttcacctttcgccttagcctcccaagtagctgggactccaggcatgcaccaccacactcggctaattttctttttaaggtttttttgttttttcttttgtttaatagatgagatctcactatattgcccaggctggtctggaacttctgggctcaagtgatcctcctgcctcagcctcccaaaatgctgggatttacaagtgtgagccactgcacctgacctgcacaattattataaaaaggaattaagcccagttgagttgcagaaaattgaccaccttttcattattttttctagaaacattcatattgtagaacatattgtcaatcacccagattctctattttttattcggttaaaataggattgctgcttattccacattattttctgacattattgtgtcatttattccttttatggctttattcatgtggatagatatagaaatacaagaatctccaagtcaaatatcaagggaaaaaaagaaaagaaaaacagtttagggaaaattattctgtgaaatagccatctgattagttacatatatcacatcaacttaatacaaatcttacacaatgtatttgtgtcaaggtttcccaagaccaccccaggtttggtggttcactagaaggactcacaggactcagcaaatagtcatactcagatctttaattgataacaagaaaggggacaagcaaaattagtagaggaataaggtgcttgtggtcaattctggaggaaaccaggcacaagcctccaggagttctctcctgtggagtgcccgggatctgcttaattctcccaggctcacattttgacaacatatgtgcagtgatgtctaccagtaccagagtctcattagagatgaagtatccaaatttttctgtggaaattattctcccttacatgtacccaaattccagactcttacaaggaaaacagatgttcagagtaaccacactgtttctataaacactttagacacagtgagccactcttctcagggaatggtggaaaccctcccaattccaatttccttaacaccagccaagggccagccttgcatgcaggcctttctaaggatggcagtctcttgcctgctatatgaaatcttttctgcacaatgcttatagccccaatttaatttttagtgttgttttaaaattttattttaataacacataatattataagataaggtaacttggtactaatttctgttgtatgatccatcttaagttgcaatgctggttactttttgacttttggtgactaacaggtatttgtatataagttaccatagcaatgttaggtaattataatctgtcctttttatctcattaagctttcagtaaaattgttaaattaaataagcataataatttgagttaaaattagaataaaaattgtattttattttaattacatgaataatctagttttcatattgtgctaaatccctgtttagaattatgaaataagataaaatattcaatcatttttatcaatattttcttacctaagcatgcaattaaatttatttattttatatatttcatatacttcaatttgagaactataatgaccacatgctgttactttggtcttcaatgatctctaatttttagggtcactgtgtcttgcttaaatatatcatcataacaggttcagtgaatatctttatttttatttatttattaattttttgagacagagttttgctctgttgcccaggctgcagtgcaatgacagaatctcggctcactgccacctccccctcccgggttcaagcaattctcctgcctcagcctcccaagtacctgggactacaggcatgcaccaccatgcccagctaatcttttgtatttagtagagacgggatttcaccatgttggtcaggctggtctggaactcctgacctcaggtgatccacccacctcggcctcccaaagtgctaggattacaggcatgagccactgcacccggccatatttttttattattattattttaattattgttctggagatcctgggatgcataaacagtgaatatctttttttttttttctttgagatggagtttcactgtctcccaggctggagtgcagtggtgcgattttggttaaccacaatctctgccttctaggctcaagtgattctcctgcctcagcctcccaagtagctgaaattacaggtgcctgccaccttgcccagctaatttttgtatttagtagaggtgaggttttgccaagttggccaggctggtcttgaactgccgacctcaggtgatccacccgcctatgcctcccaaagtgctgaggttacgggcatgagccactgagcccagctgtgaatatcttttttaaatcaataactttatttcttagagcagttttaggttcacagcaaaattgagaggaaggtacagagatttcatatatcccatgcctccaacacacgcatagcctcccccattattagtattttccaccagagtgtggtacatttgttacaactgatgaacttacattgccacattataatcactcaaagttcatagtttacatcaggcttcactcttgatgctgtacattctgtgaatttggacaaatgtataatgacatgacatgtatctattactgttatattattgacagaacagtttcactgccctaaaaattctctatgctatgcctgttcatctctccctttctccctagccacttgtggcagccattgatctttactctgtcttcatagttttacttttttcagaagagtcatatagttgggataatactgtggatatctttttgaatagttaaaaaaattaaagctccatggcaattgaaggtagccatttaagatgttctttgtccttttgtctttcttttgcttttttatcattgtaaagaatgatatatgctgatgaggtatgctttacatacttagaaaacatgatttgtatagatatttggcacataatggaaagggttgaggaaaaggacaccacgccgtaccacacagcacaaactggagcatcttgctctgtgaggtgggtccagatacagtgtctagcaatggaaggggacaagcgcaaggggttgtactttataaaactggaatcacaaagtctttcatacttaccttcggttggaaataagaccaggcagtgaatgctataggtaaatacatatgttcctcactgatccttttcctttgaggatgaggttgaaaacagcctgtattatgatgacatgactcacctacaactagattctgttatgagggatggcaagggagttttgctttatgtgaggtgaaaaagaatttttttctcctactagggagaatggcaagcattggaacattctggtagtaaaagggcattgatagttttctttctatatatttttcacatgagataatactgcccggcagcctgccacacctccccagtgtttcttcagcttatctctgaatgtggataagctcttaaaggagtgatctttccagtggttctttctgtgggaggtaaaatggcaggtgcacatgggccttgttatatgtagggcagagcaaatagctacaactaaggaaaccacccagcaccttccccagaagagtgttagccagagtaacacagtgatctctcttgagctcttctccactggcagctggaaagtttttgcaaggattcctgtttctggtctgattcctatgttttgctggcttctggtgataggatgttttatcctaaactgaacagtttgaactgaagagctagagaggctgtgttgtgttataacaaaataagtgcagtagttcccccttaattgtgggagatacattccaagacccccagtggatgcaagaaaccacgaatagtactgaatcacaaactgttttttcctatacatacatatctatgataaagtttaatttataaattaagtctgatgtaatctgaagatagggtgggagaattgaattgtgccatcagcaggaatgattgcttgcttgttggtggggaaaaactctccacacatttggtcacagaagccttctttgttgatgattgttgctgtggcgtgagagcagagaaaaacatgtcaagtatgtctttctgcacatatagtggataaggggtactactgtatcctctaactgctcctcatattttggtccagaaatcatgctctttgacactgttgactcatcacacctgttctgctaacaataacatttttactcagtctcatagggtttggctaggatgacttgtatactgcagttcacttgtagataccaaattttaataaatttattcttctttgcatctaataaatacaaagggaagagttcttactgcattaattacctaccaataggtaaaattaatgttaattctaataaggtcccaggcattctcccaaaggaattctttgtaacaaagcatcagtcttatgcttttaaaaaacaaaccaaaacaaaaccaccaccaccaccaccaacaacaaaaacaggatctaaaacatacacacaagtgtgcacaatttttttttatgaaggtagtgtcttactatgtttcccaagctggtctcaaacttctagattcctcaagtgatcctcctgcctcatcctcccaagtagtttggattgcaggcatgcatcaccgtgcattcttatgcttttaatattttgtacatttattattgatttaaaatgcattctacctttttctttaatagatgttggaagttctgatgaatctgcagtcaggtaggactttatagatttaaaaaattatgttaactaagaaaatatagatggaagaaactaatatctgttgagtgttgtattctgggctagacatcctaatatgttctatgcatttatcatctcataaaaccatcacaacagtgttcctataacctactgtttattaaataaacaactatggattagagcagttgattaattgccttataatctcataattaacaaagtagctggcctacagtttgaccgtcagcctgcctggcttccaaatcccttctcttgctcctcagcatagattgatagacatccgtgcagcacttggatcaaggtataggtctgaatcagattaatcagattccttaatttaattaatgtctaaattaatgagagtttaaataccttaaataccttaaactctcatttaaggttattgttagaatgtggttagtcgaagagtttgtcctaataaatttgacaatttcagtggtaaccagtatcttatttttaccatcaaagctttagggcagatctgacttagctttggccatagggctgtaagttttacaaaagcaagtttaggcaagtcttagagagaaattatttgacttcccagtttggttttccatttagcaagtatttctgcctgcttccataatactttttttagtcttgtttctttttccatgacttttctgtaatcttgtcttgattttttagaactttcttctctgcttttcttgctgtttcttttgttctattattttttcaaattctgctgggtatgtattcccagttttcctacagacagaatcaagaggacatagaattacagaattttaaggaatcttagaatgaattaaaatactttctagtatttttacctgtattgaacattctggtcaagtgattctctagatagagaatgtgaggctcaaagagattaggatgctttttttttagacataggaatgggcagaaatgagatttgaactcattttaaggcccagtactcttccttctttttatatcctatttgcatgtgctttaataatacaaatgggagtgagtccggtgcacccagtggatagtatgagaatggaattagctggtgaacccaatggaagtagataagaatggaatgagcagggaaaggccatgtttgaagagaaacaacactggattggataggagtatggactcttcaataagagatcaaaatattggagtttatgacaagtttgataaagagttcaagggagctctaaaaagtttgctcctttttttttaaatcaaggactgacaaacctgaagaattttactgaaagatgctaaaacattttgagacagtgggaggagtgtctacagcagatagaaatgtggtgtcatctacttccatcctgactttcagaggggtggcttagagcccttggagtactaaggggctggagattgctggactacatagatgtgtggcccaggacaggtggcctcttcacctctgcctctgttcctgattcactgatgtcattcccatgtccatgtaggctgggtcaggggcatgattggctggcaaatcagtcatggagttcagttgggtagttggtagtatgtctatgctgggtgcaggtgatggagactccagttagcttgtttttcaggagcagggatatagagggctcctactcctggtcatttgaggccatcctttcaggaatctgtgctttcataggctgaagatttgaagattggagacttctgtggagccctgcagaagtggaatctggaagtgggagcccataggaagatagatacttagatagtacttaggaaaatagaggtacaactaccaggactctgtctttctggcagtctctctccttgggtgtctgagtgcctatgaaaatttttaagggcttgctagtttatgtggacctgaataaagtaggacttatagagtgaaaataatgggattttataattattaatattttaatctttctgggaaaagtattctcaataagaacatacacctttgttatttgatttttgtacatgtagctttcatacctttcaaatattgcatgggatttcctgtaccgatttagggcaaaggaaagcaataggacattcctaagtgggttccatgttgaggaatcaagactgccatttcaaagtgatacagattagtcttttaaccagagatagatcatggaaaagagacagtggatctttctaccttgttttaggtcatcagttttcttccagtttaggtaacaaaatttatgtcatccattaattgagttttaagttcagcttcaggacagataatctgtgagggcaaattattgtcaggctctgccaatatattgactgtcactatttgttatgaagctgaaggttagttttcattgaatattttatagatttagacaggtggaggcagaaattggtaattaaaatctatttttagaacagaggacatattttaattatatcaagaatcataatttaatatatagatcactgaactttccccagattattctttccttttttgaggggaaagctggatataaactggcagttaaaaaattgtaaagaaatcaacttgctcattttcattgtgtatttttgctctcaagcattttccatgaactgtgtgtggattcattgtctgcattggatgacgaactcttgagtgttgctgctaaggtaaagtggtctcttgtaaaattaattttctcactctgaatgtagttttgcatagtacttacttttcaaacttagcagtggtttacctatcattgttttatggtggtaatggaaagtgggtcagagaaaaacatatatgtggctagttgactgaaaaaatttgtttaactttggtaactaacaaagattgataagtactgtgacagggtaggagctgaaaaaaatgaactggaaaataagtagtgagaggaaaatcacattaggaagtgctttctccaatagaggaaatatgaaatttgattaagctttatttggataaatactaatactttgacttttaaatcatatgagtgtgactttcataatatttatgcctgtataactcttcagtggatcaaattatttgtagtaatcatggaattctcctggtaacttttagttgcaaaaaggttcagcacatagcatacagcttttgttcttggaaacttattattttggtatcacatagtttttaggagagattgtttctctacttatattattggttctgtagtgagactaaaataatattaaaaattgtagaaaaatagctgagtgtggtggtgtacacctgtagtccctgctacttgggagtttgatgcaggaagattgcttgagcccaggaatttgagaacagcctgggcaacataacaagactgtatctgatttaaaaatataaattgtggaaacatagacatttaaatttatgttctcaaaatttgtattgcaaagggatttttgtgtgttttatgagttgtccatgaagagttcatataaaacacttcatctaattgaataacatgtattttgctgcaaataaccagttctagaagcagagactcttaataccaatatggtaagactttatcatcataattttgtcattgtagtttatttaaaatatttacttggctgggtgtggtggctcacacctgtaatcccagcccttttggaggctgaggtgggtagatcacctgaggtcaggagttcaagatcagcctggccaacgtgatgaaaccctgtctctaaaaaaaaaaaaaaagaaaaaaaaaaaagcacaaaaattaaccaggtgtgatggtgcatgcctgtaatcccagctgctcaggaggccacggtgggagaattgcttgaacctgggaggcagaggttgcagtgagccaagatcgcaccattgcactccagcctgggtgacagagcaagactacatcttaaaaaataaaataaccactcaaagtccttatatcctattctgaaattttgaatgtcagaaggttttctatttagttgtttaaataatcattggaagctcctgcatactacaggctactggaggtcagtaaacatatttgtgtgtatcctggagtacctagaatacagtcttccatgtaaaaagcattttacttgttgttttttgtgatggggtttcactctgtcacccaggctggagggcactggtgaaatcttggctcactccgatctccatttcctgggctcaggagatcctcacacttcagccatccaagtagttgaaacaatagaggtatgtcaccatagacctgtgtcaccatgctcggctgagttttgtagagacagggttttgccttgttgccgaggctggtctttaactgttgggctcaagtgttctgcccgcctcagcctctcatagtgctggggttacaggcatgagacattcagccttaatagttgtttaatctgaataaatagacaaatgaatttttatataatggaatgttataagtaatataatatacctaatgtatctaacaattaaatattatatttaaaatattgcttacatttgtattattttttaatatttaagggcgtataagttttgatgtgttatgttgataaattgtgccataattaaaaaggaaataaattagaaataggtcatcagtagcaaagagggttacaatatattttctagtatcattgaactggaatcttaacattgagattttagattaacatttcttaagctttttattagtcccaactcaggttctattaaatataccttttcaagccatacattaccctttattattattattattatgttttaagttctcgggtacatgtgcacaacgtgcaggtttgttacatatgtatacatgttccatgttggtgtgctgcacccattaactcatcatttacattagacatatctcctaatgctatcccttccccctccctccaccccacaacaggcccctgtgtgtgatgttccccttcctgtgtctaagtgttctcattgttcagttcccacctatgagtgagaacatgtggtgtttggttttctgtccttgctcagaatgatggtttccagcttcatccatgtccctacaaaggactgaactcatccttttttatggctgcatagtattccacgatgtatatgtgccacattttcttaatccagtctgtcattgttggacatttgggttggttccaagtctttgctattgtgaatagtgctgcaataaacatacttgtgcatgtgtctttatagcagcatgatttataatcgtttgggtatatacccaataatgggatgactgggtcaaatggcatttctagttctagatccttgaggaatcaccacactgtcttccacaatggttgaactagtttacagtcccaccaacagtgtaaaagtgttcctatttctccacatcctctccagcacctgttgtttcctgactttttaatgatcgccattctaactcgtgtgagatggtatctcattgtggttttgatttgcatttctctgatggcaagtgatgatgagcattttttcatgtgtctgccatacattactctttagaattctggtgaccaattctttttctgggtggaacgttgatggaaagttccagttttctctctctgttataataatgttctttcaggtagtggtagatgaccatatttagttaactgaatgtcttatagtaataaactctatcacagaagtacttacaaaaaactaattgtagcataaatattaattagtattatcagggatatgaaagaccagaaggctctgttatagatctatttccccatgtactttattgtacttcatgttgtttcttttctttcttggcttaagctcatatttcattgaccaattaggcttcttttttgtttgtatgtctcttcattctcacattttaaattgatatttttggggagtcagggtcttgctctgttgcccaggctgcagtgtagtggcatgatcttggcacactacagtctccacctctcaggctcaaatgatcctcccacatcagcttcccaagcagctgggactacaggcacacaccatcatgcctgactccttttggtattttttgtgtagagatgtgttctcattatgttgcccaggcaggtctcaaactcctgaactcaagcaatccacccaccttggccttgcaaagggctgagattacaggtgtgagccaccatgcctgggcaacattgagattgatttaaagaaattgattagggctgggtgtggtggtgcacactgcttatctcaacactttgggaggcagaagtcgaagatttactcaagcctaggagtttgagaccagcctgggcagtataatgaggccttgtttctacaaagataacaataaaaacattagcatggcatgatggtatgcacctgtagttccagctattcaggaagttgaggtgggaagattgcttgaggtcaggagtttgagaccacagtgagccataatcaggcccctgcattctagccctgggttgacagagtgagacccagtttcataaaaagagattgataagaaagtcttgatgcaactcattataattttaaaatggaaattaattcttgatattaccttagcagtgtgtccccgagaaagtgtcagagcctttacgtggaccttcccatggaaaaggaaacagaatagtcaatggaaaaggagaaggtgagaaccgtattttatttaaaaagtcatttgttgcaggctgggtgcggtggctcacgcctgtaatcccagcactttgggaggctgaggtgggcagatcatgaggtcaggagatcgagacaatcctggctaacatggtgaaaccccatccctactaaaaatacaaataatttgccaggtatggtggtgggcccctgtagtcccagctacttgggaggctgaggcaggaggatagtgtgaacctgggaggtggagcttgcagtaaacggagatcactccactgcactccagcctgggtgtcagagtgagactctgtctcaaaaaaaaaaaaaaagtcatttgatggaatgtttctttgaaaatatgagcactaatagagtctaatagctaaagaaaatgtcctattagctgtataataagtaaaggagaagtgaaatggtgataagttgtgtctctaaccaagggtcagcagttgattctattgggagtaccactaaaggagctgagttgtgagttccattttaagatactctaagacctaaggcaagtcaggagagagggaagaggaaatgaataaaagagaaagaaagatgagggcagagtgtacatggaataaataaaaacacatatgcagatgtatgtaatagagggtagtaaagtcaaattgatctgtagaaaaaggaagaacagggtgttagaaataggaaggaagataaagtgagcttccagtaccaacatgtgtcagagaattagagtaacattttcctacccttgctgtcatcctcactactggggaggcattaaggattgaggtattttaccacacagacctgtgttttatctaccatagatgaacatcaccataaatggtcagccatgtatggctataatttggttttaaagaaaatgttgtaacctcataggatactatcatataggctaaattaacataattgaaaagaatagtgttgggtgatgtatggaaagaaattaactagagaaggtattacctgattaaaagttattaaaagccatattaacattatggcttataatgtagtattaaattcagagacataatagggaagaaattgaggctaggccaaaaagggcaattagggtaaactaatatggaatcacataaagtgtagaacagggcattcagatcgtcatgaattagttgaggagcttctagaaactgcacattctgatttagcgggtatgggagtctgcgtttctcatgagtactcaggtgatgttgttgctggtccttggacacagctctgaatagcaagggaatagccttcctttagagaaatctggaaaaagaaccactggagagcaatttgaataataacagaatccagggaaagcattaattttcttttatttctgagcatcattctagctacaggggaaggaaaatgagatgaaaaaagagagattacaggtgtatactactgctgaatacagatgaaaaaagtggtcacaagtatccataaaaagcagttaggaagggaagcatcaggatgacagatctaaaaatccctttttcaaaggaagagggattgtgaaaggacacagagggaagaaagaaagacatttgctggggtcttgggagttaaagccaagtaaacttgagacaactcacttccagttgcttcagcatatgcccagtctcacaaaagaggttattgctgtggagagtactggaggcaggagggagtgctagaattggggtaaaccacagcagctcatttcacttcataattgtcaggcctcagagagagaagtttcattgacatgagtgaataagatgtgattaagttgcatatagatgctttggctaattttttttgagatagccagttctttgatatgatagctgctttataaaagtcctttacagtgtaagatgatataccaaacttagttaattttagaagcaattgtgttataaaattcattctgtgaataccaaaattctcattttcaatagatactgcactgattttgaaatataaatgtgtattcgtgtctagcaagtctgtggtaattcagtgttttcttttttgataaatattttgatattggaagcttattcgacatggtttatttgatgtgttttatggaccacctcacacaagtggatcaaggagctctaactcaaggccaaatgaggggataggagaaatgttggtgctgcagtagcccatgtgatcatgggaaaaatgagtagtttgattagctgttatttcataagtgtgtatcctagctgatcaatgtagaacactttctttgatgagaggtgaatcacacattcacctgaactgtcatcccaactgtatatttcctaagtgacaagacaaggggaatttgtttgtgctgtgctggcagcaatgcctctgatgtgttgagttaaaatactctgtacattcaccatcagcttggacatcgattccctcaggtttgatttgctcgtctgtttagtggtcccttttcttctcatcagcccacatgttcacggtgatatccatgcttttctattttaggtataggcatttgaaacataatctcactactgaaatgtaggctgtgcattttaggaatcctatattcctattttcctcattaggtttctgtcatgttgctgtcctaggcaatgaaaagaagaagccaagaagaaccctcaaaaccttaagtaattatttttgtagccaggcatgagaattcagctcgatagtaacactgcatgaatgtttggttggccctgtcatacttacatataattgatgacatatcccttttgctttgtagggcctcctgcaaaacatccttccttgaaggtaattaattatgtatattttttgaatcactaactccacattgtataaaatatatatgatttatgaatcattttcttttaaaacccattcagcctagcactgaaatggaagatcctgctgtgaaaggagcagtacaaaaaagaatgtacagacattgagagcaggtacctattcaatacaaatggaatgctggaaataagtacattaaatgattggaagtactcacattattcttacccctaattctgtttgttcaaaattgaatggaaggcattgacataaatgttattgttggtatccatatttgaataaaaataaatttagaagcataaaaaagattttaaaaatgtaagctttaactcagatgtttctcttttaatgttttgaagagcatgaagttttcagtataaaattttcatacttgtcagggattcaaagcactgaattttgagactctaagatatttccattgatttatgtgctagttggagttctgatctttacgtagaggaaagctttacttattaacgtgtcagtttctgttttaactttagaggctttctgctagtgttactacactgatgatctgaagccaatcagacgttctagtgagcaagactgtgtgtgcatgtgtatgtatgggtgtgtgtatgtgtgtgtatgtgtgtttgtggcatctttgactattaaaaatgaggaaagtaattattcatttataactgttagacacagtcttttaaaacggtgattttgagactttttggtgttaaggtttttaaaacatgattgcatagtggctaccaacatcataagttggtcgtttttcatttcaatgcccttttgaaatctttaactatattgtgatgctcagaaataatatgcagaattttttgtgtcctaaaatggtatgtgagtggttatacactttacatactattctgccactttctttggtgtattttgtattatattttccagatgtatccacattgacatgattatctctggtttaattcattttacacttttcattgtattcccttataccactttaccacatttcattagactctcctgttgctgataaatgaagaaagaaagaaaaataaaaataatgtcagattaagagggcttttctttaaacagtttgtatctattaatatttactatatgagagtttaaagttgaaaagttcagaatacaagcatgcaccaaccatgtttgataaatgtccttagaactatgactcgtgagcctttagcctatgaagttaggacaattcatttctctgaagaagtttgctgtgctattctcagaaaagaaaactgaaaatagcaaatgatattgtcttagatgacctcttggacatccttgaatgaaactgaaactccagggatacttggatcaaaattcagaactaatgttttgaacaatatagtttgtgaatgtccagtgatcatgagcccttgatggggaaatgacctttcaagtttcacttttgcattttttgctcttttccttgactcatcttaaaagcttaaattcaaccgttttatttttacagaaaccaggaatataacttttaaaatatatgtctgtcctgtctcacggtgttgtgtactcttcagatcttttgtgaacatagacttatatgggaatgattatgttttttgtttgtttgtttgtgtttttgagacagagtcttgctctgtcaccaaagctggagtgcagtggctcagtcttggctcattaccacctctgcctctcaggttcaagcaattctcctgcctcagccccttgagtagccaatactacctgcacatgctaccataccctgctaatttttctatttttagtagagatggggtttcagcatgttggccaggcttctctcaaactcctgacctcaggtgatctgcccacctcggcttgccaatgtgctgggattacaggcgggagccactgtgccagctacaaataagatttttaaggctattatattttatacaattctttggtctatgtgaattctgaaggtattcatgcattgagggaagattatatcagtttaatgaaagcagtttttaatttaatgtatattcattaaaattttttttgaagtttttgtctctagtacacagaaacacacaataatgtcatgggtatttgaccttaatgtgtttatgcacaaacttagttattcaaatatcttcttatccctgaagaatcttaattactaataaacaaatttctcatggaaaacaacatatataatagagatcgttgagtgattgaaagtaaattatagtaaataacagaagcttagaacaagttaagtaaacttgtctgagttaatagcaattacaggacttttaaaatacgttagaccatgagggactggtgtgtttgtgaggtagaggacaacatggtactgcttcagtgaagaaagaacttttacaacttattacaatttgtattactgtttacattctaataaataaaaactttattttcagatattttagattatgtttctactagttgaaccatcaatagtaagacttttcaaagatttgggaagttgtgagttgacgataaatatctgtatcgccatccgtgatcaaaaatcagacagcaactacagactttggacacgtgaacctcatagttaaagaaaggattaattttggagctgtgtttctatcagggaattatactcttcattacctgcgtgaatcgcagttattagagtagagagagagcaaagaagggaaagaagcatagaaaattttattctagattacctcggttggcttcatgctaccatagttctgacttttaaaaagtcattttgtggtccaatgtactttgtgtttactccccttatgcagcctaccaccaaacagaatgcttcttagcaaggcatttgtattcttcccttaaggaaagcaacatataaataacaaagagaatgaggagaaagagtaatttcattgaggttgttatttaacataaatttgagtgtgggtaccatgattatatttagaattttgggactggatgggaaaaccagctacacatctacagattccctactcaaacacaatgtgcctttgttttatttttacatctctaattttgcaagtattcagtacaactgtatgcagtgtcactaaaaataccttccaaaaccaaatattaaataatgcctatggctttctgttttatagtgttgatttacccaatactaatgggaaccattgagcatttgccttgtggtgtctcctcagctgtattcacacattccatcaccttgtcttaatggataatcatgcactgtgagtacgggttttcagaagagctgtgtcatttaaagataacacaggagcatcaaatttaattctgctagaacacctggtctactgattaactgcagctaatatggggtctacttcacatacaagttaaatgcagtgcccttaatcagtgatatgatgaggtcaacagtaataaattatgcaatatttttcccccacccctacagttttaatttctttttccccttatgtctagaattagcattttgttttataaaacatgatgataatcttctagagtagtgatgacaagctagaaatccaaagtttcttacctatgcaaatgtcttgtttgcttctattttctcatgagcttggtagatccaggaaacataacttttaaaacaaaattcccatatgtggctgggcgcggtggctcatgcctgtaatcccagcactttgggaggctgaggtgggtggataacctgagattgggagtttgagaccagcctgaccaacatggaaaaacccatctctactaaaaacacaaaattaactgttcatggtggcaaatacctgtaattccagctacttgggaggctgaggcaggagaatcgcttgaacctgggaagcagaggttgtggtgagctgagatcataccactgtacttcagcctgggcaggaagagtgaaattccatctcaaaaaacaacaacaatgacaacaacaacaaccaccacaaaacccaaatgcatttccttggcacagtaaaactgaaacagaaaaagtgtaaagtaaatacaagtaactgagacagtttatttatattatcttacttctcatttgataaaatttgtaaagtaatgagcagagtgtatttctccagggacctggatatatacatttattcattcaataaaaattcattcttataatggccactgatacttgtatcctaaacatttctgaaaacatctcctcaggcctgcatcatctttgcaacattgccatattttatctttgttcatttatttatatgtctcagaattttatgctcctcacagtatttagagttaattatctctaatgtaaatagatccatgaaccactcctgaatacctaatgtccaaacatcttaaagctttatataaggatttcagaaactgacttctgggttgggcacggtggctcatgtctgtgatcccagcactttgtgaggctgaggcagatggatcatttgaggtcgggagttcaagaccagcctggccaacaaggtgaaaccccatctctaataaaatacaaaaaatagcaggtggtggtggcacgcacctgtaatctcagctactcgggaggctgaggcaggagaattacttgaacccaggagatcgggttgcagtgagccaaggtcatgccactgtgctccagtctgggagacagagtaagaccttgtcccaaaaaaagaaaagaaaaggaaactgatttctgcccaaatctccatctgtagccctttccccatctgcctttttctctggaattactcagctgctggtaattgccccctcaccattcctcttttgtagagaaacacgtactctcttggaggcttctctccctctcttgttgctgcctggcacgtgctcaccctttcctgccctctgcctcacttaatctggctaacctcactctctaagtctcagctcatgcatgatctttaggaaagccatccctgacagcttttatgttccttccttataccccagtgcctaacacctagcaggaactcaataactaattatttagcaaaattaagactgtttatacaaagatgattcaaaagattgtcctctacagtctaacagcaaaggggatcaacatgtaaagacatgatgtgcagttcaggtggtaaagtgacactagaaaaattgacaaagtactaagggaccgcaatgaaacagacacctgtgtgtgtggagaaagatagctagaatcaaggaagacttcacacagcattctgagcctctttgttttctttttctgttgttggagacaagttcttactctatcacccagggtggagtgcaatggcgtgatcgagactcactgcaacctcaaactcctgggctcgagggatcttctcacctaaacttcttgagtagctgggactacaggcacatatcaccatacctgccaaattttttgtagagtcaaggttatctatggttcccaggctggtcttacactcttggcctcgagcaattctcccattttggccttccaaagtgctgggattacagatgtgagctattatgtccagcctactttctgagtcttaaaagatgaatataaatttttcagaatagcaggggaaaacatttgcgatgtaaaaaatggggtgtacactaattaagatataaacaacaataattttgcaaattattagtaactgccaactcaattagtgtcttgttaaaaagatactgttatgtacattgtatgttttgactgtatttcaaaattttgttttgtttccaacagttttgttgatttatgttgggtggaacaatttgtgagtgactctgagattttgtatggctgaacctggtgatatctagtgtctccccaagtggtttgttgaagttttggataattagaagtatttcttaaagaagtaaatatttcagtaaacattaagcttcatttaaaccctcaaaatataaaatacaaagaaatgttattttctatttatttttataaagattatagtctttatctaactgttcttagttcatttgaactaaaccaatgaatttgtcaacagaacaagccttaccagtggcttcagaggaagaacagcaaaggcgtgaaagaagtgaaaagaagcaaccacaggtatatgaaaatttaagtttcttgtttaatattaggttttttttttttgctttagtaacaaagtgtagtccaaatgacatgaccttttagactatacctttagaatccaataggtcataattttatatttaatttttaaaacattttaaccagttatgaaacttaagatattcttactatctctagtaactattcgttattctagtaattcttactatctctagtaactcttagctgtttttacccttggaattgaggcaagaatttttcacaattatcttgctcttttatttgtataaccttactcataatacagaaggtaacatgaaatattgggtcatattactaaggaatagaaattatgaacaatttaataaagatggccactgagttaaactagtgttaaaagagtcatcattgccagtggttcaaatgttgcagttttatattgctggtcaccagtgccgagtttaaagatttattctctttcatggtcaccagttgacttctgtgtctgtgttcagggagtgaatggggtcataaaagtcaacccagttgccttttaagagaatcctaccttgcagaatgggacctttggtatcagggtacaaacaataacttcatttcaatataaatacatagtaaatattactaaaattaaaaaaatccaaacactgtcagtactggaacttaaaatatattagaagtggatatgagcagaaactctatctagataaataacactatcatagtatatcatttgaattagaatttaaaattttgcttctctttcttattggtgttcagtttggctcttaataatttagtgtttgcctagtctctagttaatcttcagaaatatacatgcactgtaggggctcactctttctggcatgctgaggtaaagtctttgtaagagaggaagcttttataatactacctatcatctttgaattcatttctggtagactttacacataatgcattaagtttagtccaaacaaacactgagagttcagcttgccggtttatgtttctgtcgtatgttaagccaaggcaaattatttttcactttttagttacaatcccataatttaagagtggcaacacacagattaagtttcacagttaaattttaattattttctaatatttctttgtttatacttgattaaagctaattttagaacatgcattctgacagaaaagacatctgagaaacaaaacaagcaaatttgttttccattttgcacctgccaaaaaaaaaaaaaaagtctcaagaaccagaactgggtaagaattgtgaaaaaggaatctatctgtatattcacgactttctttaaaattcattacaaacaagttcaagctgaatattggtaaaagttttgaaaactccaaaattactgcttgccctgaggaagagcttctacatagtaactctaaagagggacaaaggaaaaaggagtgccctctaatctgacgaatcatatccctgattgtgaggagaaaaatgcatctggagggtctaactctgtggcagtccaggcagcacctgaacagaggaatcccatgtcaaatgtctttttattccattcacactccaggtccctgaaatacacttaccagtcatcttctaagcttcatttaaatgaaaataaatcagactataaaaatgataacaaaccagacacatagcttgtttctaacacaggtgatgaaaatttttgtaatgatacagaaactgaaacattaaggaacccagtaattgtgattgaaatgaaagattattaagagtttcacatgcaaatggcaaaaaatataaacccaaataccactaattggaaattagacattaggcactggcctcagtctagagatccagaaagtctttttgatttgtggtttacccacctcaaagaaatgaagcatatgattcagatagaaagccacagtatttctgctgctacagacacttataaaaacagaaaaccaatacagtgcttactccagaagccactatatgacaatcccagtgctaataactacaaaagcatgaatcttgaattataaaatgtgggtttattctttgccacatagtgagagaacatcaaaaatatagctagaagacacagcaagatattccaaggtcaccaacatggcacatgtatacatatgtaacaaacctgcacattgtgcacatgtaccagaacttaaagtatagtaatagtaaaaaagaatgaggtagcatgttaccagtagagttcctagctttggagaaggaaagtccaacttcaaaaagacagaggttcacttgctgcttcttttttctctttatcaattatttgattcagtcagattttctattcaagaaaatctcgtgtacagttacagtgggattatctaaatgtgtaattatgtgtcaaagtagattagttttgctatctaaataatggttctggagaatgttctcataatgtttgttcattaatcaacctaagtctccctatcagtcttccaagtggcatatgagctgggaaactaattcagccatataccatgtgaccttctgaaccagatcaacataaagaaattgctaaagaaataagctctggattctagattcttttttctgtattcatttagagatgaattacatttatttaatgatagaatggtaatacaatgggagggaagcaatgactgcgacaagccacaaaaacacgtctagccttgagagttgcaatggatattcccagccaaatgagtctgtttaatgtgttttcatgcatgcaagtttatctgcttagctcaaactgtttgaacttatagtcccatcatggttatttccaatattttgaaaacaaatatatacttccacatattttaaaaaatcaccactctccaatatttctgttgaatcagaccttacattatgttgtttaataaagtatggtaagttttggcatgtatgatttttatcatgtaagaagcataatttcttagccaaaaatttagcctttgactctttagtagaaaattgagttctgtacattgtgttctaaagatagacaaaattctagagattttcttctttcaaagtaaaagcagatgaggcctttttccaccctctgaggcattaaattgctttgcttaagttagacttttaatatatctgactaatttgataaatttatctggtaatttatgtaattcagaaatatggaattgtatcatgttatttggtgccatgaaatgctagggaatgccacctcaagagctctggatgaaacatttaatatgtcttggttggtttgactcccattatcagtagatgatggggctaaagtaggtaactgtaccatatgttttgcacctataaacttttgtggtaatagaatgtgaaatctgggaagcatctcattttccagaattctgcactagaaactcagcagtttcactctgcttcttgtgttgtggcaaactttggttcccatagttcagggagaacctttacttttttgatatcccaggattcaaaaaaaaaaaaaaaaaaaaagagagataaaaggcactggggaaaagaatagcttagtgcagaaaagggaaaacttctttactgttcctgaagccctacaaagtcacatcctcttaatctggctatttcatgtaaaatccaggtggtaaagacagaagacatatgttatgcctgtgtctttttatttctctgtttctgccagtcagataacataaacatttatgtcagatagcaaagagtggatgggaataaaagcacaaaatggagaagcggactttttaaaattttccatttttttaattttaaaattcttccattcactcaaacagaaatgagcagacttgacaaaaatttcaatgataaaatgatgagtaccttataattataataattatgtataatgataaaattaaagtaagcacaaaatacttttatcattaaaatggtgatagttaacctgaatcaagtgaaaaaatcagggaaaatgttctttttattgaataaaataattattattcatattacttttattaaaggtcatagaaggaaataatacatacaaaagtgaaaaaatacaactatcagaaaatatatgtcatagtacattttctgctgctgctgacagattaacccaacaaagaaagattgggaaaacatatcctcagcaatttcccaagaaactgaaggaagagcatgataggtaagtaagcctatagcagtgtgtttgttttgttttgttttgtttgggttatttttttttttgagatggagtttctctcttgttgcccaagctggagtgcaatggtgtgttcttgcctcactgcaacctctgcctactgggttcaagtgattctcctgactcagcctccctagtagctgagattacaggcatgtgccaccatgcctggctaattttttgcatttttagtagaaatgaggtttcaccatgttaaccaggctggtctggaactcctgacctcaggtgttctgccaatctcagcctcccgaagtgctgggtttacaggagtgagccactgtgcctggccacgtatagcaatatttcataggagataattgtcgttgtgctataaactaattcaaaattggactaatattccttaggattaacaagttttatatttttaccagggatatttagccctgcctggtaatcagaaaaatgtaaattaacataaaataagatatattttgtaaagtcatgctgatatttaaacagtaattactcgtgttggcaaatgtgaggaaaaaggcattctcatacactgttggtatatgaaattggtaaattagttctgaaaggtaacttagtgctgtgtatcaaaatttcaaataacctgacatccctttaactcaacaactccacttctgggactagatttcccaggaaaacataacttgtgtaaacatacacacacttattaagggcattaattatatattacacataatgaacaataggctaataaatatataaaatatatataataagaaggtgaattgaaagtattaagaaataattataaaaagtgtggggtaacagatgttagactctttagcctagttttggatgacagtcatttgcagatatagtttttgtgagagacatcttactctgtaaatcatttggagagacacccacaatatttcataaagatgaaaatttatttctagtgaaattatacacttgtcaataaatagtaactttaaaattttagttgattgtaaatgaccttttctaattagggagtaattatgactgtgtgatttgaaaaggtaattttgaacttgtaactttactgaattatctccagtatccttttttataatatatactagagtgactagtaataaaacctttagcagaatattctttccttactacttttcaagtatatgcattcttttgaagatgttgaagtgagaaattaaatatctgagaactgcaaaggaaaaataatccagaacatagaaatcttattaggataataaacaacatctgcagaggtagataacaggatgaactctttattttttaacaaaatgaattttaagataaatgtctttatctgcagatgcaccttaaaacaagaaaatgaagaaaaaacaaatgttaatatgctgcacaaaaaaaatcgagaagaattagaaaggaaagagaaacaatataagaaagaagttgaagcaaaacaacttgaaccaactgttcaatcactagagatgaaaccaaagactgcaagaaatactccaaatcaggtaaatcaatctttggtaaaaattctatattttaaactttattttatcaatgttacttataatatccacttgatttaatatatattatttaggtaaaaaacaaaccagaaatgttatctcatttttaaaaatgagtgatgacacttacaggtacaattattaatatttactataaatcttggcatccacataggatattattttattacaaagagcttttgaaaacaataatatgccataatatatacttagtgataacctattgataaagattttgttcccagtaaaattgttccatgtactttcccctatttcatattgattactgtacctaatattataaagaggagacagaaattattgcaatcacaaataactcatgataatcttagaagagctctataaattttatcttatttaccactggtgttttgaaataaaagttttctttcatatggatatatttacaccacagaagtaattgtgatctgttggagaactagaagtagagtcagaagtcctggggaaaatcctgtagcttgcttatatttttaacctttctttctcaaaattatggtaactagatgagttcatcaatgaatgtatataggagtgactagtataatgtctagatttatgatttagtaaatgtaattcttataactgactataaaagtgttaaaagagtcaaattgaaatagaatgttatcagtgaactgtaataactctgggaaattttatctgtccaaatatgtgtgaactaaggttcttactatagggtggtgtatgggttagatatcaaagtgtaaatgcaattttttgatatattttaatttagtcaaatttgttaatgctttaatttatacttttgagtttgttgtaattcagggaaaggcttttccaattctgaaattcttaaaaattctctggtgtgcatgtgtgtgtgtgtgtttacttttataaattcattgactttaaataaatttctgaactttttggaatttatgctctataaggttcaaaattttgcttcaactttttctccagttggatatccacttacagtaacctttttagtgcatggatgtgcaggttattctttaacttcagaggtaatcatgatatgttattttattgagtactagctaaaactttcttttgtattatttaggattttcataatcatgaagaagtgaaagatctgatggatgaaaattgcattttgaagacagatattgctatactcagacaggaaatatgcacaatgaaaaatgacaacctggaaaaagaaaataaatatcttaaggacattaaaattgctaaagaaacaaatgctgcccttgaaaagtgtataaaactcaatgaggaaatgataacaaaaacagcattctggtatcaacaagagcttaatgatctcaaagctgagaatacaaggctcaattctgaactgttgaaggaaaaagaaagcaagaaaaaactggaagctgaaattgaatcttatcagtctagactggctgctgctatataagtaaacacagtgaaaatgtgaaaacagaaagaaacctaaaacttgctttagagagaacacaagatatttctgagcaagtaaaaatgagttctgatatttccgaaatagaagataagaattagtttcttactgaacaactttctaaaatgcaaattaaattcaataccttaaaagataagttctggccgctgccgctgcagcctgctgggctggaggaagtggagctggtgccgtccctgctctcttgctgggaagcaactgagggggcggcgcggcaggccccggcagccgaagaggctggcaggtggcactgtggggtgggtgctcctggtgaaaggagtccactgcatgcgtgtgggtggagtccggcccccgagagccaccgacatgaagaaagacgtgcagatcctggtggtgggagaacctagagttgggaagacatcattgattatgtctctggtcagtgaagaatttccagaagaggttcctccccgggcagaagaaatcaccattccagctgatgtcaccccagagagagttccaacacacattgtagattactcagaagcagaacagagtaatgaacaacttcatcaagaaatatctcaggctaatgtcgtctgtatagtgtatgccgttaacaacaagcattctattgataaggtaacaagtcaatggattcctctcataaatgaaagaacagacaaagacagcaggctggagtgcagtggcgggatctcggctcgctacaaccttcacctcccagccgcctgccttggcctcccaaagtgctaagattacagcctctgcccgcccgccaccccatctaggaagtgagcagcgtctctgcctggctgccccgtctgggaagtgaggagtgcctctgcccacccaccaccccgtctgggatgtgaggagcgcctctgcccagccaccccatctgggaagtgaggagcgcctctgcccagccgccaccccgtctaggaagtgaggatcgtctctgcctggccgcccattgtctgggatgtgaggagcccctctgcccagccaccctgaatgggaagtgaggagcacctctgcctggccgccccatctgggaagtaaggagcacctctgcccggttgccaccccatctaggaagtgaggagcgtctctgcctgaccgcccatcctctgggatgtgaggagcacctctgcctggctgccccatctgggatgtgaggagcacctctgccctactgaccatcgtctgggaagtgaggagtgcctctgcccggccgccccatctgggaggtgaggagcgcctctgcctggctgccctgcatctgggaggaagtgaggagtgcctctgcccggctgccccgtctgggaagtggggagcgcctctgtccagccgccccatctgggaagtgaggagtgcctctgcctggccaccaccccatctaggaagtgaggagtgcctctgcccggccgccctgtctgggatttggggagcgcctctgcccagccgccccatctgggaagtgaggagtgcctctgcccagccgccctgtctgggaagtgaggagtgcctctgcccagctgccctgtctgggaagtgaggagtgcctctgcccggccgccaccctgtctaggaagtgaggagtgcctctgcccggccgccaccctgtctaggaagtgaggagtgcctctgcccagccgccccatctgggatgtggggagtgcctctgccaggctgccccgcctggaaggtgaggagcgtctctgcccgactgccccatctgggaattgaggagcgcctctgcccggccgccccgtctgggaggtgaggagcgcctctgcctggccgccaccccgtctgagaggtgaggagtgcctctgcctggcagccccatctgggaactgaggagcgcctctgcccagccgccaccccatctgggaagtggggagcacctctgcccggctgccctgcctaggaagtggggagcgcttctgcccggccaccccgtctgggatgtgaggagtgcctctgcccagccgccctgtctgggatgtgaggagcgtctctgcccagccgccaccccatctgggaagtggggagcgcctctgcctggccgccccatctgggaagtagggagcgcctctgcccggccaccccatctgggaagtgaggagcgcttctgcccggccgccccatctgggaagtgaggagcacctctgcctggccgccctgtctaggaggaagtgaggagcgcctctgcccggtcaccctgtctgggaggtgaggagtgcctctgcccggccgccccatctgggatgtggggagtgcctctgcctggccgcccatcatctgggaagtggggagcacctctgcccggctgccccatctgggaagtgaggagtgcctctccctggccaccccatctgggaagtggggagcgcctctgcccggccaccccgtctgggaagtgaggagcgcctctgcccggccaccccgtctgggaagtggggagtgcctctgcccggccaccccatctgggaagtgaggagcacctctgcccagctgccccacctgggaagtggggagcacctctgcccggccgcccatagtctgggaagtgaggagtgcctctgcccggccgccccatctgggatgtggggagtgcctctgcctggccgcccatcatctgggaagtggggagcacctctgcccggctgccccatctgggaagtgaggagtgcctctccctggccaccccatctgggaagtggggagcgcctctgcccagccaccccgtctgggaagtgaggagcgcctctgcccggccaccccgtctgggaagtggggagtgcctctgcccggccaccctgtctgggaagtgaggagcacctctgcccagctgccccgcctgggaagtggggagcacctctgcccggccgcccatagtctgggaagtgaggagcgcctctgcccggccaccccgtctgggaagtggggagcacctctgcctggctgccccgtctgggaagtgaggagcatctctgcccggccacccatcgtctgggatgtgaggagcacctctgccctgccgccctgtctgggaaacgaggagcacctctgcccggctgccccatctgggatgtggggagtgcctctgcccagctgcccatcatctgggaagtggggagcgcctctgcccggccaccccatctgggaagtgaggagtgcctctgcccagccgccccgtctgggatgtgaggagcgcctctgcctggccacccatagtctgggaagtggggagtgcctctgcccggctgccccatctgggaagtggggagcgcctttgcccagccgcccatagtctgggaagtggggagcacctctacccagccaccccgtctgggaagtggggagcatctctgcccggccacccatcctctgggatgtgaggagcacctctgccccaccgccctgtctgggaagcgaggagcgcctctacccagccgccccatctgggaggtgtacccaacatctccgaagagacagcaaccatcaagaatgggccatgatgacgatggtggttttgttgcaaagaaaagggggaaatgtggggaaaagaaagagagatcagactgttactgtgtctgtgtagaaagaagtagacataggagactccattttgttctgtacttagaaaaattcttctgccttggtatgctgttaatctataactttacccccaaccacgtgctctctgaaacatgtgctgtgtcaactcagggttaaatgtattaagggtggtgcaagatgtgctttgttaaacagatgcttgaaggcagcatgctggttaggagtcatcaccactccctaatctcaagtacccagggacacaaacactgcctaggaaaaccagagacctttgttcacgtgtttatctgctgaccttctctccactattagcctatgaccctgccacatacccctctccgagaaacacccaagaatgatcaataaacattaaaaaaaaaagataaaagaaaaaaaaagataagttccgtaagacaagagatactctcagaaaaaagtcattggctttagaaactgtacaaaacgacctaagccaaacacagcagcaaataaaggaaatgaaagagatgtatcaaagtgcagaagctaaagtcagtaaatccactggaaagtggaactgtgtggaagagaggatatgtcaactccaacgtgaaaatccgtggcttgaacagcaactagttgatgttcatcagaaagaggatcataaagagatagtaattaatatccaaagaggctttattgagagtagaaagaaagacctcatgctagaagagaaaaataagaagctaatgaatgaatatgatcatttaaaagaaagtctctttcaatatgagagacagaaagcagaaacagtagtaagtatcaaggaagataaatattttcaaacttctagaaagaaagtttaaacatttggttctggatacatgttgaacctagttgaatataaaaatcagtagataaaaagtgtgtttactatactgtataattccatttacatgaagcatccagaaaagagaaaggtataggtacaaaaagtagaataatgtttgtgaagggctggggctggaagctggtagtgactgctaatgggcgtgagggatcttgcagtgatggaaatgctctaaagttggattgtagagatggctgcacagctcagaaaatgtactaaaaatcttttaactttatgttaaaacagatacattctatagtatgtaaattatatttcaacaaagctttttggtttaaaaaaaaaggaaaaatgtgttcactacatcagcttagaaacataacttgtttccatagaggtgagagatgatttactttgagagaagacattgtgtcacctatgacattttattaggcacagagtcatattttaaggtagatagtcctgtagtgctgaaataataattttaatgtctttatattgccacatgttaagaccatggtgaaggtataaatggaaatgtttacacctgaaatgagtattttcaaattaaaatttaattaagtgatttgcttcaacacttaattctagatttcccagatgaactgaagtgtattgctgtatcttgtaatatcttgctttaagtagttttttatatattttagttggtatagctttattattattcatattaatttaacttaaatctgaaaatgtcagtctcaaattacatattttaatgaccacgtaatgttttaaaggcacctacttgttataaaattataatttagggtaaatgtggtaaattttagcaaaactatatttgatttagtcttcccactcgtattcataatttactttgaatatttttattaataattagctcataatttttatttcaaggctcaatgactatcatttgaatataactttgtccagtacaaagatactgtagctgcctgtgatttatgagttaggcattagatccccattttcagactaaagcggggtggtaggcttcacgtacagtgggaatggagtaattacaggagggagttgtagaagcttgaagtcagagagggaggtagaggcctgtttacctagggcctcaaaggccattggacttttacttttattctgagacaggaatctgttggaaggatttgaacagttgattgaatatgttaggaactttgaggttgagttgagcttctaagatgattgaatggtgggatgaatctgttgtattaagagaataccaatttggcaggaggataacacattctgcatccctcactgaattcagtaataaataaaaatgtgtacctgtgatgaaaagaaggtgaattgatgtgtgtgagataattttcaaagtaggtatgttagagttaaatgttcttaacataatttaataataaggcaatttataaaatcagtaacaaaagtattttatcaggtggttatgagacaacttcaacaagaagtggctgattcccttaaaaaattaactatgttagagtctccactggaaggtacatcatgttgtcacattaatttggatgagacacaggcctcaaagaagaaattatttcaagtggaaagtcaagtatgtatggaatctaacatgtcgacagttattctgtagctggttgaattatataacatgttttaggatactaattttggcagaagcttgattttgtactttcattataattaattatttccattttactatctttataatgtactttttttaaatattgtgacttttgttctaccattttgaaaaaggattgcataccttttctcttacaatatgtacccttggaaaagttgataattatacatcattcctcagagaaaattgacttttttcctgttaaacatattttcaagtaatttttgtattgctatgatgaggcaggccagattaaatcagaggacaatgtttaatggaatgttccagaaaattgtcttatttcttcacttttgtgaaaggacacagaatctgtgtctatttcacagattctaagttaacttgtatagaaaggccattatactattctttgaaatgtacatgttttatgtcaatttacaaactatttgaaaagttaggcattttctttatttaccttttatttaaaatataaaagtatagaaatatttagatctgatatagtaggtacatcaaaaattgagagctgagaaaattttcttgatcctgccattggattttaaaaacagtttcactgagatataattcatgtatcagacaggtcaaccatttaaaatgtgcaactcagtatctgttagtatattcacagcattttcatcaccctgaaaagcaaccccacatctcctaggcatgactgcagccttcctccatgtccctccacctacccctgttgtaggcaaacaccatctatttttgtctccataggtttgcctgttctgcatatttcatatacatagagttagacaatacatagtcctttgtgactggctttttcacttagcttaatgttttcagaattcatgcatgttttagcacacattggtagtttatttcttgttatagttaaatgatactctattgcatggctatactggttttccattcattcatcagttgatggacgtttacgttagtttccacttctagctattatgaaaaatgctgctgcaaacattcacttagaggttattatgtggacacgtgtttttatttccctgccattggactttatcctcagagttaattgggcagatttcagcacttgtcttgctcatgctatcctttctgccttctcagtttctgttcatctagcctcattcattcagacctggcagacaatttttttgtttttatgaagctttctctgactgttctgactctcattgaccttatgtgttaggaattgttgtccagtctgtgcagaaaacttagtccttaattttacatggctttttcttttttatggaagataattttgtctcagtataaatttgcttaatgggggaataatatataatatgtatggcacctatccttgcataaattgaaaatattttagcttagaagtttttagcatacaattaaatattttataccataccaattatttgttctttgagaccttgacacagtaaggtttatattctaaatgtatttttagcaattaaatatcaaatctaaaccaattagtctaatagaggagactcgttcaatcacatgtttatgtttttctctctatgaaaaagaatctaaattggccttttttcactatgcagccattactgtatttctggactgctcccagtttgtcagctgaacagttctggctgcagcttgtctgatgacagatagcacagcccctcaatctgagtgctcagcagagtgcttgtgaaggcagcaccacagcaacagttgctcagagggaacagattcaggagccttggtttagcaatagagtccagggttttcagctcagtgtctttagcctgtctctgctggtcatgtcagttatgtactattccatccaggaggtgctatttacattgtagtacatacatagtcattgcctactgagtcatacacagagaaaagtaagttataaattatatgccccccatttgctgcaactctcagtggtgagaagaatgattcagtgcagctataggagactacttccattggcatgccacctgcctaacatacacaattttgttaagatatacaataaaattattatgctactagcaaatattttatgtagctcactatgttccacgtactcttgtaagtgcttcatgttagtccccagttaaacacctggttgggggaggtggctcatgcaagtaatcctagcattttggaaggctgaggcaggaggctcgcttgagcccaggagtttgagatcagccacagcaatataatgagaacctgtctttaaaaaataaataaataaatacttagaggcatggtggtgcatgcctgtagtcccagctaccttgggagtctgtggtaggagggtcggttgaccttggaatattgaggctgcagtgagtgttgatcaagccactacactccagtctgggtaacagagtgagactctgtctcataaataaaacgttttgtatagattcccatagaagtgagttagacatcaggcatagtattgttagccactttgatgtctgcctagggagtaaaacatataataagggacagcattaaaccatctcagtcagtagcctctaacttctcaagaaggttcttatctcctgaatgtctaagcaagagactacctggatgaagacatttggtggacaccattttgagatgaagaatctcaaatgggaagaagggagatgtctacttgactggagcttcccaatgatatatttgagtgtcccccaaaagaaactttagaaactttagaacaagactttcatcattccatatctctatggaaaaggaaactctttaaaagaaaacaaaggcaaacaattgataatctgattctcttgggaaagttttcattataaaagaaaaaaagggctgggtgtcgtggctcatgtctgtaatcccaacatttcgagaggctgaggtgggtggattacctgaggtcaggagttcaaaaacagcctgtccaacatggtgaaaccctgtctctactgaaaatacaaaaattagccaggcgtggtggtgtgcacctgtagtcccagctacttgggaggccaaggcaggagaatcacttgaacccaggaggtggaagttgcagtaagccaagatggcgccactgcactccagcctggatgacacagtgtgactccatctcaaaaaaaaaaaaaaaagaaaaagaaaagggacaaagtatactggtccaaaaaagaagaaagaaagaaaaaaaggacaaagtatactgttcaatatcgtaatggtgagactgtccccctttgagatagaaaataacggtatactcaaagtaacatcaataagaaccaacataaaatagacaagattcactatctacaaaagtaatctgcaccaagtagcaatgtctgagcgtgtggttgagaatattgtctataatatgtgtactagaaggaagaggcctcaagaaaaatgtcagagctggaaatgtagattagggaatctagttcaaagttttgagattttaggagtcctgagagaatttaaaaagtggaatagcagccaggcgtggtggctcacgcctgtaatcccagcactttgggaggccaaggcaggcagatcatgaggtcaggagttcaagatcagtctggccaacatagtgaaaccccatctctactaaaaatatgaaaaattagccgggcgtggtagcacacgcctgtaatcctagctacttgggagggtgaggcaggagaattgcttgaacccagaaggtggaggttgcggtgagctgagattgtgccactgcactccagcctgggtgacagtgggggactccatctcaaaaacaaacaaacaaacagaaaggaataggactgaagaacagaggttgctgcatttagaaatgaagtggggtcagaggagcagagggaacatttggtcactgctcgcagctgctgctgagtaaagcaggataaagtccttcatgacccttgaacttttttattggaattattaaaaatcagatttccatattaaaaacacaataagtgatgaaaaatagatttctggatgagaccatgtgtcacagattccaatggaaggggagaaacaggataatagaaaaaccacaaaaagtagacaaaagttgtgtttttgtttattatagaaaaaaactttatttaaagagaaagggttaagagaaagggaaaaactgaaacgtgtgggtgaatacttacagagaatgacagtatttagctcaacctgaagacagatgaggatcaaaaaggtaatgggaaatagataagagttttctaaaactcgtcttagtaagatgtaatttaagaaaacttggaatatcttaaactattattaatgacaatgtttctagagcatctttaaaaagtaaaatgtaaatataactacacattttttactaacccttagtattttatgtgtaaaaacccttgtttgtaacaaacatttttggcagtttaaatttcagaaaatataatgaaagtatgtatcatttttagcagttttaagaaaagtgactatttctgaaatctgcccttattggcatcaggcttataaaatgcactttatacccatgcctaaatacatattactcatcaacttatgagaaataatatttttaagataaaagagggtctctagattttacaaaaataattttaaacacttttttttaagcctgaagaaaaaaatgaagaattaaggaaagtttttgtgttagtatcatcactggagtataatgtgaatcaaataagaaagaaaaatcatgaattagaagaagaggcaactgggtatggttttcatattgtagaacatgttaatcatttattaattgatttagctctaattttacttgactaaaactgagatacaatttcattttatgtctccattttaataattaaatgaattctattttaaaatgtatttcagaaactcacaacaaaactttataggcatgtgcatcatggggttgggagtcagctgagctgctggggcaaggttgggatgaaaaaatttgtattaaaatatgtataaaagagaaacaacataatctgacaattttttgaatgccaaaatattatacttatttatttatttatttttatttttatttattattattttttttgagacagtgcctctgtctcccaggctggagtgcaatggcgccatcttggctcactgcaacctatgcctccaagcaattctcctgcctcagcctcctgagtagctgggattacaggcatgtgcaaccacacccggctaccttttgtattttttagtagagaggaggttttgcaaagttggtcaggctggtctcaaactcctgacctcgtgatctgcctgactcagcctcccaaagtggcatgagccactgtgcctggccgcttattctttaatgattttgaaaacaatgacaaagccttggacatataatgtcaagtccactcttcattatctagtttgaatttttatttctgaagatatttttgctgtctgtggtcatcttttcttccttttgtagtatcctctgctgcattcaaattctttaaagaagacctattgtgtcattctttaacatcaaaatttatcttgatatatagcttatattttgtttctgcttctttttcttttagatataaaacatggaaatttactcattttacacagatacctccgttgtattcacgaagtatacatgttattaaacttctgttttacagcaataaatttcatatatataaaaatatatgtataacttaaaagtaaaatgagcattcatgttttgatcacatattttttttaaaaaaatggaatgtgtctttgaagtcctgaacacagctacttttctatttatttactgagcacttaagttggttttctgattctaatctacatttttctgtcattgtctttctctacatggttttgtatctctttcattttgttgacattatgtcagcaaagatctctagatctcttcttcaaagtccttaaattgtcacacatctctctgccccattcttggtcttctctttttctacattgaataatgtccttgatgctttttgtgtgtacttttttttcttcttatagactgtgaatgggtatcaaaatgtaattttttgtctttttcaaatgtatgtgttttacttttttatcttggttactcatttctaggttatggcttatatttagtaataggttattttatcttagcataccaacatgggtatgaatagtttatttacaaaaagtgtatggttaggccaggtgtgctggctcacacttgtaatcacagtattttgggaggccaaggtgggtggatcatttgaggtcaggagttcaagaccaatctgaccattcaaggccagtctgaccaacatggtgaaaccccatctttactaaaaatacaaaatgagctaggtgtggtgctacatgtctgtaatcccagctacttgggaggctgaggcaggagaatcacttgaatccaggaggcagaggttgcagtaagccaagatcacaccattgcatttcagccggggaaacaagagtgaaattccatctcaaaaaaaaaaaaaaaaaacaaaaaaaaaacactgtatggttgtaataccactttacctgccatatatgccataaaattgttcttcatattatttatctaagattataatttcatatacagtgcttccaaactatgctcagttgaaactgaaaggatcatagtttatagatgtgtttctttgatatgctataacataatatcttttaaacaattattaaatatttactcttaaaaatatttgacttactaattctgtacatttctgcagatataagaaactcctggaaatgacaataaatatgttaatgtatttggaaatgaagacatcgattgccatggagacttaaatacagatcaactgaaaatgaatattctgattaagaagctaaaacataaggtaattttttaaaaaaaattatcttaaggtctagattacatgtgtgagatgtgcaggtttgttacataggtaaacgtgtgccatgatggtttgctgcacctgtcaatccatcacctagatattaagccccgcaggaattagctattgatcttgatgctctccctcttgacccctacaggccccagtgtttgtttttcccctccccgagtccatgtgttctcatcgttcagctcccacttataagtgagaaaatgtagtgtttggttttttcttcctgcattagtttgctgaggataacagcttcgagttcatccatgtccctgcaaagagcatgatctcattcatttttatggctccatggtgtatatataccacattttctttatcctgtctatcactgatggacatctgggttgattccatgtctttgctattgtgaatagtgctgcaatgatcatataaatgcacgtatctttataacagaataacttatattccaacatacggtaattttaaatcagttttgggattaaaaatcacgtaatttgggaatatattgataatggaaaaacccaaattctgccaaaatatgttgagaaaatagagggtaaatatatcttttcagactttgaatgcatcagcctcttagttaatcttccccagatctgggaagacctagaaggggacagattgggctacattaatgagggccatttcagtctcttggccctgcagcagccatttcaaaatatgtcagaaaaatatatttgggggttaaatattttgatttccttcagcttcttctctctgtgatgctgtaccagaatcaggtgagaaaggaagccacattataagagttaataaaacccatctgatgagatttaatagtttgaagtgtgtgattctcagaccctttagatagaaattggggccaaagaaaacaagttcttattcctcaatataaatctctcagtgctttaagcagtgaaagaaagatttttcatttaattttacagaattgatactaatgaaaaggatagttttaaaaatataaaccttttttctataaaaaggacatgctgttgattctcttatgtctttaactctggccagtgatctgaaaccaagcagtacctgtctccagaccactagtaccaaattaatttgggggggggggctgggtaaccggtttattgagaaataatgaacacaccatgcaagtcactcatttaaaatatacgagtcattgactttagtattttcagagagttatgcagtcataattacaatcaattttagaatattttcatcaccctgaaaacaaaccccacatcacttagccatcttcactagttttcccttcctcccccagccgtagggaaccaccaacctcctttatatagatttgcctataagcctctgaaataaaaagcaagtggtctactgtgactggcttatttcacttagcataatttttcatgctgcatctgtgctgtagcaggtattgatgtggggtttttctcattagttcagctacatctgggttcttctctcatgaccaggaaaaattaagcacgcagacacattgaagggtgaggaggacagaatttattaagtgaaaggaaagctctcagtaaagagagtggtcctgcaaacaggtttccacctcacaattgaataccaggagcacatgagttgaagcagccaggctcctcccctgcataaggcatgaatttctggtggctccacctcatccccccagtgcatgtgggcctctggtctgctgcaggcatgtccaggcaagacaagtccaggttcccttatctgcacttaacatctggtgtaaacacttgtggggctggttggagattctccagggacccttccatatctgcctaggcattttgctgtctcctcctaatacagtatcagtacttaatttcttcttattgctgagtgatattccattgtatggatatatcaaacagtttatttatccattcaccaggtgatggacctttgggttctttcccacccaaaggtgatggactttttggttctttccactttttgactcatattagtaatgctgctgtaaacatttatgtacgagtttttgtgcttgcatgatttttgtttttctggagtatatacttatgactggaatttctgggtcatatggtaacttcatgcttaaccttttgaggagctgccagtttgttttccaaagcggctgcatcactttacatccccagcagcactggataagggttttaatttctttacatttttcctaacacttattttctcttttttattgaacaaagattttatcctgtggtgtgaagtgataccacatgtggttttgatttacattttcctaatgactaattacatcaagcatctattaatgtcctcattatccatctttacatcttctttgcagatacatctattcaaaatctttgcccatttttaaaattgaattatcttgttactcatgaattgcaaaggttctttacatattctatgtatgtaagtcgcttatcaggtatatgcttttcaaatactttcttctacttagtgtcttgccttttcacttcttgatgctgtcttcttaggcacagcagttttcaattttgaagtccattgagtccatttttcctttggagtcatagctaagaaaacactgccaaatgcagtcacaaagatttatgcctgggttttcttctgagagttttatagttttagctgttacagttaactgttttattttgagttaattttttaaaaagatatttggtcctaatttatttattttttgcatatggatacccagttgtcccagcaccatttgttgaaaagactcttcttttcccattttgttcttttgttaactttatataaaatcaattgactgtaaatgcacaagtttatttttagattatcaattcttactttgtttatgtctattattatgccaaggccaaaatgaatttactgagaagttttttttcaatcatgttgcatattaccagttgtcttatgtcataataaaaattaaatttagtggaatatctttaatttcaccttttgtgtctcaaaggagtctgtggccagcttataccttacttactctaagacatgatgggaagccaggcctataagacacactttatttcttttttctcccttcaaatctttagtctcttttccattgcctcccactatagttttgttttcagtaagttttggtcacaggatctgctgacatagtctaatatttagtgcattatgttttgctaactcattataattcatagaatcttccatagatgtttaccatccaggaaggagaagtttaagtctgagccaccagctttcctcagtggaaatcaagtgaagtcatcatcttgcagttcacagatcctctttccacctggtagctggttctcttgggtagcactgtggctaatccttttcttggtgcagatcttgcattctcagaaaccacagttagctgtattgaccgccttttactgaaacagagatgcacagctctgctttctagctcagtagaggattcttggaatataaagtttaactcattccaagaaaaggtcttaggagtgcagcacttcaaaatcaggtaatgttcaggcattttatcagagacacatagtagattagtattttgactttcaaaatttcagagccaagttgtgtgctatagagaagtcttgtggtatagcatagagatgggatggtcttaacttctccaaacaaacaagcttgaagtaaagtaaaggagaaattgcatttgattgcttaacactcaaagcactctatgtttattttacttctgtgaagactaaaaatcacttcataatgttctccttatttcctcattgagaaaaggaaaataaaaattaaatactagattgattaataaatactgaaagcttatcttttagaattttagttaattcaaatcaggtaaatatctgattttgattgtataaccaagtatttctagttttttttcataccatatgtcttcttcttgcttcccagtcttatttcctaacttgaggggaaaccttaaggagacacccttgccttgttatcagagttcataattgaaggagttttaggaaaagtttctcctcagcagcttatgtctctgtcctggttatctgctgcttctcaataatgtttgccatcaataaattaacctcaacatttattagatcctactttaaaggagactcttttctgctgcataagttatgtttcctgttgtctctttttaaaacttatttttctaacaattacccagagttttgtggcttaaaagaaaaatatttattttgttaatgaacctgtggtttggaaaaatcttggctgggacagctcatctctactcccctcagcttccctaggaacagctatcagttggggaaatggaatcctctgaagcgttgctcacccacctgtttgatggttgatgctggccattggctggaaccttggttgggacaggcagcatgaacactgacactggcactgccaggttctctttgtggcctgagtgctgtcacaatctggtggctgggttccaagggaaaacagtctgagataggtaagccacatggtatcccttttactgcattctatttattaggaggaagtcagtaaggttggcccatattctgtttttttaaatgggatcaatgtaacttctcttttgttttaattgacacacatgtacataattatgggttatagagtgatattctgatacatgtaaatagggtgtaatgatcaagctaactagcacatttactacaaccatttttcatttctttgaattgtgaacattcacaatcttctggctttttaaaaatatacaataaatcatagttaaccatattcaccctacagtgccgcagaacaccagaactccttcttatctaactgtaattctatatccattaaccaacctaccttcccctacttctttgagatttttgttgttgttaagagacagggtcttgctagtgtagtctgggctctgggcaactgtagtcacccagacgggagacagtggtttgatcatagttcactgcagcccccaactcttgggctcatgtgatcctcacacctcagcctcctgagaagctaggattatgagcatgcaccattgcaccagtctgatttttgactttatagaaatatctccctatgctgcccagatgctctggaacttttggcctcaagtgactctcctgcctttgtctttctaagtgctaggaaattacaggcatcagccatgttgcccaggcctcaatttttctttagctccctcacaggagtgagaatgtgcagtatttatctttctgtgtctgcacttaacataacatcctccagactgatccacgtggccacgatgacgggatttaattcctttatatggtgaatagtattccattgtgtatgtgtgccacagttttttgtcttttcatttggtgatggatatgtaggttgattccatacattagccgttgtgaatagtgctacaataaacatatgaggacaggtatccttttgatctattgttttcttttctattgcctgaatacccagtagtgggcttgctggatccctcggcagttccattattaattttttgaggaaacctcgtgttgttttctatagtggctgcactaatttaccttcccaccaacagcacgtaagagtttactgttctctggaacctctccggcatttttttttttatcttttcaatgataatagtttattcaagttgaagcaagattatatcatattgtagatttgatttgtgtttctctgagggttagtgatcctgagcattgttaaatttatttattggctatttgtatttcttttttctaaaaaaaagtatagttagatattttgcccaattttgaactcagattttttttcactgtcaagttgtttgaatttcttgtacattttggatattagtcccttattagattaatagcttgatgatattttctccgattctacaagttttctcttcactcagttgttagctggacagaagctttttagcttagtgtagtaccatttgtctatcatttgttttttgcctatgattctgatatcttacccataaaaatctttgtgcagactgtcctcaagaattttccctgtttacttatagtagtttgataattttgggccttacatttcagtcttcaattgattctgagtttatgttgttatatggtgttacataggaagctagtatcattcttctccatatggatatttagttttcccggtgccattcatttgaagaggctgtcctttccccagtgtatgttcttgccacgttcatccaaaatcacttggctggaaatatgtggatttatttctgggtgctgtattctatggcatttaccccaagaatcattacttcttaaaatgcaactcaaattagcatgaaacatttgcagtttaaggaaaggcttatggcatcagaatacttatttataggattcattattttgtgtttttttgagatagggtctttgtctgtcatccaggcagaagggcagtgatgtggtcataattcactgcaaccctgaactctggtacaagctatccttttgcctcagtctcctaaatagctgggtcttcagacatgagccaccatgcctggctaatttaaaaaaaattttttttgtagagatggggcctcactatgttgctctggctgatctcaaattcctggcctcaagtaatctttctgccacagctttttaaagtgctaggattacaggcatgagccaccatgcctagtatagagtgttatattattttcaaagtcttattcctagagccatttattgactttggcttaaataactcaatgtgatatttctgaaactttttttgacatattatggggaatgataatgagggaagggggatagacactttttactaagagatagcttagtgccacttaaggaggaataaaaataaattatcagaaaaataaaagtaaaatgaagtgcaaaagttctgtggcaaagatgatgatagttaaataatgtatttttgtgactcatggtagctttaactttgttcttaaaattctgagtaatttaagggttcacatttgaagaatctactgcactacacataacagtttattccaagtaaatgcatttcaaaatttgctattgattttgtattagattattctcagcctacttcattatcaagctatactattttattcatgcagtttgatgatcttacagcagagaaggaagctgtatcttcaaaatatgtcaatttggctaaagacaatcaagttcttcaacaggagttattatctatgaataaagtacaacaggaatgtgaaaaacttgaggaggataaaaagatgttggaagaagaaatattaaatcttaagacacatggaaaacaatatggtagaacttagtaaactacaagaatataaattggagctagatgaaagggcaatgcaggcagtagaaaaattagaagaaatccatttacaggttagttttttaaatcagttaagtttatctgtaatgtggtttcctttatttcactgcaaattatattttggatatgtgtatattgtgtttcctctgcctctcttgtagcaatttactttgtagagttttagaaaaaaaaggcatctgttttttcttttaaatatttaaatttccattattattataacaaaatcaacctttcagagtaatgattcttactatggagtcatttgatgattaagaccagttggcataagaaaaagttgtgatttagaaattatgtgatacttttgaattggtcttaagctacattgttcgttgatcactttttaaaattatgaatggattctattgctttttttatgaccagattacattaatactaacataattatgatttcaaatttttatgaatcagacttaattctgaattcagttattagttttgatactactgataaacattttaagcttcagcctctttttttaacagattcaaaattgctctttgaatcactggctcaaaatgaaagacaacaaacatataataattaggttataattgttttaaaagtatattcatttgttttagaaacaagcacaatatgaaaaacaattagagcagttaaacaaggataatacggcttcactaaatatgaaggaactcacacttaaagatgtggaatgtaaattctccaaaatgaaaactacttatgaagaggttacaaccaaattagaagaatataaagaagcctttgcagcagcattgaacgctaacaattccatgtcaaaaaaattaacgaagtaagtccaaacatacactcatagaaaatgaattcagctcattaatttgttttgaaagcataatttttagtgagatggcttcagaatattagtaggaagtgaatgctaatttgacaatgtaattttggaaaataatgttagtaagtaatcttacctttaaaatgttagtcaaggatagtttctgtctctcctctcatttttttttttttttttgcttttgtatggcttttttcccctgaaaagtctcttgtagttaatctgttagttttttttactaagtatttttgaagctttataattaataaagtgatcttgttttaaattacttgtcagaatttccctaaatagtaatattaatgagtttatttttcagtagatcacgacctaaacccaagtgtcaagtggtactgctactctgggcacaatcgtttttgattgtgatctttagtattatcaatagaaggtgcctcaagaaagactatttgtgtaacatattcaagatgttatagaaaggcatccttatgaaatagggaacaattatcacaggaatttaaagaagtgtaattcacaaagtggttaaaaaataacaccttgttcagtctgaaggggtgtgtggagggcaaaaagaacaagccccacctccagtgccttggtcacagtgctgggggctaattgccttcagagatgctttagttctttttgatcaacaaccaaacaatctagttctcccctaggagttgttgctctgaattattcctcattaccaaatgtttaattggtcctagataattggtgaaatgtacaggggtgaaacctaaaactggtttactaaacacaagtattcctagattttttttgttcattttagttttgttaacctacattaaggagtacaacatgatgttttgatataattatttctagtgaagtggttcttataatcaagcaaatcaacatattccttttcccatgttgttaccctttaaatacaagtatttcaaatggaatcttcagaatcttacaagtagagccattttagaaggcagcaagttttatctgttgagccatacatcactggtagccatttctcttccctgtctactttgtttgagctgcttgttcagtataaatcaccttagaaacaaaggtgcttctttagaatgattttcaaagtataattccttacaacaggtatgctctcacacatcttcagtgtgaaaacactgtttagtgggtaatttggtttactctcagggcaagtttttaaaaactacgagtcattaagaatcatttaaggaaaaatgaaatactaagcatttgtctttgctatctttacagatctaataagaaaatagcaatgatcagcaccaagctccttatggagaaagagtgggtgaaatattttctcagcactcttcctacaaggcgaggtcaagagtcaccttgtgttgaaaatcttactagtatagtactcaacagtaaatatattcccaaaatgaccgtaagaattcctacttcaaaccctcagacctcaaataactgccagaactacttgactgaggttagttatatgaccgtttctctttagggtttcatttctctagtgtaattcttgtttttaatttggtgaaatactcagttgttctgttgacttttgcatgttaagtaaagatcataattagctgtgttaacacagaaaggaaatgggaactttacattttttaattctctggagctctcatttttgagagatatccatttgctaactttattcaataaatgtgactaaactgacacatttaaaatgtctttaaaagctgcatttaagttaggttttagaaattgcatgttattgtcttataactgatgatatactttgagatactttggcttactctctagttgattgtagtttagctgtggttcataccacatttttttttcttttttttgaggcagtgtctcactttgtcacccaggctggagtgtcatggtgccatctccactcactgcaacctccacctcccgggttcaagtgattctcctgcctcagcctcccaagtagctgagactacaagcacccaccattacacccagctaatgtttgtatttttagtagagacagggtttcaccatattggccaggctcttcttgaactcctgaccttgtgatctgcctgcctcagcctttcaaagtgctgggattacaggcatgagccgccgcacctggcccatgttacttttaaagtttctttgcacagccaggcatggtggctcatgcctgtaatcccagcactttgggaggccaaggcaggtgtgtcacgaggtcagaacttcaagaccagcctggccaagatggtgaaaccctgtctctgctaaaagtacaaaaaaaaaaaaaaaaaaaaaaaaaagccgggtgtggtggtgggcacctgtaatcccagctactaggaaggctgaggcagagaattgcttgaacctgggagacagaggttgcaggagctgagatcgcaccactgcactccagcctgggtaacagggcaagactccgtcttgaaaataaaaaatttaaaaaaagtttatttgcatcatctcaactcttcccacccataatcacaactgaatgattgacatccaaacactttaccacatatggatgtttattatttagtagaatccaaaataattgcattttatgaattaaaccaaacactaaaatgttcatttccatttttatgttaaaagctttgtgcttggccaggcacggtggctcacacttgtaatcccaaaatttggggaggctgaggcaggtgaatcacctgaggtcaggagtttgagaccagcctggtcaacatgatgaaacctgtctctagtaaaaatacaaaaattagcaaggcatgttggcaggcatgtgtaatctcagatactcaggaggctgaggcaggagaatcacttgaacccaggagacagaggttgcagtaagccaagatcataccactgcaccacagcctgggtgatggagactccgtctcaaaaaaaaaaaaaaaaaaaaaaaaggcttgtgcttttcttacataagagtacatcttctgactataaaaatcctggaagaaaacctaggaaatactcttctagacatcatatttgtcaatttatggctaagtcctcaaaagcaattgcaagaataacaaaaattgacaagtgtgatctaatttagctaaagagcttctgcacagcacgagaaactatcacgggattaaacagacagcctaaagaatggaagaaaatattcacaaactatgggtatagcaaatgcctattatcctattatccagaatctataagagacctaaacaaatcaacaagcaaaaaataaataacaccattaaaattgggcaaaggacatgaacagacacttctcaaaataacacatgtaagtggccaacaaacattaacaaatgcttaccattgctaatcatcagaaaaatgccaaacaaaacgtcagtgagataccatttcacaccaatcagaatgacttttattaaaaagtaaaaaaaaaaaaaaaaaaaaagatgttggggaggctgtggagaaaagggaacacacaccgtttgtggcaatgtaaattaattcagctactatggacagcagtttggaaattaagaactaagaatgaccattggatgcagcaaccccgttactatactaggggtatactgaaaggacaataaataattgtaacaaaaagatgcatgaacatgtatgttcattgcagcattattcacaatagcaaagacatggagtcaatccaagtgcatccaaggtagattgaaaatccaaggtagattggaaaattccatatataccatggaatattaagcagccataaaaagaacaaaatcacatcatttgcagcaacatggatacagctggaatccactctcctaagcaaaccaatgcagaaacagaaaccaagtatctcatgttttcactcatgtggaagctacacattgggtgcacattgtcataaacatgggaataatagacactaggaaataaaagcagggagggacagagtgggccagggttgaaaaattacttactgggtcctacgcttactacctgtgtgatgggctcaactgtactgcaaacctcggcatccctcaatatgcctttggaagaatcctacagaggtaccacctaaatttagaatacaaactaaaaaaaaagaaaagaaaagtttactataagtagagaatagaaatttctttttaagataaaatttattgaagtaaaaaatggattaaactttttataaagggcagagttttctcagaatttcaaagcaatgcattcattgcaaaagatggctttaattacttaatcttttttttttttttttttttttttgagacagggtctcactctgtcaccaggctggagtgcactggtgcagtcttggctcactgcaacctccatctcctggcttcaagcaattctcctgccttagcctcccaagtagctgggactacaggttcgcatcaccacgcccagctaatttttgtatttttagtagagatggggtttccccattttggccaggatggtcacgatctcctcaccttgtgatctgcctgctttggcctccccaagtgctgggattacaggtatgagccaccatgcctggccattgtttaacctttgtactaataaaacactacctttctaaaatcatgtatatgcaatagatcaatattaactgtatttttgtccgattactctaaacagcattacacatatacatcctctgttacctaaacttaaaataagtagaaattttactttatttatgtgattatttttctatttaagcaaacttcaagttatgtctagtcactaaaaatactaaaggccacattttgtaaatgatacattattttcatgataatgtttcttgtttaacttaaacattattattatttttacttattttagatggagctggactgtgtagaacaaataattagagaaacaaagagaagtatgttgccaaaatttattaattaaatttaggtttattttagaaataaagtgtaaatagcaaatggcattccttttcattcttgggttagtagatactacgtcaagtattttttttcttacacacatctaatgaaagatgtgaaaacaaaaactttcacagagaagactgtacttatgcaccataaattcatcatgttctgtagcttaaaaaattcccaagaagtctgtgcatctctttttcactggctctacactttcttaagttttgccatcctcatggaactgtcagccagcacaccgaaacgattctcagaaaacacaggcatcatcaagttctcagggttttggtagaaattgaaggtcaacagacctcagactcattcagaaatgcttagttgagccataacccttcataagcagtcacttgacaggtgacattttaaatctcctgtcatttactgtgtcattggcttacacttgttctcaggaaacattccagatttttcaccatgaaataaaaacacccatgtcaatgtaattcttgtcaagttactcagccttgtctctcaccacttactgcactctgccctttgctctagcccaaactggatggagtggaactctgcagggctcttcctcacctcaggctctttgcctttgcctcttccctctatctggcaagcttttccttgtctttcaggtatcaacctatgttatctcctccatcagaaagcccatgatattgacataaaagtgggtaggtgtcccttctgtgttttccagcagtgccctgctgtatacatgtcgtggtatctatgactctatatggacattacctgcctgtctgtttttttaggttatagcatatgactgttgagaggtggaccacaccatcttcatcttgtaattccagtgctggttctagtaccttggcacatggctgttgattacatgaatgaagaatgaaaaagctctgatgtttaaacacaattagaattaatgccatgtgtaaattattaaatagtaattttgtattgtaaatgtacatacatatttctcatacttattaactctgataaagttcacaactctttagtttttaaactcacactagttaactgaagtgttttaggtaaaggacataattctttatttttctttctagctgttgctgtgttggacacttgctc

SEQ ID NO: 751 - DNA, 54100 bp, Homo sapiens
ctgacctcggtgtgtgtgtgagtgtggtgaaaatcaagtgggagggaaagtgagcaagcacctgaacaaggtacagaggcgcgcgaggtagtaccataataccatctacaccaaggtctatactatccctggtctccgctgcgtccgccgggaggaggcggtgcaagaatgcgcacgcgcggccccgggcccggccacaccctcttccgccgctcccgcccagcgacctcgctcccggggcgacgccccgcgtgcgccagagtcgccgaggtcgtccccggcaccggaagtgaccctggcgggtttgtcttcaaattctcggcgagcaggagccgcgccggcaggtggtgttgacgattgaactgggcagtactggggccgtgagcggagagcaaagtgggctggactgggtcaggccctccttcctcgctgccgggatctccactccgccaatcccctgtgcctggcgttgggcggtttcccgaggagcttgggccgccgcaggtgagttttcactctggcggtgctctggggacccccgattttccagggccgggctggtgagggactcggggggcccacagcgagaacccgccgcgcaaccctccgtgagcctgcctgtgcctgagctgaggtcctaggtccttgctgttgtccacgataacttggcttaggtgacagtccccctacctgaggaatcctgtcaggcggaggacttttcgggggctcctgtcgatcccatcttttgatctgtgtcgttagcgaagtcaccagccgagtttttagttcttcgatttttcgactggttctctccagaacccgctcacgccccccaccccgaaaccctcacaggtaaaaatcccgatggccatgacattgggaggcaacttcttttcttaaaatttgttaggttcgagtgatattgttggggatgttatttcttatttattctagagcccggcgtcctctggaaggcctgtgggccttttggtttagagttggtaccttttagaaaagttttccctcgaaacagttgtttcatacaaatgtgatgacaaagttagagataaacgtagatcctgaagtgccttacagtggataatctcaagctcttatttaatcaaaaatagtttcctgttaaaaccgcgaagggccgcttttatattagttactaacttccaacagcacagtgatgctcttttctcttgaaagcactaatttacgtcttcctctttgaaattagacctctagttattgctgaaaacattcccgatgttttagaatgggtgcagtagatctttgtcacgtaatcacaatgataatcaccttagtagatgttaagacagattcttgaaatgtttttacgggcttaaatgtctcagtataaagccctattttcttttccaaaagagctgggttttgttcttttttttttttttttttttttttttgagacggagtcttgctctgtcgccaggctggagtgcagtggcgcaatcttggctcactgcaacctccgcctcccgggttcaagcgattcccctgcctcagcctccttgagtagctgtgactacaggcgcgctccactacgcgcggcaaattttttgtattttagtagagatggggtttcaccatgttggccaggctggtctcgatttccagacattgtgatccgcccgcctaggcctcccaaagtgttgggattacagacgtgagccactgcgcccggccggtttttgttcttataccaagaaataggagcaaaactttgttttgtattaacattaacaagttgtggcctgtaaatacctttaaaaaaaaaaacacgcagtagtgatcaacttcccaacattcctagactatgaaaagctatataaagcttctttatagcgttggttattcaagaagcgtttacatttttataggtaataggcatgctatgtagtccacaagggattctccacctcattttgaaactggtatcaagatgctgacaaatattgaggattagagaatcttgttgaattcactctattaacaacattgttgaatttctattaacaatagtttgggtttttttagccacttgactgtttaaaaaagatagtattatcacataaatatggtcagtgttgataacatgccaaatagcttttgcttgtggcgtttatcgatagggcttgaatatgacttttaaattacgttttaataattaaactcactgatttgtttgtttagggtaaactgaaagtttactgtacaaatagagtggactttatatgtactttttttctgaacaggttgctttttggtgtttttaaaaaatagtggtaactttcttgtgcttaagtatttatcatatgatggttataaaggtaagaaaaatgtatgccatgctgtaattggtcatgggtcattcatttattgtgcttattcgtaatcatcagtggctgactataaattagcatgtggtttctttcatatcccagagatgaacattctgaaaattacttaccaatgtatggccacttttgaagtcatatacacttgctttactgaaatgccttcaggaagatgcatgattgggcttcgtgatctttttgttttaggaggtaaattttacagagaggtatttaaaaaacactttcagccttccaacattgctgctgattttttagtctgtgtttaataatattctatgtttgtcttctcttactaagcaaagaaaacccacctagaataaataaggtgatatcccttctattaaacttcaaggatttcaaggtctaattctgtcttatttttgtcttcagtgcaattccttgcaacttagttggtgttcctttaatatttcttgaatgaatgacccatgcacattatgttaaaaaaaactgcaaataagtggagcccagcctgagtcctttaaaaattaaatgggtaaggtatcctctttaggtgtgaaataggcagggccctgtatttgttgtttagagagagaataagaatcttagaactcagatatttcaatattttgcctgttctttttcagtctctgtgatcacttctttttcctaatcctagaggagaaaaaaaaaaactttctctgtggagagacagcactgcatcacatactatattgctagaaaatttgctgtaaaattgcgatttcagtatttttaaaaatttgattctgtcacttgagttaaaatttcacattgcatcttgcttactctaagtaagttaatttagtcattagctaactcataaatactcaaggcatgtaagcaaaagggtggttctgttagaataatgtaaaggaaaaacttgctgtgaataaagcaggcatagtgtatggttatccttctctctaataatctgtgtaaccaagagcctgaattttggggcaatctcatctttataagtgttctattaatgttgaaccaatagattgtgtttatagttcatggtgcttacactgagtcagtcagcttttttttctttcttttttttttttttgttttttgttttttgagatggagtcttgctctgtcgcccaggctggagtgcagtggcgcgagcttggctcacttgcacgctctgcctcccggttcatgccattctcctgcctcagcctcccaagtagctgggactacaggcgctggccaccacgcccggctaattttttgtatttttagtagagatggggtttcactgtgttagccaggatggtcttgatctgacctggtgatccacctgcctcggcctcccaaagtgctgtgattacaggcgtgagccactgcgcgcggccagctttttatttcaaatggattcaattcttcaaatattgccagatattgtgcttaatacagccagtttctagtcttcctgcagtggaattttagcaatgataaagatatattgttgaaaattgggataatttcataaatttacagttgtgacattcgagaaggatgttttgggcttagagagtaataagggaatggggaaaattattttcggctaacaattagggaactaagagtgctttaatactattttctgcaagcacattgtttctttgataatcagggatttttcaagtcatttgttaatgtggccttggattagactttacattcatgtttgttagaaaatatcaattcattggcttctaaagaattttatctgactagaaagagttcaaaacatggaacctttaaagaaggcttggagggacttgtatgagttttgggccgttgaatcatggccctcaagaaaaaaacgaggaccacctatatataagtaacaacttaatttaaatttatttttattttattttattttatttttttgatacagagccttactcttttacccaggctagagtgcagtggtgtgatcacagctcattgcatctttgacctcctgggcttgggtgatcctcccacctcaacctcctggtagctgggactacaggtgtgccctgtcatgcccagctaattttttgtattttttgtagagacagggtttcactatgttggccaggctggtcttgaactcctgggctcaagcaatcctcccaccttggcaccccaaagtactaggattacaggcgtgaaccaccatgcctgactattttagattttttttagtgggaaaatgggaagaaagatctccagggagactattaaggaaaagagggagagaggctttcatgtcaaaagacatgaaaggcttttgacatccaagctcatctagaacaactatatacttttagcagcgggtcccaattatacttttctaacacccttgcccagactaggtgtctctgtagggcatggatggcttcagggcagaagtaatcacacaagaatcaagctgtaatcccagcttggaagggatgagctgaggatcaagaatgtgaccatgctgagggtcaggaactggacaaggttacgaactcttggtagttacaacaaaaacctggccaggcatggtggctcacgcctgtaatcctagcactttgggaggctaaggtgggctgatcgcttgagcccaggagttcaagaccagcctgggcaacatggtgaaatccccatctctacaaaacataccaaaaaaaaaatatatatatatattagctgggtgtggtggtacacatctgtggtcccagctactcaggatcagttgagcccagaagatcaaggctgcagtgagctgtaatggcaccactgcactccagcctgggctgcagaatgagaccctgtctcaaaaaaaaaaaaaaggacaacaactaggcagtattcagtcattcaaaggttgattgagatctacatttgaggacatggttctaggtgctagagatgtatcagtaaataacagagagatatggtccttggcctttaggcttttattaagatagaatatgatcagtggtcatgaatccagggaggcaagatttaggtgataggattttattccttttcttttggagctcagatgcccagtcttgagttactcatagaccttagttcatagctatattgcttcataacagattatcccaaaacttggtgacttaaaacaacagacattttttatctctttcactgtttcactgggtcaggaatttgggcatgacttagctggatgccttagattcagggtgtttctcagagctgtgatcaggtattggccaggcctgtagtcatctcaaggctctagtgaggaaagattcacttctgatctcactcacatggttgttggcaggattcagttcctcaggggctggtggactgagggtctcagttcctcactgattgttggcctggatcctgcctcagctctttgccacatgagcctctgcccaggcagctcactctgtggagctggtattccatttgagtggggccagcaagagacagcaagcaagatgcaagtcatagtctaatctcggaaatggtattatgttatttgttacaggcacacattcaaggggtagtaattatataagggtacagataccaagaggcaaaggtcattgagtgccatcttagaggctccctatgattatccatggatataaggcccttcttttgttatatttattttttgtttctctcctacttgtcataagcaatttctccactcacatattttcctcctcaccttccatagactctctaatatatttaaggtactttcttggatatgtatgcatcctttaaaaatgagtattttatatagcatatgtatttttaatttataaaatgacattgggatttagatcttgttctatgtctgagacctttttttagccaaccctgtattttgatgatccatccatgttgctatatgtaaattttattcattgcttctgtctgctacatggtaccatgtggtctgtatccaccatatttcccctagcagggaataaatagattgactctacttgatttctcaaagatttctgtcattaatgtccaaaaccaagttcctttgtggatctgtgtgagactttctctggaagatttacacaagagtgggattgctgggtcatggggtgtatatatacatatatatgtgtgtgtatgtgtgtgtctatgtacatatacatgcatacataatttccccaagtactgccagattgcactccaaaatgactatgccagtttattcctgcaaattgatgtaaagatttcctttttcccaaatccttgccaatacttagtatcattgcttttttgagtctggtaaataaaagaggtctctcggccaggcgcataggctcatgcctgtaatcccagcactttgggaggcccaggtgggcggatcacaaggtcaagagattgagaccatcctggccaacatggtgaaatcccatctctactaaaaatacaaaaattagctgggcatggtggtgagcgcctgtagtcctagctactcgggaggccgaggcaggagaattgcttgaacctgggaggcagaggttgcagtgagccgagatcacaccactgcactccagcctgggcaacagagtgagactctgtctccagaaaaataaaaaataaaagaataaaaagaggtttctcatggcttcagtttgtatttattggtcactcctgtctgtgcttgttagctgtttgggtttcccttctgtgaattgtcctttatgctctgtcctcattttcttgtgaggtacttttgtccattaatgtgaagaattacagtgatagattttctgatcttaagtcatccatgcatttctgggataaacccttcttgatcatgtggtgtgtgtcttgatgcattgtaggtaaactaatattaggatttccatgttcataagtgaaatgggtcttgtgttcttattcagttgagatgatttcagccacataaaaaagagttgctcagcttttctcttgttttctggatcaacttttatgtggttggaattatttctgtttagaagtttggttaaaaaaaaaccccaaggcaggccaggcgctgtggctcacacctgtaatcccagcactctgggaggcctaggcgggtagatcctgaggtcaggagattaagaccatcctggctaacatggtgaaaccccatctctactaaaaatacaaaaaattagccgagcgtggtggtgggcgcctgtagtcccagctactcgggaggctaaggcaggagaatggcatgaacccgggaggcggagcttgcagtgagccgagaacatgccaccgcactccagcctgggtgacagagtgagactccatctcaaaaaaaaaaaaaaacccgaggccagaccaggtgcggtggctcacacctgtaatcccagcactttgggaggccgaggtgggcagatcacccgagatcgggagttcgagaccagcgtgaccaaaatggagaaaccctgtctctactaaaaatacaaaattagccaggcgtgttggcacatgcctgtaatcccagctactcaggagcctgagtcaggagaatcgcttgaacccgagaggcggaggttgtggtgagccgagattgcaccattgcactccagcctgggcaacaagagcaaaactccgtctcaaaaaaacaaaaacaaaaacaacaacaacaaaaatacccgaggccaggcatggtggctcacgcctgtaatcccagcactttgggaggccgaggcgggcggatcacgaggtcccaagatcgagaccaacctggccaacatggtgaaaccctatctctactaaaatacaaaaatttagccgggcgtggtggatgcatggctgtagtcccagccactctggaggctgaggcaggggaatcgcttgaacctgggaggcagaggttgcagtgagccgagattgcgccactgcactccagcctggcaacacagtaagactccatctcaaaaaaacaaaaacaaaacccaaaaaaacccaaaaaaacccccaccatacttacagaaatcatctgggcctggagcttttttgtctttttttaatgttttcttgagacacagtctcactctgtctctgttgcccaggctggagtacagtggcactatctcggcttactgcagctttgacctccccaggctcaggtaatcctcccacctcagcctcctgagtagctgggactacaggcacacaccaccatgctctgctaatttttgtattttttgtagagatggggttttgccgtgttgcccaggctggtcttgaactcctaggttcaaaggttggattaggttctcatatatagaaagtttcatggcagacacatttaacatttattgaagacctactatttgtcaagtagtatgcttagtactttaaatagccatttattgtttatagcgtaactcctgaaagtagttgctatggcagttccacagatattaaaacaggcttagaaaaaagttaagggacttgattaaggtggcacaattataattctagccaagatttttctaacttcaaaatacatacgccttctgctaatccacactgcttcaaaaaatgtatctaatattcactatttattctgcagatgtttaataaaatgtgtgtcatgcaaggatcatatagtctcacacctttcagatgcaaatcctactgtcagataacagtctactagagataagacatatatagaaactgtaatttgaagtagacaagtgtcttgggatgaaagtcacagtaaagtgcaaggggactttagaggagggagagtttattttgaactgaggagttcagggggtagacatactaggaaaactgccatctgagctgggctttgacaatagggagggtttgaatgtgggaacttttttaaaacaatgttttaaatttattttattttatttttttattttttgagacagagtctcatgctgttgccaggctggagtgctgtggtgcgatctcggctcactgcagcctccgactccctggttcaagtgattctcctgcctcagcctcctgagtagctgtgattacaggcacgtgccaccatgcccagctaatttttgtatttttagtagagaccgagtttcaccatgttggccaggatggtcttgatctcctgacctcgtgatccacccacctcagcctcccaaagtgttgggattacaggtgtgagccaccgcaccgggcctgttttttgttttgttttgttaaacagagtcttgctccatctcccaggctggagtacagtggcacgatcttggcctactgcaacctctgctaccctggttcaagcaattcttgtgtctcagcctcccaagtagctgggactataggcatgtgccaccacgcccagctagtttttacattttagtagagacagggtttcgccatattggccaggctggtcttgaactcctggcctgaagtgagctgcctgccttagcctcctaaataaaatatttctttgaggccaggcgcggtggctcatgcctgtaatcccagcactttgggaggccgaggcgggcagatcacctgaggtcaggagttcgagaccagcctggccaacatggtgaaaccccatctctacaaaaatacaaaaaaaattagccgggcatggcggtgggtgcctgtaatcccaactacttgggaggctgaggtgggagaattgcttgaacccgggaggcagaggttgcagtgagccgagatcatgccattgcgctccagccggggccacagagcgagactccgtctcaaaaaaaaaaaaaaaaaaaaaaaacaatgttttttttaaaggagtgaaatagcatgagcacacatatagagatgggaagtgtggtatgtgtgattgtttcttgagggagccctggaaagtattttttaataactatacttatttttaagagacatgtaaacctaaagtgtttctttttttcttcttctttttagcttacagttgaacatgagtcttcttatgattagtgagaatgtaaaattggctcgtgaatatgcattgctgggaaactatgactctgcgatggtctattatcagggagttcttgaccaaatgaacaagtatctgtactcagtcaaagatacatacctccagcagaaatggcaacaggtgagagtaatggctgctgtatgttttaatggcttaagtactcggaagagaaaatttagatcagatgtcaatgctgtatgtagttacatgttaagactgtatgactaccgagcacagtacacagtggctcactcctgtagtcctagcactttggaaagccaaagcagaaggatcacttgaggccaggagttcaagtccagcctagacaacatagcaagacttcattctacaaaaataaaaaaattagccagatgtggtggtgtgtgcctgtagtcctagctactagggaggttgaggtgggaggatcacttgagcctgggagattgaggctgcagtgagctatgcttgtaccactacactccagcctgggcaacagagctagaccttgtctcaaaaataaaaaacaaaacaaaacatgagtatgtgagttattacacagatttctatataatattacttgacactttattatatgaataataatccactttcaccatcagcagtattatgagttctacttaattctaattgctggaatctaataagaggggttttttttgttttgttttttcctcgagacagagttttgctcttgtcatccagggtggagtgcagtggcacgatctcggctcactgcaaccttcacctcccaggttcaagcctcccgagtagctgggattacaggcgcctgcctccacacccagctaatttttgtatttttggtagagacgggctttcaccatgttggccaggctggtgttgaactcctgacctcaggtgatctgcccaccttgacctcccaaagtgctgggattacaggcatgagccaccacgcctagccaagagttttttaaaacaatggttttgacattttttgatcagatttttacttcgtaaaaatagagtagactttattaagccattgtcgaaactgtaaatggcttgtgaatctcacaggtaccatattttttaaaaaactttttgagagagggtcttgctctcttgcccaggagggagtgcagtctctacagccttgacctcccaggctcaggctcaaacaatcctcccacctcagcctcctgagtgggtggaaccacaggtgttccccactgtgacctgctaatttttcaatttttggtagagatgggatctccctatgtttgccaggctggtctcaaactcttaggctaaagtgatccttccacctcagcctccctaagtgctgggattacaggtgtgagccaccatgcctggcctcatattccttgtataatagaactttatgaagcagattatgttgaatcccattgagaaacttcagttactgaggactaacaaaaatttaaaattggaaattgtagaacttacaggtccagtggagggtggtatttctaacaaggctcaactatgtcaaagaggaaaaaaaggttaagaaaataagtcttgcggggcatggtggctcacgcctgtaatcccagcactttgggaggctgaggtgggcagatcacctgaggtcaggagttcgagaccagcctgaccaacatggtgaaaccccatctctactaaaatacaaaaaaattagctgggtatagtggcgggcatctgtaatgtcagctacttgggaggctgaggtgggagaatcacttgatatcagaaggcagaggttgcagtgagccgagatcgcaccattgcactccagcctggcaacagagcaagactctgtctcaaaaaaaaaaaatgaaagtaatagtctttttgaggtggtcttctagatagaatattatacctcagattctgctgagctgctttttaaatattgttcaatatttgtccttaatttttttgagagaaacagcctatctctttgaacttcatctattttcctatatctgtccctccatatcctttaccatatccatgtaattaccagaaagggcaactattttattttatttatcttttatttatttattttttacagacatggcatctcactatgttgttcaggctggtcttgaactcctgggatcaaatgatcctcttggctccgcctcccaaattcctaggattataggcatgagtcaccatgctcggcctagtaaatattttatttcataaggagtcttaagtttgtcagtgaaggactttttagatcttttgttgttaggccaaagacttttacttaagtctaagcttttgtttaaaggtacttaagattaaatcatttaagttataaagcaaaacattatcatcttaaatttcatttcaatattatatatatagtttatttttatttttattttttaccattttctggtttgttttcttttgagatggattttctcacttgttgcccaggctggagtgcaatggcgcggtctcagctcactgcaacctccacctcccgggttcaagtgattcttctgcctcagactcccgagtagctgggattacaggagcccaccaccacacccagctaatttttgtatttttagtagagacggggtttcaccatgtagccagctggtctcaaactcctgacctcaggtgatctgcttgcctcggcctcccaaagtgctgggattgcaggcatgagccaccatgcctggcctaccattttcttattgtggtaaaatatacataacactttactgttttttgtttgtttgtttgttttgagacggagtctcactctgttgcccaggctgtagtgcagtggcgcagtctcggctcattgcaacctctgcctcctggggtcaagtgattctcctgcctcagcctcccgagtagctggaattacaggtgtgtgccaccacacccagataatttttttgtacttttagtagagacggggtttttgccatgttggccaggctggtctggaactcctgacctcaggtgatctgccctcctcagcctcccaaagtactgagattacagacgtgagccactgcacttggccttggccatttttaagtatacagttcagtggcattaaatacatatataatgtacaaccatcaccatatatagtttttaggctgagttaagacccattactataatacagttgaatcaaaactatatataggtttttgagggttttttggaggcagagtctcggtctgttccccaggctggagtatggtggtgcaatcatggctcactgcagccttaactcctcaggctcaagcaatcctcccacccagcctccagagtagctggggccacaggcacaaaccaacatgcctggcttatattttttttagagatgggttattgttatgttgcccaagattagtttttaaattgcgtcaagattccttttctcttttatttttgaggtggagccttactctcaaaactagggccattttactgcattccagactggatgacagaatgagaccctgtctctaaaaaatatttgaaaaaaaaaaaaaagactgcttttaaaaaaataccttggttgcatatgaattgagacctattttagtctgtaggttgtgacccattagccataaaattagtatattctgatcagtgttgtattgatttttagaaattatttactgatatataatagttgtacatatcttgggcatacacattatattttgattcctgtatacaatatctaatgatcaaatcagggtaattgggattaatcagcattttaaaagttaattaaacagaataaaaattatcaaagtagggctgggcatggtggctcacacctgtaatcccagcactttgagaagctgaggtgagaggatggcttgaacccaggagtttgaggttatggtgagctatgatcgtgccactgtagtacagcctgggcaacagaatgaaaccttgtctctaaaacataaaaataaaagtttgacaaaaatgaaactttcacaagttgtgctttgatggttttttttcccccttgggctcaagcaattctctcacctcagcctctaaagtaggcaggactacaggcatgggccaccatgcccagctaattattcttgtagaactttaaagttatgcctaacttttcaatttgttatgcaatttattttattttattttattttattttattttattttattttatttttttgagatggagtcttgctctgttgcccaggcaggagtgcaatggtgcgatctcggctcactgcaacttccgcctcctgggttcaagcgattgttgtggctcggcctcccaagtagctgagattccaggtgcccgccaccacacccagctaatttttgtatttttaatagagatggggtttcaacatgttggccaggctggtcttgaatgcctgacctcaggtgatctgccctccttggcctcccaaagtgttgagattacaggtgtgagccaccgcgcctggcctgttatgcaatttatttatttatttatttatttgagccggagtttcactcttgttgcccaggctggagtgcaatggtgtgatctccggcttgccgcaacctccgcctcccaggttcaagcgattctcctgcctcagcctcccgagtagctgggattacgtgcatgtgccaccacacccggctatgcaatttaaataagaatataaattagtagtatgatttagttagcctggattttttttttattttttatttttttgagacagattcttgctatgttgcccaggctggagtgcagtggcgtgatcttggctttctgcaacctccatctcctgggctcaagagattcccctgcctcagcctcccaggtagctgggcctgtaggtgcctgcccccatgcctggctaactttttgtatttttagtagagatggggtttttaccatgttggccaggcttgtctcaaactcctgagctcaagtgatccatctacctcagcctccctaaagtgctgggattacaggcgtggatgtttcctatcctggatgttttaattcattttatcagaattaattttgcaattgagggccgagcgcagtggctcacgcctgtaatcccagcattttgggaggcctaggcgggtggatcacgaggtcaggagatcaagaccatcctggctaacatggtgaaaccctgtctctactaaaaatacacaaaattagccaggcgtggtggcgggcgcctgtagtcccagctactcgggaggctgaggcaggagaatggcctgaacccaggaagcagagcttgcaatgagccgagagtgatcacgccactgcactccagcctgggcgacagagtgagactccatctccaaaaaaaaaaaaaaaaaaaattgcaattgaaaacataaatttaataaactgttattaacattttgatagaatatcttgatgtggtttactggatatctgatatcaaaatggagttttgtaacatctctagtaaatggccctcatttaattttgacagtgatatattatagaaatttaaacatccatcttcttctttgaaatcaggtttggcaggaaataaatgtggaagctaaacatgttaaagatatcatgaaaacactagagagctttaaactggacagcactcccttgaaagcggcacagcatgaccttccagcttctgagggagaagtctggtccatgcctgtacctgttgaacgaaggtaagtggaaaccttttaagaaaccagttatcccaagaagcttatagcattgattatatttaggaggaggatggggtggctgagagacaggaatgggagggagttttctttactgaacgttctctcttttataactcactggtcttgaaccttgtgcctttttgacctatttcaaaaaataagatttaggtaggaataatttaaaaatatgcttttgtgaatgaccttacagtggtagagacagtgttatcttgtggaaggagaatggggttaggaattgaaatatccaagctccgtgtctgtctttgccactctctgtagctttgggaaaataataaaacctttttaggcctcagatttttcttttttttcttttttttttttttagacagagtctcactctgtcacgaggctggagtgcagtggcacgatctcggctcgctgcaatctctgcctcccgggttcaagtgacttccctgcctcagcctcctgagcagctgggactacaggcacacaccacctgtattttagtagagacggggtttcaccatgttggccaggctggtctcgttctcctcacctcgtgatccacctgcctcagcctcccaaagtgctgggattacaggcctgagccaccgtgcccagccaggcctcagatttttcttacgcaaagagaggaagttagactaacagtggttctcaaacagggatcacagaatacttcttttcatcaagctataatgaaaaatggaaaatttttctaaatttgctaaaattgaaaaaattggctttttaattcatagagaacagtaaaaataaaatgttctgaattttagggttttctctggctttttttccccaacttcctactaccaagtgccagcagatgaacaactagtgatactgatatttactgaaatactgtaactagccaatcatgcatagttttactgcacatttttcaactgacaagtgtgcaggtggatgttatctatttcacttacataatagatttcctagtttgtattatagatttaaatattgactgtgtcatgcctttctagaaagaacacttatgacttcccaggttcattgcccgttaaccttgcattaagatgttgatcagattgttttcagttttaacattttgtcattgcaactctgattacttgtgtttttttttgttttttttttgttttttttgtttttttaagactagttaagggcagtagtgagaaggaggggaagaatagaacaaggagtttgatctgtaactgactgtgaacaatcaattgagataactcactacattcggaccagccttggttacattttattttattttatttatttgttttttgagacggagtctcactctgtcacctgggctggagtgcagtggcatgatctcggctcactgcaacctctgcctcctgagttcaagcaattctcctgcctcaaccccccaagtagctggaattacaggcacctgccatcatgcccagctaattttttgtatttttagtagagacagggtttcaacatgttggccagactggtctcgaactcctgacctcgtgattcacccaccttggcctcctaaagtgctgggattacaggcgtgagccaccacacccggcctggttgtattttataatacaggtactgcattatacacccacagtgtcctgaactattttaggctataggtgttattttattgcaataagccttccaaataagtcatattttccctgtatttcagataagacagctgaggtacaataaggttgggtaacttttccccactatcacaaaactgataaatggtagagctaggatttgaacctagatatattgtgttttataataatgattacaaagctggcactctctgctgtagcagtcctaacaatctctaattaaaaacgtggatttaggggcatcactcccagagagtctgatatggtagatagcaggtagaactcaggaatctgccggtgattctgatgtcggtggtccataggccacattttgagaagacccataccatcatgttcttgacatttaaaatcaattaatgagtactgattatttcttagccacttttatttttatttttattttttttgagacagagtcttgctctttcgcccaggctggagtgcagtggcgctatctcggctcactgcaacctccgcctcccggttcaagcaattctcctgtctctgcctcccaagtagctggaattacaggcacgtgccaccacgcccggctaatttttgtatttttagtagagacggggtttcaccgtgttggccaggctggtcttgaactcctgacctcaggtgatccactcgccttggcctcccaaaatgttgggattataggcgtgagccaccgcacccagccgcaacttttattttcttaatctccacataaaaggactgtactaatgttctgttactgactcctgatatcctttggatatttactaaatttttcccttgcctcatacgcactttcacataattacatttcttgttatagtacataatagttcactaaagcacagtagctcattaaagaaaaatagaaaaattcattgaagtagggggaaaatcacatagtcatcctagcttgtttccttctgttcttttatgcattattttcatagttgcaggtgtgctatatccataatttacaacattgtaccctcttttaagaaaaatcctaataatagtcaacaatcattgcatattactgtgtgccaggtactgtgtttgttgttttacatgtattatttaattctcaaaaccaccttagaaggtaggtactaatttttttagccccaatttctgatgaggataagctaagataggttaagtaatttgctcttcatattttaaacatttatgatttatataccatgtcagatctttttctctgcagttttttaagagttatttgccactgttctgactggtatgtaacctatatatagttaaccatgctcttaatgttttttcccttcttttttcattattataaataaagttgcactgaatggttgtaaaaatttttccacatttataattttttcccctaatttcagaagtagaactaatagatgagtcaagttgtgtttttgcttttgtctgttaatttgttttattcttatttacttgctcttttctccttctggagaatcatcacttgggtcttgtattagtctgcttgggctaccacaataaaataccatacactgggtggcttaaacaacatacatttgtttctcacacttctggaggccgggaagtccaagatcaagatgtggccaatttggttccaggtgagggctctcttcctgagcagacagccaccttctgtctgtgtgctcacatgacagagagagtgagtaagctctttcacatcagggactcttacttacttccttactcctaatattcatattgcgcactggggctttaacatatgaactttggggaggacacaaacattcagcctctaacagtcctgtaactcctctcagttattggtaagatctttccaacaaatagatgttcccagtgggaaatcagttgattctgaatttaatgaagtatttggtcacctcagtctcacaagcagagagggaggatttcctctgaggggtggtgggaagttaagccctaaatggtgttccttcttattgcttctcgctttcttctgtatcgttttctgttcctgattttgaatgctctagattactggtaagttttcctctttgactttatttgtggcatctgtttcttcctataatttattttacttgctctcttaactgggcatcttttaatattctttttatttttctattagtctttatttgtactcatgcttaagagggtcattcttttttttttcttttttttttttgagatggagtctcgctctgttgcccaggctggagtgcagtggcacaatctcagctcactgcaacctctgcctcccaggttcaagcaattctcctgcctcagcctcccatgtagctgggactacaggtgtgtgccaccatgcccggctaatttttgtattattagtagagacggggtttcaccttgttggccaagctgatctcgaactcctgacctcgtgatccacctgccttggcctcccaaagtgctgggattacaggcgtgagcctatgctcccggccgagagtcattctttcttcacctatgttggtgatcctaaccttatgatcagctaaattttagtaccattaaagaacagattcaactgatccagtattctcttctagaattgtacacaaaaaatgtgagtacaggccaggcacggtggctcacgcctgtaatcccagcactttgggaggtcgaggcgggcggatgccaaggtcgggagttcgaaaccattctgcctaacacagtgaaaccccgtctctactaaaaatacaaaaaaaaaaaaaaaaaattagccgggcatggtgacaggcacctgtagtcccagctactctggaggctgaggcaggagaatggcgtgaacccaggaggcggagcttgcagtgagccgagatggcgccactgcactccagcctgggcgacagacactccgtttcaaaaaaaaaaaatgtgagtacaaggaggttcattaaagccttatatagaaaaggttagacatagcttaaatgccactagatgtgacattcttttcaaatgtcagctgatgtccctcaaatatcttcccatctcacagaataaaacccagagttttcatgtctttcaagccctatgagacctggttccccacagcctctggaacctaagttcttacagctctctccctcaggcactgtgctgtggccttgaacaagcccagcccacaaatgcttcactcctttcacctgcctttccctcagctccagtgctgaatgacctgttcccttctttcatttaggtctctactcagttgtcacctcagaaagtctgtctctgactttgccacctaaaaaccacccctgatgatcctgtagcccctttcccttctctttttttttgagacagagtctcactctgtcacccaggctggaatgcaatagtgcatctcagctcactgtagcctccacctcctgggtccaggcaattctaatgcctcagcttcctgagtagctggaataattacccaacaattttttttttttttttttttttgagatggagtctcactctgtcgtccaggctggaatgcagtggtgtaatcttggcttactgcagcctcccaagtagctgggattacaggcatgcaccaccacgcccagctaatttttttgtatttttagtagacagggtttcgccatatttgccaggctagtctcgaactcctgacttcaagtgatctgtccgcctggtcttgaactcctgacctcaagtgatccacctgccttggcctcccaaagtactgggatcacatgtgtgagccaccacggccagccaaatttttgtatttttagtagagatggggtttctccatgttggccagacgggtttcaaactcctgacctcaaatgatccacctgcctcagcctcaaagtgctgggattacaggcatgagccaccatgcctggcccccttctttattcttcttgatagcacttaatattacctgatgtactgtttcatgcactgcttatacacacacacgtatgtaagtctatgacagtaagggttgttgttgaaattattattattattttttaagatggagtctcactctgttgcccaggctggagtgcagtggcatgacctcagctcactgcaacctccgcctcccgggttcaagcgattcttccgcctcagctttccaagtaactgggattataggcgcctgccaccaggccaggctaatttttgtatttttagtagagacggggttttaccatgttggccaggctgttctcgaactcctgacctcaggtgatccacctgcctcagcctcccaaagtgctgagattacaggcgtgagccactgcgtccagccagatggtgtatatttgcacataccctgcacacatcctcctgtatgctttaaatcatatttagattacttgtaacacctaatacaatgttatatgtaacattgtatgtaaaagtaaatgttggccgggcgcggtggctcacgcctgtaatcccagcactttgggaggccgaggcgggcggatcacgaggtcaggagatcgagaccacggtgaaaccccgtctctactaaaaatacaaaaaattagccgggcgcagtggcgggcgcctgtagtcccagctactcgggaggctgaggcaggagaatggcgtgaacccggaaggcggagcttgcagtgagcggagatcgcgccacagcactcccgcctgggcgacagaacgagactccgtctcaaaaaaaaaaaaaaaaaaaagtaaatgttatataaatagttgtttcactatattatatagagagtaatgacaaaaaaaggtttgtacatgttcagtaccgactcaaccatctttattttcaaaatatttttcattggcaattggtcgactccacattgtggaatctgcagatatggaaggccaactatactttattatatgtcagtgtctattttgtattatttctctagcaaagggaaaaatacatacacagaaatacttcctgaatccaaaattgaacccccatcattgcttcacatacacgttagtttggtgttatcatcctcccaaattctcattctcaactttccacatctgggagtgtcttttttttttttttgagatggagtctcgctctgtcacccaggctggagtgcagtggcgtgagctcggctcactgcaacctctgcctcctgggttcaagcgattttcatgcctcagcctcccaagtagctgagattacaggtccacagcaccatgcccatctaatttttgtatttttagtagagacggggtttcgccatgttggccaggctggtcttgaactcctgacctcaggtgatccacctgcctcggcctcccacagtactggaattacaggcgtgagccaccgcacccagcctaggagtatcttttctttctttttgagacagtcgtggtctgtttcccaggctggagtgcagtggtgcaatctcggctgactgcaacctctgcctcctgggttcaagtgattcttttgcctcagcctcctgagtagctgggattaccagtgcgtgccaccacacccagctaattttttgtatttttagtagagatggagttttgctatgttggccaggctggtctcgaactcctggcctcacatgatctacccacttcagcctcccaaattgctgggattgtgagccaccgtgcccggcctgaagtgtctttactactagagtgtctctgagactcttctcattgttactcccttaaactaggccctcatctcatgtctcagtgatatttgtaatcacaaacatctcactgctttctgtgttttctttatcagtatatcatgttcagtattagactaatctttctaaaatgttttcagtggatccttgttggcagttagctaaaagctaagcctcttgaactggtattcatatcttctatggaccgaaccatttctgctcagtattatcacttaatgttcagcattatgtgttagactggtgtctttattatcctttacatggattaagctcatttttgtttctttgcttttctttactgatgttctgtctataattgtaccctcttgtttagttcaactcctgcatttccagtcccagtttcttttctgtcttcatgaggccattcccattgccatggtgctaggtctgtttcacaccatctagtatacgtgcctagctttacatagcttctgtctgtttaactatactgtggtttatttgagaataggactccttttttgtttgtttgttttcccccttgtaaatggctgcaaccaaatctgggagcagagtaggagcctaacagatatttgagaagtctgaattctgttatagaaataaggatgaaatgaggaccaacacaggggctcacgcctgtagtcccagctctttgggaggccaaggtgggaggatcgattgagcccaggggtttgatactagcctaggcaacatagtgagaccttgtctctacaaaatacaaaaattagccttgtgtggtgccatgtggctgtagtccttgctactcgggaggctgaggtgggaggattgcttgagcttgggaggtcaaggctgcagtgacagagcaagaccttgtctcaaaaaataataataataaaaaataaatacataaaggtgaaatgaggtgatgtatgtaaatgtaaagcactgaacatgagttctagtaactgttcatagctagtgctatatcagttttttaaatgggaaaatgattaaattttattaattaaaacacaaaaattatggtatagattgagcttccctgatccgaaaattcaaagtgtttcaaaaactgaaactttttgagcaccaacatgacactcaaaggtcatgccaaaggaagtgctcattgggacattttagattgtggattttcagattagagatgctcagctggtatgtatatggaaatattccaaaatctgaaaaaatccaaaattcaaaacacttctggtccccagaattttgaataagggttactcaatctgtatattctaaataaatggtaccaaattacatacataccattggataaatgtgaattgaatacttgtattgtattctggttgtctcgataaaactctcttctctgataattttttttcagtttccaacaatcagatgcattcatctttgatatacaacaatttcctttctaagtagaggtgaccattacttcccctccattatttctgtaatataactatactgcattcctttaattaaatcaccaacagatatatcagatttaaattttattttatttttatttttttgaaacggagtctcgttctgttgcccaggatagagtacagtggcatgatcttggctcactccagtctccacctcccaggttcaaacgattgtcctgcttcagcctcccgagtggctgggattacaggtgcacaccaccacgcctggctaattttttgtatttttagtagagacggggtatcaacatgttggccaggctggtcttgaactcctgacctcaagtgatccacccaccttggcctcccaaaatgctagggttgcaggtgtgagccaccgcgccttgcccagatttaaattttagatcttaggtttcaacatcctgaagtttattcagtcgtgtcttgtgttcagttgttgcattggcttctttagttcatagactcttaacttacacagtatgtgtgttcatccatatgtggagttgattatgatattaatgagtttttgtttgattagaccctcaccaggacctagaaaacgccaatcttctcagtacagtgaccctaaatcacatggtaatcgtccaagtacaactgtcagagttcaccgttcatctgcacagaatgttcacaatgacagagggaaagctgttcgttgtcgtgaaaagaaagaacagaataaaggaagagaggaaaaggtaaatgttaattgatttttataaatgaaagttatttttgaaccgtaaaaatgaagactgtacaaatttatttattttttctttttttccttttttgagacagtctcactctgtcacccaggctggggtgcagtggcatgatcttggctcactgcaacttccacctcctgggttcaagcaattctcatacctcagccttccgagtggcagggattacaagtgggcgccaccacatcgagctaattttgtattattagtaaagatggggcttcagcaagttggccaggctagtctcgaactctttacctcaggttatctgcgcgccccaccccccgcccccctgccaggcctcccaaggtgctgggattacaggtgtgagccattgtgcccagcccaaatttcaataagctgtagtcatcagtttgccagcgctctaataaaaccttagttatactacatctaggctgggattttccccacttgcaattcaacaaatattttggctttttttggtaactttatattgtgatataatttcagactagcagacaatttgcaggaatggtataaggaacttccatatatactttacctagttttaccaattattaatattatgccccttttgacttatcattttatttttctgtatacccttttcctgaaccatttgagactaagttgtatatataatgctcctttaaccttcaatatttcagaatgtatatcctgagtactaagacattcttttacgtaaaaacaacacaattattggctaacacagtgaaaccccatctctactaaaaattagccgtggtggcgggcgcctgtagtcccagctactcaggaggctgaggcaggagaatggcgtgaacccgagaggcggagcttgcagtgagccgagaccgcgccaccgcactccagcctgggcgacagagcgagactccgtcttgaggaaaaaaaaaaaaaacaaaaaaaacacagttatcaaaagctgtaaattttacattgttatagtactgttcatctaatccacagacctttataaaattttgccaattatcccaataatgtcatatagagatttccccccttctgtccccgctaggtcagattacaatgtagaaggacacatcgaatttagttatcatgtttctttagccccttttaatacaaacatctcagcttttgcctttctcggactggaatttttgaagaattcaggccagttattttgtggaatattcctcagtttgggcttgcctgatacttcctcaggattagattaagattattcattttttttttttggccgggcatggtggctcatgcctgtaatcccagcactttgggaggctgaggcgggtgaatcacttgaggccaggagctctagactagcctggccaacatggtgaaaccctgtctctactaaaaatacaaaaattagccggacatgttggcaggcacctataatcccagctactggggaggctgaggccagagaatcacttgaacccgggaggcggaggttgcagtgagctgagatcacaccactgcagtctagcctgaccaacagagcgagactcagtctcaaaaaaaaaaaaaattattcatttttggcaggcataccattggtatgatggtttttttctctcagtgtatcatataagaaggcacagggccgggcgcggtggctcacgcctgtaatcccagcactttgggaggccgagttgggcggatcacgaggtcaggagatcgagaccatcctggctaacacggtgaatccccgtctctactaaaaatacaaaaaaattagccaggcgaggtggcaggcgcctgtagtcccagctactggggaggctgaggcaggacaatggcttgaacccgggaggtggagcttgcagtgacctaagatcgcgccactgcactccagcctgggagactgagtgagactccatctcaaaaaaaaaaaaaaaaaagaaggcataggatttctgtttgtcctattactggtgataagttggatcgcttggttaggtggtgtctgcttggtctctccacaataaacttaccatttgacccttgtaataatttgtgggaagtactttgagactatgtaaatactctgtttctcatcaatatctcatctgctagttttagcacccagtgattcttgtctgaatcagctatttctgcactgactgcaaaatcataattttctaatgccagtgttgcttctatattaattataaaagctgagtgtagatgttgctttggtttttaaaaatttttgtttgttatttttaatttgacacataataatcatacatatttatggggtacactgtgataattcaatacacatatacaatgggtaatgatcaaatcagagtaattaacatatccatcacctcaaacatttatcatttctttgtgttgggaatattcaaaatctgttcttctagttatttgaaaatgtaccataagttgtttttaattacagtcacctggctgggcatgttggctcactcctgtaatcccatcactttgggaggccaaggcgggcagatcacttgaggtcaggagttcgagaccagcctggccagcatggtgaaacactgtctctactaaaaatacaaaaaaaattagccggggtggtggcacacacctgtaatcccagctacttgggaggttgatgcaggaggattgcttgagcctgggaggcggagtgagccaagatcgcgccactgcactccagcctgggagacaaagtgagactctgtctcaaaaaaattaaaaaataatagtcattacagtcaccctatagcactatagaacactagaattcattccacctatctggctgtacttttgtatttgttaaccaatgtctgatacacccaccttcccctacccatcccagcctctagtaaccattattgtactctgtacgtctatgagatcaacttttttagcttcgtcatgagtgagaacatgtgttatttatctttctgtgcctgccttatttctctgaacatgatatcctccaaactcatccatgttgccatgaatgacagaatttcattcttttttgtggttacgtagtatttcaccatatatatgtatgtatgtatgtatgtatatgcatgccacagtttctttattcattcatctgtcgataggaacttaggttgattccatgtcttggctattgtgaatagtgtttataatagtatggcggttccttaaaaaacaaaaactagaactaccatataatctagcaatcctgattctgggtatatccaaaggaagggaaatgaatatgtcagacatatctgcactcctatgttcattaatcctattcctcccatgaggaacctccatactgttcatagtggctatatcatcttacatttccaagaactttgtatatgaattctttctctaaatcctcaccagcatttgttagtttttgtcttttttttttttgtggagacagtctcactctgttgcccaggctggagtgcagtggcatcatcttggctaactacaacctccgcctctcaggttcaagcagttctcatgcctcagcctcctgagtagctgcaactacaggcacacgctaccacgcctagctaattttttgtattttagtagagacggggtttcaccatgttgcccagtctggtctcgaacccctgagctcaggcagtccacctgcctcagcctcccagagtgctgtgattacaggtgtgagccaccacgcccagcagtttttgtctttttgcttacacccatcctaattagggcaagatggtatctcatggtggttttgatttgcaattccctgatgattagtgacattgaggatttttttttcatatgcctcttgaccatttatatgtcttcttttgagagatgtctattccaattcatttacccattttttaattggattatttgtggggggttttttgctcttgtttgagttctttgtatattctggatattaatcccttgtcagatgaatagtttgcaaatattttctcccattctacaggttgcctctttattcttttaattgttgcctttactgtgcagaagcattttagttttatataatcacatttgtttagttttgcttttgttgcctgtgcttttgaggtcttcctaaaatcttggcccagaccaatgtcctgaagcatttctcctacatcatcttctaataatttcatagtttcaggtgtaaacgtttatatctttaatttattttgagttggttttatatatggtgagagttagggggtctagctccttatttctgcaaatggatatctagttttctcagcaccacttattaaaaacactgcacttgctccagtgtatgttcttggtgcttttgttgaaaatcagttgactgtaaatacatggatttccggattctctattctgttccattggtctgtatgtctgtttttatgccagtaccatgctgttttggttactagagcattgcagtttagggtcaagtagtgtgatgtctccaactttgttccttttgctcaggatctctttggagtcttttgtggttctccttttctatttcttttttttattttttttttgagacgaagtctcgctctatcacccagtctggagtgcagtggcaggatctcggctcactgcaacctccacctcccggattcaagcaattgtctctgctcagcctcctgagtagctggagttataggtgcccactaccatgcccggctaatttttctatttttagtagagacggggtttcaccatgttggccaggctggtcttgaactcctgacctcaggtgatccgcccgtctcaacctcccaaagtgctgggattacaggagtgagccactgtgcccaaccaattttttttctttctttctttttccttttttttttttttctgagatggagtcttgctctgtcaccaggctggagtgcagtggtgcgatctcagctcactgcaacctccgcctcccaggttcaagcgatcctcctgcctcagcctgccgagtagctgggactacaggcatgtgccaccatgcccagctaattttatatatatatatttatttatttatttattttattatttatttatttatttatttatttatttttggagacaagagtttcactctgtcaccctggctggagtgcagtggcacgatcttggctcactgcaacctccacctctcaggttcaagcgattctcctgcctcagactcccaagtagctgagactacaggcgcaggccaccatgcccagctaatttttgtgttttttagtagagacggggtttcaccatattggtcaggctggtttcgaactcctgaccttaggtgatccacctgcctcggcctcccaaagtgctgggattacaggcgtgagccacctcgtctggcaatattttgtatttgtagtggagacagggtttcaccatgttgatcaggatagtctcgatctcttgacctcgtgatccgcccgcctcggcctcccaaagtgttgggattacaggcgtgagccactgcgcctggccagtgttttatagtttttagcacatgtcatatatatgtcttgttagcttttatacctaagtatttcatttttgtaatgattgtaaacagtgatgtatttttaatttcagtctgtatgttaattgttaagctatagaaattcaactgagttttaaaaattatttattttttaaaagttgtggcaaaatatacataacataaaatttaccatttaaaatatttcaagtgtgcagttcagtggtattaagtagtacattcacatgttccactagttgtggaatcatcactactgtctatccacagaacattatttatttttcagaactgaaacactacacccattaaagtcatcattcttatcattctccccttcatcccagaccttggtaaccaccattctgtttctctatgaatttgactattcgaggtacctcatctgagtggaatcatacagtattttcccttttgtgacttacttgttttacttagcatagtgttttagggattttgccatgttgtagtatgtcaaaatttccttcctctttaaggctgagtgctattccattgcatatatatttcatgctttgtttatcattcatttgttgatgtacacttgggttgctgtcactgtttggcttttgtgaataatgctgctttgaatatgagtgcacagatatttctccaagaccctgcttttaagatttttggatatatacaagaagtggatttgctgggtcatatggtaattccatttttaattttttttttaagacagagtcttgctctgtttcccaggctggagtgcaatggcgcgatcttggctcaccgcaccctccgcttaccgggttcaagtgattctcctgcctcagcctcccaagtgtctgggattacaggcacccgccaccaggcccgactaatttttttagtagagatggggtttcaccatgttggccaggctggtcttgaactcttgacctcagatgatctgcccgccttggcctccaaaagtgctgggattacaggcataagccactgcatccggcctcatttttaattttttgaagaatgacaaaactgttttccacagtggctgcaccattttatattcctaccaggattacagtttctctacatcctcatcaatgcttgttattttcgggtttctttgataataaccatgtaattgggtgtgaagtagtatctcattgtggtattgatttgcattttcccaatcatatagttgacatttttcccaataatatagttgacttttttgcatatagtaaaatgcacataacataaaatttaccattttaacggtttttaagtgtacggtgcagttgtactaagcgtatcaacattgctatgcagccatcacaaccattcattttcagatctcttcatcttgcaaagctgaaactctgtactcattaaacaataactcaccattcaccctccctgcagcccctggcaaccaccattctacctcctctctctgtgaattcggctacttatgtaagtggatcatatggcatttgtctttttgtgacaggcttatttatagccgtccctgctatctttaggttactgtttgtgtggagtatcttttttcattcttgcacttttaacctatttgtgtgtctagatctaaagtgtctcttgtagacaacatataattggttcatgtttttttattttaaaatttattttattaattaattttagagacagggtctgactgtgttgcccaggctggagtacagtaaatattcacagtgtactatatcataatgcactaaagcctcaaactcctgagttccagtgatccgcgcccctacccagcctcccaggtagttgagactataggtgcacaccctgtcagttttttgtccgttctgccagtttgtcttttgatgggagggtttaatccatttaagccaattactgataaggagggacttctgttatttcagtctttatatgcctatctgtctttttccttaattttctacattactcgccggggatggtgctcatgcctgtaatcctagcactttgggaggccaagacaggcagattgcctgagctcaggagttcgagaccagcatggacaagatggtgaaagcccgtttctactaaaatacaaaaaatcagccaggcatggtggcgggcacctgtaatcccagctactcaggaggccgaggcatgagaatctcttgaacccgggaggcagaggttgcagtgagccaagattgcaccattgcacccccagcctggacgacagagcaaaactccatctcaaaaaaaaaaaaaatcaaaacaaaaaaataattttctacattactgtcttcttttgtgtttagttgtttttttttttttttttttttttgagacagagtcttgctctgtcacccagcctggagtgcagtgacacaatctcagcttactgcgacctcagcctcccaggttcaagcgattctcttgcatcagcctcctgcatagctggaattacagatgtgtgtcaccacacctggctaatttttgtatttttagtagagacggtttcaccatgttggtcaggctggtctcgaactcttgacctcaagtgatccacccgcctcacctcccaaagtattgggattacaggcgtgagccactgcgctaggccatttagttgagtttttgcagtgaaatgttttaattcccttctcattttcttttgtgtatatttgtatattttatagctgttttctttgtggtctccatgtttctcaggctggtatatggtggcaggatcgtagctacttgtagactcaagtttctgggctcaagcagtcctcccaccttagcttcctgagtagctgggactacaggtgtacacctccaagcttggctgatgttttcatcttttttgtagagacagggtctcactgcattgcccaggcttgtctcaaatcctggccttaagcaatccttgcatttcagcgtctcaaaatactgggattacaagcatgagccaaccatgtgtgactcacagagactttaaaaattcccgtgtgtggttacttttgaatttcctagactttaaatgtctatttccccaaaagggaaaaaagagaaaaatgaaggggatgggggaaataaaaggtcggtggccctttaactctcctgaagttgcttcagcctgaaggggaagggcttgcaacaatgggaggaggggtgcaaccatagctgcccctgtgactgcaaggtcagaagctgcattcggcaatcaaaacacacatacctagtttttggaggacagggtcctttttgaccatcctggctcctgtgaactgcctgcagactactccaggagcacgtgtacagttgcctactaagggcctacgggctgagttgtttattccattttgtgctgctatcacagaataccacagactgggtaatctataaagaacaggatttttttccctcacagttctggaggttaggaagtccaagatcagggtgctggcatgttcagttgtttggtgagggctgcatcctctggagtagaggaacactttgttctcacatggctgaaggaataagagcaggaaatccaaatgctgtgtgatacctctttgtaagggccttaatcccattcatgaggaaggaacccttgtggcataatcccctctcaaaggcccaacttttaatactagcacattagctactgagtttcaacaccttgcttttggagggacacattaaaaccatagcagtagctgggctgaaattaaccagaattaaccataatttgtcatttactatccaggtttccccctggaagttgcagtcctcccaatagactccagagttcctaaatagttgcatcaaacagattctgcaggtgcagtttttgtttaggtggaaatacagattcttgatgcttcctactctgtcagtcttccacgatcctgtcccaataattgatttttatatgtttatcttctatcttgtcagcttaatactatgctagaattgttcattctaggagaatttttgtagattccttagtattttctgtgtggacaattatgttatctgcaaatatttctgtatttttggatttctatgccttttatttcctcttcttaccttattgcattggctagaacttccagtactatgtcaaatatttaagagtgacaaagtagatgtccttgctgtgttcctgttcctgattttaggaggaaagaattcaatgtttcatcacagagagtataatgttagctgtaggtgaggtgtttttgtagatgttcttttttttttttttttttttttttttttttttttttttgagacagagtctcgctctgttgcccaggctggagtgcagtggcgtgatccccactcactgcaagctccgcctcccgggttcacgccattctcctgcctcagcctcccgagtagctgggactacaggcgcccgccaccacacccagctaattttttgtatttttagtagagatgaggtttcaccgtgttagccaggatggttttgtggatactctttatcaggttgaggatattccctttaaattctatttttctgagagcttctgtcctggataggtattcagttttagcacatgcttttctgcgtttgttgcatgatcacatgggtctttttctttagtctcttaatatagtggattatattgattaatttttgaacattgaactagtcttatgtccctggaataattctcacttggtcatggtatgtaattctttttatatcttgctgaattctatttggtaatattttgttaacaatttttgcatctgtatattcatgaatgatactggtctatagtttttcctttgttttgttttttggaactgtcttcatctgatttcagtatcagggtaatatagccttttataaaatgaattgagaaattttccttctgtgctctggaagagtttgtgtagaattgatttaattcttttttaaaaattttttttgagacagggtctcactctgtcacccaggctggagtgcagtggcgcgatcttggctcactgcaacctccgcctcctgggttcaatagattctcgtgcttcagcttcacgagtagctggggttacagatgcgtgccaccacgcctggctaatttttttgtattttagtagagacagagtttcaccatgttggtcaggctgatcttgaactcctgacctcaggtgatccacctgcctcggcctcccaaagtgctgggattataggggtgagccaccacgccgggccttaattcttttttaaatgtttctacaatgaaactacctgggcttgaatatttctttaaaactatgaatcaccttcattaatagttatggtactgttcagattatcttcttttattaggtgagttgtggtagtttgtgattttcaaagaattagtccatttaatccaagttgtcaaatttatgtatgtagcatttttgtaggattccttatgctttttttattttttgagatggagtctcgctttgtcgcccaggctggagtgcagtggcatgatcttggctcactgcaagctccgcctcctgggttcacaccattctcctgcctcagcctccctgagtagctgggactacaggcgcccgccaccacacccggctaattttttgtatttttagcagtgacggggtttcaccatgttagccaggatggtctcgatctcctgacctcgtgatccacccaccttgacctcccaaagtgctgggattacaggcataagccaccatgcctggccatattccttattctttaagtgcttgcaggtctataatgatagctcctttttcattccttataccagtaatacgtgttctctgtcctttttgcattgtcagtattgctagaggtttgtcaatttttaatctttttaaaagactcctttgtttcattgaattttctctatagttattctgtttttaactttattgctttttgctcttatcaatatctttttttttcttttttcttttttctttttttttttttttttgagacagagttttgctcttgttgcccaggctggagtacgatggcgccatctcagctcactgcaacctccacctcccaggttcaagtgattctcctgcctcagcctcctgagtagctgagattacaggcccccgccaccactctcagctaatttttgtatttttagtagagacagggtttcgctgtggtgggtaggctggtctcgaactcctgatctcaggcaatccctcctgccttggcctcccaaagtgctgagattacaggcgtgagccactgcacctggcctattattttcctttttagctttgagtttattttgttcttttctacattcatgaggtaaaagcttaaatgattatttgagacttttttgtttgtttctgagacggaatcttgctctgttgcctgggctggagtacagtggtgcagtcttggctcactgcaaccaccacctcccaggttgaagcaattctgcctcagtttcccaagtagctgagactataggcgtggaacaccacgcccggctagtttttgtatttttagaagagacggggttttgccacgttggccaagctggtctcaaattcctgacctcaggtgatccacctgctgcggagtctcactcttatcgcccaggctggagtgcagtggtgtgatcccaaagtgctgggattacaggtgtgagccaccatgcccagcctgagactttttttcttgtctaacatatgcatttagtgctctaaattgccctctcagcactgctttaactgtgtcccagaaattttgataagttgtatctttatttttcttcaggtcagtgtgttctttgatagccattgagacttcctctttgacctggattatttagtaccatgctgtttagtttccaattgtgtggagattttcttgttttcttcctgttactgatttctagtttgaatcttttgtgctttgagaatatacttcatataatttcaatttttttaaacttgtctaagtttgtttttggcttaagatatggtctgttttggtatatgttctgtgaacacttgaaaagagtatgtattttgctgtggttaggtggaattttctataaatgtctgtcggatcctttggatggtggtgttattgagctctatatccttgctgattttttttttttttttgagataggatctctgttgcccaggctggagtgcagtggcactgatcatagctcaatgcaaccttgaactccttcggctcaagggatcttcctgactcagtctcccaagtagctgggactacagatgtgtgctaccacacctggctaattttttaatttttattttgtagagacaggatttttttttttttttttttttgagacggagtttcactcttgttgcccaggctggagtgcaatggcgtgatctcggctcaccacaaccttcacctcctggattcaagtgattctcctgcctcagcctcccgagtagctgggattacaggcatgtgctaccacacccagctaattttgtatttttagtagagacagggtttctccatgttggtcgggctggtctccaactccgacctcaggtgattcgcctgcctcggcctcccaaagtgctgggattacagacatgagccaccgcacctggcctattttttttttttttgagatggagtctagctctgtcgcccaggctgaagtgcagtggcacgatctcagcttactgcaacttgtgcctccggggttcaagtgattctcctgcctcagcctcccgagtagctaggattataggtgcccatgaccatgcccagctaatttttgtatttttagtagagacggggtttcactgtgttggccaggctggtctcaaactcctgacttcgtgacccacccacctcggcctcccaaaatgctgggattacaggcctgagccaccatgcctggccgagacaggatcttattttattgcccaagctggttcttgaagtcttgagctcaagcagtcttgccaccttggcctcccaaagtgctaagattataggcgtgggccaccacacctggcctgagtttttttcttgaaaaaatactttttttttttccttaaaaaatactatgctacttcctctggcttgcttttctgagaagaaatctgctttcatctgaattgtttttccctataagcaaggtgttgatattctttcattgctttcaattttttctgtgtctttggttttcagaaattaaagtataatgtgtgttggcatggagtctttggggtgttctatttgtttctgaggctatttttcttcataatctttcaagtacattcataattattgaagcatgtaaaaggctttaaaatctgtcaggaaactaacatcactgtcattttggtcttggcatctgttcattgtctctttacatttaatttgagattttcatggttcttggtatgaggaattttctgttgaaacctggacattttcatattatatcatgagactctagatcttatttaaaccttctgtttagctgatttttcctaacattgctctggcagagagattggggtgccaccgctgccaggtggggatggaagttcaggttccccagccagcctctgtcggcacctgcctaggggcagaggccttctcattactgctgagctgcggtggaagttctccacacgctctccagggacactgtggttggggagtggaagtctaggttccctctatgatgtccagtgactgtggcggggaggggtgggggagagaacatgcaggggctcttgttcatttcatttttgggaatgaaagtttcagcttcttatttagcctctgattctaccctggtgggggtttgaggtaactcactgtaggcttccagaagtagaaagtcctaggccttccaccctgcctttgctgccctgggtggggccggggccacaagtctttggtggtgcttgactggagtagagtgttactgtctaaaagctctgtcttgctagactgccccttccttggtcctttgcctagaaagagcaagcttctgttggggtgtttttgtttgttcaaattggcgtatccaggttgccggctcttcagccccaagtttggatatttgaaagaaagaaaacccagggaactcacaccatgtttgagttccttagtggctctgctggcttctttgcacctttcagagtcctcctgtgtttgtggtatgtataatacccaagggttttagctctgtttagcagaagaaatgctgaaaagtatgctccatcttcctggaaatgagaacccagctgtcatttttaattaactcttttaattgaggtaatgggttttgtatttataattttgccagctttaaaagaactagtttttgtttttgtttttttgagacggagtctcactctgtcgcccaggctggagtgcagtggcctgatcttggcttactgcagcttctgcctcccaggttcaagcgattctcctgcctcagcctcccgagcagctgggattacaggtgtgaaccatcacacctggctaatttttgtattgttagtagagacggggtttcatcatgttggccaggctggtctcgaactactgacctaaggtgatctgcctgcctctgcctcccaaagtgctgggattacaggcgtgagccactgagcccagcaaaagaactagttttaaacccaaggacttatgtcctgattaatccgtctatctgaaactttattttgagcatgaaaaaaggagtctaggtccctttgaatccctcaactgtttttttccacttcctactggttactgttttcacttagaacaagttattgtttgtttttatttgagatggagtcttgttctgttgcccaggctggactgcagtagtgcaatctcagctcagtgtaacctccgcctcctgggttcaagcgattctcctctcagcctcttgagtagctgggactacaggcatgtaccactatgcccagctaatatttttgtatttttagtagagagggggtttcaccatgttggccagcctgatctcgaactcctggcctcaactgatccacccccctcagcctaagtgctagaattataggcatgagccactgcacctggccaggagcaaattattagatagatgtatatctaaaagaaattgtactacttcaactaattaagtaaaatcctattaaatatgtcagcatttgaagttccacagctttctttggctgtcctattacaacactgtttctttcttctgcctacttaaatttgttttgctttgtctgcgaacattcccttagtactgtgttctatgggagaaaagaaagagaaagagaaaatgccttatatttgtatcttccctggcttacagtatatgttcctgatagtcaggtacagtgtccttttcctgttctccatagctgctaacacagaacagatacttgttaaatatctgtaaatgagtaacaactttataaatactttgaagaaaagattatcttcttctcttttaaatgttacacagttctggctgggtgtggtggctcacccctgtaatcccagcactttgggaggctgaggtgggcaaatcacctgaggtcaggagttcaagaccagcctagctgacatggtgaaaccccatctctactaaaaatataaaaagttagccaggcatggtggtacatgtctgtaatcccagctactcggaaggctgaggcaggagaattgcttgaaccggggaagcagaggttgcagtgagccaagatcgtgccactgcactccagcctgggcaacaagaatgaaactccatctcaaaaaaaaaaaaaaaaaaagttacacagttccttccttgaatcttttatgctaatattggaggctcaatacacacattgtggaactgatgcttatttggccatctaggttaacattttgaatatcataaatattggttaagtctggacattaataatggcattagacagcaccagttggcaaaggaatcatcatgttacgtgcaaaaaaaatgttatgggaattgggtaacaatcttagtacggcagaaaaaatgtttatttaccctaatgcagggcttcataaattttcttggcctataatattcataagtatcttagtaatttttatatagcatctctaggccaggatacccatccacttatgaaaaatacctatccatttatgaagaagttaggttcaaacagtttatgttctagcagtttaacacctattgggccctgttacacagtttctcaaaccctgcagtcagaacggacattctaccctcattcctcttccacattgattttctctctgtacatcttatcacagcaactgcccaaaacccagcttcacaaaaatatggtattattcaggccggacacagtggctcacacctgtaatcccagcactttgggaggccgaggtgggcggatcacttgaggtcagcagttcaagactagcatggccaacgtgctgaaaccccatctccactaaaaataattagccgggcgtggtggtgcacacctgtcatcctactcagaaggctgagacaggagaattgcttgaacccaggaggtggaggttgcaatgagccaagatcacactactacactctagcctgggcgacagagtgagactctagctcaaaaataaataaataaataaataaataaagcattattgaagaggagtatagcagtcttatgtaggaatcgtgaactacctctagctagtagttcacacagtgttcaacagatgttgctgtgtttctttcaaaaatttaaactatcccacaatacctcgtgagtttgccattgtgtcctgggtattgagtacatagtttgggaaccgtggccctaatgactgtcatcacagaggatgagaggaatcccatgtaaggactgagatgtgtcttttggagggtagtgggaataatgaaaagggatatttttaggagcattgatgagggacaagtaggtgtttaaagattgagccatagtcttggctaaataagccatctgtctttaatcttatctcctctaaaggattgaaatacattttgtgtatatctgatattcacttgcgaccacatttatctcagtattaatttttttatgctagccagttcatttgcatggtcatttttatttttctttgatacttttgatgtatcaaaccaatgttgatgtagaaggatgacttagagtctttggtcctatccttgttattgtattattattattagccttttttttttttgagttggtgtctcggtctgtcacccaggctggagtgcagtagcatgatcttggctcactgcaagctctgcctcccgggttcacactgttctcctgcctcagcctcccgagtagctgggactacaggtgccgccaccatgcctggctaattttttgtatttttagtagagatggggtttcaccctgttagccaggatggtctcgatttcctgacctcgtgatccacccatcttggcctcccaaagtgctgggattacaggtgtgagccactgcgcctggccaaatgatgtattagctttttaaaggacgtcacttgagtccaatctgtgtttccgactcacagaaacaaaataaatgaatcaaaagcgcttgtttttttctcttcatgtagaacaaatcacctgctgcagtaacagaaccagagacaaataaatttgatagtaccggatatgataaagacttagtagaagctttggaaagagatataatttcccagaatcccaatgttcgatggtaagttatatcacaaccaaataattgggtgctggtgatgctattcggaatggaaaatggagcaaatgtgagcatgtactgaagagcagagcttgaggacagaaccggagtatgtgcagcgtgagcatgacttccctgcattcagcctattccaatttttgtctgagagtctgaggtttttgtttttgttttttagagacagggtctcactttattgcccaggctggaggacagtggctcgatcatagctcactgcaggctcaaactcctagactcaagtgatcctcctgccacagctttccaagtagctaggaccacaggtgcacaccaccacatctagctaattttaaaaaatgttttgtagagatggagtcttgatcaggctggtcttgagctcctgggttcaagtgatcctcctgcctcagcctcccaaagtgctaggattacagtcatgagcctttgcacctggccaaggcaatgatttgtatgtatgtgtgttgcttattatctatagcatcctagaaatgttgcttttattttcttttagagcagtggttctcaacttgattaatattacatgtaatcaaagatctgtaatgtattacaatgagttataaaagttaacttttccacaaagttaggtattttatatttctgttaaaaccttaatgattattaggtatgggtttgaatgatattaaaaaatattggggacattaatattttatacaatgaaaatactttttttaacagaaattgccacatgtagcagtagtagtaggtattctagtggttggagatgactttatagtaatctctgtgatactctttaaccttggcatctacctcttagtaaagctggaggcaaagcagctatgttgtagcctgtctctgctttatacgatttttattctttatgcttttttttagttttaaaatacatgggctcattgtttctaaatcatggagattatggaatgaggaccataagagcaggagtttaaaatgagttgacacataaccctgaagagtgtgcctgtagactatgttctcgtgatccaggctaaaaactgtcaaccgccaataactgaagaaaaggttgtgctctttatatatctgctggttgacatggtgggcctcatcacagtgcattagttcacccgggctcagagagaggctcaccattctgtcagcagtgcaacatcatgtgcttccagtggttctcaagagtgactgcatagacatgtatcatctaaagggttgttaataaaatgtcttctctttcagggatgatatcgctgatttagtagaagctaaaaagttgcttaaggaagccgtagtgttaccaatgtggatgcccgaattctttaagggcattaggagaccatggaaagtaagtttattactgtgatggcattgtcaaagtaaatggcagcatgttgatacagagagccaatatttatctatattgggaaaagtggagggagaaagtggagtcaggaaatgtttaaattaaaaggtatatgttgtgctactgagaattttgttagaccagaagctgttgcatgattcctagaataagaaatacatacaatgtgatctttggaaagttgaatacacagcattaaaatttagaatttggccgggcgtggtggctcacgcctgtaatcccagcactttaggaggccgaggcgggcggatcacctgaggtcaggagttcgagaccagcctgaccaacatggagaaaccccgtctctactaaaaatacaaaactagccgggcgtggttgtgcgtgcctgtaatcccagctatccgggaggctgaggcaggagaattgcctgaacctgggaggtggaggttgtggtgagctgagatcacgccattgcactccagcctgggcaacaagagcgaaactctgtctcaaaaaaaaaaaaaaaaattagaattcaccccatttagaatgagctcatatttgcaaatatgacctagtcagctaatgcaaaaacactccattttatatgtcatgttgcatgattgtaacctgtattttggggattgttctcaataaattaatgagaaatatctgcatgtgataaatactttttaaagtcatgggctgatctaaaaaaagaccatcaaaaaagcttttcttggatttggaaaacacactgataggtaactctgcatgtatgaatagttgtaaaaatcctttatacattaagtgataagcaagatacaaaatgatagatatactttgaataaattatatatatatatgtattttgtttgttttgttttgagatggagtctcgctctgtcgccaggctggagtgcagtgcgatcttgcctcactgcaatctccgcctaacgggttgaattgattccgctgcctcagcctcccgagtagctgggattacaggcatgtaccaccacgcccagctaactttttttgtattttagtagaaacggggcttcaccatgttggccaggatggtcccaatctcctgacctcgtgatctgcctgcctcggcctctcaaagtgctgggattacaggtgtgagccaccatggctggccgaataagttatatttttaaacaacctaatttgtctgagcaaaaggacaatcaggatataaatccagatgctaatggtacctctgttagggtgctgatattataaactactttttctcatctttgagttccaaatttttcataatgtggttatcttcttttttaacgggaagagtaaatttgtgacaaagtatcctcctgtttatctgtttgtcttttatttgtcttgatattatatataagttggtcgaaatttgctacttagtaatgacacttttatgaattagaacaatggcagataaatcctctgctgaggctattatattcgcaacagggagtactgatggtcggcccacctggcacggggaagacgctccttgctaaagcagtagctacagaatgcaagacaacattcttcaatgtctcttcatcaactttgacttccaaatacagaggagaatctgagaagcttgttcgtcttctgtttgaaatggtgaatgtttgagacagctctaatgattctttacctctctaaaaggggagaaagtgagctgtaactatctccagtatatggaatagttaggcaggatgccattttgcccagagtatgagtcctatgcccttaaagctagatttctttacaaacatgaataattagagtttctctttgtctctttttctccagatgtagatccaaatctaccagttttggggcatgctcacattatgggatctgcattactaatcttctgtaggaatctgaaattatgttttttaaatcaataggtttagttataatatgataaccacagtattgtaacaatgatgccaaaaggtgagaatcataatttattgtggaacttaggtcacctccgatctattaactgcaccaaatgccttcattttaatgacctaatctttggattaggttctttcttccaccaatacaaatcagagtaccaatagaagaaatgtaattcaacaagttctggtagagtgtttagattgaattccacagccttttaaacttcagactttgttaagcttcactgattacgtcactcttgcctctaagaaacagagtagttttatgtaattaggatagagttatgctattagtgacaaagacgtgaatcttcttttttttgaaatgggttctcagtcttgcctaggctggtatgcaggagcatgatcacaactcgctgcatccgtgacctcccaggcccaagtgctcttcccatctaagcctcccaagcagctgggatgatggacatgagccaccacactcagctcattttttttttttttttttttttacagatggggtcttgctgtgttgcccaggctgatcttgaactcctgggttcaagtgatcctcttgcttcagactcccaaagtgctagatttataggcatgggtcaccaatcctggtcaagacatgaattctattttttttgacagggtctcattctgtcacctaggctggagtgcagtgttgcaatctcggctcacagcagccttcacctcctagcctcaagcgatcctcccaccttagcctcctgagtagctgggactacacaagtgcactaccatgcctggctaatttttgtatttttagtagagatgaggttttgccatgttgaccaggctggtcttgaactcctgacctcaggtgatctgcccaccttggcctcccaaagtgttaggattataggtatgagccactgcgcctggccttttttgatttttttgtagagatgaagtctcactacgttgcccaggcagtctagaactcctggcctaacactcctcttgcctagaccccataaagtgccgggattacaggcaagagccattgtgttcagcttttttttttttttttttttttttttaagataagctctcactatattgcacaggttgtagtgcagtggttattcacaggcacaatcatagcatactgcatcctcctctctcagcatcccaagtagctgggacttcagtcgtgtaccactgcactcagctttcaagccttatttttattgtccttagggtaatgaactctcagcaaagttagccctcattttgtcatagttccagcaaaagtccaaagattaatatttggcctgttttgagtttcatacctatgccgaaactccttgtttttggtcagagaattggagtgctctgattggccaggtctgaataaaacccctggagttccaagtaaagttagcctcttttgaagtagtggaataggaatgagaggggcccggcatggtggctcatgcctgtaatccccgcactttgggaggttgaggcgggcagatcacttgaggtcaggagttcgagaccagcctggccaacatgatgaaaccccgtctctactaaaaatacaaaaattagccaggtgtggtggcgtgcacctgtaatcccagctacttgggaggctgaggcaggagaattgcttgaaccggggtggcagaggttacagagagagggagaggggagaggggagaggggaggaaagaaagaaagggatgatttgcaaatgaaaaagaggcttctcttaccagaagtgtgctgtgcagggagaaccaattggtgtcctctaccgtaccttcctgggccagctaaacccaggacacatagcctttccttgaagtcagatcattctacataacctcagtatgtgggaagaatcagtctagtcacttttgcttggtgtggcaacagactgaagtttaatttttgttgatgtaggtgcttttgatagatgcttcctaaaattttagttgagaattttcttggatgttttaatgatgatgaagttcactctttccctctctccatttgttgaaaaagtacaaaaatatttatacataaagacccaagtattgactctctttaaagatgaaattatcccactaggtacagtggctcattgtaatcctagcattttgggaggccgaggcaggaagattgcttgagtctaggagtttgagaccagcctaggcaacataataagacaccatctctaccaaaaatataaaaataagcctggtgtggtggcacacacctgtagtcctagctactcgggaggttgaggtgagaggattgcttgagcccaggagctcaaggttgaagtgagccaaaatcatatcactgcactccagcctggatgacagagcaagaccttgcctcttaaaaaaaaataaataaataaaaaacggttcattagaagccatattttagctgttctaattctatcccatctccccagtattagcgtgagagaaagatgcacagtgtggcaggctccttagctgttttgttgttttctttctttcctcttgttttagagacaggttctcactctgtcacccagtctggaatacagtggtgtggtgtgatcatagctcactgcagccttgaactcctgggctcaagggatcctctcacctagcctcctgagtagctgggactcagacacgtgtaaccacactcaactaatattttaattttctgtagagatggagtcttgctatgttgcccaggctggtctcgaactcttgggctcaatccatcctcctgcctcaccctcccagtgttgggattacaggtgtgagccactgtgcccagcctccctcagctattttctgattgctaatctgtagattattttaaaatgaaataatagcttaatagcttgatattgcatggtttcttcctttaggctcgattttattctccagccaccatatttattgatgagatagactccatctgtagtcgccgagggacttctgaagaacatgaagcaagcagaagggtgaaagcggagctgctggttcagatggatggtatctgtgtttagcttgagttgaacagggacgggaggttgttaggtgtggtgtctccagttccagtgggtcaaactttactcatagtgctaacccaagcttttaataggtattcttaacttcagatggactagagggggtggcaagaagttcctgatagtgatagtaatagatttggtacactgacagtggtgacaagtcagaattaatggccacacacagggcacccttttggtatatacaactatcttactttagctatgaaattgaaataaaaataaatgcagataaattggccttagagtttatgtacgctttgaaaaagatttaaaattgttatgtatttgagatctggcttttcgattaaatctattttgagtcatatatttgcatactacagaactcattttctttggattacaaattcacataggtaccagttaacctaagtcttaaggaggcattaagactgtgcttccttgtattgttgtactaaatagttgttgatctttaaatagctgagcttcatttggtataatccaacttaatatctttttcactctccccttacccttattttaggtgttggaggtacttctgaaaatgatgacccttccaaaatggttatggttctggcagctactaattttccctgggatatagatgaggctttaagacgacgccttgagaaacgaatctatattcctttgccgtcaggtatcttcctttcaatcttgtcagaaagcctgttaactttcatgtagttttgtttagagaatttaaaatttgttattaactaactttctggaagagatacatgaggagtatcttcctttacagtactagtttggctatatgccttaatactaaatagtaaggaattaaaaagtaaagaatggctctttacttaattatctcttcttagagatccaattcttactggaagacaacatctcacacaaagaagatttgagacaatagtatactatgtttatgctgcaggcttacattttaaaatttgtttctaccattagcaaaaggcagggaggagctattacgaataagtctacgtgagttggaattggctgatgatgttgaccttgcaagtatagcagaaaacatggaaggttattcaggtgcggacattaccaacgtgtgcaggtatgaattatcatggaagcataggtttttgtaagcataaacttctagtatgaagttttttggttttgttttttgagacacagtctcgctctgttgcctagactggagagtagaggcgcagtcacagcttactgcagcctgaaactcctgggctcaagtgatcctctgacgtgaagtttttatgctgaattaagacagatcaatatcttggtggtggctcacgcctgtaatctcagcactttgggaggccaagtgggagatcacttgagcccaggagtttgactggcctgggtaacattgcaagacctcatatccatgaaaaaaattttaaaaattagccgggcatggtggttcccacctgctcaggaagctgaggcaggaggatcgcttgagcccaggagtttgaggctgcagtgagccatgattgtgccactgcaccccagcctgggcgacaaagcaagaccctgtgtccaaagaaaaaaaaaaaagatgaataaagacccacattccagttttgttttgttttttgagacggagtctcgctctgtcacccaggctgaagtgcagtggtccgatctcggctcactgcaacctttgcctcctgggttcaagtgattcttgtgcctcagcctcccgagtagctgggattacaggcatgcaccaccacacctggctaatttttgtatttttagtagagacggtgtttcaccatgttgaccaggctggtgtcgaactcctgacctcaagtgatccgcctgcctcagcctcccaaaatgctaagattacaggcgtgagccaccatgcccggccccacatacattttgtagtcagggtcacaaattctggttttgttggtgttagcaggtgctggtaagatatctggtatctttcatgtcagtgaagagtctacagttcatttgaaagctacaagttcaagaagctaatgttaggataaattgtgtaaaatagaaaatcagtaattgtcttggattaaataaattgttggtgcctttgttcactatattataaaatacgaaatgactgtgaaatatattgacttggcatatgcacagaatacagtctcattctcagtgaacttatcctaaatgtgacagaatagcagtaaaaagaaaaaaagaatgtctttaatccagctggttcaagtaggttttgtcctaatctaagtattagtagagacacttaattaaccaggggcttgactgcgctcgtttcctcctttctaaagtgagcataccacacagggttctgaggattaaagctaaagtgtatacatcaaacagctctattgctatccctttgcataaatggtggctgctattaaggataaaacttggtaaaaggcaagagctgtttgaatctgaagttttgttttttttttttaacacaaatgagaaaaggagaaaccctgaacttacctagcttttcctctacatggagaaaatatttaattttcttgttaacagtttctcttctcttctgactctgtgatgcttattcttcattttattgaatagttataatgaaattcaaattgctagctttaaccccacttttactttttctgggattttatattcagtattaattatttaaattagcatcctttttcattacagaagatttaactgcttaaaaatcaatcacaacaggctttgtattccaataagtttctatacaatactacatatatatgtaatataattagagaatgctacaacagatcaattgaaaatttttctattaacaggttttcatttaaccaaagtaacattgtgtgtgttgttgttgtttttaacttaaaacctagggatgcgtccttgatggcaatgagaaggcgcattgaaggtttgactccagaggaaatccgaaatctttccaaagaagaaatgcacatgcctacaactatggaggatttcgagatggctttaaaaaaggtttctaagtcagtgtctgctgcagacattgaaagatacgagaaatggatatttgagtttggatcatgctaaattctcacatgtaaactgtgagaaatgtgccttaagtgtttgaatattaaatgcagtaattcattgtactgagtgctatattttttttaactttcataatggtaagatttttttaaaaaaacccttatgattctgaataaaggcaatatttttaagctgaaaa

SEQ ID NO: 752 - DNA, 187883 bp, Homo sapiens
gggagacgcaggcggcgaaacggcagaggagccgagccccctccgcccaaggcgccctccctccgtccgcgcacaggcgccgtcgcttggaggagcaaggtgcctcccagcccgcaggggcgccgcgcgcaagcccgcgggctcttcggtggctctgccccgggactgcacctggaggcggccccggacggggatggtcagcggctgctgccgtctggctcgcgagcgggacgctgtgagggcaccatggcgctgactcccgggtgggggtcctcggcggggccggtccggccggagctctggctgctgctgtgggcagccgcgtggcgcctgggtgcctcggcgtgccccgccctctgcacctgcaccggaaccacggtggactgccacggcacggggctgcaggccattcccaagaatatacctcggaacaccgagcgcctgtgagtatggtccccgcccctggctccctggctccgaggttgccctcccacccagacgcaattccggacttgggggtgggggcaggaccattggggcccgtccgggctccgcagcccacagacgggtcagtgcctgccggggtctttcccgagccaggagccaggagcgccgtggtttccccatccctgggattcaaagggccctcggcggggttgtcagcttccgtcctcacacctgcaccctgcaccctgcactccgcaccctcaggccctcctcactgcgccagcgctttattcctccagggtgcctgcgaactggtgtcagaaagccttccttgcacccaggagggacacttcccacactcgccaagcacaatgtctccttttgggcacatggggctacggccgcgttctgagccagctgcgcagattcccgctcccagagcttgctcctgacgaagggcagcagggtgggatggaggcgaagtttctggtctgccccttcttctccattgtttgccccagagccttgagaattcttcccctgcaggtgccacgcgttggtcccctactcacccgcctccctccacacccagccatccccaacacaggcagacaatgggacctgagggctttgggtatggggcttggggtatgtaacattcagcacccgaaaaggggcaggtgtgtcttggatggagaacccggtggataatgccaagaagtcaggagcttggagaggggggcccaaggttaaagatattgaccatgacaagtaataaaaaaatagcatttctcttcccctgttctgtctcacttgtgaattcttgaggaaacttgatccttttcttttctagacccagtaagctagtagaatgtgtgtgtgtgtgtttgggtgtgtttgagtgtgtgtatttacagacctttatactttgttttctgtgactctcctgcagaatgtgtttctgtgtgaattcctagtattaaggggccaccttaatagcgtgaggccatgagagtccccgtaatgggctgtgtgtgtgtagattttggtcacatgcagggcctttgtactgctcgcagaggtgactacaccaggagatttttgaacagggctttggagaaggctgctggctcctttgaaacctacctactcctccttcccacactcctcggtgactgcagtggctctcaggaaaggtgtgcatattttgataactttcgagcacattttcatggcccccagctggtcagagacagaaatctgaccctgaggagagctgtctcccgaatcagactctgtaccaaggccagcaattagtgagcacacatttgccccagactcttcttggctgcatctgaaaaattcccgtggaggttttagagaatttgcaatctagatgcaatctagatgggaagtgtgtgtgtgtgtgtgtgtgtgtgtgtgtgtgtgtgtgtggtgcatgtgtatgtgtgtgtgtgaatgcttgtgtgttacagggctggggagaggtggtaccaaactgagtttctgtgggcagcgtgtgcattatcctgtgtggacccagagaggatctgagggtcagaaatctgtccagaggacccccgcagtggcctggtcaccctccatgcctgtcccctctgtacctgctccctgctccccttgccttgtccactggagtttctcctgaagctgctaccctggttgcagcctagatctaagacacattagcccttcttctttgcttttgaatcttgagtcttaaagtcatctcctccctctttactctctcaccacctttagtgtttaagacttccatgaactctttagctcttttgtgatcagagtgagatgaaaatgaaatttcctagtacagaggaaagaggtggcattctgggagctatactgcctggttccccagctctgtcacctattagctgtgtgaccttgggcaagttacttaacttctctgaaccttagttgctttccatcaggaaaatggggctgaggctacataaggtctctggttcttgtgaggatggaagatcatgtatgggaattgcctggtaccttctgatgctcgctaaacgagagccattattatgataggatagggaggggaatctcattattttaattcagcaaatgtttcggagccaggaactgccctgggtgctgaggcgtcagcagggagtgagcccatccctgtcctcaaggggcacatggtctagagaactgggcagaggacctctaatggtgagctctcaggagagggccaggcagcctcagggaacggactgtgggaacactggggtgagaagcccttttccagggtgaaggggtttctcagaggatgggccactttatcaaggttggtttggattttgccaagcacagagggcaggcaatctaggcagagggaacagctgggctccaggcccagcacattctgctgcttgtcaggtcatggggcctgctttcttgcagacgtctttttttttttttccttttttgtagagatgaggatctggctatattgcccaggctggtctcaaacttctgggctcaagcaatcctcctgcctccgcctcccaaagtgttgggattacaggcgtgagcataagcaaaaagccagcaggtgtgagtatgagccaaaaacctgcgggtgtaagcatgcctggcccgatatgggcagatggaccagcttgtccctggggctgaaacatgctctggccagtggccagtgggtgggatgggacttgaggctggaaagagatgttgggaagggtcaggaagactttctatatgtgaacttttcctctgggaacttcctagttggaagccaggggtgagttatcctggggaagtggagcaggtctgatctttgccatgtgggcaaagcttcctggactgggaaagcgcagggagcccgcctgttctccaggcagcccgtgaaagagctgctcaaagaggaaaagaacatcttgaaagaggccttggtgagagcccaggcagactcaaaataactgtggcaaatgctctctctaatcaatatgagtgttgtgcagtatcagagcctgaaacagtggcttcttctgaggctgtgaaatttttatggactgcagctgtgcatttgccttttgtcctttgggcagtttctgcggcagcctgcgaggcccagcaactttatgatcatatattctataactctgggtccaggcctgtcccccgaaatggaaagaaatggtcattggtttgctgtggggacttctggaaagaggttgggtaggccccagagctgctgaggaaattggttcagccagaggggctgtggggctggtcagctgggcagggaagggatgctaaataattcactgtaatgaacagttaaaatacagagccagggctgggagaggtggcggaggcggcccgggaagcttcctttctttgtactgcccaggcgcagagagacccagccatggtcaccattaagttatttttttcttccacaacgaccttgactttcagttggacttggtttttaatttaaaaaatcttttgagtgtccaggagagtgtgacaggagagtgcagtatgtgtggacatcgctggttcccccagccctgggcatcctgggtatttgaggtttgtggaaggttccccttgtgcagagagggtaagttgtccgaggatggagggaggcaggcagggcctctgggaaggcctactgttctctctttgcctccaggcccagcacattctgctgcttgtctggtctttttttttccttttttgtagagatggggatctagctatgttgcccaggctggtctcaagcttctgggctcaagcaatcctcctgcctcagtctcccaaagtgctgggattacaggcatgagccaccatgcccagccttgccgtcctccttatgtgcccttccctccttgccagttcgtccaccctgccctatctccatgcctgctgtagaggcctgggaggccctctctagactcaactccctgagctagaggtcccatttaacagggctgagtggtcacgcataaggaaggctgcccagggcacctgaggctgatcctctggggagcctgtttgaaattccaaataataattggatggtgaccttggtaaatgaggtcaggggccactgcagccacatctgccatcagggcccgattggatctgagcaggccaccatggtctcctgcagcagaggcctgcgctgtgtaggggaggtgcctccctgcagggcaagagtctcctgcttgcttaggctttggtgtggtcactggcccactggcttattgctgggctctgaatgactggtgttaggacccccgtgccgtgcctctccctgctctgagacccagtttccccatctgtaaaacgggacgacgacagctgtgcaggttgatagtgaggagtaagtgaggcagcgtgccacgcttggtaagtggctggtgttcgcccttctctcggcctctggggctgataacacctactacctcaaagggcctgtgcactcactcatgctacagttgtgaaaatgctttgtgattcaatcattaggatattattgttattatttgggaagctcaagctagaggctcgagggtttgggtggggcagaagagagctcgggaggtaaggatttgagtgttgcctctcttgcagtctgtctgcttagagcgcagtctgtctgtttagagcgctcatttacctttcctgggcatctctgcccctttcccttgggatgtggagacagagtggggactgtatgcagggcggatggtcgtgatgggagggctgtgaagccagactgcctaggtttttagccccactctgccactcagcagctggcggggccttgggcaagtgatggggtttaattccctcattcaacagatagctatctattgaacgtctgcattgtgccgggtgaatagtgctggacagaaacagaaacccgagttttagtccagcaggggagatagagatgaatgacatagtataagaataagcacataactgcaagctgggataagtgctctggaggaaagggcgacttctcagaacccccatttccttgcccataaagtggggatgatgatagggcctgctccaaagggtggtcatgaggattaaatgcggtaatgctcgcaggagcgctttgcacagggcctggcagacagcgagtgctcaataaatggtagtattattattgttattaaggtgacagagaattgcagggatgtgaaggaaatttgggcgtcacgctggatcccagggtggccctcctcttcgccatcaggcagccgctgggaaccctggagcacaaggggaggggctgatcttcctcggtgccccttcttgggcggggcgggctgtcggtggcccaggctgcccgaggctgccagcaggggcggccgtgctcttttggggctgggcggctcctgcattattgggagcagacgggtgcttggcggagttgccgcctccagttctgtgccggcattagcagctcggcggggctcttgcttaatgggattttcttcccaaatcctgtaattatcgccatacaaatacttattacccagagcagatgatggccaggccttgggcagtagccagggagctgggctgtgccggggggcggggagggtgtggagaattggctcctctttttgacggagctcatgaccccctcctctcctttctggaacccagcctgtggcggacagacagctgttgggcacctgcagggtgcatagcgtcgttgagagaggcctgaggagcttttggcctggtgagggagaaagaacaaaagtgtaaggatgtccatagagacgaggagcacagtggctaccagcccaggcttcagtacgagaatggcccagtttgaatcctggcttcatcacctaccgagagatcttagacaattcactagtgactcaacttcctcatctgtaaaatgggaccagtgacagcatttacctcatagggctgtgaagttaagatgagatgatttttttgagacgggatctcactatgttccccaggctggtctcaaattcctgggctcaagtgatcctcccactcagcctcccaagtagctggaactacaggcatgcatcaccatgcccacctaatttcttagttttgataactgtccatggttatgaaagaggttaatgctagggaaagctggctgaaggcagcaagaataaagattaataattagaatagagtaatgcctggcacatagtcaatgccccatcagcatggagatgaggctgatgagagtcgctagatgggagtgagatggggaggagggattgaattgttgttgtgttgtggaggtagggtttgaactggggcttaaaggctgggcaagacttaggttaagtagcgaggcgaagcgagggtaagggagtttgggagcattcagaaggtaagtgccatgtatttgggaaggagagtgagaagcaaaaccccctgaggggcgacgatttgtgttggtgagttctgggagaggagattaaagaaatttaactttttgttaaattttaaaaaacaaataaatgatttttaataaacttatggacttgtgcaaacatcacaatccaatttgctttatcataatcacacacacacacacacacacacactttctctctctctcttctctctatcgcacacactcataggtaattttttttctgaaccttttaagaatagcttggagacgttgaaacttttttcctttaaatatttggtgggtgttttctaagaaccacaaggctatcaacatcagaaaattaaacatcggtgcaaaactattctctactccagaattcacattcagttttcatcaattgctctgataatgtctttcatggctattttttcccaggtccacaatcctgccaggatcgcacatggcatttaatggtcatggtctttagtctcccttaatttggaagagctcctcagcctttctttgttttccttgacctggacattattgatgtatgcaggccggttattttgcagaacgctcctcagtttggcttcatctgatctttcctcacaattacattcagattatgcatttttgcagggaatgccaaataatgactccatgtccttcctggtgcaacatgtcagaaggcacgtgatgtcagtttgtgccagtattggtgattttatctttaattacttgataagttgatgtctgccaggcttctctgctgagaggtagttgttttcttctttggtattaacgggtaatttgtcagggggattgtctgaagctgggtacatattctgtttctcatcaagctttcatcccccgagttttagcattcattgatgattttgcaactccatcatttgttctctattagttggctttctactctaagaaagaactttcccttctccctcatctgtttttttgtttgtttgtttgtttgtttttttgagatggagtttttgctctgttgcccaggctggagtgcggtggcacaatctcgactcactgcaacccccacctcccgggttcaagtgattcccctgcctcagcctcctgagtagctaagattacaggcacctaccaccatgtctggctaatttttggatttttaatagagacgaggtttcaccatgttggttaggctggtctcgaactcctgacctcaggtgatccacccgcctcagcctcccaaagttctgggattacaggcgtgagccaccgcgcccggcctgatttccttctttttttatggtttcatagtactctgtggtgtatatgtaccatattttctttatccaatccgccgttaatgtcctgccgccaccttgactttaacatggttagactgattttggacttctaacttccagaactgaaagataatacatttgtgttactttcagccactagcatatggtaatttgtcataggaagctactacagtcatagaattcaaagctattgcagaggccaagatacgaggggaagtgggtctggaccaaggcagagagagctgagagagtaagtgggaacggcgtggcagactctgatgctcgagtctgagagagtgatcttgggacaggaataaagctggaaagggcgactggtcctggaggagaagctgtggatttggcttttgcctgttttctttgaattgccactaaaaatctatgtgaaaaagatggccccagaggtcatgatggggaaggttactctggagagtattcaggttggagagagagatggggggacctcaggggaagcgcttcaacctatgagggcagtggaacagaaactttggtgggaataaggatctcctgggaggccggtacaaaatgcggattcccagcccatcctagaggtgctggctctgtagctcttcagcaaggcgattccggtgatttggattctggagtgcccagggcacagtttaagaaatactgcttggtgctgggatttcctggagaagaaagcacatccttcgaggactcacacacattagctcccacccacattagagggcaggaggaagggaaggtgttgaaggaagagatagtggagaggcgggaggaactcctatcctgtgtttgacagtggagagcagtggctacacgtttgtggatttgaacctgggccgaggaatcattgcaaaggccaaaggaggagtttggtgaagaggaggagggttagcagtgtggagagcattcagtccgtctgaggaggagggttagcagtgtggacagcattcagtctgtctgaggaggaggtccaaggaaagcttctggaactcgagatcggggtcactggtaaagtgggcagagcagtttcctgggagaagcggaaggcaggaggcagatggccggcagcaagtaggtggtaaggaagtttgcagaggagaggacaggcatgggagctctgagggggagcaggctcaggagagagttgcctgcagcatagaggcaggtggactggagtctcttggggagggaaggagggagccaggggtcttggggaatgtgggaatggggagggctggcaatgggccagagaaggacagaggcagagagaggtgagagggagttttgatggtggctgtggtcgtggtcgtggcttagagctcctccctctcgccagcctcaaaggagctgctttacctgagttccttcttttactcctcataacactcctgggaggaaggtattactcacctctgctttgcaggtgaggagaaggttcagagagatggagccatctgcccagggttgaacagcaggctggtaagtggtaagctgagattccctgagtcttgaggctctgagacgtgcctgtgtttagtttttaaatttgacttctgctctatagtcttaatgaggcctgacttcattcactcattcattcattatttgccagatattcattcagcatctataaaacacctgccagtttagcactggggctgtaaaggcaaattggccatgattgattcctgcctgcacatgtttgctgggtgcacccatgttgcaggctggtatagggagtgaggtgtctggtctgggggtggagcgtggtgagcagagttgggcagattcagggaggtggtggtgcaggcggaggtcagtggcgggtggcctcccaggggcctgcatggatagagagcatggaggcctaggggctgtcagtggggccctggctgcagggctgtggtttgggggtaggtcccagacctgggaaggggattggcaagagcaaggcagggcctcagaagtgaagggactggggtgcactttgggcctcaggacagaatcctatggagttgggattaagagctgggccgtgactacctcacacccactcggattgcgactgtcaaaagaacagaaaatatcaagtgttgacgaggatgtgcacgctgttggtggggatgtgaaacggtgcagctactatggaaaacagtatggcggttcctcaaaaaatcaacagtagaatcaccatatgacccagcaatttcacttcaaagtaaatacccaaaagaactgaacacagggtctcaaagagatatgtgtacacctatgttcaaagtggcattatttacaatagctaaaatgtggaagcaagccacatgtccaccaacagatgaagggataaacaaaatgtgatctatatatatagaatagaatatgattcagccttaaaaaggaaggacattctgacacatgctacaacatggatgacccttgaggacattgtgctgggtgaaaaagccagtcataagatgacaaacactgtatgatctcacttatctgagttacccagaggagtcacattcagagacagaaggtagaagagcaattgccagggactggtggagaatgggggaactctgtagcatagagttgcactttgcagatgaaaaagttctggagattggtttgcacaacaatctgaatatatacattttaaagtagtacagtacactacagaactatccacttaaggattaagatggtacattttatattatgtatatttttaccacaattaacaactaattattattattatttttttaaaaagagctgggtcctggggtcagatgtgccagagctcaagtcctgctcctcaaccagctgggtgacctgaaacaggtcatttaaactctttaggcctcagtgccctcatctgtcagtcaagactgacaaggagcctctgagccaggtactactgcgaggcttaaatgagctggcttggttgggatactactgtagcaattgctatttctccagccaaggaaacaagatgggtccccaggagcccaggcgcaagggtggagtggatcggcagcaaatgggccctggcatggggtccctgcctcctcctccttggggcttccccactggtcacatgtcagagggtggtcccaggctggagttggtgtctggctgtggctcagcctggtgggttggaggactgggatgctgggagccctggctcctcacctactaaggcctgaggatgtggggaaggcccagctggctgacgggagtgcgtgcaaggccttgagtatggtatgccagcagcccctaggctcagtgggcagggttgctctggcagcctatattcagtgagcacctactatgtgccaggtatcctcacaggtgccggggatacagcagtgagcaaaccagctgtggcctctcccctcacaggtagctgggagactggccttaggcaaaggacctcctattgacccacaactccgatggcagtccgagctccagaggagataagtgggcacctggggaagctggtttagaagagggcgtttgactggaggcctgaagcctgttcagacagggagcctggtgcatgtgctaggggcaggggaagagcttgctgagctctaggctgctccaggccagaaggaagcgctgatattgaagggaacggaggagcagagtggaagccctgctgctgaggggctggtattttcctattaaagggctgaggaataattattcttctaccccctgggccaaggcaggctggccagaggccttcgcccttcaggagccccagctaccctttccttggggtcagattctgtgctcactctgcccttctgggctgaggtctccaggacttcagagtcctccgatacctgccaagtcttgcagctgcgctcagggatccctctgtgaccccctccttccccatcaacctcacatcctggaaaccccaggctgtacccattggggcctcaggccctctgcctcaccgctgcttgaggccaacgctggctttgctcagatcctcgtcacccccacttgagcctgggaggtcaaggctgcagtgagctgtgatcatgcccctgcactctagcctgggcaacagagtgagaccctgtgttaaaaaaaaaaaaaaaaaaaaaaggatggagctgggattccagcccaggcctgtgcctgcaagacctgagttatttggcccaagcactgagccacttggattggcttcccagctctgccactcaacctgtaggctccatttcctcatctgtaaggtgatgtgaaagatgcctacttccaagagatgttgtgagaagcatgtggagctcatgtttatgaaggagccaggcccgtgctgccccatggaagggacctgccccgttccaccggctaccctggctctcctgaagcctgagaccggccctgagcaggaggaagacaacccatcctttcctctttcctcctgagggtgtctggaatcacccagcttctcacttagcagcttggaccctaaggacgctatttccttgctcatattgggctcacttatgagaatggaaggacctggaagagaggaggtcgttggtaacatgggagcatcctctgcgtgtggagcttttttggggtgatgtccatttggggagaacatttatttcttttcctctctctctctttctaaacttctctctctctctctctctctccctccttcctttctctctttctttctgtttttctttttctttcaacagggtcttgctctcttgcccaggctgtagtacagtggtgcaatcatagctcattgcagcctcaacctcctgggctcaagtgatccccccacctcagtctcccaaggagctgagattaccacgcctggttaattaaaataaaattttctttgttgagacagggtcttgctatgtcacccaggatgatctcaagcaattctccccacttggcctcccaaagcactgggattataggagtgagccagcacgcttggctggggagagcatttcttaatgtgtgtgtgtttttattttcggagtagggaaacaaagaaacatggaaaacccactcaactaatgctatttaaactgtcaattttaatgcagattctttcctgcattcaagaaatccttactgaaacatctatcatgtgccatgttctgtgttgcaccctgggggtacaatagtgagaaaacacggtctgtgtccccagggagcttctaatctcatgtggaggctgggacatcagtcagggaatcccccaaatcaatataaattggctctggctgggggaggtggctcatgcttgtaatcccagcactttgggagacagaggcagttggatcacttgaggtcaggagttggagatcagcctggccaacatggtgaaaccctgcctctactaaaaatgcaaaaaaatttagctgggtatagtggtgggtgcctgtaatcccagctacttgggagactgaggcatgagaatagcttgaacctgggaggtggaggttgcagtgagctgagattgcaccactgcactctggcctgggtgacagagcaagacactggctcgaaaaaaaaaaagcaatataaattggctctgatttatgctacagaggagagggttggggcgctctgtgggcctgtgataagaaggtttgccaattggagttcgtaggcaaagaggaaggaaggagcattccaggcagatggagtagcaagtcagaaggagcatggggcaggctgggttggtggacacagagcaggccactcgggaacttgtagttcatggtaaggagattttttttttttttgagatggagttttgccctgtcacccaggctggagtgcactggcacgatctcacctcactgcaacctccggctcctgggttcaagcgattttcctgtctcagcctcccaagtggctgggatttcaggcacctgccaccacacccggctaatttttgtatttttagtagagacaggtttcgccatgttggccaggctggtctcaaactcctgacctcaggtgatccacttgcctcagcctctcaaagtcctgggattacaggcatgagccactgtgcctggtcagtaaggagatttttgtcttgattccaagagcaatggaaatccattgaaggctttaagtggggagtaacatgatcagatttgcatcttgaaaagaccactctggctgtggcttggagagcagattggagaggggccaaggtgaatgtggggagcctgtgaggtggcgctgcaggactcaggctcgaggatagaggcatggggcgggtgttgcagctggcaggtgggatggggcaaatgcacccgggctaccctgcagattggggtgttaggcctctgtgggcccctttactgctgtctgcgcagtggctggggagagaagttctttctttcctccgttttccccgtctgactctgcacactctcagcgccgcagccttggccagggtaagatttcaaagcaaagagctgggtgtacatttcccgagtaggcttgtcttattcggtgacagcatgcgtggtttcttttttctttttttatttttttgagaccctgcaggaagggtgagcctctccatccaccgcaagctgtgatgaggaaggaacgttctagtccctgagggaacaggagtggctggagctccagggtgagaaattgtgaagctggtgccaggagcccccagaacagcccgagaggagcccagggagtttattcttgcagccccgggaaatcccagggtttcttttggttcctcacaaacacccagagactggggatcaaattcttgtttcctgagaggattcaagacatccttgtgtgtttttgtttttcccttagtaactttgcttcggaggattttctccaaaatcttttgccaccgaggttttcctttcaggctaggaccacacaggaatggagggaaatcagggccatttgccactggagcatttttcctccttggggagaaggataggtgtaaactcatgacttttggaagagggagaacgcgcttagggcgtcttccctggtcttcagcttcctgggtcctgcagggaagtgagtctctgactcctcccagttcagcttggccctgccagtccagcaccggctggagctgagccagaggacaccacctcctggcagagccatggtcctagaggaaaatcacaacagtgcagtagtaaagataattgcagcaggtaatactgctgtagagagcacgaattgtgtgccgggcattattcttggtgttttagaaatatcaagacatttaaacctcaccacatttccaagaagtgggtcttaccatcatcctcattttataaatggagaaactgaggcacagaaaagctaacttacatgcccaagatcacacagccagtgtaatggtggagcaggaatttgaagccggatggtctggctccagagcccacactcttggtgactaagaacacttaactcagcctggcgggggagccgccgatattgttgtgtaggcaaagcacatggttttattacagagcgcctgtgcagccgtgtcctctccaaagccctcaagttatgttcttcatgtccaaggcatggccactcgaggtgagggcatgggatgaggggacaaagggagagtccagcaacatgaggacttgtgacgtaggagacagaacatggaatcacactggctggggtctgatcccgccccaccacttattagccttgtggcaccatgcaagttgcttcatgcatccgtgcctcagtttcctcctcagcaagttggagatcatatgactccccttataggttgtgaaatgagagtgaaatgagatgaagcatgcttagggtcaggcccggagcctgcacacagttggtgcccaggaagaagtggtgggtgtgggctccagtggcaaaacctcagggagcccaggtgggctctggaccttgggatcttcctgacactcgaggctgggacctgcccaggtgggcctactccaccggctgccctggctgccctggggcttaaggtcctagcagcatcttccagtctcccctggcagcttgctgggggagggggctccgtggcaacattgaggacctcctgttggaggaatcagatgcagcagaaaaatgtcctccttgccttattctagcagcctctgttaaggggaagtggctggcttaggttgtgaacttgatcctggtgggagagagggtgggctacccagaggaggtcactttctcagcctaagtggcaatgatacctccttaggcagccagccctcagacccgggagcttagtgagagctcacaggctgcgggctgggctgaggggctctcccctgagaggaggcattaagctctgcgttagagagcaaggctgatggcggcaggctggggtgggcttgggcctcttttgacattctggtccagaagcagggcccccaggggagaggctgtgcctgccttgctgtctgcgccattgtctttttctccctgcttgtcttaggtcttgtgtggagtggggtgtaggaagtgaggaggaggggtgggactaaggaatgcacctccgcacctgcactgtgggggctggtacaaaagggtgagaagagaggtgtgctaatgtggggtgtcatcagaatgtcatctccacctctgtcccgccttagtgggaattccatcctcagggatttttgagttccattttggatcctgccttgttcagataagtcagtgtttgtctttgcctcagttttgccatctgtgaaatgggaataattatcatagtcaattgctttagttgccatgaaaaggaatgagtgatgaatgatatgtaaaattcatcagatttttcatgactttgatcaagtaattccatttacaggaatgtattcctcccaaatgctcatcaaactttatgcaatattgtttataattggacaatatctaaacagcccagggattccagtcacagggaatcagggagggagtggtccagtaacttgatatacccaaatgaagggacactttatggccaatcataatcttaagtggagaacacacagtgtatgacgttgtggaaggagggggtaacatttgtgtctcattcatcctcttatcttcagaaccttgcaaaatgctttgcacatagtaagtcttctgtaaacatttgttgaattaactatataaaaatcgtttccagcaaaaacaggtttgagggcaaatatttcagaacattaataagagttatttcttagtgatgggattatgtatgactttcatttttttctttattttttgggaaattgaaaaatattcagtaatgtgcatagtactcttatttttaaatgccataacttttatttatatgttgggtattatggatattatatgttggatattatgttggtttataacaacatagatgtcttttaaaaaatgaaaacactgcaaaaaagtataaaaaagaaactaaggtcaccttgagtcctaccacttagcagtgacagccattgttatgtggcatgcagcccccagctcattctgtattcatgtgtgtgtgtttgtgagtttctacataagcagtttattagtccgttctcacactgctaatgaagacatacccgagactgggtaattcataaaggaaagaggttaaattgacttacagttccacagggctggggaggcctcaggaaacttacaatcatggcggaaggggaagcaaacacatccttcttcacatggcgggagcaaggagaagtgcaggagaactgccctttttaaaaccatcagatctcatgagacttattcactatcacgagaacagcatgggaaagacctacccagatgattcaattacctcccaccggctccctcccatgacacatggggattatgggaactacaattcaagatgagatttaggtgggtacacagccaaaccatatcaagccggctcttagaaaagggttgtcttgtgaccttttcctacgttctgtgttatgcacaacttttgttgtcaagagaaacagatctgtaccattttaaatggccacatggtattcggttttgcagatgtgctgaattcaaccaagcaatactctactaacatccatttaacttgttaaagatttttcctcttataatcaatgctgacatatttttataatagaaaaacaacaaccaaaagtgccttgtggttttaggtttgggaataaacatttcagcccaaagaaaaccagccctgcttgggaagagaaccactttcaaagggcttcatgatgacattctcagtgtttgaagaaaggccggggtgcagagggagcaggttggggtgcaacacagtgaggctcagagtggctgtttcgggaaataatatttagttcattgaaaaatgacctttacattaagcagagccatctcatttggagagggtgtccttgcagcatttagggtggggaggcagctcagtcagggactctcaccaatggcttgtgttagcttggaaaggcctcaggcccctctgagagatcctgttaggaaagcgatgaggagctgggaatgagtttttgcagctgcttctgaggatcaggagccaggcccacgggacagacagcgggaggatgcgttgaatgttgagacagcctgacctggtagaaaaagcctgggcccgcgggtcagatggccacgggttcagattcctgttctgtcaattaccagcaggtgaccttgggaaggcacctagcctcttagagccactctcatctataagatgagcacagttactacttttttgcgttgtgtgagggtgtgcataatgcccagttcctggatgatgcagaaaaggaatctatgtgttgctgatcttagtggaagcaaccctagaacatcccagcaacccagatcaagctcgctctttcttttttcttttttcttttctcttttcttttcttttcctttcctttcttttcttttcttttctctttctttctttctttctttctttctttctttctttctttctttctttctttctctctctctctctttccttccttccttccttccttccttctttctttttttttggagacagagttttgttcttgttgcccaggctggagtgcaatggcacggtcctggctcacttcaacctccacctcccgggttcaagcagttctcctgcctcagcctcccgagtagctgggattacaggtgcctgccaccatgcccgataatttttttgtatttttagtagagacggggtttcaacatgttggccaggctggtctcgaactcctgacctcaggtgatccacccgcctcggcctcccaaagtcctgggattacaggtgtgagccaccacaccaggccggaccaaacactttctaaacacctggaggacagggactttatttctcaaagtagcttggacttgggttgaactcttggccatacgcagaacttttgactaaaattggccaagtgagaagactgggctgcaggtgaacatggggcgtgagtgtgtgagcataacagtgtgaggaagaggagcaggcgagtggggagctgccccaaggagacagatggcagaggggacagctggagtgaggcctgagggagattctgctgtgtggggctcagtggggaactttctggggtagggggagcctccctcctggaatggtctgccttggtgaggctgagcgaggctgggtggggcagacagctcctcaggtgggtccaaggtggccttggaaggaaggaggggccaggcagcccagcatggggtgagaggaggagctgtaggcctggccccaggacccagatggtggggtggcctcgcttcctggactgccctcctgctcactgctgcaggactggcctcctgtcaggccccccatcctcctgacccagagcctccgctggccctcggtttctcctctgcttgctctctccggccttctgtgatctgggcctgccttccctcagccctgcttctgacagcttccgactctctggctgtctgctgcccccttcacccctcagctactctaggcctgatgtggtgtggtccttggggcacgtctgctccctccccgtcgtgtgcagttcttccttgtctttgggcctcagcttgagtcccgcttcctcagtcctttaaaattgtacggccctctctgctgtctcctgcttagaatacggcactcgcaggagccagtgccaccagatgataacactggtgtccccatggggacctttgcaagcgcaggctatgccgtttacttgcttctaccctgtgctaaccgtataaggtagacacagttgtccgcattttatagataaggaaattgaggctcagcgaggattctacctgaatagcctgtcttcttgactagtttccggattcttccctgggtgaatgtctcatctctccaacttgactgagttgcatcagtgggcagaaaccacgtttttggtttccacagcactcccagtgatgcgccctgtgccctgcggttccagtgggttggatgtcagctgcgaagagggcccagcttgttgggtcttgacacagactcaactcacagaagcccccagccccgctgatgagacgactggctgatccaggcggggagggcacctggagcagggcccctggcctgggggcttaccctgctcaccccactgcttccttctctccttcttcctccagggaactcaatggcaacaacatcactcggatccataagaatgactttgcggggctcaagcagctgcgggtgctgtgagtatggggtgctccctcccaccccacccctggcaatgccacggcagtcctgggcagggccctggctgtgggtggtagggtggtgggctgtctgggcccctctaccacggagtcagtcttggcaagacatcctgaggggtgtcgggtggggtgatgttgagtcttgagtcttaactcatcataaggtccgtcgccctgtgctctcagggtagtgcaggggtcttaggacctcagttctttcagaactcccacctctgcagttctgagggtctttggaggagcagggacctcgtgaccaatcgtctctgaggtcagagctgacaagccgctgggcacggatctgctccagaaacccccaacctctgccgcttcccaggctctgggtgtgtcccttctgagtctggggaggcccatgctctctcccaggattcccctcccctctgcccccaggcctccagcgggagcctctcacacttcaggcttttggaaacaaagcagagaaagagaaatatctggtggcggttcccccccctgccctgcccccaacgtcatctgaggcccatgcaggggcacgaaagccacctgcttgcgggtggagagggacagatgcagggggaaaaacacacttgactatctcaaaagttatcacgcaacagtcaatctgttggtgaaaaatgctgccccaccagccggatgctctgggtttcagggcacgttggcggtgaggggatgcagagtcccacagagccaggtggttcagttggcgtgggcaccccactcttttcttcagcagatggggccaggcagggtgggggtacagggagacagggtgttgtctgccaattgtagagtgtgttgctgcctgtgtgggctctgcccagttggcacaggctcccctccccctgatactggccggtccccccgttctgtcccttggacatgtgccttcagggcccaaagaggccagggcacgtgcgccagcagctcaagccagcctgtgctgcctgctgctgggcctggctccctggagcctgattggagcggagacatggtgcttgggtgccctgtggccttctgccctggcaggcagcttcagagggtcagggggttgcaagtgcattttgtggtgaggtaagatgctgggagccctgaggagcccatggtgggaaatttgcaaaggtgtaaggaaattgagtccgctcaggccaggcataggcctgtgtgaggcttgggcatggctcctgtcttactcccttgctaatgctgccctggcagaggttgcctctgccccgccgttgtgccagctgtttctagcagcccttgtcccacaccctgtagctgtccttgtctctttgcttccccaggcagctgatggagaaccagattggagcagtggaacgtggtgcttttgatgacatgaaggagctggagcggctgtgagtcctggcagggtgcaggccaggagggcggggggctggcacgagagggaactggcaggccaagctgctgccagggatgaggggcactcatgggaggggaccccatgcccagcctgcctccaccagcggatggagccaggagcagctgcagctgtgaaagtggtcacaaggcatggtcacagagaaacctggagtgggtccccaacccacattctccatgcaactgtccctgttgtttttccctgaagatacgggatggcaaaaaatttacataataatacagaggaagtgacatttcttcctgtcatctcatcctgacataaccgctgtccattgatttgtgtgtccttaaaggaagccgtgccaacggaacctgtcagggaagccccgggggattggtgtcttaggtgcacagggccacagtacagaaatgggaaggtggaggcctgtcctgattcacatggtttgttgctgaatagggcttttaagtttgaaaatgggtcttgatcaatttttacatttcagtttggcaacgatgaaaaaaaaagaaacatagtggggtgaggtgggggatgggcactcatcatgttcacggtggtcgccgatctcgtccttctgaaagtggtttggctgtaggtgttaggagtcctaatgttcatgctctttgaaccagaaagtccgttttattttaaggaaataatcagagacatggctaaaaatcatgtatcaggatattaattgcactttattatttatttatttttgagaccaagtcttgctgtgtctaccaggctggagtgcagtggcgtgatctcggctcactgcaacctccacctcccgggttcaagcgattcccccgcctcagcctcccgagtagctgggattgcaggtgcatgccaccacgcctggctaattgtttttgtatttttaatggagatggggtttcaccatgttggccaggctgatcttgaacccctgacctcaggtgacacacctgcctcggcctcctaaagtgctaggattacaggcgtgagccaccgtgcctggccattgcacattacttaaatagaaaaaaattggaaacccattctagtggatacataagaaataaaatcacatttctgaagaacagtgaagaacacatgggaatgtgctcgcaatataatgttaaatggaaaagataaaaaatgacaatagtattactaaaacaatttgcatgtggatagaatacaggaggaagaagacaactggaaccactaactctcattatagtgagtggtggattatagataactttatttttattctttgtgtttttctcttttaatggattttcttatgacaagtttattattatgattatagctaccaccactctatgccaggcacctggggaagctctttgccttatattatctcatttaatccttaaaacaacactgctctaagtagtatttcacagatgagaaagagaggtacacagagattaagtcacttgtccccagttgtacagaagaggggattagaacccagatcattttgccttcaaagtctgagctcttaatgaagatgacttgatacctcacctttctttttttgagacggagtttcactcttgttgcccaggctggagtgcaatggcgcaatctcggctcactgcaatctccgcctcttgggttcaagcgattctcctacctcagcctcctgagtagctgggattacaggcgccagccaccacgcccagctaattttttgtatttttagtagagactgggtttcaccatgttgggcaggctggtcttgaactcctgacctcaggtgatccgcccgccttggcctcccaaagtgctgggattacaggcctgagccaccatgcctggctctttcatttttatattaaagaaaataggatattaaataaaaggaaaagaatccgattgcctcgttgccctcctacagcctggaagaaagcaaggcaatctttcttttgtgctcctcatccaggcctaaaacgaaatgataaggagcccacagctagaccagatgtcgaatgctgcatttgttttctttaaaagacttagaataaaatacatgttaatgacctggctatgaggggctgatttgaacctgacccaacctggctccacctcttgtgctgggaaggaggggaggagggaaagggtctggggggtcgagacatgaccccactgggtgagtggcgactttaggcctgcaggcaccttcctgagtggtcagttcaatggtcgccgcctgagttgttggagaccagtggcgcatcagttgatcgtaaaaggtgattaaagtgcagagtcattaaaaaccacacataccagccaggcacggtggctcatgcctgtaatcccagcactttgggaggccaggtggtgggggtggatcacttgaggtcaggagttcgagaccagcctggccaacatggtgaaaccctgcctctactaaaaatatgaaaattagccaggcacagtggtacgtgcctgtaatcccagctactccagaggctcaggcaggagaatcacttgaacccgggaggcggaggttgcggtgagccgagatcatgccgctgcagtccagcctgggcgacagagcaagtctctgtctcaaaaacagcaaaacaacaacaataacaacaacaaaaccccacacataccttagacatttcattttatgttaaaacatataaatgtgcatttactgacccctcctcttttttttggccaaagtctttctctttggtgtgaaacgctggtgttctttctgtgttgtttgcctcgcctaaaccacacacgtataccttgttgatgatttttgggtttggtttctggaagatggagtgagattttccaaagggccttgggagcaatctgggggagtattcctgatttttaaaatgacacccacccctgtctgccaccgtcttttacttaattcaacagccctttaattagcagctttcctttcatcgaatctttctaaagcattccacttagttttcatagagatgactctttttccactagcatttcattcatttatgtaataggtaattaaattatagagttagaatggcaagtgcctctggcataaacaggtttgggagtagacataactggttcttgtgagcagttataaactccagagtagatgcagcagtgtgcagttgagctggccaagagggatcaggacattgtggcctcagcgggtctgcaggtggagaggagtggagtgtgcccagtcaccctgggagctggcctggcactgtaccgtggccaggatcataccatgggagcagccaggatggggagtagagaaaggcaagcttcaagatcccacatctaccattcagtaatggcttgggcgagtcacttacctcttggtacccctattctctcatctttcaaagatgagcaactcaacaaagtcagcaaacctatcttgggcacctatgaagagccaagccacgtggtgcagtggtggcaggaaacctctgtggggggtgtttgttgagagtcaggagggtgagggcacgaatgcaaagtgctgttgtcactttcaagagaaagaggcccacctttacgctccgctttcccgcccgcgatgagctcatgcccctaatgcatttgccccatgcctggcacatagtaagggctgattatgatggtggccatgactactgttatcattctcagtaaacttcatgtccctcgccatgtggagtcccttctttagtgtcctttaattttccattttaaactaggcattgaatccctttttcctcctaaataattttcagaagcagaagccagaaaaatgagaaagtcttgggggaaaacaaaacaaaaccagtggttaccaggcagtgtaaatacaggattaatttactggaccaaggataaagaatttggagctatctgatgtctactcctgttgctttaaggattgtattgatgattttatccccccaaggcaatgaagtgtttccctaggagcctgcccttaaaagtaaacttccagtgggtctgcaaaagttgacttaattgtctgtaccttggggaacatggcggtgcccaatgtggtggcaatggcctttctcacatattagatgaaggatgaccttctaggaggtaaccacagaccaattactgctggctacatggaattaagtttttccccttccctctggaagtaagcttttggctgagatggtttatcatacagttgtcccttggtatccatgggggatttgttctaagacccctcagacacccctggggctacaagcctggactaccatgcccagctaatttttttgtattttttgtagagatgacgtttctcttagttatttctctttgttacccaggcaaatctgaagcccctggcctcaagcaatcctctcattcagcctccccaagtgttgggattacaggcaggagccatttgacatgctttttttttcttctctgagacagagtctcactctgttgcccaggctggagtgcggtggcgtgatctcagcttactgcaccacctccctggttcaagtgattctcccacctcagcctcccgagttgctgggattacaggtgcatgccatcatgcctggctgagcatgcatttttattaatgataaaaataatcaataaaactattttctttctttctttttttttttttttgagacagagtttcgctctgtcgcccaggctggagtgcagtggtgcaatcttggctcactgcaacctccgtctcctgagttcaagcgattctcctgcctcagcctcccgagtagctgggattacaggcgcctgccaccatgcctggctaatttttgtatttttagtagagacggggtttcaccatgttggccaggctggcctcgaactcctgacctcaggtgatccgcccgcctcggcctcccaaagtgctgggattacagttgtgagccactgcgcccagctgctattttcattttgaaaaaagacccaaagcaaacaataaaaaaaaaagtgaaacctctgttgagccaaatgtggatgaaatcagggctgtgtggccattagggtatgtctcccatttcaagtgtagtcaggtttccaactcacaaagggaaacagcattggaatcagtgccttagaaaccacacagggcttgcaaatgtgaagtgatgatgatgatggctatgggaagaagtagtggaaggagaggtgctggtgaggggcttccgcagacactctgttcttatcctcccctcgtgctgggtggtggaatctccactttacagatgaagaactgaggcccagagaaggtaatttccctgggatgccacatggaccctgttaggatttgaatactggaccttctgcctctgaatccatcttgtgctttctgagaagtcctttggatttcctggctgtctaggtgatttccaattcttcttctcttttataggcgactgaaccgaaaccagctgcacatgttaccggaactgctgttccagaacaaccaggctttgtcaagactgtgagtgacgctctgtggccagagagttctccctgtggttttgtctctcaccctgtgggaggcacagtgtttggtcagtggggcctggatattcccatgaccctgaccctgtgctcctcccctggcaggaatggtccagggcatcaaaggccaggccctttctgtaggaaggtgctgtgcagggtatttctccatggcaagcacttggaagaacccgcagttcatccagatttgtgagctgccgctgacagtgtgggtacaagggtgttctgcaggcaggcatgcttgtggacggtgatgccagcctttacaggggctcattcttacccatctcactgcgcctttagtaacctgcctggagctgaatatttactcattcaactaagcccttcttgaacctatttctattttcagctctttctaccgtttagggccatgaggtctgtaaggttattaaccatggtataagatcatatttttatgtattgtcaatgtacttctttcaagttcgaaggatagttgctaattctgctgcaccatgatttgccacatgtgtctgtaatttttctaccatatatttcattttatgggaattgggttggacaagacctttgagattatctaaggaatctcttctgcagctccttagcatatggtcccacagtctttgcttggctacctctagtgatggggagctcaccacctctgcagacaatcaactctatcactggacaaataagtaaattagaaaatttttaactttgggccctaaatctgctctccagtaacttacatatttctcagttttgctttctataactacctagtttttgaagagctgtcaggtttttgaattttgagttgggatgttttttagttcccttaattgttgtcattaataaccttaagagccaccggcagggccttctgcatgcctggcacagcactactggttcgtccctgaaggagctatgggtcagcacctaggtagagaaaggggtaataagcaatgtaggtaagactgaggggtgtgggttgggtgagagtggcaccctaaggttacctgagtgctaaggggtctgaccatgggctcctagagtctggggcttgattttgtctcctctgattaaacacagctagttctttctgcctctgccatgatttctagacctctctgtaagcccagtgatctccagaatttgttgttgatcttaccttcaaacttttatttacttatttttgagacgagatgttgctctgtcacccaggccgaatacagtggcacgatcttggctcactgcagcctcaatcttctgggctcaagtgatcttcccacctcagcctccagagtagctgggactacaggtatgcactaccatgcctggctaattttttaattttttgtagagacggggttttgccatgttgcccaggctggtttcaaactcctaggctcaagcgatccaccagcctcagccttccaaagtgctgggattacaggcgtgaaccactgcacctggccaagcttttgtctttacaatggaactctaattttcagtctgttggaatggtctttctggtcacttcctgttgcttcctcctcctggcctggagaccactccacagtgacctttagtgatgatctcttttgctggtctttgccaccacccttgggcttgagttgggccttctcctccagttttcctgtaactgataggttggccaatccattctgtgccaggcatacacagtgggtgcttaatttttccctacttgattgcgaaaggcagaagattcttcccagcaggtgcctccgtggtaatgtctgttgaacctgtgggccatgcactggtctatgtggtccatgctgttgctggccacatgcaagcatctggccttgccctgccttggccccagcaactcctgttttctctctgctgttctttctctgctgacttgcaagtgttatcacagctctgcctttctgcaaaaattcttcttgaatgtcttttctcttggtctcaattgtgcaattctttccccctcctatgtcctcttaacctttcaagcttttgcccttgctctcctggcatgatttgcctacttgggtcccttctccttcccatagtgatccgttgccctctaccttgctgggatcaaggcatatgtatactgtacagttgccgtcaagctctgggtgcccactttcactctccctcattgattttaaaatctccaagacccatcatgtaaatctgaatccaccaacttccagccctttacttgagatcatctccagccatattcatttttagcggggagctgacttcttttgtcataaccttccaccagcccttgggggtaaagggtagctctgcaggggactccctccctcctttactcgagtccacccttctctttggacattggtgccttgcacacacctgtgttccttcctgaggaaaatgacaacttggctgcctccttggcctgtgtctgggaaacctggatcccccctggaatggaaggtggcctgggaagcagaaagtcaagggtcaggtggtcctgggcttttcaaggcataactttgggtggtttaattgttcagagcccatttctcttacccatacatggtagggctagtaggagtctgaactgggactgtgcatgtaacataaccaagcctgcagctggccctcagtggatgttcatccatcatgcccctgataactcagggtgagcaaatagcccctcggtgaagcaggtgctcctgtgcttgatatcttgtctgacacatgtggccatgaggcaagcaatgtctcccactgttactgccagcgagacaggttggaaagaggaagtgacttcccgagagtcaggatgaagccctctgactcctaggcccgccctcttcatggtttcatattttacaggagtcctagaggaaaggacatctatattttaatgagtattaaatagccagattctataaccaaaggctggcacaagaagattaaatcaaggagcaaaaagccattgcagaggacagcactctgtatgatacctgctcttggcaccctatggggctgggaggcagaagcctctagacacattgggtgtcctcattgcagtggtcccaggccagctgctttcgggagggggctggttggcagccaacagagggacttccaggagggcagtggaagtcttggtagccctttgggggggtgtttctaggctctagagccagaacttctccctaacacttactgtcttttctttccaggcatcaggtcctttactctcagcaggaaacatttctcatccaggagcatagcaggatttgggtgaaggcagacttttctttagctttccccttgacatttcttaacctcatctgtaagcaaggcatgcaaaccgagaggactcctgcagggctcttggaggactcccaggcagtgtgccctgcttagtttgcactgaggccaaggcatttggtggccaccaggtcacatctcaaaacgggcactgtctgggggaaatgattcaacaaaccttatttatctggttgttcgtccctggtgtctgggcttaccgggttcttcaccttggagatggttatagggaaggatagaggagcaagtgtttaaagatctacttgttaatattcttctaatattactgtgtacgcatccgccctgccccattctattgacctgagcacctggcattctaaagtatctctgttaactcccccagttggtctggccaaggagtactcggcacgcttggttccagaaacagaataccctgccggctggtgatggtaaaggtagaggcggggttttgtaggggcacagctggcaggctcccaggctcccagagcaggaggtgagatccagctggccctcccagggacctgcactgagatgtgagggccatttctcgttatttctgaatatctgccttattgtcctgctcttccctgcaaaccagtgttctaggatcatcagcagcatctcgattccatcatgactcaggtcagccatggtgccaatttgcctcctacttcctgtgacctcggagctcagatccacacagcgtctcaggccccaactccgggtttctgggagagtgaatctgattggcccatcttaggtcaagaggtcacaccaggccagtgagctgttggcagggattgtgggatccgctggtgcagcaacactatggtgcccacactatctcaggagctggagtgggacctattcccttagaaggcagtgcctggcattcctgttctctcacttgttgacctcccctttgctttgtagggatctgttactaattcttcccatctggagcaaattatggactttcatgcacaggctgttatgctaaatcagcatgaaaatgggtttgagagagaccaaatgtgctgggtaaggcatggtcaccaagtctgtaggtggtggcgcagcccacatttcagttgattttgtctgtgtggcctccagaagttaaaatcctgttaggggttattctgcacgaatgtttcccctgctgtgaggttagtctgtctatttctttcctatgcaggatctatggctcagagaggtgatttgccttggaccacagagcagcttgacaatagggttggaattagacaccaggccttctaggggccctgaagagcctgaaaatggtcttaaaccttgacctaggaatctcatatttgggcatctgccctaaagaaataataaagcatgagcacagacatgttcgttgctgtattatttagaatattgaaatatagaataatgaaaagaatatggaaataacatatatgtccaacattgggggcatgatgaagtaaatgatgatgtatctacttgatggaatatttataccatcatcaaaaatggcctttatgaaagatgtcaagtaatgcagatacatgtgtttgatatcaaaagccaggattccaaactgcattgacaatatgaccacttgataaatcactctaaataatgcatgaaaacatacctggaaaatgccaacagggattgtctgtgggtggcttttttctcttctgtgtctcagatgttctttaagaagcatgtgttacgtttacggtaggaaacctcccagtttttaaataagaagtgaaaagcctctgtagtctgaggtgaagcaaatgcctgtgatacgatgttgcagcgtttcctttaaccgagcctgtttgctcttctgtgagatacagatagtaagggctggctgcctcatggggctgatgtgacgattaaagagagctgtgacactctcttgtgtcagacatgaacactgtggcacacgggaggtgcccaggaaatgtcagatgagtccacatcagggctacttcggagggtggtgcagccccagcgtgacctgcacctggacctgcgtcccatattgatgttggcttcccctgtcccttgtgccaactcaacctcaccactcttaactcacaaccatcccctcaatttgcagggaccttcccccaacagggttttgtttttttttctcgaggggcttaggtgaccctgcagagacaccctgaggaggctgtggagggaggctggcatgtggtgggcaggagggccgtgaccttggcacagtcagtgcccgggctgaggatgtgggagatatgctttctgtcctcttgggcactttcctgagcaggccagggagagcaaacatggagcaagtaggtgatgctgccctggaggcatttattggtgccctgaaattacatatgtattctgtacttccccagggatgcccccattgagggtgggctggagcagcactcacacctcttcagaagagagcacacccccttccccaaccccactgcagaagtgaacctgccccatgacctccttcactgcctcactctcccagggcctcatgaaaggtctcagggactgcaatcatcatagtaacggttagaaagaatggaaggttgttgtgtgccaggctcatgctgagcaacttacagatatacctgatttcatcatcagaacactctacgaggtcagcactttccgaattttacagataaagaaatgcaagctcagcgggtatgtgacacatccaaggggctaagccaaatgtgaaccccagtctgtctgacaataaagctcatccttacataccacccctagcctgcctcacccatccaccccctccacccatccacccatctgtccatccacctagttatcaaccactgcccttcacctcccatctaccttcccaccatctaccaacccatcagtcaacccacccatctctctccctactcctgacccatccctccatcccccatctcctcccatccattctcccatccagcactccccacccactcaccacctgcctatccatccactctcccacccccacccatcaaccctccccctcccacgtacgcatctaccaacctacctataaacccagatacccttctatctcccaactcctccccaccttcctccacccctgtattcgctcctgctcaccttccatcttctactcacccacccactgatccaatagttcctgagggcctcctgtgggccaggctctgtgttaggtactgtgaacccttggagtgatgtctaggtaagatggatgagtgtggccctgcctcttaggaggtgacaggtctgtcatcagtgctctttgagagcagcctgccaccctctgacctatcagcagattggagtgggtgggggcaggtgctgcactggctggacctatatctccttccggcgggggggcaggtataccctggtggggggttacctaggtttggaggtcagctccgtcacctgacagtgaaccctcagaggatgtggagatgttgtttccatggacatacacaggtgttaagttgaaggttagagggatatgctggaaacctgattgcttcttacagcagcaaaactcagtcttcaccaggttcaggtggggagcagggtgtccgcccaccacgcatgccgcctccttggcctccaatctggggaggatctctgctgccgtgcagctctgctcttgctgatcccctcgtcatccagaagctgcttctggaaacccagttcctctgggcttccttttagccttgaaaccaatatgtgtcccaacaagattgaccttttgtgtctctgctgggcctggaaggggtgggggtgggtgattaagggcagcccagggcatttatttccccttatttatatccctgctgtaaggaccaccataactcattaacagggccctggtggttggagaggcgtggatatgagattcacaggagccctgctgaagaatgcctgaccctatcgaccctgtctcaagctgggtttaattaaactgtcagcactggtcagaagaacaaagcttcccttcccgtcttggtccccagcccccatcagaggcaggagggcattctctgctgaaatgaagagctgttaaaaatggatctgttttgcctctgagggaaattacccaaggcaagaaggtgacctcgctattgtgacgcatccatgccaggcagcagaactgcagaactgagccagccatgccccgagacaccagcacacgagaacggggctcccagccgcccctccccagccagagcctccttcctgccagagtcctctggggactccttgagatggcggtccatcactccttagacttccctttcccagaaaggaatttcactagctttgtccttcaagatattgagatgttcctggcattaatggtaaaaaggagcttccttggttaaacaatttggggaagagctgggccaagcagagtccttcgtcaaggactattcagcccatttaacacgctaatgtgcgccatacagctcccagggcagatgtggaatgttgcgtctcccaaacatatctgactgtgaacctcaaaaaatttattttttcggggaataccttttaacatcagcctagtattaagtaacttgcggaagtctcagacagtaagaatcagagctgagattcgaacccaggcccacctgaccccaaacccacatacttaccttcaaactgccagtccttgaactagagtatgattaagagttgtctcagtggggagtttattaaaattcagattcccagggtcacactcagagattctgagtcagtcagtgtggaagggcccaagaatctgcatcatcaaacctctctttatctggctcgtgcttgagaagccttgctccccgtcaggcatggtgagtcttaggaggggcttcctgttgggtagagctcctctttgcttctgccccgcccggttcaatgtgagagccatgctaagtaagggaaggccccaagcgcagacgcttcacctcctgcagctacacagagaacaatttggggattatgagttggcaattatggagcactctggattctcgaagtgctttccaatcattaaatctgcgcctgctgtcaaggctcaagtgaaagaggcgagcgtcccactgggccggcacgggagtctccgggaagagggcggccggcctcagattgacatctgctcgccagagcgggctgatgcgcccagcatggatgaatgtcctagacacagccctggtgcctggctgtgggctttgaatccagctctgcccctgctggctaagaaccacacagggttttacaaatttggacagccaagggagcccggggcctgaaggagggccacgggggggtggcgagcggtcagtgggtcatcccgagagaatgcctggcaaacgcggtgtgccctgcacttacaggggctcaaaggcatgaaaagccactggtcctctcctacagcattacaaaaattggtgtgagacaaacggaattcgtaaccattgggaagattctgaatagagaggcgtgcgtgcaggaacgggctcttgtgaataacttttagggaggtgaggattttagaaaaatcatttcaaaagttacacaaatattatttgtcaattaaaacatattaaaaataaaatttctttgaaagcatacgattttaaaataaaaattatgaaaataattttgctagaaagtgaacatttgaaaaatagcgaaaagcaaagaatgataggagataagggatttagttttctagttaaggcatttaaaggtgattgagctaacatgcaaaattttaaaaaaataaagttttaggccaggcatggtggctcacgcttataatcccaacactttgggaggctgagatgggagaattgcttgtggccaggagttcgaggccagcctgggcagcataggctctacaaaaaataagaaaaaatagctaggcatggtgatgtgcacctgtagtcccagctactcaggaggctgaggtgtgaggatcgcttgagcccaggagtttgaggttataatgagttatgactgtgccactgcactccagtctgggtgacagagcgagaccctgcctcaggaaaaaaaaaaaaaagcttagtactaaagcaatatgtaattattataatgatagttactgtttgttaagcactcatgtgccaaaaactttatgtgcattttctcattttaattgtcatggtcctatgcaatgggtgctattattttcccatttttataggcaggagaattgagggcaggttaagtaaattggttgcatagctagttgttggcagatccaggcttggagtacaggaagtgctacccagagggtgtgctcttcttcaccatgctgtacacccttttcattgtagaaaatgggagaaaatagagaaacagcaagaagaaagagactgctcacgagtcttctgggaaggtgggtttcaaggtatcgaagggtatgggagacacaggagggtgaagaggaagaactggactccagtggaaggagcagctgtgcagacacaggggtgggaatgcagttccctgtgagcaggggccccacagttctagagtgttgtgtgagctcagcctggaagggagtgtagatgggctctagacctagaaatgttctagaatgaagagtttggatgggtaataggaagaggaagccatggagtattcttgaagagtggggcgacttagtggagagtgagcctcagtcgccccccacaaaggcctccttcccccccctcccagctctctgaacctgagccatgaacaagagggacagatgggccacctctgcctcacctgggtctcccacaggttgcctgaaatgccaccttcccatcacagcttctcagtttctccctccccagaaaaaattggttgttgcctccccagtgccctcttttttttcctttgtaacacttttttaaaatcatggtacaatatacataatatttatcatttcagctatttgtaagtgcacaatttagtggcattaaatacattcacgatgttgtgtaaccatcatcactatctatacccaaaatgttttcaacatccccaatataaactctgtacccattgagcaatagctcctcatccccctccctgcagctcctggctacttctcttctggttctaaaactttgcctgttctcagtacatcacagacatggaatcatacaggatttgcccttctgtgactggcttatttcacttaacatagcacttttgaggtccatccacgttgcggcacatatcaaaatgtcatttttttttaatggctggataatattccactgtttggatagaccacattttgttgatccattcagctgttgatggacagtaggttacctccacctctcagtgcccttttagcagttgcttgagcctctgtcagagcccccacaatgctcctcatagctctttgccttctccaccagagaaggcaatgccttttccaccagattggacagaggctcaggcaggagtcgttcttgtttccccagcacaagtggggttagcaggctggcaagtgtggtttctttctggtggcagacactgtccgaaggctgaaaaaaggggcgccgcccatttcttgctgtctgatttcagggcttggggctctatgggtctgtgctgggctccagcttcatggattttgtagactcagaactttccagctgacttctgttttacttgacctgtggttggcctggacttgtggtccagaaacatgaaggcagttatttagggtttagtgctggcttgcaggataaataaaatctactgggaggtgttcagtggggggggctggggtacctctctgtgtgggtagtcacagagccctaaagaaggcccctgtttcctgggaggcagggaaagcttgaggagggagtcaagggagaaggggatccaagaggaagcatggtcctttcagtgggtagagacgggcatgagttggtgccaggctggactcagggatgcagtgatgacttgtacatggtaggttttgaccaactcaatttttggttaggatgggccaggactcaccacctcctagttagacccttcccttaagccgtgacccaggtttgtatttgtaatttttagccaggcatcagtggatcttgaggagctcaaagaagtaacgatggggttcctcaagctctttgcagtgtgtgccctaaggcaaaatgtgatcacttcaatgtagtctttgatttggggctggaatcctatagtttggaatcagtttggtggtgcaacactggctctctgatgctaatgagaaaccctggctcacagttgattaatcagctcttgagtaatgcaaatatggcaagatacattattaaccaatataatagctcagatctttcaaatgttgggtttggggtggggtgggaaaagtatcaaaaggcatctttttggtgacatggccgggaattactgtcttgtgcgtttgggcctgttcctgccccacctcctccatcccatgctgtagggcaaggagccctgggctcctcactgccgcagtctgtctggctttggccccagtgtttatgtggagcatcttggagaagccttatctttgtctcagaggaggtctgagtgtctcctgctcttgcaggagctttggagtagagagagggggataaagggaaggtaaggaactgataaccccatacccaagtcttaatctctggctctttttccctcagtcttctcgggtccagccacatgctgacctttatctggccatttgttggagctgatgagtggcctgtcacgagtggaccctcacatggatcctgcatacgagagtggactacagcccggcagagaggggtcaggcttctcacatcagaattgtgcctgaccagagcctgttgaggtggatgctcatctgaaaggaagtgctttccatgtaggaaaaatggacagcatgaaaataggtcaggcacagtggctcacgcctgtaatcccagcactttgggaggctaaggagggtgggtcgcgaggtcaggagttcgagaccatcccggccaacagggcgaaaccctgtctctactaataatacaaaaattagccgggtgtgatggcaggcgcctgtagtcctagctacttgggaggctgaggcgggagaattgcttgaacccgggaccgcaccattgcactccagcctgggtgacagagtgagactctgtctcaaaataataataataatagtaataataacaataatactgtacatcatttaataataatactgtacatgcccccacataccaccccagcccaggagcaccccaaaggcagctctgctggctcttccagttggaagttaggttccttggcattgagtcctctcttttcctccagtgatcctgggtactgattatctgtggggctctggacaagttacctaacctctctgtgtctatttcctcatctgtaaagtgttgggggatattatgaagattgggggtgattgtatggagcatgtagtgcaggtattgtgattatgatcatcacccaaaccattgcaagtgatagaggggtaggtggacatgtcctgtcctgccgcattgcttggatgctgaggacaatttgctgtcctagaagttctcacaagttggttttggctggggggttgctggctcccgcttcatcctggcttcagtgggaggttgcaggctgggcctgggagcctgcaggtcacctccctgcttgtctctgacttagcggggcctgccctcagttccactgcctgtcttctctgtgggggacagagctcccctttgcatcttgcctcagtgcactcaggatttggcaggcagcttagcctgccgcctgagagctttactcctgaagtctctcctttctttggtttatagactgaaaatggggtagtgacttcatacactggaagaagaatggctacagcctctttctctgaatgcatttcccaagagttggctttaaatgtagagttcttcattagattaacttggcatgaatattaacatgaattagaacttactacccttaaattcttgatctataacagagcaagatttgaagaaataaacccctggatacagtgccttacctttttcatgaattcttaactggaatagatctctgcttaatctaatctttttttttttttgagatggagtctcactctgtcgcctagactggagtgcaatggtgctatctcggctcactgcaacctccacctcccgggttcaagagattcttgtgcctcagcctcctgagtacctgggaccacaggcacccgccaccacgcccagctaatttttggatttttagtagagacggggtttcgccatgttggccaggctggtcttgaactcctgacctcaggtgattcgcccacctcagcctcccaaagtgctgggattacaggtgtgagccactgcgctcagcctgtttaatctaatcttaactttaacattgaacctctgagcatcaaaagtccttcctagaacatacatacagtatcgttactttgggacttcaggttatcttggcattagaagttcgtggaggcagcagaggttgttgtacgtaaatgaagcattaatgttcatattcacaaagactcttcagcattccctgatgtatctgcaactcggttctgctccactgaaacccaaaccccatccctcctttttttccagttctaggctgtcctacctctcatcaatagtggcttttctaaaattgtgataaaaacacataaagcttactgtcttaactctttttaagtgtccagtttagtagtgttaaatatgttcacattcatgttaaacagatctccagaactttgtcattttgcaaaactgaaagtctattcccttctccccacagcctcaggtaggtaccattctattttctgtgtctatgaatttgactactttagatacctcatatgaatggaatcacatggcatttgtctttttgtgcctgccttatttcacttaacatcatgtcctcaaggttcatctgtgctatagcatgcgccaggacttctttacattttaaggctggatagtatgccattatatgtataccccacattttggttatccattcatctgtgatggacagctgggttactgctacctcttagatattgtgaatagtgctgctatgaacatgggtatacaagtacctctttgagaccctgctttcaattcttttggatatacacccagagtggaatgactggatcatatggcagttctatttttaattttttgagtaagtgtcatactgctttccatagcagctgtaccatttcacattcccaccatcagtgcataaggattccaatttctccacatccttgccaacacttgttattttctctttttttttaacagtagccatcctaatgaggtgatatgtcatcatggttttgatttgcatttctctgatgactagtttgcgcatcttagttgtgttgagcacaacatgattagttatgttggttatttgcgtatcatctttggagaaatttctattcaagtcttttgcctactatttaattgggttgtttgattttttttgttgttaagttgcagcagttctttgtatattctagatagtaaccccttatcagagatatgatttgcaaatattttattccattccataagttgcctttccattcttttgactgtgtcctttgacaaacatggttttaagtttgatgtagtctcatttgtctattttgcttttgttttctatgctttcggtgtcatatccaagaaagtactgccaagtccaatgtcatgaagctttccccttatgttttcttttaggtgttttagttttaggtcttacatttaggtctttgatccattttgaattaatttttgtatatggtatcagataagggtccaacttcattcttttgcatggggatattcagttttcccagcatcatttgttgaagagactgtcttttcctcattaaatgatcttgacacccttgtccacatatacttgcaagagtttgtttttgggctgtctattctattccattggtctatttgtctgtctttatgccagtaccacattcttttgattactgtagctttgtagtaagttttgaaatcgggaggtatgagtcttccaactttgtttttttttaagaagagagatctggtttggcagtatttgttgtgaaagggccgatgacttcaagctaaggttaagtcaagagtatgttaagaggccaggcatggtgtctcatgcctgtaatcccagcactttgggaggcccacgtgggaggattgcttgagtccaggagttagagaccagccaaggaccagagatcagtgagacccttactctataaaaacaaaaaaattcgctgggtgtggtggtacacacctgtagtcccaactactgggaggctggagggctgaagcaggaggattgcttgagcccaggagtttggggatgcagtgaaccatgagcatgccactgcatttcaacctgcatgacttagtgagaccctgtctagtacaatacaatacaatacagtacaatacaatacagtacgatacaatacgatacgatacgatacgatacgatacaatacagtacaatacaatacagtacaatacaatacgatacgatacgatacgatacaatacgatacaatgcaatgcaatacaatacaatgcaatacagtgcattaaggtggctaaaagagtatagtctcagtttgaattaatagaggcaatgtgtcctctccaggggagggcagtcctgttctagtctgtgctgattcaagcatatccagagaacagtgttcagaaccaggatctgttttatcgcgtgtgcttgtgtggaggtctctgaacatgcttggaggagggtggctaacactgggagccatctggaaaccatttcatatgggatagagtcaaggggcctggggctgtttggtgcgatgaaaagaaaatgtagaggaaccctgagagtaattttcaaatctatgtgaagggctgtcatgaggacaaggaagcagatttgttctagaagctgggtccaggggtggaagtggatgttgttctgcacgaggcaggcttcctagacacgagctggctgctgaagggtgggctgctgtgcttgtcacctcattcctggaagagttcagggaggggctgaatccgcatctgccagaactgcgtgctggagctgtcgtcgggagccagggtctgatagcctcggggtgcttttacatgcagagcctccgacaagggagccgtggaggacttgcgagtagggaagaagccgacccaagcggtgtttcggatggttaatctgctcacagacacacgcaactggcagctggtgggtgcctggaagtcccctagcctgagcctcagtgttggaagccatcccctctagcaaagtggttccagtgagctgtgtaacaaaatatttaccagaccccagattctggcccacatttcagagtcaaatttggaacaataaaaatcgacaaatcgctttggaagtgatgtctgatttgtaaagagacacaggaggtttatccctgggcaaaaccagaggtgccgaggagcccgttctcccctgggctgcccccacccagccatcgcccgctgagcaatgactcatttccccctttgaagtccacgtagttgtctttggggccctggtgtttgtacccctctgctccttcaacaaaggcccttctgtcggccgatcgcggaggccaagcagggaagggttagaaaggaaggtatcgactgaataccaataaggaggggaagtgtgtttatggagaatgaggggctccaggcaacttgggggcccactcgtgctgtgcaaacacagcggagaattccctttggcgggtttgttttactaaaggctctggggcccaaggagggcggtgggaggggaacaggagagagggaggaaatatttcacaattcgaagttgaagcttagccccttgttggggaggggccggcctgagagctgcagggtaacaaagaggcagtgtgggctggtgacagttaggggaaaacacatggcaactaatggggtagtaatgggtagggaggtaacctgggaaaagctggtacgaggaacgctggcacataaattctggtggcgagacacccgccttggcagggagacaggggccactctttcaccctccccatggtcagagccagagatgttcccactcccaggaacatggtcagggtgagggatggcgggaagaggaaaagccatgctggggtttcatcaccctgcaaggcccctggaaagacagagaggaagaggggagcttcaggctaagtgccagaaatcagcacaaagcagaggcttctgttgctgctgcctaccccattcatagtgaggggcgatgggcaccttgctgagaccccgtggttggacccccaaggacacccaccttgtgagaggctttgccgatttcgggagtccccagctgttcagctggagccaagggcccagtgccctgtgtgcacactgacatgcagtgcccttgtaggggacccaaagatagggttttcctattcatccaggcccccggaactctgcacgccatttctaggagaatcctttggacatgtcagctctcagaggggacagtatttattacctgggggtttttggaggaagccatttagcagtttggatttggacgtttacagcttccatgaggttccccaaacaaccagtggtgtcccagagttcaggatagtgtgcttgttgacaggggttttggtaccctgtctgtcacagagcaactatttcttgatcaagttgataatactcttctcttagaaaccaaaacaaaaaagcaaagccactttttatgtatttccctatctttgtgtgtgtgaccagctctcctctccacagtgcttaggaaacatttaggaaagaagagaatggggatgctccgtttgaggggagcacactgagagcctctttctcctccaaggctactggccctgggattgtgaatccttaatgtgattcctggttgatgtttgcaaagtagcagctagtcttagactcctgagtacttccagtttcccatggtgagtgtccctcctgaaggtaactgaattctcgagatggcccccagcctgctgcctggctgagaggcggccctcctttccagcctcactcccgctgacttggccgtggggaccctgggctctgcttccctctccggatgcatggatgcattcattcacccgaccaactcattacaagcctgctgcctgcagtcatttgtctggcacagggaatatcaggatggattagatatggtcttgggcttaggcagagtgttgactggtggtgctgcgggttgctgattctcaagagggtgatgtaagctgtgagaatttgatggctggttggcagcctggctttttccctcctggttcccatccatgaaatgaaaaaacactggaatgtaaaaggaaacaaatagtgaaacattgtatttcacaggcacagatgcacacatatcaattatactgttatgctgttccagcataatcgccttcctcatcttcctctgtctcagacatattcaaatttggtcaccacacctgggtgtctgaatgtcttgtccttctaaaggtaactagaaaaaaaaaaaaacagtttcctacaaatcacaactgcgtttataggaaacaaaggacaggaaataattttgagcagatccttacgggaaacttgtgtaagcaaggcctggaactcatgtattgatgatttttaatagcatctttcccagccagctggacatggcatgagacttcagtcatcccgaagggaaggccgtggacaactggtcatttgaacattgaccacagaccgtggtgaccgtccccggcctccctgcaagagtgcatccctcgctgataagcgccatctgttgatagtggaggtgaatgcaggtgtcagctgtacattgcggaaggcacaggtgacccggaggcccgtaagtggggaggccactgtgcagcttccatctggacttcgcatgtaatattctctggtgctacccaaatataattggccactggtgtacttggtagattggttccgcaatcagcccttcggaacccgcgtatgtaaaatgccagccctcggtatatgcaggtttcataacctgcaaacactgtatttcccatctgcctctggctgaaaaaaatccaatataagtggacccaggcagttcaaacccatgttgttcaaggatcaactgtaatcttaatcgggaatcaggcacaacagggaagttgagtttagactctggaatccaatagctctgctactcaccggctcggggacctggcaagttgcttaatcttgtttagactcagttttcttatgtggaaacagggcatagcaagaaccaatctaaattgttgagcacagattaaatgagatgatgctgttaatggggcccaacatgtggtaaaccatcaagaaacattaagcaaccagcctgggcaacatgacaaaaccccgtctctacagaaaatacaaaaattagctggggatggtggggcacacctgtaatcccagctactttggaggctgaggtgggaggatcacttgagcctgggcaggttgaggctgcagtgagccgagattatgtccctgaactccagcctgggcatagagtgagaccttgtctaaaagaaagaaagaaggaaagaaggagagaaagaaagagagacagagagaaagaaaggaaggaaggaaggaaaagaaacattaagcttgtatttttcttgatagttaagtcagagtccctctaacagtagaaaatatggggaacaaaataaaacaattacatttccagcatcttaatcctcatcctgtatttagaatatgttagagcaaaattttccagatgtggttttctgattatttgtagatatttttccccccaaacaaagagaatcaggcaaccaaatgtggctgagattctggaattttggtctggatatcaagcatgtggaattcattctagcaagagaggagtgtgcctcgaagatgtctctctccaaagtgcttcagttaatagctaatctttccagactatataaaggatttcctttattatttaggaagaggaaaacattatttttaaagaaataaaataaaataaaaatggttgtttttaatgctgataaaaggattgtggtcaaatctgcaaacagcttcctttttcttttatttgacctcactgcaggcctgcttggtgtgaagtccaggttggagggatgcttgctggtttttccagctcatttaactccaagagcatcggtctttgttgagggtgagaccttgacagttatccgttttgactctaacagggaggacttgtccctgttcaatctgttctgatctcctgtctccattgttaatatcagctcacatccagaagggacctaggttgagaggtgttcctggtgacccggccactgcccccaggcatgtctcatcatgccacaaggacacagtgttgcctcctacacaccgacagtatgccttcaaatcttgcaagctctgtaattaggagcttcgttaaacgtggaaggatcactcatttctgcccatttcctggctttcagggaggacccagtcatgctcatcagtactctataaaacgccgggcagagatggtttgttttttattttcgtgtaaggagatgggttgtttgtttgttgtgggggcaggagcctgaagctttttgttgtgttttactttgttttgttttttgatgggggatttctaaaagtaaggatacaaaaagattactatgacacaatttacaaaattataatagcatatggacacattgttggtgacctactcacactgtagaagaggccaatgcaagtgagtggccttgaaatataagtttccttaacttcatggtaaagccacttaaaaaaataactttatttttaaagaacagttttaggttcacagcaacaccaaacggaaggtacggagattccccaaacaccccctgccctcccacgggtacagcctcccccagcagagtggtgcacctattacagtggatgaggggacaaggtgacacagcatcacccaaggccagagttgacacaagcgttcactcttggtactgtacattctataaggacttatagtgactttagaatatggttttatgagtgtgttgccattctttatttatcaccaatgccaaatgcagatgctgacatctcaagttagtcagcccgagggccccatcctaatgttaaattccatcatcaccccaaggaccccggaatgcaggagcccacccaggggtcccaggtgcctttccaaccaccaccccttccttatccctccccagggcacagtgtgtcagctcctgggcatttttctatggagcaggtaaaatagaatgatctcctcctatgcccaagagaagtggttttaacaggggacccactccccgacctggtctctgtcattgtccttttcggaaacgggaccatccgtggctgtttacatccccttctgcagcccctcctccacttgactgagcagccccgctggggagagacccaagtacagcatccagtcagagtgccctgagggctggggagcgcctgagctgtgggtactcactgcagccccctggggttacctctccaggcctcaggcggcccagcgggaagctgcttccaccccggcttcctcactattgctcggcctccagttcccaggacgctgagcttgccccacttccccttgtgattccaggtttttgtggatttctgcttgttgctttctacctcccaaaggaatactgttctgttgccctggctcttcaagtctgtgttctcttgaaggggcctccattctagggaggagggtagaactgcatgtcccttccctcctctttcagtgcgacgctgatggagttgcgcagtgagtggacaccgagcctaagtattttagaaccatgttaaatggccgaactgttatggacagatgaagacgcaggcacgtggtcaggcgatggggaagggagcatgcaccactggctccccagcctgcttggctgtgcctgctgggtcccgttcgtgaagcccgtgccttcgactctgcaggcacggggctttccccaggctgggcccgtaggcctctggcttttcctacgtcagatatttactttttcatttgtaacacactcaacaaatatttctgtttctgcctcattctggtctctgggggtatcatggtgagaaaaaaggctgtggtctctgcttttcagagctggtgggtcctgttggggatgtgagtcaatgtgagctgcaggagaggagacccctcatttggtgacttgcccaggttgcacagtgagtgggttagtagctgggagggaggttcatccaagggcctgcctgatggcaaagcccgcgtcctcatctctcctctagaaccacgtgatcaaactgtaatgctggccccaaaaaatcaaaggggaagagaatgtcacttccacaggcaaaaggtgacaatggaagtcccccaaacggaagtctgaacaccttgaatcagctctgggggaatgaaatccagacttgggcctggcgtggagggatgcctgctgagggagaggagagccagggatgggctcagagagaattttgtcctatgaagaggcgctcacagcacccaggtgggagagatctgcagctcgggcttagggtgggcaggtgggctctgaggcccccaccctcaggcttgaatggagactcggccggcataagtggtctgctcctacccaggggcgcagagagaacaggccgccctttcccaaactgtgtgtgcttttcccaggggccattgttcctggttgccaggaaaccgcggccttcaggtgtcacccgggagactggggcctgggtatttgggtttaggtcaggcacaataacgcctgtagaatgagatggcgtccccaagacctcctcagtcatttgtcacgcaactgtggctgtgactgtggggacacaaaggctgtgggaggaggtgggtggcacaggatggggtgagctaatgatctcccacccagagcagagcaaacacacctctttggggagaggaagtgaggccgccccagcctcttgagatggcagaagacctgcaaggaatctgaccgaggttcagggctgcccgctgggaggtgggggctcaccagccctcaggcctgatagcgccctaggaaacacacagcacctttagtggggtgtctgctagatagcccagcagcacagtcatagcaaagaaacaatccaaatccaatagcaagggtatacggctgtccagaaatgatggcaaatcagagtgacccaggggacaagacggtgagccaggggatacaggacctgggggtggtgctggagtgagtttttagcaggcctatgaaacatccagatccttccctccccaaacccttcagcacagcttctcatgaatgtgattccaagcaaatagaaggagatggatgatatgtcattatatgtaatctacttgcaaaatagtcctcgtttcacttttattttattaaaaaaatttaaattgtggtgaaatacacataacataaaatttaccatcataatgatttttcagtgtactgttcagtaatgttaagttcgcatcgttgtggacccgatctccagaacattttgacttcataaaactgaaactctattgccattaaatgacaactcccattgccccacctgccagtccctggcagccaccattctactttctgtctctataaatttgacagctccaggtacctcatagaagtggaatcatccagtgtttgtcttaaaaagaaattctttaaaaaatattagagatggggtctccctatgttgcccaggctggtttcacactcctgggctcaagccatcttcccaccttggcctcccaaaggctgggattataggtgtgagccaccgcgcctggcccagtgtgtatctttttatgactggcttatttcacttagcgtaatgtcctcaaggctcatccctgttgtagcatgtgtcaggatttcctttttttttaagctgaataatattccattgtctgtacacattttgttcatccattcaactgtggatggacgctggggtggctcccactctctggctcttgtgataaagctgccatgagcatgcaacttcccaatttccaggctcacctgaatttactttatgactgggggacgttagctggtgactgttttcatctaaacctcaggagggcctgccttggacgtggggccgccagtgatccatttcatgccctccaaagatgttcatctttggctgttcccttctgcctgacaatgtaggctgtagctgtgctccctcttgtgaagaaggcctccatccaggcagggaaggggatgggttaggagccaggagtgctggccccaccggccctggagattgaggcaggtctacaaggtataatatctcagaggcacaggaaactccagcgtcctggcacatgtgcagggcgcctagtagtaactggaccctccaaaggtgggggaatacacaatgaaaaatgggggtggctgacccctggaaatgctggggcccttggcattttagattctgtcagagtttagggacagggcccagggctcagaagagggtggtggcaatgggctgatgactgggttggcaacctgggatgggagccaaggtggcaatcagctggacaacttgggtaccaggtcttggccattggactgtggacaggcacctgttgcatgggggcagttctgaaggtggtttgaggctcagggaaccaagaggactctcagacatcggagctgggaagggtcaccgtgggaaagaatgagtgctgcaatcctaaaatctgtcacctggtggggaggggagagactgagattgaaggggaacctcaagttggctttgtctgggaccctgggttacctgagcctgcagaggggccagactgaagcctgcaggggccagggtctgggaagacaaaggaggaggctgtggctggcagaggggcacctcagtttgcagtgcctagaacctgaaccttgaaggcagggttctgcaggagtttggacaccccaggggtccagggcagtgagcctggggcatgcagccacagggcttcaatggggcatcgtcccggagcttcatttctactttaaacatttgggggatggacagttagctgattaaaaacagttctacatatttcacttatacagctgttaaaggagtggacttgggggccgggctgggttccaagcccagctctgccacatgggcacgttgcctaacctctttctgctttagtgttctcattggcagcatgcggatacttagtccccacgcataggctgggtttagcaaatgcagtgatacacacaaagagctccgcacggtgcctgaaacttggcatgtctcagtttatgtttgtggctgttattatcatgactaccggaaaacaaatggggcattaagtagtaaaatgcagaattggctagaacatttaagataaaacaagagaccttcaggaagttctgtgcttggggcagctgggctccggtcctctgcctttaaggtggtggagccatttgggaaacctcacagcctccagagggtggaactcacatctgctgttcacaggggtctctagggcctggctggtagcggggtgtcaatacgtgcttgtgaatgcggtgagtgtgttgttggccatacccagcatggctggcagaggcatgggcctgtgtgcctgtagtactcctggtcactccccacccttggtccagggctgggtgggcgcagcctgaagaaaggccttatttgtggcttcacatccaccagaggctgtcagcgcccaggcgaatttgtttgaattagctgcttcaatgggcctgtttttgatgacagtgtgtgtggtgagagatgccggcagaattttaaagggcattagaggcgtcccatgggccctggatggacagctgtgcaggaaggggaaggctgtttctggcctgtgtggctctttagggcagaaggaagtgccctcctttggtgccgactgacagggaagggcgggatcacactgtccacaatgcccttgctcggcctgctccatgctgtcggtctcacctggcagggtgtgcttgggccccacaggctctgttctatgtcctggccaccacagtttcatgaccaagattgagaatgtccatgtggccgaggtcctgcccactcagggaaccgtggactctttaggggtccagatcacagagcatgttccctgagaaaatctagggaagaagaaaggaggacagacatgttcgcagacattcagaccatggaccgaatggcaaccccctcccccatcaaaaacaatagcggtgctggtgtggtgtttttatgcgcctcgtgatgttctaaatgcttaacacatattagctcatttaatcctcccagtagccctacgaagtataagtgcagctatccttattttacagatggggaaactgaggcacagagaggttaagtaacttgctcagtatcacacacttagaaagaagaagagccaggacttgaacctaggcagtcaggctccagagtccagcccctggcaatcaccattctactttctgtttccgtgaatttgaccgtgctgggtaccttggataagtgagatcatacaatatttgtccttttgcgactggcttatttcacgaggcataatgtcatcaagtttcatccacattgtggcatatgtcagaatgtccttcctttttaaggctgaataatattccacattaaataccacgtttgttatccatttatccgtggatgaacactgaggctgcttccaccttttggctgttgtgaataatacttccatgaatgaaggcgtacaagtatctgtttgagtccctgtacattcctcttcggtatgtacccagaagtggaattgctggatcatgtggtgattctatgtttaatttttgagaaatcaccataccagctagactttttaataccagtaaatccctgtatctgagcacatgcttgatttaggatttagaaattttgttcatcagcccactcagggtgctgtcccaaacctcccctttccctgaacttggctcctgttcctggcggcggagaggctgccctgccagaagaggtcgtttccttctgttttccctcttctctttgccttcacccactttgagatctaggagcaatgccagggcctgagaaccgggtgagtagttgtgggttttgtggagagggaccgccttgttcttgagagagcgtctggctgggggcaggaagggggctgagtgtgtgttggctgtgaaggctccatcagcagcaaacgtgggtggggttgggggaacagggctgtgtccacattgttttcactccatgcccggtacccgatggtgaggtgctcaggacctgtgggcaggatgagggagtgaagacagcagagctggggctgtggagtactagtcgaggatgcccgcttggaaggctggtgagatgggccacgggtcctcccagggcaggggagggaaggtatggcggagcagcatggaaatgaccctctctcccctggttcaggccattctgcagtttcgattcctcatcttagaataaggagttgcgctagatgctctagctgcaacagtccacgtctagtaacagtgaacatttgtgggtcctaactgagatcaggcactgtgatgggtactttacatgggttactgaacttaatcctcacaacacactatgaggaacttatattagcttcttttttttttttttttgagacacagtcctgctgtcagtggcatgacctcagctcactgcaacctctgccccagaggttcaagtgattctcttgcctcagcctcccaagtagctgggattacaggcacacatcaccacacccgactaatttttgtatttttagtagagacggggtttcgctatgttgctcaggctggtctcgaactcctgacctcacgtgatccgcccacctaggtctcccaaagtgttgggataacagacgtgagccaccgcacccggccatattagcttctttaacgtaagtgaaaactgaggcacagggaggttgtgcaatttccccagggacacagagcaggaagcagagaagctgggactgaatggattcagtccgagcctcactttggatttgctcctctaccacactgcactttacaaaataaaatagctaacttttctttcctaagatttttttttgtcttagttttccagggcagatatttaaggaacacggaaggaatggggcttattgcttgttctgcggccggaaggctggagggcctgaacatcattgagtatgatcctaagtgagatcttttctccctccggcaggatctggtggaggccggaattcatcacagcaaacacatcctctcctttcctcttcatcttgctcttgcacaaacaagaaacctcagtcacgattccagctgggcatcctctgtctcttagcaaccactgccagcccaggctttgggttctgggctccaggcatgcctttctttgctgcaatactttctgtggatcctgcacacacaatgcaggttgtgggcatcagggcaggaggggcctgttaaactcctgctcccagagcccgagggaggtggggaagacccattctgggaagttaactttgtgggagtgagctggtggggtgtctcctggtggacgttcacagctctttgctgaagaggagtgggatttggggagagtgtgagcatgcacacgtgcgcttctagccacggtgggggcatcgtgccaggagacagatgaacactcctgcttgtcctgctgggcccatctttatgattacccacatttgttcaaaaggtttgtgtctcaaatgtgatgaagagccccctgggactccctggctcaggcttgcagggaaggggagggacagggccctgggactgtagagttctggtgagaggaagcagcgtggatggaggaggggagaagagggccagggctgaggccagcctcacttacaagaggcagaggggccgaggaagggcgggaagaaggcgtcaatgcaaggcccgagagcagggggctcggtggtgcatttgttccctgaccctgcatggtgggttcccaggggcttcttggaggccagtgtgggagctgggtctgttctgagtggctgcttgtcaattcatgaaaaagctttgcctctgggttttctacctctcctccccaaagaatcattgctttaatcatatatgaactggaaagaacctgagagaggttctaattcacatcctgtctttgcagatgaggacagtgaggcccgaagaggtggcaggagttccctggagtcatagctgggtgggagcagagctgggagccgccccaaggctgctggtttctccgctgtgctttcttactttgctggagtcctccctgcacactggttggtgctgaagccaccatgtgactacgcatgatccctgaagctctagtgagtgtttcttcgtagagtggaacttgcacacatagaggtgaggtcttggaggctgtttggctcatctctgtgcccagaggacgtggttcctgatgaggtccttgctagtcaggctgcttctgcacatcttgagtgacccggcactgttcaggagagatcctgagttcatttcctaaggagggagtgagctgtgtcttccttgcatctggtaggtactgcatagacattgtcctaacttaacggacagcatagggctggaagagcccttttctcttttaagctataaggcttggctgatgagtctgattggtttggatactttacagaaatgtcagactggaaaccaacttcaaaaccttttttttttttttgagacggagtctcgctctgtcgcccaggctggagtgcaatggcgtgatctcggctcactgcaaactctgcctcccaggttcacgccattctcctgcctcagtagctgggattacaggcgcccgccaccatgcccggctaattttttttgttttttttttagtagagacggggtttcaccatgttagccaggatggtctcgatctcctgcccttgtgatccacccgcctcagcctcccaaagtgctgggattacaggcatgagccaccgtgcccagccttcaaaacctttaaagcctgagaatggcgtagatgggaggagtgtttggccgtatgttgtatctggaaaaaggtgaattctgtgcatgctcagggagatgagaagggcaggaagtgccaggcgagggtcacaggtcttggcttgagccttggctctgtctcttgttgctgtgagtcttgagcaagtcacacccatacatgggactgaggggcttcctctggaaagttcttccagatctaacagcctgtgagctctcaggacctgcccgagaccagccactcattcatgtattccacaaatgtttgctgagtgcccagctaggcatcagtgaggttggggaatgcctcctgccccagctgtaaggtggagcttatgggctggtgttggaatctgtcagtcaacaagaaaacccttgtgcatccctcagacctgctctttgagagccagtctctggtcttgaagttggttcatcaggtaaaatgtatcagtgaagaagtctggttcctgggaagcaaggtggtgatgagtctttaaaagcctcatctccaccatcctgaacctctcaggaaaaggccattttggactctgccacttttggtggctcctgaaactcctctggggatgaatgtggtgtgttactctaaaaagcagtgggcgctgcatccgattcattgttcaccccgtggggtcttcgtctctaagagacacccatgtcccacgtgtcccatgtgcacgttcacgtctgttacagtttatagccctctctcatatcagctacatcaaatgttcacacaaccaaggtgctttctgtgtaagcgaaacagaaccttcacatcggaaagttattaaaaatctaatacctagtttaaaaaattaaataagacggagacatataaaatgaaaataagtctctgtcctattccagatctcgacgtccccttcccagagacagctactaaaatagcttcatgtggaggcttcctgaaatgttctctgcatatgaaaacacagatattctctctctctttcttcagaatgggagcttacctgtttattttcctcctgtagagctaagagaccactgtatatcagcacatatacagctggtgttcctgttcttagcaccacagactcagactcttgttttttttgtttttttttgtttttgttttgagacagtctcactctgtcgcccaggctggagctcagtggtgcgatctcagctcaccgaaacctctgcctcctggtttcaaatgattctccttcctcagcctcccgagtagctgggattacaggcatgcaccaccaagcccatctaatttttgtattttcagtagagacagggtttcgctatgttggccaggctggtctctaactcctgacctcaggtgatccgcccgcctcagcctcccaaagtgctgggattacaggcatgagccactgcgcccggcctacttttttttttttttttttttgacacagggtctcgctttgtcacccaggctggagtgcagtggtgtgatcttggctcactgtaacctcctcctcctgagctcaagcgattctcccatctcagcctcctgagtagggtaccacaggcgtgcaccaccaggcctggctaatttttgtattttttgtacagacaggatttctgccatgttgcccaggctcacacagtcttattatgtgtatttcatggagggacattacattgttttcagtcttataaacattgttacaaggaaacgtccttgtttgtctgactctgtgttctcatatggcaagatcagtaggacccactcctagaaatggaggtggtaagtcaaagaaaagatgcattttacattatgatgcctattgcctagttgctgtttagaaaagctgttccatcttcacagtatacaagaagctctgtttctccacacctccagtattgaacattcttgacatttttcactttgccagtttgatgggctgaaatacatcttgttttaacttgtatttatttaattatgagtgtggttaagcatcccattttaatgcttttaaggccatttgtgttccttttctgttaaactacctgtttgaatcctttgcctatttctctattccatcttcattttattaagagtacactgaagctcagaaaggttaagcaacgtacgttgggtcgcacagcgggtaagtggcagagctgagactagaacctaattttccctctcctggtttagtgattcttctaatgtccatgctgcttctctgtccaagggctggactaggtatacctagtgctcctgggtggggaagggaccccattctgtgtattcccaagggtcccattggccctgagtggaacatgggggtaccttcaagactgtctgcaaagctcagccctctcaggctggaattgattcttaaagtgcttctaagtcttgtctccccctgggaagccgggtgcgcaccccagtgtacatttgctcctaggtggttagaggtttaccctgcagcctccgcagaggagatccagctggcattattgtttgtacccatgaattattgataaggcatgaaatggcctcaaccttggaatagcaaagctcgagggagggcagctaccgtgctgaggaggagcatggagctgacagacccccctccctggggcccaaccttctctgggctaaagaacacttttgaatgtccaaaggcttcatagtcttcctctcccctgccctgccaggttttggttggattttgagcatgtgtcatttaagaaaatgtgcagggacaagagctaccttgaatttcctaccatttttcatatttagattgtttaaaaatttataaggttatgcatactcatgataaaattcaaatatcccagagctgtatcatgcagaaagtgaactcctgtgtggtctcacccccgaggcttccgctgcataatgctgttaagtgggtttgtttttcactcatcccctgagcctacatacatgtgaagagagtactgtttattcaggcaacactgtctgatggagggatttgaggactccttggaacacatcctactccacgtgatggctggtccctctgcttgagagctgaggctttgtggctttgccgtggacccttgttcttgtgtttcagttgccagctgttgaatcttgtgactgggtcactgcactatgtttctactctgtctccagttttttttttttttttcagacagagtctcaccctgtcgcctaggctggagtgcagtgatgcaatctgagctcactgcaacctccgcctccgaggttcaagtgattctcctgcctcagcctctcgagtagctgggattacaggcgcctgccaccatgcccagctaatttttgtatttttagtagagacggtgttttgacatgttggccaggctggtctcaaagtgatcttgacctcaagtgatccacctgcctcagcctcccaaagtgctgggattacaggcttgagccactgtctccaaatttgcctgtctccaaatttgcctagcattgggcttgttctgaaattgtttgaggacggttcagacattctggaggaaaggaatggcccagtctccccatgcatagcattatttgccaaatgaagggaggttgctctacttcttctcttgctagatggcttacaattttacattccacaggaattttgaaggaatctattgttttgcaaaactgtggcgtgctgataaaaggtgtcagatttttagggaaaagctacttgacatgtgtgactttttggcaatccctttagggaaggccgggcattgacttcagaagatcacgtctttgggaagagcatgacaagatctgtgacgtgcggcaactgtcactgcagttccctaagcctcagtttcttcatctgtaaagtggggatggtaatagcatctctgttttggggatattggttgggttctttgaagggtgtttgaaggccccctgtgcagggctggcctccacaaacattagccccttttccttcctggataaatgacatctgttgatgaggacaagttgaggggcctggagatgctggaggggatgagcctcaaggtagagacaggtgaaatagacaggtgaaatatagagctgctgagcaggtgaggcacaaacttggagtctgtctgaagaactcagagaagaagcagctctaggacggactttctaagccagatctagtttgctggcactggcaagcagcttctggacaaggagctcccaggaagcatcactggcatttggcaaacatttgttgaatgaatacaagggctgccctgatgctctctgagctcctctcagatgtgccttcctcacactccactctgggcttgtacacattgttctcttggcccggagtatgtacctccctggacagatgcacatgcacttgtgtaacacactcacacacactcacatacacatcatccaggccatgtctgtcatcctccgggtctcagctgaaacaccacttacccagcaaggcttccctcctcacctcgtgggctggatggggttcctctgccacctgctctcgacaccgtggcttcaccttttcgtaacaggagtctgtttcccttggagagctggggtgcacatctgtgttccctgtgtctgcaatacccagcatggcccttgctatctattagatattcagtaaatgtttgttgaatgaatgaggcaagaatcatcttcccttctgattattgtttacttgaaaacagggtttcagttgcctacaatggagttgtgggaacctgttggtactcatctcaagacatgggagaccccatcttccatgttgctggaatccttatctctgtagcagcctccctctcagaaatgtagttggctctgtcctcacgagggagctggagaagtagacactggagtcagaatgtctggcttcaagtcgaggttctgtaacttactaactggatgactgcgggcagtggctcaatctttctacaccttgttctcccatctgtaaaatgtgtttgttaattcctgtgttacttgcctgataagattttatggattaaatgagataatccaggaatatattatagcaatgatcaggtagcgcgtgctcaataagtagaatttgttcttgccgttaagccatatgtgtccatcctgtcaagaatgtggcatcggtaaagcaatggggttgagcgggactatagctgatgaggcaggaatgggcagatgaaatggagccaaggtaagaactacacgtctgagaggtcctgcagaggaaggcaggagggaaattggatgtagcaagaaggcaaggggtgggcttgcagaatcacgctgcacttagcccgagggttttctggtgtgtgattaggacttgggttcggatcttggctccgctacttgacatgatgcattattttgggtgagttacttcatctctctgagcctcagtttcctaatctgtaaataggttaataatggtgacctcgcagaattactgaaggcttaaataagagactgtatgaacggcacttccacaggccctggtgcatagtcggggtgcatttgtgtttaagaagggaaagctggtggggctctgcacatgtttgaagggatggcagctctaagagcagagtagacagatcagctcgtcctggtgagagatttcccaagtctgcagaagggagggggtaagccgactgccttcagcgtggcttctcagggtgacaccacttattgtgtaattatggaacaatgtgcataaaagtgaaaatgtgggtccagatggcaggccttccatgctgttgagaggcagagctaatgaacttaacaaatcactgataattaattttcagaagccaaaggaaactggggagcaatgaataggtctacagaaggagagaatgcaaagtagtgccaactgtcagcctggagagaggtgtgagatgctggcacttccaggccagggagaccgtcttgacatctaatagttttggtgggacagaaccgggagagagaaggcggtccaggtaatatagtaatagtcatgacaatattagccaagcttgaatgaacccttctatgtggcaggaaccattgtaagcattttatttggatcggctctcatttcaggcagcttctcccgtagggtagggagagagagtcagagtccagtgggtgataggggcctttgtcttactaccatggagcaatgaggcaaagtgatgagaatagctaatatttactgagcacttgctgtgtgccaagcactgtgctgaactcttccggaggtgtcggccgcttagcatcatcaacatcctaggaggaggcacagagagggtgggtgacttagcctgcaccctcagcaggatgcaaagcctgtgaaaatgtggagccaggaaggactgcgccgccgctcagagccgcccgtgcacacggtgtgaagcagcattgcgagtcaggaaactgcgtttcggctccagtaccccgacacaagtccttgagcctgcccggagttttgtttctttaactgtgaaatgggagcagtggatttgaatcaggaggacacacacttttcagacaacagtcctgtgtattcaagtaaatctcacagggcaccggagatgtaaagcagacattggaaaggagggtggggtctgctcacttgcggcccctcctttctcacagagccccaaagccatttgggtctcatttgggcagctggggatgagctcagcagtcacagggaagtggctgtggggagcgggcctggcacactgtcttcttgcccaaccctgggctgaatctgaccctgcaccttactagctgtgcagtcctaggcaactagtttaacctctctgagtcctgttttgctaaactgtaaaatggagctaaaacttctttgggtattcataaggattaaatgtcataatgttgtaaaactcttagctctatggatggtgcccaataaaggctcaactagaaggtaactgacagataaatgtttgttaaatggataagtacttttgaatctatatacatatacatatatatatatatatatatatatatatatatacccctttggaaaaaaaatatgtatttcctcctaaactttcaagactaagtgaggaagaattggaagccccaggaagatgggccaatctgccaacattgggcatatttgctccaggtgagaacgaagggactgatctagctgatggggtgaaatgtttgagtccctttgtcttcctcgctggctgccaacacagagtgggcgtccaccgggaccctccccaccgctgctgagccacctcctgcctgtctctgggggtcagatgcaaagccagggaggatgggtgaacccaaggcgccgtctcctgagtcctcccagaccctcccgatgacctcctcgcaccgccccgtcgcaacccaccttctgttcacggcccatcagctggctttctccctgactgcgctcggatttgagccattgtgaattcatgtttccagattaattagcaaggccccatgtcagatgctaactggaacccagatgtctgcttggttcctgcatcaaatcattttgtccctgtaattgaagaacacggaggcagcagccaggctggccagacccactagcttcccccgcccctttccattaaaagagaaataaacccacttcccacctgggaggatcggggaagggggatctgcccaccatttctgtgccagccaataggatggcgatgagttgacccctgaccttcctgtgagggtggggttccctgaggagtttcccatgggtttacaggaaggtaagaggggtggtgaggacggagaattcttcctaattttgactttagccagacacccgtttcccaagctagaacactgcccctccaggggaacacaagagaccccaggcagtgcctgcctgaatggcccatcgctgctgggctgcgtggaaacttccagcttcggggtcacgttgtgcatgcctgagtgaaacagacatgtcagagcagggatgtatttccgtttctctccaagccatatgttgtgcatgtgtgtgtatgccttttgttttttagctataatttattgggcacttactatatcccagtcgtcatggctaacattttatatgtactgtctcatttaatccccacagcaatcctataagagaggattcttttatccccattttttctggtgaggaaattatgtatagttcagagaggttaagtaacttgcccaaggttacgtggctagtgtgtgacagagttgggtttgaatcattcggtatgtcttttaagtggaagcagcagttacaggaaagatgagccatgtttccttcccccttaataatgtgtgttctcctgggcagaagaggtgagaacaggtttggtcataccttcgccttttctattgaaggtcagaacctgcgacggccattttggagatagaggagcgctttgatgggtggcacagaagatgccaagggaggccaagagatgcatgggctggagtctggagtgtgcccgaagcctgcagaaagcccttaaaagtggggagtgggctctaactccatggctaggtcagtgccccaagtcctgctgcgccaagaagtggaggacaaagtcctgaaggccctgagttctttgggaagttcatgggcatcccaaaactgagggttcaaacccagctccagcttacgcagcctgtgacctcgggctgctcgtgtcacctttttgagtctcaatttccccatcagcaaaatgggcctaaaaccttcttataccatatagtccttgtaaagctgcactgagtattatgtgatattcaggccctcaggaaatgtgagcgtactgtgatggggccagacacctcagaacgtctcaatttaataaagtagaatcttaaatagtaaatgcaaagatttggaatagccatgctcaaacactagagaatgaggaagctgtttattaaaaaatgtagatttcagagccttacccctgaccttcttattgagaatctgaggctggaaccagaactctgcattttgacagatccccctggggtttctgaaatgtattcattgagctttcattctgagacacatttacagaacattcaaatataagagccggcagtgacttcagaggtcttttaggcccctccattcacagagaaggaactcaggttgtaactcggaaatgagttgtcctcagggagagccagaagtggatcttagttcactgatttttcaaaatagttgctggtaactgagtgacttgcatgtgcgtcacttgcatggcccaagcctcatggactttttcagactcagcaaccgaagagattatttatatactctcaaattctacccttccaatttacccctggtacactgtcaccaggtggcagtagtatgctatagagcctcaagggttgttcctggaaatccacacccttgtggatttataaccttgaatagtcatattcctttttttagttgttaacatgaagacaaacacctttattatgctagctaaatgcaagcaaacatcaagcaaatatcgacatggagagtatgtttggagcaaattttccaagcaaataagttattagagacaggaagctatctttccttataattatttaatagacgttgttcttagtccttcatctccctgtaattttttttaatttacctgctttgctctttggacacccacttcacatgctttattctcagatctttcagggttgggctccttgatgtcagaactcatgtccctggaacttctcttcatgtcaagtgtttttctaagtctctgctcgtagaaacacagagaaaaaattgcttttttttctgatttcattttctcctctctctatgaagcaaggtattggcatgtctctgccacccactgtagttagggatggggagggagggagagaaaacagtgttgggtactgactgtggaccaagttccaagccatatgctttcctgttacctcacaacagtgggcagcagagtgtgttgtcatttcacagacaggtaacaagctgacgggtggaaggagggggtgggcaggagtgaatcccaggtctttggagctccagagcccatccgtcctctcgtttccatggtgggctggggatggaggggatgtgggctgccagatgctccccactcctacagaggaagcccagatgctctggggtgaggaccaggcctggtgacaggctctcccacccccagcctgcaccagagaggaggcaggaacacctgggcccctctccctggggagcccgactgcatggcagctgcttcgctggcattcttgagagtgttaattgggcaggatgcccagcccccagccccactgcctcctgaaatgagctggaccagggacagaaaccccactgctcaccaggcatagaggagacaggatgggctcctggtcagcagctcagggaggaggcccaggatgccgggctagacctgtgggtagggggtgctcctcatcagcagcctccactcttccctcctctggggaagctgggaaagcagtgttgaccccagggctccggacaggccctaaggaggaagaacctggaatccttgcagtgggcttcggctagctcaggagatggtcttctctagctggagggaggaggtgaagtggggtggggatgaattatttgaattattatttctctctctcttccttctctttctcctctcctactgctgcctcctcctcctcttcctccttcctcatcataatgaagacttattcagtacctgtctgacccaggctgccaccaggactctccatatattatttcattctcatctttcaacagcccgtgaaatgtattttgttgattctacttttacattaagctcagagaggtcaggcaacttgcccaaggtcacacagcaggtgaactggcacaaccaaggcttggatgaaggtttcactccagagcctgtgctctgtcaactcggccccctgcttctcatactctgcccatcaaggacagagcactttgatcttatgggaaggttccctttatccctggtaccccagtcctcctgggaggagtctatgttttctttgttttcaaaagacttggaatctgacacaggcttcctttctgagccttggctcctcagaaggaagggcagagaaacaccattttcacagtacagtgagaaggccgggtggctcataggtggcgactggatttctagagaaggacccaggatgcccaggtgcccagtgctgcagttgctgttgagcctcccctcagcaatgacccagtgacagaaagataggagggactcaggggtcaggatgcccagggctcttccaggcctggaagacctggtcagtgagagccatcagggagctgagggctgctgggaacacctttctcagactgtggtgcctggctccaggcttctcatctccagagaacatttgcaaacttacaggcacccagaattggcccccggacctgtgaggggtcagtgaagaaactggagaggtttcaggtctccagagctgctgagaggatttgaaagcatggatgtgggccatggggatgagtgggcttactctctgttctccagaagaagcaggataagtaccagcaggaaggtctcagggcaattccaaggaatagcaggctgggagtggatgttgagcctcaagcattagtgagctctctggccctgggcgaggtcaagcagagcccaggtgggcaatctctaaaccaaccttacggggaagccaggaaggggcccctgcactgggccagccttcaaactacatgatccaaatgtttccttgaagctcacatggcctctgatgtcgcaatgggaaagacccttttgtgctctgccaggtcactgctatttgctgagcatctactctgacaccaggcactgatggtgaacaagacagacagcagagactgtcatgggtaatggcaggaatcgtcacaacagcatgaggtgccatttatcatgtgctaagggttttccatcattatcttatggaatcctctcaacaactttatgaggctggaattattattatccccattgtcatagaggagaaaactgaaattcagagtagccaagaatttgcccaacatcacacagctagtgagcgcttggatttttatttttattttttgatttgagaaggctagggagacgagcttccttaggactcttccttgagctaagggatgaccctaagtatccaggtagatgactccatcacctactttggactttttatttttctgtctgagacagggtctcactttgtcaccaggctggagtgcagtggtgcagtcatggctcactgcagcctcaacctcttgggctcaactgatcctcccacctcaggctccagagtagctgggactctgggactacaagtgtgcatcaccacacccaattaattaaaaaatttttgttgcccaggctggtcttgtttcctaggctagtcttgaactcctggcctcaaatgatcctcctgccttggcctcccaaagtgctgggattataggtgtgatctgctgcacccagcctgtacttttgatcttactaggaagacttcagaatgtgcaataattccctctgctgtttctatgttcacttgggctccctttccaccggctggcctcccttaggcaggccccagagtgggagtcggtgcttctgagaggactcagggcctccgtggctgctccatgttgaacctaagtgttgcggtgaattgtcctttgctcccctggcttgtaacattaccaccatagacagttacactgtgacgtggtcagaagctgggcaggtgggtgctcctttgctaggtcccttgtcctcacttcctgccttgctaggacagtccctgagtatcctgaggggctgggagagctggagtggcttcaggcacctggtagcggggtggatgtcttcccctcaatgcctcactcccacccctgccccacctgggagtgtagtaagactctccatgtgaccgtgggcatgtctttataccaggtcaggccaccctttggaagatccataaaattcaccttaaaaatcttaaaagaggccgggctcacgcctgtaatcccagcactttgggaggccgaggcgagcgtatcacctgaggtcaggagttcgagatcagcctgactgaccaacatggagaaaccctgtctctactaaacatacaaaattagctgggcatggtggtgcatgcctataatcccagctactcaggaggctgaggcaggagaaactcttgaacccaggaggcggaggttgcagtgagctaagatcgcaccattgcactccagcctgggcaacaggagcaaaactccgtcaaaaaaaaaaaaaacctaaaagaaaaatgtttggggctgagcatggtggctcatgcctgtcatcccagcactttgggaggctgaggtgggtggatcacctgaggtcaggagtttaagacaagcctgaccagcatagtgaaaccccctctctattaaaaatacaaaattagccgggtgtggtggtacacgcctgtaatcccagcttcttgggaggctgaggcaggacagtcgcttgaacctgggaggcagaggttgcagtgccactgcactccagcctgggcaacaagattgaaactccatatcaaaaacaaaaacagaaacaaaacccaaaaaaagaaagaaaaatgttcagaagagctgattcagatggaaaatcctttgacgttgcaagaggctgtatatcaaattatatataattataatcaattaatgcatctttgtagatgattagaaaaaatgatcagggacacaaaaatgaccactaaatttgatattgctttccaagatacctttcaggtctaaattcctctgatttcaagattctagtggcatccaattgcttatttaaaacatttaataactggacgtggtggctcatgcctgtaatcccagcgctttgaaaggccgaggtgggaggattgcttgagcccgggagtttgaaaccagcctgagcaacatggtgaaaccctgtctctacaaaaaatacaaactttagctgggtacagtgacatgttcctgtggacccagctgcttgggaggctgaggtgggaagattgcttgagccaaggggcagaggttgaagagattgtgccactgcactccagcctgggtgacagagtgagaccctgcctcaaaaaaacaaaacaaaacaaaaaacaaattaataacaaatcatgggctttggaaccaaagagttttgggttacagattatgtggttttgttcctgatactggacttttctaaatctcaattgcctcatctgtgaaatggggatggtagtacctcatagtgtggttgtgaagatcaaattggatagtgctgtgaaggctcagcacaggtcctgcccatgagtgtggattatctgtcctggcccattgctttatgtggtcctgggacctgaggcccaggagacacacacatttatttatagcatgctctgaattcatgtctcccagcctacaggctgtggatgcggaaaggggagctcagaaccatgggaggatggagaagaaaacagagagagctggtgctgaggggtgagtaccacagggcgctctgtcagggagtggtggatgccgaggggtgagtatcacagggcgctctgtcagggagtggtggagcttggcagtgaagcttggcagaggctccctagaggagggggcatcactgctgggctctgagggtccaggagaccttagctaggccaagagagaggtgacgaagggaaggacagggggaacagcctgtgtagccttggacagcgaagggaacgtgataagtttgagaacccgcaaatggagccgagctgtcaggtcagggtgcgggtgtgagtgggaaggggcaagctcggcacgttcagccaggacatgccattctgctgaggggcttggctttaatcctgaaagtgatggggagcctctggcagattttaggcagcagagaggcacaaattccctcacaaacagcatcctgtggtccctggacacccgagtcttattttcacggtgtgttaaattgaagacgatgagtaacagggtggtgggccatctgggtacggatgtgagcgcagacagaagtgtgtgttcatggaaacgagtgaacgctcccaggtgagctgcagcaggctccagcagcaaaagccctgtttgtctgacgccaggcgcttcagagaataggcattatcaaagcaaaacatttggttataaatatttataaatatgtgttggattgaattgcactttggttcattcaccatttatgtctataaatatttgagaggctgcttggcatcatggaaagacgcagtctttgtaggcgtggacagacagggtatgtttggtttctccgcggcgggagcagcttgatgaccctggccttgtcacttcacctatcagagctttagtttccacggttataatgacacccatcttgcatagtggctgtgagaattagaataatctctgtagactctagcgtgtgtagatgacatgatggacactcagtgaatacagctattattgttgttcatttgtctctgtggtttttaatgactcggactcttggctgggcgtctgaagcatttggagtccctttttgccttcagatgtccttacctatattagggtcagccctctttcttttcttttcttctttttttttttgagacagagtcttgctctgacacccaggctggagtgcagtagtgcgaccccagctcactgcaacctccgcctcccaggttcaagcaattctcctgcctcagcctcctgagtagctgggattacaggtgcctgccaccaggcctggctaatttttgtatttttagtagagatggggtttcaccatgttggccagctggtctcaaactcctgacctcaggtgatttatcccaaagtgctgggattacaggcatgagccactgtgcccagccaaccctctttttgaaaataatgctttagaaatgattttttgataacaaaagaaaatttagaatgtgtcttgatgtatatgttagtggcaaagcataataataaaatgagtatccatgaattcaccaccaaacttaagcaaaagaacgtagcaaagctgcaggaaggtcccgttccctctccaacccaaccccagcctcagctccagagggaacctctctactgacttctgtgtttataacttccttgatttcctttttggtgttgctacatagatgtatatatgtaagccttagcttaacttttgcttattctctaactttttcataaaggaaccaaactatgtatattcctttgtaagaggctggttttattttttatttttttggactcagtattacatttctgaaattcatccatgatgatgtggactgtggttcatgcatttttcactattatgtggcattaccacgatttgcccactttccttttggtgtgtatttggattgttttcaggtttttccgtgcaaataatgcttggaacatcctggcaggtgcttcctggtgcacagttgggagagcgtcttcggtgaatacctgggagtggaattgctaggtcatgggcacgtgcatcaactctacttggtcttagcaaatcattttgcaaatgtaaagcctatgaggagaggctctgtcatcggaactgttttgattaggcattgagtgaagggctggcacctctatatggtttcaagccgtggaattgtttctgttccttcttcccaggcacagaatgtcctcattccatgacaggcagagaaggagccagcaaatattttaaaagtaaaatctagtttcagtgattattgggtggacagtgggtcaatgaataagggattgatcctttgctctgtttgggcccttctgggaaggcattaagggtctgtcctaactactgcctgggtgtggtatatgagtaaactgagctgaatacagtgttctttccccctcaatttctggcccatttaatggaggtttgcaagagaagagccaggaggactgggctgtgtctgcccgctggctcagcttgcacccagcagcttggcagggactgagaggtttgtcggcgatgtttctctttaatgtgctacagaagggaaatgagatgactgatcaggcacaaaagctgtggagagcacacacgccagacccgcccctcacccctcctctgtgcacctgccactccaaggctcaggcagcactcttccagtatttactttgaaatgttaatatccaaactccatcgtttcatcccttcctctctgtttgacaaggctaatggggtgaagagggaagatggcagagttagagagagcaagagatgcatggagcggcaggaacccacagcttctcgctgggaaagtttcctgtcgggatgtttccagaaccttcttctgatcacctctcctccctgagcatcttggaggcagtccttctgccctactttcttcctttaagcacctctggagagagtagctgaggttgcagatggtctcagagcactctctactcattacagataggagtgcgggcatcattatcgctaaaaacaaatccattgtatttattgtgacttactaagtgtcaggtattgtgctaagctcttgaaatgtcttttcatctatttctcactgtaactctgtgaggttggcttttttttttttcttttgctttttggtggagatgaggtctctttatgttacccaggctggtcttgaactcctggcctcaagcgatcctcccaccttggcttcccaaagtgctgggattataggtgtgagccaccatgcctggctttttatttatttttttagattgtaatttttatttcatgtttacagatgaggaaaccgaagctcaagaagtaaaggaacttgtcctttgtcgctgcactccgaccctgggcccatgtgtgatctcaggaccactgagtcccgagtgtggctttttttttttttttttttttttttttttttgagactgagactcactctgtcaccaggctggagcgcagtggcgcgatcttagctcactgcaacctctgcctaccaggttcaagcgattcttctgcctcagcctcccgactagctgagactacaggcacatgccaccatgcccagctaatttttgtatttttagtaaagacagggtttcatcatgttggccaggatggtcttgatctgctgaccttgtgatctgctgccttggcctcccaaagtgctgggattacaggcatgagccaccacacctggccaaatgtggctcttaaccaccagccgatgccatgttgggcctttcgtgagggccctattgggtggctgctccaccattgccatgggggaggtggatattggggtgtgctgggggcactgcagacacacggagcctgggccctctggaactctcgatttggtggaggaaaaggacaagttaaaagcatgaaagctcacattttctgcaagagccaagcgcttcctgggaactattttattcactcctcagcactgttactctccttttttcacagaggaggaaactgaggcacggagaggtgaagtgatgtggttaaagtgacaaaggaagtggcaaagctggcatgtaaacccaggcagcaaggagagcctaccctcctacccacctcccctgctgcaccttccagaaggtcctcacagaggtgcccacagggtgctgatgccaccccaggggagggcacaaccagccctacagaggaggaggatggtaggggtcacaggacttcctaagggagggaagatgggaagaaaggagggcagctcaggcagtgaacgctggggcagacaccccggggcagggaagagctgggcacgtgtgtgtgtctcttaggattctttttgcccccggaccggagcctcacccctttcatctctctttgtgcagcactgctggtcctgcccacaggttagcaacccctcggtttgtcttctcctcctttgtgtgggtgacatgggcctcgagtgtggttggtgggcagtgggagtggcacctctctgtccccagcccggctcctgcttgagctccccaggaagctggccccatgggttggttccctgtcttccaccctactcacagctcaaagggcagcacgtgggggtggggcagggtccttgagccttggcagggcctcagcaaggcaggacctgagctttcccagccggacctttggggaagctgcttgtgcatttccttgcaatttccttttccaaaaattagctgggcatggtggcatgtttttctttagtattcttcaagtagtcctccatggcttaaagagaaaggtctttgagaacaggaattggtccatgaccaaaagggctccagtgtcaaggggaatcagcagagctctggggtctcgtgtgatgcagttaagatgcgaggtttctggggagaaggggaggcccagggaatagaggtggcatcccttgaccagctgccctgccttaccccgggagagatgagatgagggttttatttaacaaaggagagggagtgagtctttacaaactaagcatagagttaaaataacaacacgttaccgttgacaaagcatgttgccatgtgccattccatccagcctcagcagcacatgagccagctcaggtgagcatgtctccaggaggcccctgcagctggggtacttccctcaggtagagtgctttatcttttgtttccaacttcttcctgatggtatccctgttgggtaccttttctggctttgggcctgtgcccttggcaaacatcctggaggaccctcaaggctccctcttgcattgtgactgatagctcagagtcactgctgtacagaaagtttagattactgccagctctgaatggattacccaggattactgtgtgccttgacatttatcagctgctcctccgctggttccccagtcctgggacagtgttaggatgcgtgtcgctgcagatgtggcatttctctcccaaagagcattatgcctgtcagtcccttgagctggcatttccagggcaggcttactctagggttcagttatcaaagtatgaactctgccagcacagccctctctggacctctggcctgtctgctcaggggtagagcggcgcagcacaaagatcatagccttggggctgatccctggtctgtagattcctgtctccaccatgtgtgaatgacctaactgggcaagtttaaaaaaaaaaaaacaactttaatttgtttccttatttacaaataaagatttcccccaaataagcctacctcccagggttattgcagggactaaatgaaataacacttgcgctgcactgggcaataaacactaagtaccgattagcttccttcctttgcagtctggcagacctgagtcagatgaggcctgatcaggggctcaaatgatgctacgagggcccaggcttcattcattcattcattcattcgttcattcattcattcattctctctgtctctctccctcccctagtctcttccacataggcctcatttctgattttcccgttcttcattcatgtcccaagatgtttacagcagctccagctctgaccttgccttacctccaagtcccccagaaatgacgttaacctctgcctcaaaagtctcacaccatcataatggctttgatgggattctgtttccatctggaactagactccatggccaggcaaatgatgggctggccctggagctggtcatctccacctgaccacaagaccagagttggggaggggcggatctccagacaaaactggggttaccactgggaagtccctgggaagtagggtgagcagaagctgcagacaaaaacaaaacaaaacaaaaaccggtggatgcccaccatgggtaccatctgcgggaccttcttgcctagaggttctgtcccatatcctgacctcctgcatgcctttcctggcatccacctgatggtgcccttggcggaggcctccggaccagattccgggtatggttgtctttctggctggtcaatttctctgttttggtctgggctgaggctaacctggtgaaatggcttgaaatgttgttacctgtggcctccagaggggccacggctaacaatgtccatgtgtcctggccccattttcacctcaagttccttaattaagaccctgcggagatgccctgtggtcctgtgatttatccacatctggttaggcagtcatcttctagattctgaccccggtttgatctgccatctcttctgcccgcttcagaaaatcatgtgtgagttcagcagtctttaatatgttttctgtaaagacagggatggtgatttatgttctctgctctcattacaccacggtcactggaggcccctgcgatgtagccagagtgctccctgccactgacttggcaaggagggccttgggttccctttcatctggttcttgctgctcctggggcctcatttatgtgtgcaaggtgccctttctgcagacgcaagagcttgagtgtggccaggcagccccgctcagcctttttgtgtgtgtttttgaatctcctcatcttctttatcatgacctgtttttatcttgtcaaataacttacctgcatctatgttcagagacggtggtgaatggaactgagtggtcatcagatttatttttcctgctgacttttttatgttaaggaaggagcatgccccccttctttctatttataattatcctggtccctaggacactggaagaagccagctctgccccctcagcatcttggctgagtatcggccaggtctctgtcacatggagggggccaaataggagtcgtgcatttactggtgttattcagctgaatttaaaagtggcctactcagcaccggggctaagccccgcagataagcttggtaggtcaccatctcacgggtggtgacaggggtgggaggtggggtttcctggggagatgagaccagcgtcaaggatgagatatatccatgagtgacccagcatgcttggccatccgtgggaggcatgacatccctctggggatgcatgagggatgaattcatggagaaggtggcctttgagatgggttgtgacgttgggtaggacttcaggaggtgctgagaggaggaaggaacttgcacaggtgaaagcaaagacgagggaagatgtgtggattcagggagagggaggctgtagctgggcacgtgtggtggggtgggggctggaggtgtggattgggccttgttacaggggcttgcatccaagagtgaagggtctgggatgtgtcagtaggcagaggggtgttattgaagggttctgagtgggcacgtacatttgcttgtgtgtggagtgaccggatagaaactgaggtgtataacagttgctgatgttaattgaacacttactacatgcaaggcatgttcctactgccttacgtgcatcattttctaaatgtaggtcactcttctgtttggaaccctctgatggctactgcttcatcacagtgatatccaaagtccctacccttgactacttttcccctttctcactccagcgaccctggactccttgcttttccatgaacactaagcatattcctgcttctggaccttggcactgactgttctctgtgcctagaatactccttctcccagacacccatggggctcactcccttcttcctttaggtctttgatcaaaggccttccctgccacctagaaaaaggtaactcccactcggcacccccagtgcttttacccctcacctgcttgattcttctctgtagtactcacctccacccgctaccccacagaatatgagctccacggggcagggctgtgttccttgctgtatccccgccgcaggaacaaggccacctgatgcacaggggtgctcagcaggtagttactgcatgagtgactgttctgcagtctgcactcccgccgtgggagttgcctgtcatcatcctcatcttgcagacaaggaaaccaagttgaaggtcaagtaactggccaaggtcacctgctgggaatggctggagactgcctacctctgaccctaccgtgtaaccacatcgccttgtcatggttgtgactgggcaacaacactcacatctctgtcctaggggctgtgtgaggtttttttccagctttattttgaacaatgtttttgttagaaggtacttcattcccagagggttcattaattgagggcgttgcactttgaagaaatcgctgtctaacttgggtctggaaatcacactgtgcgcttttcagatgtgctaaaataaacgtttagagaagaaaaaaggagtctgattgttgtaaaaattaggcagtttggggagagagctggaagcttgttaaaatcctcaccaaggggccttggaagtcgttactaaggagaccaatggtgggttcctttctggttagccggtgggagggcctcaggaattgcttggaagctgctgctgggaaaaagagtgttgggggttttcagcagatgtgtggccccaactccagcatggctttgtcctgatctgtcctgctgcaaagagaggggaagcaagagaccctgtttggatcttggagaaggccagtggcgttaccttacagcagcagaaatgaggaagcacccgactccccatctcattgcccctcccaggcatgcagccagccctctcttggactccctgatgtactcgcacctatccctgctgaacgcttgctattggagagctgcccatacggtctcacctgcatgagtgaagctgctcatcagttcttccgtgcaccaagcccaacctgctgtcctgggacttgtaaaccctggtcacctggcctagatctgcctcccttagagtattcagagaagcagttagcttccccctgtgcccttgattttgatggtagctcagactctgagcacttgccagggacctggtgattgccagcttctcacatttaggatccatgcacatccttacatcacagtggagatatggaaacgagttccagaaaactgaccgcacttggtcctggagctgctaatgaagagtgggcatacagacccaggtttgtgggcccccaggccttgtgctccctggacactgtatataagcaggtctcccaacctggtggctgcactgtgacatcacacaacagtgcacattgagcttgctgtcatctacgactcagtaccctgagctgctgctgagccaggcctcccccatccaccccgtgacactattacagagtgatcatggcagcatgtcacacacacatcctgtgaaggacagtctgcgatggcctctgatggtgtccagagtgagctttggcagtctctaaggttgtcacctttgcgtgtccctgcagtgcctccccgcagtgcctcacagcttttttttttcttttttctttctttctttcttttttttttttttttgacggagtcttactcattctgttgcccagactggagtgtaatggtgcaatcttggctcattgcaacctccgcctcctggattcaagcgactctcctgcttcagcctcctaagtagctgggactacaggtgctcgccgccatgcttgggaatttttgtatttttagtagagacagggtttcaccacgttggccaggctggtcttgaactcctgacctcaggtgatctacctgcctcagcctcccaaagtgctgggattacaggcgtaagccaccgcgcccggccacctcacaggttttaacgtgcatctacatcaccctgggatcttgtgtcaatgcaggtcctgattcagtaggttcaggaggagcctgattctgctcgtccaagctgccaggtgaggctgaccctgccggtccacgaccaccctttgagaagtgacatttgatcccaggaaaatagggatcaccctgagggcaggatcccagctgggttaggagcaattagtattttccaagatccatgacactcctgaatttaatgatagtccaggccagtcccaacagtgatcagaccatgggagagatatttagttttactgactgtgactcaagaggcgttgtggctcaacacaccagacatgcaaactcatatccacccccagagcagggctggtgctgcctggtacaggggccatgctttggttgctcatagccagtccaggctgctgtctgaggccaggaggcatgtgcagcacatcctccctggcacagctatcagaggagggcaggccctaaacccataacctgctgactgcaatggctctgtgacacgacattgctcccagcagcaaggtgggcgggggcgatgggaagagcaccagctaacaagctgcgtgagtccagagaaggcacttgacctctctgggctttcttgtcatctgccagaagagagggttgaacatgttcatgtttaaattcccccagggtctgatttcctttgtgtgagcactccgccactaggggttctttggctggcaagagaaactagagaagttttgcttccaggaggggagaggtaagtacagccttctgctccccgagaggttgtcctgggcgtgagtgcagcagtgttctgggttgtctggggaggagcgctccatccaataggaagaggagccaggaagctggttctggtgactccctctctattctcctctgcagacactccatctgtgtccccaggggggcctatgactctcttccacctgtatctggtctccttgcgaggcttctgaatgtgcctttgggatttactctccctccctagtgctgggtggcctccacagtccccttggggacactggcaacgttaagggctcagtgccagcaggaaggggttcagcttcattgatgcacagagaggtccattcccttactgttttctgctcttgtaggtgggcagactatacccatggggcccaaaccggcctgcgtctgcaccgtccctagaaatacgcagcagcacttttcctcccctccctgagcaagccagggagccctgtggcttccagggcatttgcccttgtggtcacctaaggccgaggcagcggcgtaccaacgggtggcagtgggagcccctccttggtggggagcagtattgtatcactgacatgccttaaaattgccgatgtgtgatgctaatgaaaatgaactgacttttattattggttttattgttatggtcattattttaatgaatgaataacaattattgtttcaatttttttttttttgagacagagtctcgctgttgcccaggctgtagtgcagtgatgcgacttggctcactgcagcctctgcctcccgggttaaagtgattctcctgcttcagcctcctgagtagctgggattacaggtgtgtgccaccatgcctggctaattttttttcttttttttgtattttttgtagagacagcgtttcaccatgttggccaggctggacttgaactcctggcctcaagtgatcctcctgccttggcctcccaaagtgttgagattacaggcatgagccactgcacccggccaaaaattttattattgctgtacaatcaatgcatctcttgctggctgcacacaggtgaaccactcctgctgtgccttccctgcggggctgatggtcccctcatccactccctgcatgccgggtcccagctcagtgacttgggaaggggcgtattcatgtcaaacatgtttctgagtcaaagtctctgtgctgtatcaatccaagagccagcaggaagggtctccaacactagaacacttcctgactcaaatcgtgtgacatcatgtcacttattgtcaatggggagatgcctggattcaaatattatgtcttctagggtgatggaagtgagaaaattggttctctggccacactctaagtatatattgtcagaagattttaaatacagataagacatttaattattaaatggcttttcaacgtgaggctcaaatggagccttctaattagctgtcagttctgtcacagccatgactagtgtgccctgggctggcttctctcctgattttcatgtataaattccatttcatggtaaccagacactgcgggggcactgcccggggtctctggcctcccctgggcgagaaggtaccatagcttccctctccttctgggactgcctttccctgctcctaggtcagggcaggggaccatcaagctggatttactcgaaaaggataagtgaaaggaaagactggaagcaccccgctccctgcacacctgacacacacgtatgtacacatgcagagaaagggggccaggccacaggcagagatggacactaggtgagccagcagcagccagagacagacagatggacacctacccagatgtacaacagatccaggagcttctcctcctgtccactgcctgctgtcccccacccccccaacctggagtctttttctctttgtgcaattttgacttttagaaactccgaggtggctgcagccccactcagctgtgttgagcctgctgctctgggtggccgacctgaggcaggccagcctggtgcggtggtgcctgtgctgcctgcatctcttccttgggactcttcctgagatctcaggccctcctgtgacttcagccttcccttttccccaggaatccccacatcaagccctggcccctctcttcgtcctgtctcacgttcccaatggcctgagggaggggcagtcacagcatccccccaaactggacaccccccgcgcctccactccaacctcctgttgctattcacgttaatcatggcagctaacaatggtgaggggcactgagaaccaggtgcttggctgggcaagtcacacacgctcgctcccttggtcccctaacatccctgcctgaggacctggtctcatttcctgctgctttattgctcaggaaactggggacaggaggggctgagtgtcctgtccagggccacttggtgaggccaactccagagttcctactgacagccacgtgatactcctgccctccatgcccccaggcattgtccctttctgggggaagtcagatccctccatttgggaattgggagccccatcactggtgctttaaggactattgtggcctcgtgagggactctcctctgcccttcccctcttccagacatcctacttggtgctaggtgtcatcttcctgagacaccacgctgatccgctcttgttttcaagtcttcagtggtcctgtggctgtgggttcaagttcccctcccttacatggcattcaaaggccttgggcacctgcccagcccaggcacctcctagcttgtttctctgtgcacaccacttggaccaccaggctcttcagttctagccccagcacacgctgggcttcctgcctctgctcacctactctgcctcgccaagtcctcaccgtacccctagaagccctcacgtctcccaggtccctccagccaaggggtgtcttctctgactgaaaacctggcccctgcccctctctgcctagcagcttggcttcatcccagttaccacttcctcagcctgtcttccccagctctgagttgggagcagcagtaggacttttgtgaacagaaaatggtactcagcacatgtccggcccatagcgagagccccagaactcttagccccccgggtcatcccggtcactgttttctcaggattccttagggcagggctatgcctgtgtgcacgttcacattccctgcacaaccccaccactgtcccatctgtggaaggcacttggggaatagtggttccagctatgatggttcaaggctattcattttgccagaccctggtagctggcagcgcaatcagaattttgcagattgaactataaactgggcttgctgattcatttgaaatggcaatatcaacatgataacattaacaaaatcgttaggctggtgattgcaaatgtacgtgtggaagtgaaaggaagcactctgaacaaagcaaacacagcttgccatctctctttgtagggcatggcagagaagtacgaggactgatggctgcccacagattgtgtatggctggggaaggccttcctggaatagtggaaataatgagaaatttaatattttgcctggggctgcagattgcagaccaggacatatagcagagggctgcagtatagcaaactgaacgaatgatcagagtggagtaagtcagggaagacttcctggagggggctccttgagacttaaaaaacacccactaccaaaagttttagattgtttgcttttgtattagcatccacatagggaaggcaagacgtctttgataaagaaagaaatctaaactgtggttgttctttctatgcttttaacagctagtttttcctcccacagaagcatcgttctcacctctaaacccccaccccaccgccaccgtcttaatgaagtgaccttttagtgcattgagttggaaatgctttctctgtaaaaattatttcctccatgacccaggagtaaattatttagtggtctctgagaccttctacaagtgaagtttccaaatgagccagatgcattcccatgaactctgaccttgcttagcagacataaaacacaacagtgaatctctcctgagacagcaaagcatcaaggcactccatgctctgggatcctctttctcaggcccatcagcgtagtagctgtagggatgagatgtggttgcagtgttagacgcaggagtgtgtgtgcaggacgtggaggcgcttgggtgggagcctggcctaggctaggcgggtgctagtgaggagcccggaggcagggtcagcctcttttggggtgccaggcgctgtgcactctcatcttgccttcctagtatccctgagaaaaaatgggagctttggatggtacagaactccagagaggagcaggaaggctgtacgtttggcagacagctggttgggcggtttaaatttgtccaaatgaggataaagccacccaggaggggcttgttggtggctctcattaaatacaaaactaaatgggatttaatttttctgcctctatgagtcttttcacacccaggcatttctaaatcacaccacgtgccctgattcttgagagagaaaatgtggttactagaagtgagaaaaccgctggcccctgggtttttctgggtttgctgggggaagggggctctccgcctcccctctctcggggtcgagctggggcgggtgggctgtgctgtgggcaggtggcgaagcagccctgcaagaggtgggagtgaggagccgctgacatttcattcctggcccctcctgctcgggctccgtgaagcctttttagcttggctgctggaagcttcgagctgataatcatgagggagtgtaaatgtcagcgggctcccggcttcaatcagagctgttaaaaataagcctggcaaggcagctctgccagaggtgcgctcagagagtggtggggagggcaggaggggttgagggaacagggcgctggcgggggggctcgagggcgtgatggcgagaggatgtcaagcctagtttctggcaagtagtgagtgggggcaggaagcagagacagacacgaaggaaatacttattttcttttctcagccttttttgtgattaaaaaaacaagtgacatctcaaatttcatttggaaaggaaaaagcagaaggcagtggtctgggtccctaagctcgggccgcagctggctgttttgtttgctgggctgaaattctaacggtgcctgaaatcagagtgcctggcacaccagggcagaggcagggggtagggggacagctgccagcctcactcagggtgagagattctttctctgcttggccactggggaggaagcacagccccaggtgagatccgggagggaccttgcacctctcaactcaaagggtgcccttggctggcagcatcagcctccggggtaacacagactctcaggcccaccccagacctgcccatctgaacaagtccccaggggatttgtgtgcacattagtggctgggaaacactgctttagagatgatagcgtctgtgtcttcagatggggacgtggaattccagagtggcagagggtcgcacccaaggtcacacacctggtgcaggaaacgagggcctctgaaccggggtctggagcatttttccatccacatgatgtccgtcatagagctgggcacagacgcaggttcaacaagtgcagctgttacttctcttcctgctgcagtatggtggcttttctaaccagggggaatagcttcagggaccaatcggtatatctgggtggacttcagttctcactaagaatctccctggcacgggattcagtcctatcccttttttcatttgggacatgctagcttctccccgcttgtcccagagttggcatctgaagctgtgcaaggaagcaaggtgcaaaatgggtgtggaaggccctgggaagccccaagaagagggaccttccatgggaagtagtggttggtccataagaatagcattaggatgtggtgaggtcagcaactggactctggctggaaagcatggatgcagtttaattgggtttctttctctctcttttttttgtttttgagaaggagttttgctctgttgcccaggctggagtgcactggagcaatctctgctcactgcaacctccaccttccgggttcaactaattctcctgctttagtctccctagtagctgggactacaggtgcccactaccatgcctgactaacttttgtattttcagtagagacggggtttcactatgttggccaggctggtcttgaactcctgacctcagatgatccacctgcctcggcctctcagagtgctgggattataggcatgagccactgcacctggcctatctctctctctctctttctggcagttgggacaggggtagggtagagaattaaagttgagaattaaagcagagaattacatcatttattgagatgtgctcatttgcgtttatttgtttaaaataattccataaattgtaaaagttcttccttccacccaaggggagaaaaaactgataagatgacataaagtagttttaattaattgtaaaaaaattcaaagatattcatgccctcattcattttgtcatagattgatgcattccccgacttcttactagactctgatttctccctaggcactgtgctcgatgcttatcacaccaggcaatttctggtcctagtgctgccgtcacctgctccacacagctgcattcctcttatgaatactatttaacccaggtgcccaaactcgacattgtatcattttttagggtggaaactcctcctgtcttcctaattaggggccacatggcctcacataatcatcaataaggctgagacatccttaggagcatagaatttggctagttttggagccatacagtcggtggaggcatggtgggatcagacagctatgcagggtcactgtgttcagttgctcaggatgtgcactgcccaagggtgccacctctaaaggacaccattctcattatagatgtagatttgcacatttatttagacaatttccaaataaatagaagtatcttgaagaagggatgcctttttctaattcccacaaaggtcccctatggcctggcagtggccctggaggttctggttccagcacgagctctggtactagctgccttgaattcttcccacaggtcaacatgctttttggccttggcctttcttctacgtaggacacaggaggtcctctgggggcagggtgacctagctgcctttccagaaggtgaatgacagtcttagcactgggtcagcccttccctaggtggtttttgtcaccttctgaaaatgcccatctttgctgttgctagtttctttagcactcactcacatttcagccatttcttgtttgtgtcctaattctcccttgtcaccagcctaagggaaagtgtggctgtgagggaggccctattctcttcatctcaggactttgcttctctgctgtggtcaggcccacaggtgcctgcacatcctccacctgccttagcaagacggtgtttctgcagatggagtgttgggtactgctagctctgctggtctttcctcaaaggtgacttctgtgcccgctggaattgggtttggctctacataagagaaaaacttttcaaaaagatgacttaaactaagatatcggagtttttctctcacattacagtatggcagctccagagtcagctgggagtcagagtcccaggacccctctatcttttgctccaacattcttaagctttatcttccatcctcaaggtcacctcatggttcaagatggctgctggagctccagccatctcatatgggctttaggcaggaagaagaaggaaagtagtgaaggaagggcacctttcccaactgagtcagcctccttcaaagagatttttctggaagtttttttgttcagcaacttctacttaagccttggctactccaagatgcaagggaagtaggaaatgtaatttttatctgggcacatgggtggccacatcaaatcacagttcttgtaagaaggaaaaaggggagaatggattttggttgggaacacctggcaacctctgccacatcttgctgcttttccccttcccctatccactgccctcccagggtctcaaaaaagctgttctggagagctttgcaacacaggttgtgtcttctggctgccgcactgccctcttctcacaccaccttacagtttttttctctttcctctggttttccctctgttgcttctccagtgaatccagggagggcagttttttgtacagtggttaagatgtggattaaggcagacctggtccaggttgtagactggactcccagctgtgtaaccttaggcaaatcacagaacctctctgaacctcactttcctcttatgtgaaatgaagccaacaatagtccagtggcctcatggagttgttgtgaggaataaataggggaggcatgcagatcacttagcacggagcctggcacattgcaaaggactcagtaggtgttggttactcctatttttattatcatttttgggtcttgcccttggcatggattttataggtatcaccagctggtggcatatttcttttctcttagacaattctcatccagtcaagaaatatttattgagcatctactatacaccagtctctcttccagaagcttggaataattggcaacacagtaggtaagaatccctgcttcaaggaggtgatatttcatggggagagtcccattgtgctgggtgagaccctctggaccttggctgctcttttgccaccagaaatagcattcatgtaggtatataggtctctgggccttagcctctcacacatgttcttatggcttctgaggctttcaggtgcttgacctatgagataccccaaaggctgacttttgaatcacattgttctcatattcacaaatccttgggcccactttagcaggctaacctatgcaagtgcttggagatgagtgcatgtctcttcccagttaattcatttgcttctaactggagccttctagagacagtctctcaaagcaggatatgtgacatttttgggaatcggatgcaccatgcacatatgcacaatttgcacatggttttaggggctgcatagaccttgggcagcccactcttgaggcctcagagcctccaggggccccagctcagaaccctgcttgacaatctcagcagtgacctgtgccagagctgccttgacagcaagccttcacaaatgtcactgcgtgctagtctttcttgctccttgtgggtggcctggttcgagcaaaaacttgagataaatgtaagaagatgaggcaatggttagccgaaaaccttcctttctgccaaggttgccctttgtcctttactagtgtgtgaattgtgagcaagacttctcgccactcctggcctcagagttagttctggcctgtaaaagactggagcttgtttagatcatttctaaggctcttttcaacttgggaactgcaagggcacttagcctatgggcttggcattggacagaggggggtccaagccctgtttgtgctcctacgagctctgtgcacttcagccagcaacctgacttctctcagcctcggtgttctcatttgcaaaaggaagataaaaacatgttcaaagtatgactgtaaacgagctagaagtgtgactgtcatacaaatataaagcggtatgtgccaaaagtttacatttaattcatgaatgaagggaccagcaggatggtaaagttgtttcaaggagaatttggggggctgagagcttatcatcagtgaaagacagggaacactgaaataaaactacaaagttcaatacaaaattggttaatgttggacatggttaataaactaaaccttgaggttattttttctaccagacagtaatgatttgcaactctaccacacaaaaatctacaagttcgtgtgtaactgcacagaggacagaccctaatcagtagtggatagtgagacaaaggtgagtcccctaaggaacctggctcacttcacggaaagacatgaggagaagcccctctccaggggagaagatggcaggagtggtgcatggagcgtgtctgagcacatccacactaattggttttcagatgcagctgcaaagttcatgtgaaatggaaaaaatcaaatctgtgctttgaatccatagcacttgccttttgcaagaggcaaattctcagtatggggataggtgatagaatgatatcaaaccggagtgaacagagtagctatcttctcagctgatgtcaacgaatgatctcaagtgtatcacaaagtagtttttcctccagcactgcctgtgacattgaacaaacccctcctggggcagtgaggcaggggcagatgtgctctgccgccatactgagaaccggggctgccccaggggcttgcttgccacccccttcagcactagcagagggccactttcatggatggagcgtgggcttaggaggcagcagccagggcctgccagggcccagcacccgctggacgacttggggcttgcaatttcacctcttctgtgaaagcgccaaggtgcagagcctggtgtggtgcaagcactcagtgaagggagctgttggtggcaccctcttccgcccttttccaccctgtggcagcgctcagtgtcctcatcttaaaaattttacctcttaaggctgttaagagggttgcttcttgctttcactgccccccccaacaccctataatccagttgcctcccagaaaccagttctccttataaaatatcagccagaccctgctgctctcctgctaatacactccaactcactttgagtccaactcacatcccagccatgcctccgaggctctccgtgacccagtccctgcctatggctctagccaccaccttctttctattccctgacacttccagctcttgcccacctcacggcctttgtgcctgctggttcctctgcctgggacgctcttcccaggactctgcttggctgcttgcttcttgtcacttcgtttctcccttgacagacagggaagcccaccaaccacgcgggctgcaggggcccctgcttcccactccctctccatcctgctcctgttctgtttccttcacggcactcctccatctctgaaatcatgtgggtggtttttggctcccccactgggatggaagcatggagctcccttgccttggttgctgctctgcctaagcccgtggtccggccctgagaatggagagggcctggatgaacagcagcggcgaggatgctggtgacagacacatgtgccagcagggactgagctgaatgcttcacatgcttacttattgaatccccaccacagctagatactgttactatttgttattcccattttatacaagaagaaagagaggcacggagatgttaggggacaagctcagagtcacccagctagtgagaagcagagccaggattcagcccagacaatctggctccagagtttctgcccttaactgacatgtgaaatgcttgttggatttgtgatgtacgagacagaacatgagccatcctccccggtgaaccccacccctccacgatgacaggccgtccctgctggccttgatccctcagcctactcccccagctgaagcctccctcccccagccatgagtaaggacaggacaccttccaccgcctcacagggatctgattcagatagggctgcagcggccagaattccattcccacctctgcctgggattagtcacacaggacacatccccgtgggcaggtcacctgcaggcttcacactcatcttcagagtctgacacctccagccatgggcaaattatctctctgcgcagtcagcccagagagacggagtagcagagccctggagccgagggccccagcagccccacgctgcgttcttttcatttgcaccttagctggctgtcaggtgcgacagggactcactgccacccctcactgctgcaaaaagcgaagtcccaaggcttcccagctcagagcctcacccccagtcgtggggggcttggcctctccctgtgtcttcctgtctgactctgtcttttttttcttctttcacttctgtttcttttgtattctgtttttgcacttttctcttcattggtctcctggctctggactgcctccctttctctctctgtctcagattcccttgcctttcccccagatgctgcactgtggtggcactggcacctgggagctggctgctgctcctgcagggcttcagccattgctttcctgcagtttctccttgcagggtgctgcccaggagtgcacctgcaggctgggcaagtggccggggcttctggcttctgtttggccactgctcatctgataaacaagtgtgatccagcctctttcttcccttggtctctagatcctccccatgacagctcatgaggatgaggggagggttttgggtggggatgctgacaccaagtcaccaaaaggtgtggcagacacagtgcttcattcctttatggacgtgggcccctgcgatcctgtcacccacagccctggttcctggcttctgaaggtgctcccctcactcactcccctttcttttgttttctttcctaccaaaaatgttagcaggatgcagagatttgggcacatccacacagatgacacataggtgtctttgctcaactgtctaaatttagtagcaaactttcacccatgccatgtgtaactctttcctgtatagtacgtttagctgtataaaaaaagctaatccagggcgaccagcaaagccctctctgcccaaagcatttcatttacattcccagactggtcagatgtcaccaatgatagactagcctaagccagaactccccctgacataccacatagaaattagggctgtcagtcattcaccacctagtatgaactactcttccaggcccaatatcctcaacacctagttagcatcagtcatcctggggcattggaaatactgtgagaaaggggtggagaaagaggtggcaccataagaggggcactgggtgggaaaggacaaaatgaggggtttgagggacagagaagatagggttagagatcatacgtgtagaatgagggctctcaaccctggctgccctgtggaatcccctggaagctttgaaaaatcccaaagcccaggctccctccctgatcaataaaatcagaatctctggggtgggtccaggcaacagtattttttaagtttcccagatagttccagtgtgcagctgagtttgagaaccactctcttatccagtgctgtgccactcgaatgcacgcacaaatcgccttattaaaggcagattctgatgcagcaggtctcgggggctgggtgcgattctgcatttctgtcactgctggtacagcacattttcttagcaaactttgggtagcaaggctttagtttacctggcttgttctccaacctggctgtgttctcaaacaaagaaagatgaaaatgggaaatattggctgggctgatcaagactccatccccccagcgcccagctctggtaactctgagttggagctcaagcttagagtggaggcctcgggctccccaggctggaatcagatctagggatgttactaccccctagatactcaggacaggagccgagagtgtgatcaggaggctcaggcagagagccgtgctttgaggcgagcctttgtgtgcacactattggatcatggcatggctgtgctggcttgtaggtacggcccagggcagtgctcttcactcatattagcgtgccttcctccaggaagctggcagagggcagatgcatccttctccacagctgtgctgccatcgttattatcaggaggcttgagacttgcagacatgcaatgtgacaaatgcagggatggagacgggggagggccctggtgaccacggggaaaagtgtttgtttgggggaacagggaggcaagccggaggatggtgagagggggctgcaggagatggtcagaatttccttctggggctgtggaccttccacccaacactgtcacaaaggcaggctgggcctggttcagggacctttgtcatttgctggagaacaggccccctggaggaatgacagctgtgtgtggggctgggctggggggtggtggcggcagggggcttcatacacttatccagtccagtcaatcttcaaggggattggtacctgtttttttttttttaattgttttaatagaccttattttttagagcagttttaggttcacagtaaaattgggcagaagccacagagattcccaatttaccccatccccattccctcacaagcacagcctcccctgttatcacatcccccaccagagccgtacatttgtcataatcaatacatctatgttgacacatcattatcacctagagtgtgtagtttacagtagggttcactcttggtgttgcagactctatgggtctggacaaatgtctaatgacatggatacactgttgtagtatcacacagagtggttcccctgccctaaaagtcctctgtgctctgtgtattcatccatctctcacaccacctgttggcatccactgattttttttttactctctccataattttgcctttttccagaatgtcatacagttagaatcatacagtatatatcattctggcttctttcacttaatcatatgcatttcagtttgacttgatagtcctttcctttcctttcttttttttgggagggttggagtcttgctctgtcacccaggctggagtgcagtggcacgatctcggctcactgcaacctctgcctcctggattcaagcgattctcttgcctcagcctcccaagtagctgggactacaggcatgcaccaccatgcctggctaatttttgtatttttttttttttagtagagacagagtttcaccattttggccaggctggtctaaaagtcctgacctcaggtgatccacccgcctcagcctcccaaagtgctgggattacaggcgtgagccacctcatccggccagctcatttctttttatcactgaataatattccattgtctggatggtccagagcttactcatccattcacctactaaaggccattttggctgcttccaagttttagcagttaggaataaagctgccataaacacccatgtacagattttttgtgaacataagttgtaactcctttgggtaacgccaaggagcatgatcactggatcatatggtgagagtatgcttagtgttgtgaggaactgccaaaccatcttctgaagtggctgtaccatttcatatcctcaccagcaaaggacaaaagttcctgttgccccacattcttgccactggcgttgtcagtgctctggcttttggccactctagagtggtgaaggacctgtttgttaatgtcaaaacatcgcagacccctcccaagggctagttttgacctttttggtacccaaagataatcatcaaatattgatgacatcccacctccatgctaggcataaagtaaacatccatggcccttgcccttctgtaacacaagattaaatgaaggagatagatattaattacataatttcataaataattgattgattaaaactatggtaagtgctggctgggcacggtggctcacgcccataatcccagcactttgggaggctgaggcgggcggatcacggggtcaggagtttcagaccagcctgaccaacatggtgaaatcccatctctactaaaaatacaaaaattagctgggtgtggtggcatgcgcctgtaatcccagctactcaggaggctgaggcaggagaatcacttgaacctggggggcagaggttgcagtgagccaagattgtgccactgtcctccagcctgggtgacagtgcgagactccatctcaaaaacaaaaaaaaaaaaagtacatgctaagaagaaaaagcatgggtacagtagttaggaagtgaccaaggaaatacatcatgtttttgaagaagaccttaggagtccagcagtgcctttgagtctctatcttacttgtccacaagggcatctgcacccacatgggaggtataagaaaagtaacgctgggcgtggtggctcacacctgtaatcccagcactttgggaggcaaaggagggtggatcacgaggtcaggagattgagaccatcctggctaacacggtgaaaacctgtctctactaaaaatacaaaaaattagccgggtgtggtagcaggtgcctgtagtcccagctacttgggaggctgaggcaggagaatggcatgaacctgggaggtggagcttgcagtgagccaagatcacactactgcactccagcctgggcgacagagtgagactctgtttcaaaaaaaaaaaaaaaaaggaaagaaaagtaacagtggccgggtgcagtggctcatgcctatagtcctagcactttgggaggccaaggcaggcagatcacttgaggccaagaggttgagaacagtatggccaacatagcaaaaccctgtctctactaaaaatacaaaaaattagccaagcgtggtggcactcgcctgcaatcccagctactcgggaggctgaggcatgagaattgcttgaactcaggaggtggagattgcagtgagttgagatcgagccattgcactccagcctgggtgacagagcaagactctgtctcacaagaaaagaaaagaaaagaaaagagaagaaaagaaaataaaagaaaaggaaagaaaagaaaagaaatagcaagagctcctatttattgggccttaaaccaccagctatgactgttactttctcccattttacagatatggaaaataaggctcccagaggtaaagcccatggtgtttaaccctcattcactctacacacagtgctaggggtgcatgaggatacccagatattgcaacagctctgtggcctttgtggctctgcagcccaggtggggacccctggtctagggatggagagaatgaggcaggcagcagggtgcctggcagcaccaacccttccctgggggagagcatggctgtgggagctattctctagaagttggagaaaatttccaccccttctagagaagcaggagttgggccaaattggatgctaagatgaaggctcctgagccctgaacagtttctgatattcacaatggtggtcagagccacccaccctctgcctgtctcccccagaatttggctgcagccaccagaccaggaggtgtagttgccctctatgttcaggttttgcagagctggccgtcacttccacaactagatgaagactggggccaggagccctggtgtcactcctgctgagggctcctgggtggtggcccagaggtgtgccaaagactgtgagaagtcaggggctgatggccttggatcccccctccaagctgctcccaccacactcttcattctcggagacctcaaggaagcagtgtcaaatgcagctgcatgtctgtaagggacttctgaacgaagcctctcaccacaagattccaatgcctgcctctttgcctttcaaacctacaggggtttggaaggagtgacagttcctgagacactcataggaattctgggaggcaagaagtccccaggcaatgttcatcgcagacaggggctgacattccacactctctgcagcacggccgctcagggaaaacatgtgaaccgtatgccatttttgatgaggatatgtctagaatttattatacaagcatctaagttctaaaacagagggctctgaacataatttcacctttccttgatgactcaatgtcaacattatgaatgttcacgatcgcactctgctttccaggctttcacctcctccctccaagttcatccatcaagtgtcactgccgacatacatacacttccagaagcctccccacacacttgcccgtcagtttgaagattctaatgtgctgtgcctgtgtagcataatgggttagcttgtgggttctgcagttaggcaggttgggaaagttactatgcctcagttacattatctggaaaataggcatgatcagagtacttttaataaaataggctttggccaggtgcagtatctcatgcctgtaatcccagcactttgggaggctgaggtgggagcatcgcttgaggccaggagttcaagaccagcctgggcaacatagtgagacccctttgctacaaataaataaataaataaataaaaatatttagctgagcatggtgggggtgtgcccagagtcctagctactctgcaggctgaggcagaagaattgcttgagcccaggattgcctgagcccaggctgcagtgagctacaattatgccactggactccagcctgggtgacagagtaagaccctgtctctataaacaacaaacaaacaaacagtagactttctttttttagagcagtttcaggttcacagcaaaattgagcagaaagcccagagagttttcatttactccctgccccctcccacacacattctctctgactattaacgtcccacaccagagtggtgagagcatgtgtctcatgaggttgttttaagaactaaatgaggctgggcgtggtggctcactcctgtaatcccagcactttgggaggccgaggagggcagatcacaaggtcaggagatcgaggccatcctggctaacacggtgaaacctcatccctactaaaaatacaaagaattagctgggcatggtggcgggcgcctgtagtcccagctacttgggaggctgaggcaggagaatgacgtgaacccagaaggcggagcttccagtgagccgagatcatgccactgcactccagcctgggcaacagagcgagactcctctcaaaaaataaataaataaataaaataaaaaataaaagaattagatgagatcatgtatataacacatataaaatacctagcacagtgccaggcacatagtaaatgcacgataaatgttgccaccaccactatcatcaccaccaccaccaccactaataacaatcgtgtgtcacacaagagccagtcacaatcattcatgtcttaggagtaaagtgaacagtttttgtgcaaagatttggattatgtctaaatgccctctcagcacctctctgtgcttgcatctgtgttcaggcaggcagcggggaggtctgacttctggagaagtggaaactggggaaggattcagcttcaccccatatagaagtagcttagtgatgtgcactgcagtcagcacatgcctctcctaggagtctaagggtgggtcccttgaggctcatagaggagctatcctgtctttctgggtgtgtgttatggatcagactctctgtaggctttggagaaagaagagctgagtagacaaggtttgatgtgtgggccagatgggtcaggttgaaggtggctgggatccaaggtgagtctttagccctgagcagaggaagagccgccggatggattcaggaccacggacagctccccagacagcgactccttgtggttcctcgtagctcctctgggcttttgttgtggccacctgcagatgaccctcagccaactggaaaccttccttgctcctgttaacagtcagggctctgtgtttctgcctgcctggaaagttgttagggtcttattccctttgagcatccctgtctgtgcatgtggagggggcctcaggggctgcagatatcctggggaagctgacctcttgctattccaatccctccagccccttctttcttctgagaaactcctgaggccaagactgacagggtgtgacagccccgtagaagactgaggtgtggaagaatggggcatggtctttttggtagagaagtggaccccatttcccctgaggaagagggaatggaaatgccccagggacccagtggtgctctgctggcctccttggtgggctgctcctgatatgacttcaagtcagacgtcagtcttgacattagctgtcctgccacgttggtggggctcccagcttctccctggagaagcttggattcacagcccctctgccctggtcacttctctgagcagagccccttcccccagcacagcctgggttatacttgcccagccctgtcactcctctcctcagttctctctcttttcaaaccacattaaatcctgcctttcccagccccaggcccacccctggtcctcaaccgggagaacccaaagagtctgcccctcagagtctggatgagctttcctgagaaaagtgatgcgtgtgaagggtggcctgcctgttgcgtagactgtgcattcttcaaaataccctaaaacccacctggcttgagccagtccagcaaagagcagcgtagtaggtggtggcactgaccctgcagaacgacttctcctgagatcaggtaccaggccataagcccgggctgggagcatgtgagtaattgccctgtgaaatgcattgctgtgacagaagcagaccaatttgccaaatgccatttttgctaaaagccaatttgccccaaaagtcaattcatggaatggccaatttgtcaaatgaccaatacgtcaaattgatttatttcttttaactatttggtgtgagttgactggtttgcattttgtctttattacagcagtttaagaactgttccatttgtctctgccccagctccgggtgtttgaactatagtgaacccgccccagcctcttcctacagaggaatggtggagcttggagtcttcctacaggaagtggctggggtggggcaatctgactgtccttaaaaggctattgtgaagggaaatgggaaactgcccaactaaaaccaaactgttaaaggaaacaaagaaatttagcaaattgatcctttgcagaattagctgacctgtgacttagcttcatgtgacttggaaggtgtggctgagtgttcttgggcccccgctggggatgctagtgagggtattgcttttctctctcacagtcatctctattttttggcagggggtagcagggagctccttgcaggaaacgatgtcctgtgatcatccctttataaagacttgtaggaggcctctgtgcttggttttagacccaggaaaggccactctgctcccaagctgttttatccatagacttgctaaattgtgtaagataccattccccgaagtccccctaggctgtgagaagcccggggcccattggtagcagatgcaaagggctttgcaggctgcacctctcttttgtttgatatttctacctatttctgtctttattctttttacttctttgatttctgttttctctattttacaacataccctcattgcttcctgcaacaaggcagagaaggcatttggacctactctgaaggctattccattggcctatttcccatactccagccctggctctcccagatccttgctcctgtagttctaccccatgacctggaagtcttgtcccagagcagggtgctgtgcctgttctccaggaagacacagaacctgaaccggtattgctgtactagagactctggaagatgcagcatcttcacctggcacagtcagatactcacatctgcacagtgcccattttcccatttccgcctctgtgtctgttggaagctggccccagtccctcctcactgttggctggggattgtttctgccacactgtcctccgtgcagtttcctctcagcctgggaatcttcccactgcttaaaattgtgagcctggcttcttggagtatttgtcacttggcagattttttctgcatttgtctcctccagcagggactggagagggagggcactggcatttgttgaatgcctacaaagcaccaggtgctggaatcagtgcttcccatgttactttttaaaacttttaattgaagtataacatatattctgaaaagtgtgccagtgagtatacagctcaccacattttctcaaagtgaacacactcatgtaaccagcaccagatcaaaaagtaaaacatcatgagttcctagaagcctcctgtacctccttccagccacaaatccctgcaccccccatcccgactaactacaatcctggcttccaacagcatagattagttttgcctattttgagctttatataagtggtacatatggtatttaatcctcgcaactcagcaagagggagatgtgattaaccctcctctacccatgagtaaccagactcagagaggttaagtaacttgcccaaggtcacacaggcagtaaatggtagggcttggagtcaagcccagggttttctggctccaaagctcatgtccttttctctatacatcaattctttgtcctcctgcaccacctcccctgcccccaccattgtgtgtctggcctgggaacttctgaagtcgctggtcctaactgttccttgtaggtgcctgggacaggagccttgcctctcatactccccggtgcattcccgcccaggactagcaggtcaccaggggcctccaaggtctccgcgcccagcacctggtgttgagtaagcccggaggcctcgccctggtgttcacatgcagaggggcctgcattcctctgcctgcttcattcaccctcgttgcctgctgctgtgcccttgccttagtggctgggactcatgtctgccacttgcagtaggtagagttgaagaggacgaagctagttgtgtcttctgtgtgcccctgagcctctcactgcttagtgggactctagcctctgagctgctgttccttggcagggctgaactttcacttcaaagcagggctgccttgtgggatgtgcccctgatatctctgttgggggaacgcatgctcagtagctgcatagcaaacagccgggttcaaggaaatgttaccctgggtgcttttatgttgcggccattcaaggctgcttaatgtctctgcctgatgaggtttctgcaacattaactctggtggtggtggagggagaaggagggggctgccacaggagggtttgtggcttcgcggtgggcagggaaggggcgcacctctccagctgatgggacctggcacatgttgggtgctcagtaaatgtgggtgggatgaataagggcagagctcagaccccaccatccacagtgtcaggcccccaaaccacctgcaggaacttggacatcaggaattccctgggaccatgttggctgttccacattttattttatttatttattttttaaatttttgagatagggtctcactctgttgcccagactggagtgaagtggcatgatcacagcttactgcagcttccacctccttggcttgacaatcctcccaactcagcctcctgagtagctgagaccacagacacactaacacacctggctaattatttaaaaacatttttgtggagaccaggtcttgctatgttgcccaggttgcctcaaattcctaggctccagtgatcctcttgcttcggcctcccaaagtgctgggattacaagcatgagccactgtgcccagactgtagttcgataattgaaaaaaaatctccagacctcacagagcatgtgtgagctttaattccgtgaatcttatcattctcttaggagtggaagaggtggtaaaggagagggagcagtcatttcttcagtcagagtcacagagctgtaccactcaggatttagtagcggcagttggaagcctcacggacaatacaactgattgtcacccaccgtgtgccagtctcctcttacaaacttatgttacagaaaaggaaactgaggcccaaagaggcatcagttggtgctgagcttcgttttgaatccaggctgcagggctctgctcccagactagctactgcgccctgagacttcctttagggaaactcgctgatctgatgaccctgccatctgctccagctggtctggctcaaggcagtcagggttgcagagaaggggagcaggagagcacccaggattaggaaggggaacttgccactcaaaggaccgcagccaagcctagtggaggtggcaaaggcagctcccaggatctatcctgtcctgtgtgatttttttttttaagagatggagtctcactctgtcacccaagttggagtgcagtgtcatgatcatagctcactgtaaccttgaactcttaggctcaaacaatcctcctgccttagcctccgagtagctaggactacaggcagacatcaccatgtctcgctgattttgttagctgtttggagagatgggctctcactcactatgttgcccatgatgatctcaaactggcctcaagccatcctcccacctcagcctgccaaagtgctgaaattataggtgtgagccacggcccccggttccgtcctgtattttcacaagacagagaagtagaggaccagattaaaggaaactgggcttgtggcaggcgggacccactcccccttcactgcaccagtgtggtctctttgacaccactgctgggtctgctttgcaccctggccctggcccctacctgagcttgaacttctggagaagatgaaacaaacagattcacactgagaattagctgactgataagctttctacttgcatcttctgggagcacctgaggtttgtgagtggacaaagccctggcctctgggttgaggcccaaggcagcacaatgcaggttcttatcatcgaatgctctccagaacccaccttgaaggtgaattagacctagtccctgacctggagacaggcgtgcacacatgcagtatgcacacagggtagatctggggcacttgagtgttgtttcatgggctggagagagcaggcagggaggggtacttgcagaattaattccccttctacgtgggaggcataggatctaaagggaggtgtgaagaaccggcagagacaaaggcgggatggtccagcgagatcccaggagcatctctgagcagcatgtgcatcccagcgtcccacccatgggtattgatagcctccctcctgccaagccatcctgcagcagggccctggagcacagacagtccttaggagtctgtctcccattccctggcctgagcagggagccagggctgggactcctgacctcctggcaatgctggagatgccaagtcttcctctgctgtgagtgctggagctgattcaccagggagccccacacctgctcctcacccgtgccctcaggcatcttccatgcaaattggcagaaatgcaggaagggcctgtgggacaaatgtagtggctggtccctgccccccaccagccctgtgggtgccttttctgttcctcaggaaggcgggccttggtgagctgcagctgaggggttggtagctgctcttccctctctccactcactaggggtgtctgtgtctaagtctccccacctcagcccccaaagaataggagttggcacctccaacccttgctttgaaatgctaaccagtacagaggttataatctggtttgctttggctccagctggggacattaaaacattttacacctttcctctgctggaggcagcacttctcagacttcagtgtgcacctgagacactgagggatcctgactcaggaggtgggacccagaaaatctgcttttctatcaaacttcccggggatgacgatgctgccaatccaccaggtgccagggactcacttgctgagttatctgcagtggaatcccgggcagccacttattgataacagtcgtgtgaggctgccccgtgctggcaccagctaccagtgggcacgctgagtgtgtgacacacacagcatgtaatcccatcctcccagcatccctgggaggtcagtattgttgcagatgttgggaactaactgtggtcctgccagaggtcatggagtgggttggcggccttgagcctcagcctcctgactcccaggccctgaccctccctcctcctccctacagagcccaaaaggcaattattaaagtgtgggcaatggcagccaactctgccagtcctggctgaggccccacactcagctgtggttaagccatatgataattattcccattttaccatgagaagactgaggcttgggggttagaagatgtgcatgaggccagagcctgagtccttaatccaaccatcttctgacaaggatctaagcccccagatgaggtgccctggtacccttggggtgccctggttcaaggtaaccactcgggctgcagggggccgaggggacaggccaggctgcccagagcttccatgtggcatgaaaggcagacaaagtaaggcctgtgccctgcagtggcgcccgagtgggcagcaagaacccagagcccagtccagccttggcaggtgcccagcagccctctgtgtactcccacccctgcccccactgctaatccccttagaggctggtctgccagcagggaccaatcaggttagagcgtgaaggcagattagcagccagaacatggggtcttgacctcagcttccccaacccctgcctcctccagccctgggagaggatggggggattggcagagtgtgcagaaggaggggcagccagagcagggtgcctggggatggtgccaagtcagggtgtgggcctggcggcccccttgtcttcaggggcgggcggccgactggggttgcccgatgcttccaggccaagtgggggctgctcttggtggagcttgcctcctggggtgcttgatcttggcaatggggttcatgctttgtctgcagggcccttgccttgagctggtgtgaacttggaaccacttgagggtgttggttgttaatatcctgaaggatgtgtgaagggaagaggtgcgattgttacatcatccacaataacaagtgcttgctcgtgcctgccttccccttctgagcctgcatctcactgggtctgcagcctggttaggcagagcaggtacaagtggccgcagcataggtggggagctgtggtctctcgccatgcacagccagcctgtctggccctgagctcctgcctctcccttggccagtcctaactacttgttttggccgggaaaacggagagggattagagcagaggactcatgtaaggatccattttagttcattcagctaaaaattactaagtctctgcaatgtgccaggatataagggaaagtgaaggagagtgtctgctgggaggttatggtctggagagggagatggacgttcaccagagtcagtacttcatcacattcggtgcacctgtattttattacaagcctgggttgtgccgaaaagtaaaagtgggggtgctaggagcctgttgcagatagagcagctgactcaggctcaggggaggtgtttgtagactgaggtgtgaaggataaatagcgtttcctgggtgaaggtgagggaagagtatcccaggcagaagccacagcaagtacacaggtcctgtggatgtcaggaggggtctgggaaactggaggaatgtcagcagaggtgagggagtaggcagcggcacctctcccatcagatcctgcaacataagtgccgctttccatccccatgttgcagatgagaaaactggggccagagaggttacatgacttgcccgagaccacacgatttaagtgagtggagccaagtctcccctgtgacacccagctgtgggctttgtcctcagcaccctggcctctccgtgagtgctccctggaccagcatccccgcatcccccaggtgcttgtcagaagtctgggaccttgtcccgcccttcagcttctgccccagccctgtatctccccagcgctgtcctgggtctgactctggggatctgtcatggtgccctcgtcactgtcctgcccctgccctccttctgaacccctgtctggctccgcttccccgggctgggacaggccctggctgccctgggcttggctgtttgtccttccagtcgcagatcccgcccgcttccaggacggcagttctcagggtgtctcattctgcccagacacatcctggccatctcctcacttcagggcgtttgacaaggccgcgtgggaggaggacgggcagcaatgactgggtctgaggaagatgaaggtggcccagagctcccggaaaactgatggggaaaggcttaggtggtgcttttggggggtttccacacagaccaggggcagaagacatgataaactttatttcaaagggatttgggaaagatgagacaagtattggcaaggtaggaagtcagttggagcaaaaagaaaaaaaaagagaatagctttgttctgctagtttgcgatgtggttgaggcatccaggtccagggaaggcttctggcgccccctcgtgggaaagcttgaaacaacagagccttagggttgcttaggctgtgcttcgggcagggacaacagcccgcatttcttgaatgctgctaaatggaggttgtgattcagaagcttaagtacatcaattcacaatcttctccaaagtcccacgtggtagttattttacaaataggacacctgaagctctcaggtgcagaacttctcgaggtccatggttggtcaatagcagaagcaggagttgaacctggtccttctctctacaggtgcaggctccttctaccacccgctttgctgccatcaggctgcattttcctgaggcttccaaggttcacctgttttcctctggcctctcctggggccccaaattcactttcctgtcttcatttaaacgatgagggctggttccggctgtgggctgactggccagggtgggacagttccacacccagctttgggccatctcttatctcttgatggccgttggcatcacctgctgcctgcctgcctgggggctgtgtctttcctctttaagctttggtgccccagaacaaagcctgaaagatggtcagagctgggcacagtgcccgtgcctttagtcccagctacttgggaggctgaggagggaggatcacttgaacccaggagtttgagaccagcctggacaacatagtgagaccctgtctctacaaaaatattttttaaaaaattagccaggcatggtagcatgcgcctgtagtcccagctactcaggaagctgagagaggaaaatcacctgagcccaggatttcaacagtgcagtgagctgtgattgagtgactgcactccagcctgagtgacagagtgagatgctgtctctaaataaataaacaaaataattaaaaagatggtcatatcacagccctctctgttctatcccatcactctccccggcctgtgtgaggcttctcccagctgacacttgcttcccagagcctctgctcctccccagtcataccaggctctctcatgccccagcgtctttgcatagactgggcctacctggagtctgcctctgccttcttcctcttccctacttagttcctggtgtgagtccttatagaaatgcatttgctgaattgtactttgatgctattataagaaacagacactcaaaccccattaattataaggatctagtgttattgattaggctacactgtcatttttaataaacacccctgggaaaattcttgcctcatctgagtgccacaccagctgtactcctgagaagctgatccttttagacttatacgtgtcccgtgggcgctgtgagctgactggctctcctttcacgctggctttcagtgagaaagctcagagccccgctcagcccagcctggcatgtggtcacatggtgcatgcattcttagtacccgccattgattcctcctcttctctgtgcctcatttttcactcttgctctcttgctgttttgaaaatccctataagccaccttaaaggctttctagaacaaggttgggtctaaatcgataagcaaatcaatacgaataaaaaaaccttccttgcagggttgtggtgaggattaaatggaataatgaatggatgtgagtgccggcccagcgttccttcccaggcttggccaaagggtgagtggtcggctgggctgagatgagggtcccactggaggtcccgccttcctgactctgtggacgtcctcaggccaccactccttcctgcctccatctggctcttaatgcacatgctctcatctccctgagtccctgtgggtcagcaaaggtggcaggctgtgtctgtcttctccccagaccccgtctttcagtaggtgtatggccagcaactttcctcacctcctttctgggaccccaaatcctctaaagaagcaaccacctcacttgatgtgtgtcttagtctgttccagctgctataacaaaatattgtattgggaggctgaggtgggtgaatcacttgaggccaggagtttgagaccagcctgagcaacaaaatgagaccctgtctccacccgtagagcatctgtagtcccagcgcatctgtagtcccagctactcagaaggctgaggtggggaggatcgcttgagcccaggagttcaaggtgacagtgtgctatgattgtgccactgcagtctggcctgggtgacagcaagaccttgtctctaaaaaaacaaaaacaaaatgccgtagaccaagtggcttataaacagcagaaatttatttctcacagttctagaggtgggaagtccaagatcaaggtattggcagatttggcgtgtggtgaaggctgcttccggcttcatagacagtgccttctagctgtgtcctcacacggaggaaggggcaaggcagctctctgcggtctctttcataagggcactaatcctattataaggatggagctcacatgacctatcacctcccaaagtcctcacctcctaataccatcacattggagattaggtttcaacctatgccttttttgagaggaaacgataattcagaccatagcaatgtgtcttgcaggcatgtggttgggtctgcactggtgaagagcttagaaatcttctgctccagcctatgaattggacaaatgaggaaactgaggcccccaaaaagaagtgatgtagccaagtctctaacatgatttcagcccattaacctggagcctaagcatgcccctcccttccttagggtcatgcctcaaagcaacgctggatgagtcatcaattgtgcgtaaccaatgacttcaaaacactgcggctttcaagaacaaacaataaacatctcacagtctctgtaggtggctgggtggttctggcttggggtttttcatgagattgcatcacaatgttggggggttgtgtcatctgaaggcttggctggggctggagaatgcacttccttgatggctggctcacaggctggcaagcctgtgcctgctgttggcgagaggcctcggttcctctccatgtgggcctccccagagagctgcttgagtgtccttatgacctgggttgggttctcccagagagggcaaacccagaaggaacaaggagggagctacagtgtcttttatgatctagtctcggaggttatccattaccgtttccatcatatgtggttcttcagaagtaagttactgagtcctgcccacattcaggaggaagagaatgagcctctgtcttttgaagggaggaatgtcaaagaatttgtggatgtcttttaactaccacaacctcccacgtacacacaccagtcatacgaaaccacatgagattcccccagcctgccttgttccttcctgtctctgggtttctgcacatgctgttaccgctgcttagaacaccctttcctcattttccatttctgtctgggacacatcaactctttaagatccggtcagagatcacctctcctccctccagcggacttgttcactcacttctctgcactctcccatctctttggcagtactgctcctccagccattgttgaaagctggcatgtacaccccatgaaagcaagtctttgggggtccccagcagaccatcagctttcagtacacatttctggggtgaaggattgaaggtccactcactggtttcccatctgtgccctcttctgggcatgagtgctctagggtggaccatgcacctgtggttagctctgcatccacaagcccagcccggtcactggtgcctgtgggcactccatcaaggtgagtttggtttcatgttgggctcccatgtcagcctgggctcctggttactgaggaactcgcatgaccatgagctccagtgtgggcagtctgttgtttacctgtgtggcctgtacagccctgctctaaatccagtaatttccctgccagcccactctgcccagtggcagcatcccacttaggaagatggagagaacaagtccacaagtccacagaccaggagaaccatcaagccattagggcaggcaccaccagggtagcaatttcttatatgaagcagagacactaagaagaggatgtggcagccaaggaactctctaggcaaggaagagatgataacaaggattaggcaggcaaagactgaaatgagcctctcaagacatatggggctgggggagttgctgcataaagacaggcatcggggagtaggccactgggggccctctggggagtagcctaaatgggcggaatctggggaatgtctccaggaatactgacagactacactggggagctggcgatatggcacaagtaaccaagatcgaagatgaaagatgccatggggagagcaggaagggaaggtggggccgggcgagtgcgggaggaggaagcttcccccacaagaaggggagatgcctcagggatagcaggtgggacggctctggaggagggacagctgtgtctgtgctgcaggcttgaaccatctcccctccaggagatggggcctacatccaggagagagagagcaatagagagcaagaacgaggggcactgatggtgccaaggccccttcagacacgggtgcctggctgcttttctaaaggctgtgaggggacaggacagaggggctgggtttgggggagggagcacatagatgttggtgcccactctgtggggacgggaaggcaattgctttgccaggctttcatttttcccattttgtacatgaggaaactgggctcgggaggggaagggtgccttgcagatgtatggccaggagggggagggccaggcctcgaaccccaggctcctccctccagctgcaagtccccagcccagagaaggggaggtagctggggactgagctccctccaggacagggtgcatctctccagttccatcattcattcattcattcattcattcaacaaatgcttggcgagtggctgatgtgggccaggcactgtcctaggtgctggggtgcagcagcagctggtccagtgccttctcacagttctagtaggcagtaggagcccacctgcctcctacctttctgactcagggctctgtgcacaccgttgggtttctcaccagggaaacccagacagggcagcggcggccttgacagttcaaggggcggtgtgcggcggggcagggggctgtgggctgtgttctcggaccctgtggggtgaggggctgaaaggaagggcaccgtcaaagcccacgggcctggcccaggaggaggaggtggggctgtggaactgcctggcactggggcctatgtcaggacggtctgccgctggttgttcaccttcaggaccccggtgtgtctggggcaaggctctggggcagggagcccgggtccaaccaggtcagttacttcacatctcagagctcagctccctcctctgtgaaatgggcgcaatggcagttcctacccccagggctgccgcacaagccagggctctgggacctgaatgcctgggttcaaattctggagccaccacccaccagctgggttaccttgaagaagttgcttagcttctctgagcctcccttttctcctttgtataatggggatggtgatagtatccacgccacgctcctgggaagtactcaggcagtgctggcctggggggagtgtggctgtgagtaggaagagctgacctggaaaggggcgtttgcacacgtctgtggatgccagggaggctgctgagagggaagagaggcaggtggacaggtcagaggcccggccctgacagggagtggaggaagggccccaaagctggcctggcagtcactgaggctgaggatttgcagtcctgacagcgccccctcccctcgcagcagggcgttcatggggaggtgtgaagtcctcagtgatcccagccccttgcgtgctcctgactccctgtggcctaggctctcggaggtgccctgttgcctgcagtccacaagagcacagggtttggagtcaggccctgcctggagctaaagatctgggtgggctactggccaactgggtcaccggagccaattctgtccttcctgagtcagcttgctcagcataagacacagagcgtaagccccaggcgcacccaccacagccagcccagggtgccatccctcccacctggtgccagacagtggtcatcaatccccctccagaagcacctctgttgtatgcccctttgcgccctgcacgatgctgtggggggctgaactggcctctgtgggtctggtgggctgacctctgtgggcattaggctgttcttgtattgctataaagaagtgccgagactgggtaatttataacaaaagtgattgacttggctcacggttctgcaggctgtgcgggaagcaaaggcatctacttctggggaggcctcagggagctttttctcatggcggaagcctgaaggggagcaggcacttcacgtgggagagtgaaggagagggagaatggagggggaggtgccacacacttcaacaaccagagctcccggaactcacatgccatcgagaagtcagcatcaagccaggagggatcagtgcccatgaccagatcacctcccaccaggccccacctccagcactggggattaccattcaacacgagatttgggcggggccaaatatccaaactacatcaggtggggtctggcagggctgatcgtagctgccccaggcttctccttccagctgcaagccccgagcccagagaaggggaggtggctggggactgagctccctccaggacatggtgtgtctctccagttccatcattcattcattcaacaaatgcttgctgagtggccactgtgggccaggcactgtcctaggtgctggggtgcagcagtggctggttcagtgccctccagcccacctgccctgcttccctgacttatcacagcactctgcaggaacctcttttctgaccggtgttttctctccctctggctttatcctcccagggacttgagtgagaacgccatccaggccatccccaggaaagcttttcggggagctacggaccttaaaaatttgtgagtacaggcctgggagggagaagggtgtgggggctccagggccactcctggcagcatcctcagggtatccctgagcgagccgtgtggtccaggcagccagggagctgacctgggctctcagagggctggtgccagcatggtcttctggaatagtctggggttggaggaaacaggcagcccttgcctctcccttggttgtgattccatatgagagccaacggagggggcccttggggacctggtgaagcgtgttatcagcgtgggcaatgttctcagtccatttaggtggcacagtgtctgtgcccgcctcatatttgggttgggagagctgggtttgaatcttctcttctagttacacatacataaggccgctgcaagtcagtgaacatcgctgagcctcgatatattgttctggaaaatggggatactaagatctacttcacaggcatgttctgaggtttaaatgaaacatggaaataaatacactttgtcaaatgctatttaaatgtaatggcttattattattactattcaaatgtattctggtccaggcttaccacctccttgaagtctgactacagcagggatggcaaatgcctggcatgcttgtcacacacacccccaacctcgcctgtggcacacattgataatcagtcaccacattctttcccacagagctcacctcacagcttcagtttactctgacagcagcactccaggtagccacctctagtcaacctctttggcactcaggctgaggtctgtttgccagctctggatgtcactgctttgtgactctcccattttccagctgccagcacccactaggtggtctccaaaatgtgtgtgtgtgtgtgtgtgtgtgtgtgtgtgtaggggggtgcctgctccccaggggatatgtaaggttgagtagaagaatataacttttacttatatttatgattttaactgaaaattagaaaaaaacccttaagtttttactaatgttcgctatttggattgacacatatacacataacaaacggctaggggtgcacctcttttgaatgaatggagcacgcggtcagaatgtttggacacccttactctaggcaatgtgcccttctctctacaaccttcctttgcttcacagacagctggacaagaaccagatcagctgcattgaggaaggggccttccgtgctctgcgggggctggaggtgctgtaagtaaagcatggaaaaggaaggaggggtgtggagggccctgctaggcaggtgccaagtgccgcagcctaggcagcgggcatcagggagacaggaagggagagacctgccctcctagaatcacctcggaggaggggaggacaggcactcatggggttgtgcctgcagcaagtagtgtgccccagtataacctgctcaggatgaaacccaagggtttctggcacttggcctggaatgcttctccctttctccctacctatccaaaccccacctttcttccaagccaacccaagcctgggacgcgtcccatcacccgccctgctccatctccctatcctaccagccttggagtctatggtgctgtcggcttacggtcaccgtcccagctcagggctttcctgtggggtgggatatgcctcatgctcttcggcttagctcctccatgtccagccccgtgctggtcactttaaggtcgagagcctccctgttcgttagcagggcggccctgtcccacatcatctcctgctgggcaggtgctaaatgactctggtttttcccatttaggaccctgaacaacaacaatatcaccaccatccccgtgtccagcttcaaccatatgcccaagctacggaccttgtgagtcagccggggcagctgggagcggggcagccaagcccggttgatgccagggggtgggtggggcaggaggtgaaggttttgcagacaggtcatggagctcattctccctcagacccccagaggccagcccaggctgggggcttcatgctctcggaggcggaaggagttatacggttgcagggcatccaatgccacttaatttggtttttccttggaaaacaaatgatttgtttttgtgtttgaaaatgagccaggtggtttggggaagtgagcctgtgcaaggtcattgcgatgacctgggctttgctgggtacattccggtccagctgtgcccagagcatgtgggaggggaggggcagcagcgggatcttcacggggctgtggataatccccgggttggagctgagccgtctacttgactaaatgtagactgtgtttggcttgaacacagcaccgggggcagcctcctgcctgagattggggttcccacaatcaggctgggctgggggatccagatgggttgtgagccatcctgtcctcttgcagccgcctgcactccaaccacctgttttgcgactgccacctggcctggctctcgcagtggctgaggcagcggccaaccatcgggctcttcacccagtgctcgggcccagccagcctgcgtggcctcaatgtggcagaggtccagaagagtgagttcagctgctcaggtgggtgcagacccctgccgggctctcaactgtccggcgcctcctgccctgcctcttgttcccgcccctaatctcgacattaatacctggcctgcccatcacctcctgaccccgcccatcacctggccccacccatcacctcctgaccctgcccatcacctcctgaccccactatctgcccctcctgccccatccatcacctcctgactccactgtctgctcctcctgccccatccatcacctcccattctcaccatggcatttgtctctgcatgtcacttcttgcctcctctccttttccctcctgtcccctcattgccttgtccactcatcaccctctttgttccaccccgatctctttctggtctactcagtgcctcctccgatgtcctctgggctccttgccactgctatcacccccttttccatcctccaatcgcctcacctctgctgccttgacaagtcgttgaattaggccctctaaacttggctccaaaagaggtgggcctcaaagcccacaccctttcaccttccccctggggttctgtcatagcctcctgactggttgcctacatcctccctggcccctggcttatactacagccagaagaccaaaaagaacccgcaagtctgggaggtcactgctcgtgtactcacctggccgtcagcactgtgtcgagagtctgaggctctgcaagcttggccagggccaccgctgcctcccctgcctcctgctgcctgcagctcccccagctgtgcctggcctgcctctgccccttcctggtgcaggtgcccccagccctggcctcacaggctgctcccctgctggacacacccttccctctttgttgcctgccgactcctcctcaccctgcagggcagggcccagggagccttctgtgatcctacatgaggtcccgcattgtgtttctggtgcatcctcagcactttgtctttgcttggcacaggaaatacttgctgaatgaagggacagttctcagatttgtgacagaggatttagaggctgactgtttctcccaaacccgtggactgggcctgccagccacacagagttctgaaggaaagcatctcctaggcacagcctcccctcctcagtgtgaggctcttggctgtggctgtcacctcctccattgcactggcagacacccagtgcaatgggtgggcttgaacaccgctgtgctctgcactgctgtgtgtgtgtgtgcatgcagatgtgcgtatgagtgtgtgtgcctgtgtgcgaaaacctgtgtgcatgtctcttgtgtgagccaggactgcctctgcatcattgcagctgccacagtttttaggaattggaatgggtaaatcacttggacaatttttattttgaaatgaaaccttttcctttgcatttggaagaccgtggtttctattttcagacatgagtttctcctctggagtctgatcagcctggcaacccttttcctttgaaggccactgtcacaatatgccaggaatccatgtagctttgtctcatttggtcctggtgcccaccctttggggcagccatggaaaatattcgaagttagaatgctggtgggggtatcaactggctcaaccactctgcagaactgtctagcaggatccactaaggctcaacatctgtccaccctgtgaccctccaactcctactaggtgtgtgcattttttctgcaaaaatgtccaaaaatattaaaggcagctttttccataatagccccaaattggagacaacctgaatatccaccaactaattatgatgtatccatataatggaatactactcagcaatgaaaaagaacaaactactgatacacacagcaacatagtgaatctcaaagattgtatattaagcaaaaaagccagacacaagagaaactactgtttcatttatgtgaagttcgtaaacgagcagaacaaatctttggcaatagatctcagaatggtggttactttggggaaggggcaggagggaatcttcttgggtaatggaaatgttctatgtctaggtagtggtcccaccagctacatgcttcagaaagaacactttgtataagttatacctccattttttcaaaggctcttatttcagacactgggctggatcctggttttaccacttattagctgtgagaatttctacaaattaattaatatcgaggactctgttttctcagctgtagaatggcaacaataataggctcctcttaggcttaaatgcaatgctgcatgtagtgcacttattatagcatgtggcatacagtaagtgcttgagtgtttaggaaacattatcaccctcatgggagagatgaggggactcaggctcagaagtgttaagtgacttggactagaatccagagcttcagaattctaggccaggatttcttagtgtatgaatcacacaccagtgcagttcagttcagattcaagttcagcaaacatctgacaagaacctgctgtgtgccaggcacccacagagttatatcaaagtccagaatcttatttcattagtgatcccctctggttcatccttatcgagagaaactgccagtgtacaccctatcccatccatcagtcggtatctgggctcaagggaggtgctgatgcatgacagcctgaggccacacccccctgtttctgcaggccagggagaagcggggcgcgtgcccacctgcaccctgtcctccggctcctgcccggccatgtgcacctgcagcaatggcatcgtggactgtcgtggaaaaggcctcactgccatcccggccaacctgcccgagaccatgacggagatgtgagtacggggcagggcagatgctggggcacagccctttggcaggcctggctctggagggccagtgaagagctggagtaggcgctgcctcagggcttgccccaacccctcagtggccgtagagaagacacagtttgcctctgctgggctgagctttgtgtccagggctgggaaactctggagggctggggagggagtgtccctctggggtcccacccagctgcgtgagtctgctagaatcaggttctcagcatcatttgtgggcccctttcagctacaaatgcctgtgataatggagcgcaagtcagcattttctctgtctgtcccggcgtccttaccccagacttcaacttctggaagtgggaagggagcaggggcaagaggggccaaaggattattcagggcaggtgagcccagcagataacacccagggctgggctgacctgggcccttgggcttcccctctcttttctccccgcagacgcctggagctgaacggcatcaagtccatccctcctggagccttctcaccctacagaaagctacggaggatgtgagtgcctcccactgcttcctggggagctggtacagggctgacggagatcctgggtggtcccacagccctggggcaggccctaactcagccccccacagctgagtggccttggccagccacctgaccttcctgcccttcaggctgcttggctgtgatgcggggacctccttgcagggctatcgtgaggcctgaagggagtgctgagcctgagcctggcctgtgatgggagctgcttgtcatcctcccgtttcagcttgggtaccaataggagcaattaaggatgggagggggctaggagactgccaggatgcatgggaaagctttgtccataacttcccaagctggagtgccccctcctgcccagccctcagactgcacagggaaatagcggccatgggcttttcaaatggaggagagatctggcctctcactattctcatttcaaagcactccaccctgctcctgtgacatctaggaggtggaggggactgggcagggcttagtggctgttgagggattcagatgccccctctccttctgctcaccttgcagagacctgagcaacaatcagatcgctgagattgcacccgacgccttccagggcctccgctccctgaactcgctgtgagtagcagtgccaaggcttcctcagtggcccagggcatcccctgaggaggctggcagggcccagggtcctggtggatgcaggaggaggagcagggctatgcccccctccacacagcccctgcccaccccagcctcagtgggtcatcctttggctgcaaagggtttgctgttccagctccctcttcctcactggtggaccctccgacgctgggagcgggagaagtgtggagaagctaggcagagctgttgcccctggcaactgggatgcactccctgccacagtgaggattttcccagcattctttgcacaaccatcttggccccgtcccccgcccgaagcccagcatgctgtgctcctgaggcctctgcagtcaccgcagggccagtgagcaccagctccagttgtgacatctgccacaacttgctatcttttatcccaaatgtaatgaatcccaagatgtggtgggtgctgctaggacagtgtttgcccgctcctccttcagtatttcccttccttcaggatctactggggaagtctgtcaataaaacatacaaaaggtagtgaagcacctccctctcccactcaccaagggcctcactacccgaggtcctacagcactttgtctgtacagagagcacactcagggtgccctggagttgggcgagctccctgtaggaggggccatttgttactctaggggatgagtgttttcacctgctccttggcagcacaggactcatgcttggcatagactagaggcctggcaagtacaacggaatagaactcccccggggagtgcaggagcctgccagctcagtgccttctgtgtatgccatcttttcttggagcagagtccaagtagagggtggggccaattatgaatggcacccctgaagttgtgcagtgtacaccctacacagctgtacatgatagcctggtgagggatcgttgtcattggctgaggagatcagattctgaaggtggcctgccaaaatgcagggcccttcctctgagaagtgaataaagctctcctaagttggaacatggcagtctaaaaaggtaaaagtgaataacccaaccaagtggatttctgttgttcatgggtacctggtcacagccacctccctgcatataggaacgtggatgattccagtacaccccatcaacagtgtctacctcggccagccctgaccttgcctccctgcttcagttcctgccccctctgctccatttcccacccagcagcttgaggggtgtttctgaaatgggaatctgatgctgtctcagtggcttcctgatgctggctgggtaaagaccaagttactgtcccatttgttccctccattccagccacactggccccgtcacctgtccacacacgacaggcacacacagctcccactgcagggcctttgctgttgctgtgcctcactccaggaatgaccttgaagccatgtttgaagaggaagtacccaggattttttactcagcttgaacgtttacgagggtagcttgtggggtccgattatgatattgggaatggcatacaacccccctccccaaacctcctggatgttttcactgtcctcctgaacccacccatgtctacatgtgtttttttgaacttttgtttttttaaaaaacctatacatggaattcatgctcaatgcagaaaactttgaaaatgctaaagtataaaaaaaaaatgcttgaagtcccaccatccggatctcacactgcatatgccgtctggcattctattttttcctgtaactctctgaaaatatgttaattattcctgcccatgggattttctcttctctcaacaatctccttttggattctggaccagatgaatttcccaggaagtgcccctttgcagccttctgtggggtccacgtgtgagggcggtgaagcaggagctgctttgttagtgattggagtcaggggcatctctagcccatagggcactttacgccaagaagcaggcaacgctttcttaagacactttactgtcatctgtggacaagttgctataacaaatatacaccattaggatgtgctccatgtaaatggcttaggggcagcgctgttgagctggggccgtctgcagagttgtgctattgccctggtgggctgtcctctaaccctcctctctgctgccttttctccagggtcctctatggaaacaagatcacagacctcccccgtggtgtgtttggaggcctatacaccctacagctcctgtaagaacgaatcctgggtgtcttgggtgggacccagggaagggccagctttcctctggcctgctagactgtccctttaggcctctcttgggtatgggactcaattgagacaatgagcttggaagacaggcagacccactagggctgagaaagtctccagggctctgcagaggctagagaaggaggtagaggcagcttcagagctgctcacaggatgccaaagcagagaggctcctgagactcggcccgtgctcctgaggagcttggtgtggctggggacagagctttctcctgcaggggggacacccaggccagctcggcctccttgaaccatgaactttcaggcagggattgtctcccagggctcaagaggcatagaacacaaatgctccaactcagctgcctggggaacccaatggacctctgggaaggaggaggagccccccccaaaaatgccttcacaaggtggctctctgctttcccggaatcccacagggcatctctagcagttcttggaaagagagacgagtgggttgaccaagatgtccctatgcatggaggaggcagtcggagttccgggcccctctccgtggggcagacatccagagggcagattccctgggcctgctccgatgggctcctccctgtaataacgcaggccgggactgaagaaggtgcccaggacctgagatgggtctcaggtcgagcctctctcctcaccacttggtcctggctctgcccacaggctcctgaatgccaacaagatcaactgcatccggcccgatgccttccaggacctgcagaacctctcactgctctccctgtatgacaacaagatccagagcctcgccaagggcactttcacctccctgcgggccatccagactctgtgagtgccctgatgccttcttcttctcccctcccagcaggtgggcctgggggaggttgcagcctccagggacaggcagctctccggctctgggctgctgtgctcactgggggtggcctcttacagaggaaggacacagacctgggttagaccgtcctaggttcaaagtccacctaggcctcttattggctgtgtgattctgggcagcttctctgggcctcatttttatttatccgtaagatggggatgccttcccatagggttgttatgagattaaggaggatgtttgtatgaagcttagctcatcacaagtgcttgataaatgctgcctttagctaacaataatattgatggtgatgatgatgataatatatcgcgctgattctaagacacatgttgtttccacgttaacagctctgaaactgggatgcatgttataatcagtggtacatcacttagttggcagcattttgttctttattgatagtacaaaaaatagtagtgcctcttacaattcataatgtcaaatcagatgaaatacggtaatgacaatggtgactgtgaataaaaaaattagagagcaataaatctggtaatttgttgtaatattttattgtggaaaattataagcagattaagagtagtactgtgggccgggcatggtggctcatgcctctaatcccaacactctgggaggctgaggcaggaggattgcttgagcccaggagttcaataccagcctaggtaacagggctgggcaccccatctccacaagaaatttttttttaaaaagtagccaggtatgatggcacatacctgtagtcccagctacctgggaggctaaagtaggatgattgcttgagcccaggaggttcaggctacagtgacatgtggccacaccccctgcactcccacctgggcaacggagagaccctgtttcaaaaaaaaacagagtgctatgtatggtgaacccccaagttttcatcacccagcttccaatcctgtataattaattccttaatatcattgagtatctagttagtgttgaaatttccaagtgtctcttacatgttatgcaatttttttgattgttttttgttttttgagctggagtgtcgctctgtcacctaggctggagtgcaatggcacagtctcagctcactgcaacctccacctcccaggttcaagtgattctcctgcctcagcctctgaagtagctgggattacaggcgcccgtcaccacgcctggctaattttttgtatctttaatggagatggggtttcaccatgttggccagactggtctcaaactcctgacctcgtgatccacctgcctcggcctcccaaagtgctgggattacagatgttagccaccacgcccggaatgttatgcaattttttaatagtttgaatcaggatttaaataaagcctgtgcaatataactggctgatgttggtttatgttggttgatgtacctcttaagttgctgtttatctatgtgtcctctccatttctcttttccttgtaactgatttgttgaagacactgcatcattggttctgtagggtctagactttgttgattgcttccctgtggtgtagtttcacatgttcctctgtcttctctgtatcctgcagattgaaaattggatctaggagctcggtcaggttcagttttgattgatttatttggcaagatgattttatagatgggattgtggacttcccgtcagaaggcagacagatgtctggctgtctcccttttgtaataaaaacagccattgatctcagtgcttgaacccattaattcattagcaatcctgaaatggtgattttgaatttgtatcagtctgtttttgtgttactatcaaggaataccagagactaggtaatctataaagaaaagaggtttacttggctgacagttccatggggtgtacacatacggcaccaacatctgcttggcttctggtgaggcctcaggaagcttacaatcatggcagaaggcgaagcaagggtaggcacgtcacgtgacaagaggaggagcaagagagggagggggagtgccatgctcttttaaataatcagatcttgcatgagctcagagtaagaactcactcattatcacaagggcagcaccaagccattcatgagggatccactcttatgcctagtcttgcttcgccttctgccacgattgtaagcttcctgaggctcaccagaagccgagcggttgttggtgccatactcgtccagcccacagaactctcagcccagtaaacctcttttctttataaattacctagtctcaggtattcctttatagaaacacaaaagcagactgatacaaattcgaccaaacaccgaacaccgatccgaacacctcccatcaggccccgcctccaacactggggattacatttcaacatgaggtttggtggggacgaacatccaaaccatatcagaattctaacattcttttttcatttctaatgcagttgtgactatgctttaaaacagaatccttatatttaactggaatgtttccacgtaaggaaaattctcatctgttgtgtggttaaacttaggcaattaaatggtccccttcatctacatctttaattctgagcctgcagttaggcaggatgtgctgacttgtgggttctgtggtgtgcatttaatgagcattaattattaatattattgtgtccattgttgtcgctgtaatccctgcccctgtctatgccaggcagtgctcttcatcagataacatctacatggggtattgggataggttccaaacaggctgagtaaaaggtacagctcgtgacccctggggactctgcacatcaccagagatgtcagccacaaagacaaactcattaaagcccacaaatttgcctgcagcccaactcctcccaattaatttacttatagccagggagacaaagaggaagccccatggggaaaccttgccaagtatgtgaaattagagggtacagggagacactggcaaggtggactattttaagcagctggcagaatgtctgagagaaacatgctaaggagatttactggccggggactcacacacaggaaaaccttggggatggggaatgggaatgagagactcatgtgagccactgttctttgcatgtattatcttaatacttacagtgatgctatgaaggtaggtgctttatcatcctgattttacctaaaacaaagactgagagaggttatgtgacacacccaatgttgcagaacatccggtaaaacaggaatttgatctcaggcatctcttcgccatcaccaagaaattacttagctgcccctttaattgtgctttttctgtaagaacagagctcattattgaaggctgtaaagcaacactgaactttcatgcacatctattagatgttaacaactgaactacaacttggaataagaataaaagaaatagaaatccaaggtactatcaggtactattattacaacctcaagtggttcagtttcttgactgagtcttattttattaaacctgagcagatttaaatttaccaaatcatgtttgatttgtccgtagctccaagatctgtggcgaagtccctgtgtaacagcattgattttgctgcagttttacttgccccaagagatttaacatttaaaaaaaagaaacagctctattgaggtataacttacatgccataaagttcacctgttctaagtatacaattcagtgatttttagtaaatttccagaattcaactatcactacgattcaactttagaacgtttccatcaccttcccttccaaatcccttgtccccatttccagactcagctgctggccatcactgatctatttcctttctctgtagattgccttttctgaacatttcataaaaatggaatcatacaggccaggtgcagtggctcacacctgtaatcccagtgctttgggaggctgaggtgggcagatcacctgaggccaggagtttgagactagcctgggcaacatagtgagatccccacctctacacaaaattcttaaaaattagccaggtgtggtggtgcatgcctgtggtcccaagtactcaagaggctgaggtgggaggattccctgagcccaggagttcaaggatgcaatgagctgattgcaccactgcacacaggctgggtgacagcctgagaccgactccaaaaaaaaaaaaaacaaacaaaaaaaaaccgaatcatacaatatgccatcttttgtgactgacttatttctttagcataacgtttttgaggctcattcatattgtagcatgtatcagtactttgttccttttgatcgccaaataatttttccattgtgtaaatagaccacaatttgcttgtccattccaggtgatggacatttggggtggtttccactttggggacattatgaacaatgttgctatgaatattcactcacaaatctttgtgtggaccaacattttcctttcttttttttttttttttgagatggagtttcactctgtcgcccaggctggagtgcagtggcacgatctcggctcactgcatcctccacctccgaggtttaagcaattctctgcctcagcctcccaagtagctgggattacaggtgcccaccaccatgcccggctaattctttttgtatttttagtagagacggggtttcaccatcttgatcaggctgatcttgaactcctgacctcgtgatccacccacctcggcctcacaaagtgctgggattacaggcgtgagccaccgcgcccgacattttcatttcttttggaatttctggttcatatggtagattcctgtttaacttttttaaagaaactgccagtgttttccaaagtggcggtactattttacattcccaccagtggtgtattatgaaggctccaaatttctctcattctaatcctcaccaacacttggctgtactattttacattcccaccagtggtgtattatgagggctccaaatttctctcattctcagcctcaccaacacttggtattgtttgtcttttttttttttgcattttgattctagccatcctagtgggtgtgaagtggtatctcattgtggttttaatttgcatttccctaatgactaatgcttttgagcctctgcctccaaagatttttagctgtgactccttaatgcatacatctacaaagacactgagaatcagtcctctcttcctttccttccactgccagaactgttcagggaggcagctgcgtggccacatatgcagcacgtttttgggtgttcctttaacacgattattttttcccaaatgaattttttttcttcctcttgagtgttctctctttccagcttcctgctctttgaaactgttaaaaattctaatttgtataaaatactaaagtttgtacagaagccacctgtctctgtgggtggttcaagttttataggttgtttctggcacagcctgtttttagaaaggagatattctacaccacacaccttgagtattttaatacatgcctaaacaacacaattggattgactacacagttttctgccaagatggtaataaagggaagcaattggttcaggcaggggctgaggcactgaggcacagccagatgtggatgggcagctggggaggagtcataagcagtccttaaatcctggtatgttttaaattagctacaaactctgcccccaggatatcagcaaacacatcctctctgtgcaaactgaaagtttaaaaggggaaatgaatgttgagcttgatgcagaagaggtgggagggacctggtccacctggtggagctgagaggagcaagaactcaggtgggaaatagggaaagacactgcaaaggagaggtggcagggacccagctcccaaccggggggccagagggcagagcccaggaggtgatggacggcagagagcaccgccaaggtctgaggtgagctgggcacagaccctgggcaagggtttactcatctgcttggagagtcctgcagccccttgcaggggcctgggctgagaccagtaagtcagatggcctgaactgatggcacttagatggaggaaaagtggccatggcagggcaagtctctttgagttggcctgttgctctgtctccccgtacttctttttttttccttttcgagacagagtttcgctcttgttgaccaggctggagtgcagtggcacaatctcagctcaccgcaacctctgctccctgggttcaagcgattctccagagccaggacaggtgtaggaatgctcttcccaggctgcctcggtttgtacagccatgagcagggcatgcccagtgctgtggtggctcagaggtagctggtctgaacctgctgtttgtcagagcccacccgtgggcatgccagcatggggtcgcacacagcaacccatcacggccatctgctccccgccaccatccccgtatttatcctgctgacaacacaggcagcctgggagagaatctgagtgaatccccagcaaggggctgctcagtcatgatttctgagttttctttgtgttgacagacagctgtaaaatggtcaaggagaggtcactcctgtggcctggggtggggatggtgactccctgtgaagcccagggactccagcaggcctggccaccctggcctcatccctctctataggagacaggctgctacctgagtctgaaggaaagggcacaaaccagggcccatggccactggggagggtcagaggctgtggcctgggcgcctgcagtcctgggttttgttaccctctctgggctttggcttccttgcctgtgaaaggccaggggtgctctggccagcctctgggtccttcctgtctccgctcgtgctcgtgaaatgtcccagggcagagagagggaaaggtgagtggaaagagagggggcagaatgaggcttgatggggagtaggacagcaggaagctctgggtggcagagacccttcacctgtagtgcgctggcaggacctctccagaggtggtgggctgcaccctgggggttcaccccactctctctttccccccgtggctgaccctaggctccaggccacaggcagcctccttggccccagccacaacgaggccctgtcccggtggaggtcagcgcgggtttgcagcccttgtttctcatagctgatctgcctgctttggacaggcacctggcgcagaaccctttcatttgcgactgtaacctcaagtggctggcagacttcctgcgcaccaatcccatcgagacgagtggtgcccgctgtgccagtccccggcgcctcgccaacaagcgcatcgggcagatcaagagcaagaagttccggtgctcaggtacctgcccgcctgcccacctgcccacctgtccacctacctgcctgcccacctgcccaccggcctacttgtccacctgcatacctgcccacctgcccacctacccgcctgctcacttgcctgcctgcctacctgtccacctgcatacctgcccgcctacccacctgttcacctacctgcctgcccacctgttcacctacctgcctccctgccggcctgcctgcctacctgtctgcttgtctgtctgtattcagcctgctcagggaccccctgatgtttcctggatggctcccacaaaggtgtctttcattactgtgaacccagactggagggtgtgggcccaaaattctagacttgatctgaatggtagttcagtcccacctcattttattgaggcctagggaagaagcaaggcttgctgaaggtcccagagggaggactcaggtccctccacttttagccagttctcttttatgcctttgttgtcaagccttttaagacactcaggaggcctgggaaccctccttagtgagataggagcctcctccaggctttgggatgcagaaacagccttagcaattgtagtccacgtggcatctggctggggacagtgtggggcagcttctgagcctacatcctggtcaaggtcctgacgccacctgtaccccgtccccacctgtaaaattagcacagtccccacctcgtgccattgcgagtgagagctcgatggttttggcactccttgcgagaggtttaactggatgcgacacccccagtgtcagcctgggcaaggaacatgcgtgctctgtagctcgcccttctgcacacagggactgggcagatgggctcctcagccctgtctggggtgccttcagctgagcagtggggctggggcctgggctgttactgcaggtcctggctgattcctgcattatggtatttctgcttctcttcccagccaaagagcagtacttcattccaggtaggagagtggggggatccaaggccagcctggcgggaatggtggtagtgggtgggcaggctgggggccttggttgacccaaactgctgggagccggccccgggctcctcagcctctgcccccaccctctcatggcaggcacggaggattaccagctgaacagcgagtgcaacagcgacgtggtctgtccccacaagtgccgctgtgaggccaacgtggtggagtgctccagcctgaagctcaccaagatccctgagcgcatcccccagtccacggcagaactgtgagggtccctggcccccccagccctcccctgtccctaactgccactaaccctccttggcctactccaggattttcttggtccagccctgtctggggctgaaccactggagcctctggctcaggacataccaactgctggcttgggcaggaagaaaccccacccctgctgccctctgcttcattcacagcccccctcacccatcaaaagcagatgccagtctctggcactcagggcaggtcaccagcctgaatcagggatggcttttctcaacgatgcgtttgtcttattctgtgggacatgattccaaaactctttgttatttttattcctctatctaaaaatatgaatttgtgtacacatatgtctatgtgcatagatgcctgcaagcatctgtcatttacgtctgtaaatttttcatggcatttttaatgttaaaaatatccccattcatatcctctcccagtactaggcccagccttcctttgaaataggatcaatttgctttgccagataaattcttctgggagtcttctctgtttgagtcccaaatattctcagtttggaagggatttgaaatgtccatcatttgtgaatgtgcaagttcattcttgtctcttacaggcgattgaataacaatgagatttccatcctggaggccactgggatgtttaaaaaacttacacatctgaagaaaatgtgagttacccattggcgagaaggtgtctgttgggatgctggccagggatggacaagggaaatgccagggtgggggcagctcccacggcggggggccaggactctgtgtgtgggggtgttgcctgcaggaagggaggggcctgagctcctggctgctggccatatgtaatcctccccccgcctcttctcccagcaatctgagcaacaacaaggtgtcagaaattgaagatggggccttcgagggcgcagcctctgtgagcgagctgcacctaactgccaaccagctggagtccatccggagcggcatgttccggggtctggatggcttgaggaccctgtgagtgtgcagggctggggagcagggtgggccagctgcaggaggcaggcaaagccaagggaaaggaagagagaggctggaggagcccctcccctgggcccagcttgcaggagggtggggagaactgaggatcctgactgtgttgggacaggtaatcaagttggcaactctatggtgagacctgttctcttgtaccctggggcatggggccaatgcccagttggcctcaagggatggagacatgtggacccttctaggggtcccttcccattgccctctggtcaggctgcaagagcacagcatgagttcaggagtggctggcactgctgcaggcaggaggggctggatgaccttgccaaggtgattcagtgggtgtagataggggagcagggatgctgcactgtccctgagatgctaggatcccataacccacagcccagcctgagctgaccagaatctggagctcagtgggatcctggggtcatctgctcctccatgatgcaggacaccccctccatctgccccaggagggctggctcttcagatgatcctgagggtgtgtatcgtgtcccatagacagggcagtctgtcggatctcccacagagatggaaatgtttcaagtctacgctgtccagaccagtcacttcatgtggctgtggagcagttgaaatgtggctagtgctactcagtgactgaattttgaatttcattttattttaatgcatttaaatctaaatagctacatgtggctagtggctactatattggacaccacagctctaggaagccacttgcccaggtataagtcccaaatctgcagcaggatgtagagttgtctctgagcaagtaaatgaatgtgtgacaggactccctgtggatttttgttcctttattttacaaaaagcaaattttattatgcactatgttttgcagcttgctgttttcacctgtgaatacagcattgccttctttccaggctgttcctataggctgcctcatttttctttatgcttacctagtattccttaaatgtgggtgtgggggctgtccagtcagctgcattctttccaaggaagacttagataaggacagaggaaaagagaagggcccataccccatcactatccagaaatgaccactgttaattgttggtataaacaactgtctttccagtcttttacatatctctaaacctgcatacacatacatatacacacatacatacatacaagcatgcacgcatacagaaatattctaatggactcgtacattttatttagtaacctgctttttccttaaacttaatatgagcaccattacatattaaaatttttttccattccacatttaattcctaatacaaaaaaagtgctctgcatcagtttgaatgactaggtattatataattattggcaatgtaggctgtttctatttttttttttttataagcaatgttgtattgatacctgccttagtgggttcaggctgctataacaaagagccacagactggaggtttatagacaacagaagttctggaggctggaagtctgagaccagggtgccagcatggatgggttctggcgagggccctcttctgggttgcagacttctgacttctcattgtgtcctcacatggtagaaagagggcaagagagctctctgggatctccttgataagggcactaactccattcatgagggctccacccttatgacctcattacctcccaaagaacccccatcctgatcccatcacactggggattaggacttcaacatagggattggaggggatcacattcattctgtgacaatatctttattgtgaagttcacgtataatgcatgataatactcttgttaggaattcctaaagatggagtagtcgggtgaaaacacaaagtgtcattttggggattttgctacatctcaccaaatgcacttccagggaggtataaaggcatctcctgccagtgtgtggaagtgcccagtcactcacactctcagagatcctggatgtcattattattattattatatttttcattcttttttaatttggcaggcaaaaaatcaatattgcataagtgtctttgattagtagtaacattgaacatttttgtgaatgttgataaaccattttaatttcttttgtgagttggctaccctgtgttgacttggtttttgtttttacttttggttggcaagtgaaattgagctgggtttttgttgttattgttgttgttgtttagggagacagggtctcactctgtctcccaggcagctggggtgcagtagtgccatcatagcttactgtaaccttgaactcctgggctcaagagatcctcccacctcagcctcccaagcagctgggactacaagtgcacaccaccatgcctggctaagttttaaatttttttgtagagacaaggtctcgctatgttgcccaggctggtctcaaacccctggtttcaaataatccttggcctcccaaagtgctgtttttacaggcatgagccactgcatcaggcttgggctgggtttttgaagatgaacagcagcttttccagatgtagatgaggcaaaagagtattctagaaaactgtcacagcggtgtagcaggctgagggctggtccatctctagggaggcaggcaggtgccagggctgagatggtccgggtctgggtagacatggtctcaggtcacagtaaggagttcgagcatgactcggtgggcagtttggaggctgttagtggactttaagctggagagtgacatgatggattaggtttcaggaagtctcctgggcactgatgtggagcatggcctaaagacgggcaggaactctgggcacccagggcacggaggcaaggccagcatgggggacagggcagtggcagggagagagagacagagcctcgaggcttctcagaggcgggggcgggtctggagtgggcacaggtgtgtaaaactcgcctcacctggccggggcctggctggtgcgtgttcctggctctgcggctcgcagcctatggaggagaactgtgaacgagccacgatggcggaagctgcgtggcccaggtggatggctggcagggcagcaagggtcccctcctccctcccccgttcctccccagaatgctgcggaacaaccgcatcagctgcatccacaacgacagcttcacgggcctgcgcaacgtccggctcctctcgctctacgacaaccagatcaccaccgtatccccaggagccttcgacaccctccagtccctctccacactgtgagtccggcctccaggacaggcgggcgggggctctggagcaaccgtcccaaccgtctcggccagccactttgaaagagctcaccctgggggtgctgggtcttcgtggtttgctgaaacgtgggttccacatttcgaagtctccctccggtcctcagagccggtcctcttggtgatgggtggtggtctgggagacagtgccatgtggccatgtggccctgtgtccgtggtacaggaggggtttgctgggacctctgagaggggcagagtgtctccatggccgcctggcctgcctcttccaggaatctcctggccaaccctttcaactgcaactgccagctggcctggctaggaggctggctacggaagcgcaagatcgtgacggggaacccgcgatgccagaaccctgactttttgcggcagattcccctgcaggacgtggccttccctgacttcaggtgtgaggaaggtaactcgtggccccccggtggcaagggagagggcgccctgggtccaaccagtggggtggggcaggtgaggaagatgggagtggacaggcagcaccccctggcatgcccctgagaggagaggttaggtggggaggggaggccctgttttcaggaggagacgcgcctgcctggtggtgtctttgtgtggttataagagcaataaagttcctatccttaaaaaatgggaaagtatggataaaagaaggaaataaactttacctattattccatcgctcagagaaaacagttcccattttagtgtagtttctttctgtaagtttggtgaactcagacctgccttttggctgtccctaagcactctagactcatggggtcaccttatcttaatatgcaatggaacccttttgagtcccctcccccatatgtaggaaaccctggtcactctttgctccaatgccttgtttcctgggacttctcagggtagccccatccctcattttttcgccacagcaccaagcacggaaggtcactgtaggaagcagatttttctctgtgcagccatcccatccttagtgtctctcagcaccctgccgcagggaatttctccctggctgacctcagcttccagcccccttctccgcttctgggtgctaaggtgcctcccttctccctggtctctccctttcttgccttctaccccctgcagcctactcccagtggcagctccaccctcagctggcctggccaggccacgtggcagtggagagctttgactttcaccccaagaaacaccatcagggtattttctaaacaaaattaatgaattctctaagaatacttttgcttctgacttctaaaatttaaaaaagagtctatactatttacatatatattttattaatttatataataatagcttgcaagtctttttaaaaatgtctgatttgtttaaaacctaactatatattttgggcattttctcatgccattaactatcctttggaaacattattttttccaagatacggtttccttttatccttctttttacaaaagaaatgcatcctcattccttaaaacaacaacaaccaaggacaaccagaaggaggatttaaaaaagttactgacaggccaggcgcggaggctcatgcctgtaatcccagcactttgggaggccgaggcgggcagatccctgaggtcaggagttcaagaccagcctggccaacatgctgaaaccctctctttactaaaaatacaaaaattagccaggcatggtggcgcatgcctgtagtcccagctacttgggaggctgaggcagaagaatctttagaatttgggaggtggaggttgcagtgagccgagatcacaccgttgcactccagcctgggcaacagaatgagaatctgtctcaaaaaaaaaaaaaaaattaacgatttgcccactaccccccggcccccatgccccaactctggataactcctgtcgacatttgctatgtggctttccagatctttgctgtgtgctcatgtgcacaagtgtggcacacagaggatcttgcagggccacctgtgaaaacctttcaacaggatggaccgctatctggaaggctccacaattgatgtaagcagcccccagctgctggacattcagacaacctcccaagtcccgctccaatgcatcgtgctgccaggagcaccctcgtagatgctccctacgtatatattccactctcccctagaacagcttcctagaggtgaaaggatgtgaatatttctaagatgttgctgctgagagcctggtggccaatcgagcaggttctggaggcaggctgcttgctccaggctggggcaagtttctgaaccactctgcctttagtttcctcattgctccaatgggctaatagtaacacattcactagagagctgttctgaggattcagtgagttcacccttatcctgtggggcctgcacacaggcgacctgcataactgatggtcactgtcacccgggagcatgtgctaccagcatcccagtgtcctcaagaactccgaccgtggtgatattatcatctctctgacacccaatcagcagaaaggaaggcacagattttttgaatagatgaatgaatcaatgaagggatggtgtggtatcgagggctcggattttgcggcagccagacctgggctcagactctgcattgccttggacccactttatgattcaagcaaggtgcctaacgtctccagacctcaataaaatggaaattcatccacttgttcattcattcattcaactcatctgttttgagggctgctgcgtgccaggcactgcactaggcactgggctctatcagtgaaaaaaagaggagaaaagaggcccaggtctccatcctcctcatgcctgcattctaggggcgatgctgcacccctaactgtactgttaaggagacaatgtcgatccagtgcccggagtagcaggcactccggggatgggatggtgcgcggccatcctcctgttctactttgaccaggtccactttgagtttgaggagaaagagaccaactcaagacctattttaacctcaaaactgctccagggggcttcattcctggtggcggtggtggctggcggggaggtgtagtgcacagacttactgatggccaaggtactgtcagaggggtcttctgttctgagaggccccagagcatggccctgactgtaggaggccctacagcggcccgtccacctccctgacaggggcttcgtgccttcttccctaggccaggaggaggggggctgcctgccccgcccacagtgcccacaggagtgcgcctgcctggacaccgtggtccgatgcagcaacaagcacctgcgggccctgcccaagggcattcccaagaatgtcacagaactgtgagtagctcaaggccttgcccccttcacgtgggtccacaggacggggacagtgggggcatttcctgaggggctggggcctagccatgggaggaggaggtgaccaagagcaggcattagctgactaggagctggagttcgggctttgcagaaaacactgcctccagaaaggctttgagcttctctctgattctccctctgcggtcacctgatgaccgcatggcagcgagtgcttcctccctttaaactaagctccgcctttaaaatgaggagaaccttgctttcccgcctgtcattgtctcaggctcctgtgtcatgaagacacaaatgtgatttttgcaccagcagtgtagtgttcttcacatgaatctactatgacccagataacaaaaccccttttgttggatatttgtttccaatttttttttactgtcataaacagcaccagtgctaacaccccctcactgaaatcgccagtcagagagcggtgcgtttttaggactcttgctgccttttgcctgatggtcttccaagaaaatctgtttcctttgcactcccattgaccatgtgagaaggtggccttcttgcttccctgggtcagcactgagtatggtgctgaaatcctggctgattggtatttggtatctgagcacatgtggaggattggacatagatgcatttgacaaacaggaatggagagctgggacttcttcagcagacacctcccaatgaaagactctggccagctcctgacctctgacctcttcctgtgctctggggttgatccctccaggcctccaaagctgagcttttctccccccacccccaggaccagcgatgaggcttctatttgttatttcttgcattaccagcaaggctggccttttcttcacaagcacatcaaccactgcgggccttttcctgggcctggcctgccccgtcttcaccctgttttctactgcagagttagtgtcctacaaacctcatgagtccttgctttctccttggagcctcctagcagccctgagaataatgggatgggtggggcagcctaccttctttgactgaagatggtgaagttcagagcctgcgaaaatcttttaacttctctaaacctcagttttgtcatctgtgaaatgggactacttgggtatgtggacgaggactgcctcgaggatcaaacgagatgggtgggaagtcagtttgtatgatgcagagcgaggggtaaggatgagcacagccctccttttgctcctctctggggctttgggaagtgggggagagctgtcctgcaggctgtagttagttggggggtggagatcctgtgctggagctcagcttggctcagctcctggcattgggccactgcttagcaccttcaggctggaggcatgaatggtcaacaatgaagggaagagggggaggttcagagcatcttgaatcccaagctctatcctgtagaaatgggaaccttgggaagcttcgggcttaggaggatttcggtgggcttggttttaaggacagtgacttggatagcagtgagtagagtggaggccagaagggaggtccaaggtgcagagaacagacagaagaggctgcagcaggagcccgggcatgggtggtggtgcacagtcggcgggtggcatgagagtgcaaggaaagcaagctgtgagagagcagcggtggcactggctgcagagggaggaggagaagcgacatcagggtgcggagcctggaaggcaggaaggcagaggggtgctgatggaatgagggggaactggttgggcagtctggctgtgaatcagcttcacagcccatgccagcaggtggacagggggccctgggagctggcagggcccggtaacgtgcaaatcagatctatttggccaggaaagagcagagcagggaggggaaggcaggggcccagggagtgtccatggacaaggaggaggctgggagggtgagaagggaagcgagaagggaaccgagagaggccacgtgactattggctttttaccaagtcctctgggtggcacctccccagatggcttcaacaacgtacatattttctcctcccataagtgattctgggcccatcgtgtggcctatgtggaggagaggaaatgagagcgaagtccctggctgcagggaaggctgtccccagcatggggcaccaccagaggtggagatgggcactaacgccgctgtgttctctctgcagctatttggacgggaaccagttcacgctggttccgggacagctgtctaccttcaagtacctgcagctcgtgtaagtatccaggccgcttgaggacaggagggcctttggcatctaaccatcaggactccggctttcctggaatttcctacggacctcacttctgggcagatcctgcttcttttcctttccctgctcccctctgggaacagctgtgcctagagctgttttgccacctagtggccacgattggcaattacatagttccaggccatgttgggttggacctgcctcctcctcctgcccacgccgtctccccaaagctcccccgtgaggctggtcgtgactgttaaaagggttatcctggtcgggcgggcacggtggctcacacctgtaatcccagcactttgggaggctgaggcggacggataacctctcgaactcatgttggagttcgagaccagcctgatcaacatggagaaaccccatctttcctaaaaatacaaaattagccgggcatggtggcacatgcctgtaatcccagctactcgggaggctgaggtaggagaatcgcttgaacccgggaggtggaggctgcagtgagccaagatcgcaccattgcactccagcctgggcaacaagagcaaaactccgtcacacacacacacatacacacacacacacacacacacacacacacacacacacacacacacacacaaagggggttattcttgcaaggttaggagccaaggagccaggaaaagtggagggtgatggaaagcttctcggtccagctcagctctcaaaccaagtatgaactatggcagctacaaatacatacctgtaactaagtttttcttcaggctacgcctctgcttttctattatttccacctttgaccccttctactccatgaaaatatacaaaataagcctcaggataataagttcagctccttttagttttctagcctacctagctcctcacttcaattgtctttatctgctccttggccagattctaccaaaaagaagtccagagaacattccaccttagtgtgatttggagcagtcccactccaagtgcaatctacgggcccacatcagtcccagaactgtttgtaatgggtttgtaattagatatggcgcttacaccagaatctaaatcaatgtattgcttcctttgttgagaaagtcttgctatggaaacaatgttcgcgtaaactaagctaggtgtggtgaccggatcttggcccaagtttcttattgtgggttggtgaaatttagttcaaggactggctactttgggcggctctggcttacagaattttgaagctccaatttatctgtctttgcttaatgacctggccaatgtgtgttgaatgttccaatgggaggggtggagaagggatggagtagtgtgattcagtggctggtgtcagagtgctttgagccagtgaaactgcctcttgggggctgaagtaccaccacctcctcatcacaggggaggaccacaaagtgtgttgaacattcagtagagcacttaaatgtatctccaaagacagtggaatgatttagaattagattagaggaacgttcaggaggagaagatgaaggcacggcacatcgttgcattttctaaatgtttcctgagctgagagcgcatgaagtgggcagacgtgaaggccccgaagtcatggccccctctccagactgtcatggtttagggaggatgcaggggaggggagggagcgcataaagtcgtgtgggtgataagggttccaacagaggtcaatgctgattagggctgtggctcaaggaggatgtgatcaactcagggaggcggcttgcggggagggcatcttggaacacgagctggagttcattggtgggcagagggaataagctgtctggggccacagagtgtagtctgctcagagaacttcaagaagcttagtgaatcctaagcctgggaagtcttcggagcagggagcagagggagggaggggcaggggctagacccaggagtgccgacaggtggccagctagagggcctggagtccacatgctaggcacatgggtgccactgtggggtttcgtcagctttgtgtcatagagaaattgctctggtgccaccctcatggcagatggatcaaaaggggcaaagcagtgggtgagagatgaggtcagaatcccaggcaggagccagagagagaggacgctggctcaggaggagggcacggtgcgagaggtgaccagggccaccagccaggggcggatcagatgggtgggatgagagggcagatgtgtgggcaggcagcattatggagctggagcctgggggatggggcgtggtagggagaacaagatgcgggcggagtttgagtatctgtgggcatcaggaggaggagttcatgagaggacaggctggggccatggggaggggggcactgtcagcacaggggcgtccccgagggcacccagattggactaaacagggcacagatgggctttagcaatccccatgcctctgggctgagtacaaaggaagcttctaccagagactgaggaggcacagccaaaggcccccaaagacagtcgggagcggaggaaagcgggtggcgggagttttgagaagagaagagagatcagttgtgtcagatgccacaggtgactcggagaggccatggcagcaacctgggcttgtggccagtggaccggctttgaatctggctctgcctccgaccagctggtgacccttcaagagtcatggatccctctgagactctgggtctttgtcaaatggggctgccctctccctcataggactgcctcgtagggagggcttctgaacgagcccacctaaggtgctggcaggagagaaaggagagagtgctggatctggtcgggaggccaccaacaccctggtgggagtgttcccatggtaaaaaggggcagagccaggctctgcttgcagagggatgggggtgagggtcaggaaatggaggcaccaagccctggtacctgagggagttgagggagcagcgcagcactgtagctaagcaagcgctgagacccgaggctgtgcaccagggctcctctccacccctggccaacctggctggggaatggccctgggcagagtgagggaggggaagaagcccgtgaatgtgagccagggctgagtgagttctttctaaatcatgatgcctttgccttttccagggacctgagcaacaacaagatcagttccttaagcaattcctccttcaccaacatgagccagctgaccactctgtgagtcccagcagggctggggtggggggccccggggccatggctgtgagtcattccctagccccagcctgtgctttttgctcccagatccctcgcctgcagacgccttgccctctggagagggtgccgggcctgagagcctaaaagactttgaaaaaacatctttcattgtgaaatacaacatatggcatatatggaaaataataatgcaaaaagtaaatagtgcaaaaaaataaatatacagtttcacaaataatcataaagctagcacacatgtagataccaagtcaaaaattaaggacactcggccaggcgcagtggctcacgcctataatcccagcactttgggaggcagaggcaggtgaatcacttgaggtcaggaattcaagaccaccctgaccaacatggtgaaaccccatgtctaccaaaaatacaaaaattaatcgggctgggtggcgggtgcctgtagtcccacctacttgggaggctgaggcaggagaatcgcgtgaacctgggaggtggagcttgcagtgagccaagatcgtgccattgcactccagcctgggtgatagagcgagactctgtctcagaaaaaaaaaaaaaaaaaaaatagaacagtgctagcaccttgtcccttcctgatccttattgctgtctcctcccctaccccaaggcagctgctgtcctgactttatgaggatcacttcttttattttctttacagcattaccatctacataagcatttctaaataatatagtctaattttgtcgattttcactttgttcaagtggaatcatatgggtgatagtcttttgtatctggcttctcttgcttagcattgtctatgagatccattcatgccaccgtggcagctgtggtctgttcattctcattgctaggtaatgttcctttggaggaacgggccacactttcctcatctattctagtcttgatggatattgaggttgtttccagtttggattgttgtgagcggtgaccctctgaacattttttgtggccatattctaagatatttaaatgctggctttaattatattccaagcaactgatcagaacatattaccaagtgtcccttatatttgcctggtgtgtaaaagtatctcattcaccttccaacacctcactttacagatagaacagtagagccagtacccaaaaaaggaaggggccctgacccagccattctccaggagctgaatgtgggcccaagccaaaatacaaaataaaaaaattagtcaggtgtggtggtgcacatctgtggtcccagctacttggggggctgaggtgggaggatggtttgagcctgggaggcagaggttgcagcaagccaagatcacacccctgcaccccatcctgggtgacagagctggaccttgtctcaaaaaaaaaaaaaaaagaaagaaagaaaaagagtgctattcttgataatcccctgctcctgcctctcccagctccgagacccaggcaaccactggtctgctttctgtcactgtaggttagtttgcattttctagggttttacatacaaatggagaaagtcgtttttgcttggcttctgcgcccagcatgattattttgagcttcacccatggtgtggtgttgcatgtgccggtagctctttctcattgctgagctgtgttccactgtacaggcatggatgtgccacagtttgctcatccattcgtctgctggggaacacgggggctgtttccagcatgacgctattgcaagtgtgatttcccttgttaatctgcctgtctgccctggatggattcagttacttggaagcattttgggacagtggcttagcctgtgggctctggaaactgaaagctataatgaaaatcccttcttaataacttttttttttttttttgagatggggagtctcgctctgtcgcccaggctggagtgcagtggcgcgattttggctcactgcaacctctgcctcccagattcaagtgattcccctgcctcagcctctcgagtagctgggattataggcgtctaccaccatgcctggctaatatttgtatttttaggagagacggggttttgccatgtcggtcaggctgttctcaaactcctgacctcaggtgatccgcccacctcagcttcccaaagtgctgggattacaagagtcagccaccgcatccagccttcttaatgacttaataatgtgaccctggagaagttttttcacctctcaaggcctcagtctcctcatctataagatgggaatagtgacagcaccttcctcactgtcacagcttttcaatagtaaattattgtagatgactttgcctgtcctccctggaagtggtcggctgagacggtgagctccccgcagtcaggtgtcaccttcatagggaactcgcctatgcaccttgctggggcagccccttagggaatgttctcaatcataacaacagcaactctcctttgttgaggatttattggagtcaggcatgatgctaagtgcttcacctggatttcgtccccaggacagccctatggagttggcattatttttgtccctattttacagtcgggggaactgattgaggcagaagggattagggggcatgcccaagaccaccagcttcttagggcgcagcccagcccatgcacttgccggctgctctgcctcccctcacagagcccgaggaggctgctgggtgagagggacctccacgtcctgggcggcggctgtgcccacaggggccaggcactaacacagtgcccttcctccatctccttcctccgcaggatcctcagctacaatgccctgcagtgcatcccgcctttggccttccagggactccgctccctgcgcctgctgtaagtctcctcactcaccatcctgccagaaaatccaccccactgagggtcctgccacccacctggtgggcagaaatgttcccatgtctagggcccacgctgtgccatggtggagtccagagtgctgtcacttaagcccctgtggatactctcattcccaagaagctggggcgtgcatgggaaatgatctgagaaatgggggttgctgtcacccccaagatgagtttgtggtggtaggggcgggacatccaaaataaggtggcccttcatttgcatgtgagacttctgttcagattaaagaatgtttgtttgcaagagatttgtgaacctcttctgtgagttctcactgtgaggtttttgccctgggatcaaagccctcagtccatccattatgatggcctcagtcagcccaccaggggcaaggtgacattctcccagccctaacctgtggctgtccttcttaacttcctaagaagaagcgcctccccccttagggtcctccacgaaaagagggagggctctgggtgcacgggtcctgtttgtaatgtaaacacagtgtttcagtcctccgaagggcttggggacagggccgtctgcctggaggatttcttccctgtggccagctgagctaggggccatctccttcaggtcactgactgagaggcctagagggaaggcacggcctgtcccctctctgcagagggctgggcctctccctccagcaggtctcccatctctgtccctggataaggcaccagcagcctcttcccttctcaggtctctccacggcaatgacatctccaccctccaagagggcatctttgcagacgtgacctccctgtctcacctgtgagtaccctagcccctttctctgggcctctttggatttcaacaggacttggtttctgagaagatcccacctcctgagattgtcagagtttgttgcttttactctgaaattaagcttgggaacttcccacgtgcaccttctgggactcttatatgtccagtggttcatcagccacagcaatagagtagaagaacagttcctcgcaagcggtagtgaaggttgtcatgaccattgatcgattgctgtgcacttcgcctgcctcagctaatgtgcgcctcacagttatcctacaacataggtgctgtggttctcatctttcacaccgggaaatggatggagaaaaagtgggatgcttgcccaaagctgcacagctgcagggtggtgaggtttctgactcctaggccagtgctcttaagcgctccactagtactgtgcctccgacttcacacagtgcaggataagctctggaaatttactgcctccaataggtgctgtaattcaatgtagaattacttccaaaaccatttagctagcagtgctatgagaattccttaaaagcagtgggcttgattcctcaaaaatctcaacataggattactgtataacccagcaatccactctaagaggtatatccagaagaatggaaagcagggactcaaacagatgtgtgtacaccaatgttcactgcagcattttacataataaccccgaactggaaacagcctatgtccacagatgataaacaaaacgtactacatacatacaatggggtattggccataaaaatgatgaagttccgatgcgtgctatgacatggatgaatcttgaaggcattatgttaggtgaaataagccagacacaagaggacgaatattgtatgattcagtatatatgaggtacctagaacagtcaaattcatagagacaaaaagtagaatggtggatgccaggagctggaggcaggggccatggggagttggtgtttaatgagcacagagttcttttggggtgatgaaaatgttttggaaataggtagtggtgatattgtacaacactgtgaatacaatcaatgtgactgaattgtacacttaaaatgttgaaagtggcaaatttcatgtgatatatatattttgccatataaaaaacagacgaaatcaaaaagcactggactgtgacagggccatcctaattctggaggttgggctgggcactgagcaggcacattctctcctggcatctcttggcattactggctgaggcaggataggagaactgtggccacgtggactctgcctggcacctcaggtgcaactgtctccttttgctgtcagccccatcctcaagccctaaaaggggcctggtgggcaggcatacccaggttggagagccttttggggccccaagccactcttcttgaagttcattcactcatcagtctcgctagattttctctaagactcaccttttctacattttaaactctaaaaccagagtgtatatttaatatggtaatgttccccacccttcagaaagcatgttaaatcagcggtgcatcaaacaatcttagacttcaggagataaaatagtaacaggtgttgccctttgagggtctgcctgagtcaaatactatactctgtgcctcatctacaaggtcttgattaccccatgattgaaccgggaagtgcgttttatgttatgagccagctccacatgattggcaggaactgtcttgaggaccgcactgaagattccagggctggacctggactcagtgggaggggtgctgtgattgatttgtaatgtctgccatggaagtgggaggggtaaggggctctgcctcaggtggtaggatttgatttattatttccattttacagtcctaggttctaaaaatttaggcagcttccctaggatttgaatttaggtgtgtctgattccaaagctcgctatttattctttactctattgccttaataaatacatcctgggtaaccagagtgactctagtgctgaagaatttactaacacaaggtttctgcccactgtgaccatttgggatcttataaagagaattcaaaggaagcagtgactaactctgggcaagtccaaggggcttcacagaggaggtaccatttatgctgtcattggaaaggaactaggagttggccagttggagaaagtgaggaagggaattctaggaagagggaacagcatgtgcaaaggcatgaacatgaaaaaatgggatgttcaaggatgctgcgttgtccagcataggataaagggtgtttggttggggcaggaatgtggggtgggaggagattaatctggaaagggacattggaattctgttgtgaaggaccatttgtgcctgctagggagtttgcacttcattgtgtaaagaaagggaattgtggggaactgagtttcaggaaactcctggaaagcccatggtgacatacagagggtgagtggggtgggaggaggcaggagtgagccctgctggaggtggtgcctctggacataggccaggttgggacagtgttgtttattgttcctactgacttgaattcacaggggcttgtttccatctgtgttgggtaatttttggttgcatgctcatttttgctgacatgtctttaggaactctgaagagctaagttggagatgctcctctccagagtgcatttgtgcttgtctctgctgggcaccaagggctgctgctaccctgggaccacatagcttttgttgcatacacctgggcatagccgagtgtccactttcactgtccaccttagccttttcagcatctagtctacattttacacctttgcatttccgcccccccttaatgtatctcttgtactcggggttcaactgtgcagatgtgcagttggctaccttttctccttcctcatgagaaccaaataacacctgagtacatcttgtctccagctcaaaatctagaggttttgtttttcaaatgagaggtgaacaaacaacatatgttttaagcaaaccaaaaaaaccaaagctgcaaaaacaaatgttgagcctatacccatctataaattaagactttctttaggagaacagtgatatcaggccagaagccagatctagtttataagaaataaaccaataagtaaagatcaggttagcagtacttgtagaaagtggcatcagttttactgattagatgtgtttattaattgcacctaagcttaatttctctacgaaacagcatctgtgtgaaagaaaccttcagttgttatcaagaaagcttgtggataaactctgccctttatacccagggtttaagatggaaacaggcagcagcctggaagatgtgtgtgtacttatattcatgtgtttgcacatatgcacatgcagtattgatgggatatatgtcatgtacacacatacagtggttgtcgcctctgtgcttaagacctgcaactcttccagaaagaatattgagcacttataaggaattgaagaacggtaaaaggatgacatagacccactacattcactccgggcttcgtgaaagctgtatgcaatttgaagggaggccctcgcacacggctctatgacaagtgacaatcgagggttagccaggagttaccatccagtgttcctggttcctgaaggtgctgatgttactgagaagccctgctcctgatctgactctggccagggcctctcctgtccactcgcagtgtggaggaggggtgtgtggaagaggggaagtcttcctatttaaaacccttgaactctagactaatcaggacttggggctttaggttcttgttctgccatcaacttgcaatgggctttcagacaatttattcttctcttgaggcctattttcttacctacacgaagatgatttctaaggtctcacatggttcacacatgctgtaatgattgtgagcactctttactgtgctggacttcaataccctgcacaatcctctgctgctatttactttgcagttaactcatcttccattcagccagccagccatcagcaaatatctactatgcaccaggtcccaggctagggttccccaatgtctgtcttcattgctatactctggcattttgttgcctctcatttgctgtaggctggaaagctagatgtccaaatgcattaagaatttggcatgaaaggaaatatggaaggattaagtaaattatggcatgcccatatgacagaatagcaagtacttaataatgatgataaagacaacacatttatttatttatttatttatttatttatttatttagagacggagtttcgctcttatcgcccaggctggagtgcagtggtgagatctcggctcactgcaacctccgcctcccgggttcaaccaattctcctgcctcagcctcctgagtagctgggattataggcacctgccactatgcctggctaagttttgtatttttagtagagatggggtttcgccatgttggccaggctggtctcaaactcctgacctcaggtgatccacccgcctcagcctcccaaagtgttgagattacaggcataagccaccgtgcccggccaacactataccttattatttgatgaaaacctagaataaagtagactgtacactctgatgtacaaacatatacacaggaaatggaagggaatacactaaaatcaaatcagttgcatttatgggatgataggtggttcttttctttttgaatttcctttgcactaagatgttgtgcttttctcatgcttttagacaggcattcattcattcaccagacattgactggtgcctgctagtgcctgacacagctggggatttagtggtttctgccctcaaatgcagcaggagacagtgatgcgcacagatagatcgcctaggagtgggatggatgattctgtgacttgtaagacagccagggggcgctatttcagtccaggttacgcaaataggagctgggtagggccttggcatgaacagatcaaatagctactgtttcaactatttccatattatgccagagatcaacaacacagggttatttttactttggctggggtataaacctgaatccacagtccttttggattggcgtggcctggctgcggtgtctgcctccccaacccctgaccaccaaatacatctcagtcgggccttggctctgcactccccactgagttcacaggagttttcgtcaggagaaatagtccccagatgaatgcaaactacaagtactaccgaagagagggcaaggcagtcctcagccccgaaaatccagcctttggataaatgaaagcttgtaatgttgaattcaggtgtggctcagagtctattcagtatagaaacaaggaaaagcaagtgtgggccaatccagaatttatatttttgaatagctttagacgtgactttgtacccatattttttgttgttgtcgttttttgtttttttgtttttgttttttgagacggctggtgtggcatgagccacaagttgcccaggctggagttcagtggtccgatctcagctcactgcaacctctgcctcctgggttcaagcgatgctcctgcctcagcctcctgagtggagtagctgggattacaggcgcctgtcaccatgcccaactaatttttgtatttttaatagagacaaggtttcaccatgttggccaggctggtcttgaactcctgacctcaggtgatctgcctgcctcagcctcccaaagtgctgggactacaggcgtgagccatcgctcctggcctgcacccatattttttttatgatggagagaggggaaggagcacttacatctcaggtgtcactttgctgacatttatggagggaccgtaagccacgccgtgggccctctctttcacagggcctcagatttcatctttttggcatttttctctaaatgagctacaggactgaaataaagcattcccaatcatctttcaacttgtggctcattgccaggccacactccttatcatgtgctataaaaaatacttagaaatacattgtgtatttatctttcgaataacatacttatgtgacatcacactttttgttagtataaaaatactaatctggtgagtgtaaacattttaaatataccaccatttaaaaattcctgttatcttaaaaagtctttgtttttctaaacacactggaacttcagaaaaaaatcacccatcccgttagccaggatggatgctgtcagcaaataaggaaagaaaaaaatgaaacacatgccgaggtcgaacctgctctcttttctgagctgtgttgttccctcagcacctcttttaggtcatgcgtgcttgtctgtcttctccctctaggttgcaggctctttattgaaacatgaagtgacccccagatatattaagggagccactcaaggtcgcccaggcacggggcagctgcatgggggccggagtccaggtcttgttcagcctgctttataagattgtgaatcatcagctgagctattttggggaattcctgttcagagccactgctgctttaatcaggttgtacaggtctcaagggtaactgcttcctctgtcctgcccagaaacaggtggaaaatggcaaggcatccattggttatttagtaaatgtgcccattctcattcacgttatttagccttatattttcaaaataatgttgatatcaatgaactttaggcataaggcattcatatttgctgagtcagagaactctggcccacttttccttccctcgctccctccctccctcctttccttccttcctctctctctcttttcttttttctttttccactgagtttcagtcttgtcgcccaggctggagtgccatagcatgatctcagctcactgcaacctccccctcccgggttaagtgattgtcctgcctcagccttccgagtagctggggctacaggcatgtgccaccacacccggctaatttttgtacttttagtagagatggggtttcaccattttggccaggctggtctcgaactcctgacctgaggtgatctgcctgcctcggcctcccacagtgctgcgattacaggaatgagctacctcacccggccggaattctggctctttcttaccctaaaatccatgtcttgtccatctctaagtctctcatgtggtttagtggagagattctgagcttgcccatcagattggtaagaaacaaaggggttggcagtatgttggtgcaggcgtgagagcaggcccagccttgtactgatggccagtgtaagtggatacaacctttgcagttgggggcgggctattagcatattacacgtgcttcctctgacccccaaatcctacttctaggcatctgttctagagaaattctcacaccacacaaaaaggagccaggtgcagtggctcaaacctgtaacctcagcacttttggaggctgaggtggacggatcacttgaggccaggagtttgagaccagactggccaacttggcgacacctccatctctactaaaaatacaaaaaaaaaaaaaaaaaaattaggtgggcgtggtagtgtacgctgtaatcccagctactcaggaggctaaggtacaagaatcactggaacctgggaagcagaggttgcggtgagctgagatcgtaccactgcactgcagcctgggccacagagtgagaccctgtctcataaaaaaaaaaaaagaggcacgtatgagtattcactgccattggaaagaaccagaatgtccagcaacagggacgctgtccactgtgccatgggatatccactctgggatattgcggaacagttggacacaatgagatagatgcttatatgctgaccaggaagattcccaagacgtgctgtttagtgacaaggagcaagctgctcagtagtgatgtgatttgtaaggaggaaccacgtgtgtacgtgtgggaaaggcctggaaggctacacgcctgagcatggtgaccctgtgactgtgtgcccctttgtggagggcagtgacagtggggtgtagacttttgtttttcgtaatgtgaatgtatcacaatttatataaccactccccattgatgaacatggggtttccagtctttccattacaaataggcccattgcacagatgtctttatgtgtgcctacaggtaaacgcccagaaacaatggctggatcagaaggcaattgcataagtcatatgataagtgtcacacaattcccctccacaggcgctctactattttgcacccccatcagtaacacaggaatgtgccttcaaaaaaattgaggtgaaattcacataataccaaattaagcattttttaaaaagtgtgcaactcggtggcatttaatcattcacagtgttgtgcagggcagacacttgctttgtctgcaatgcttgaaagtggctgacaatgagaatgcattcatgtgttctgtttaattaaaaatgcaaagaaaaataaaagagcatgggcttcggaggcagacagcggcacatctggatccaggggctgcccttagctagttgtgtgaccccagggaaattacttattccatgggaggctcggtgcccacatctttgagatggagaggagaaaacttgcacagtggggctgatgagatgattcggtgcccaaacacaggaaaagcagctgtctcattgcagcagtcgatgtgggttgctttctccccatgcacactggaggcagtgcattcgtaggctctggccccaacagcatggccccaacagcttcccgtttctctgtgtgatcttaggcaaattcctcagcctttttgagcctcggtttctgcacatgtaaaatgagaatagtagcgtgtggtgatgactaagtgagacaatgcatatgcagtgcttaaaacagcactggcagccaggcacggtggctcacgcctgtaatcccagcactttgggaggctgaggtgagtggataacctgagtttaggagttcaagaccagcctggtcaatatggtgaaaccccgtctctactaaaaatacaaaaattagctgtgcatggcggtgtgtgtctgtaatcccagatacttgggagtatgagacaggagaattgcttaaacctgggaggcagaggttgcagtgagctgatattacgccactgcactccagcctgggcgacagagcgacactccatctcaaaaaaagaaaaaaaaaaaaaagcagcactgactatacagtaaatgctcatgaaatggaggctaagatttttgccagcccctggtgcagtgcctgggactctaggttcccagtgggcgagggaccccatgaagctgtaatgcctgcttctctctgctttctgctcagggccattggtgccaaccccctatactgtgactgccacctccgctggctgtccagctgggtgaagactggctacaaggaaccgggcattgctcgttgtgctgggccccaggacatggagggcaagctgctcctcaccacgcctgccaagaagtttgaatgccaaggtgagcctaggagcacagcctcctgctgctgggggctcacagaacttgcccaacactgcagggccttcctaacatgcctgcgtccctgtggtgaccgctgggcggggggtcaggggacaggaacaaggcacctgcggcttgatggctgccttccaatcctgacatatcatggacaaaaagagccaggcagaaaaatcccaggccgtcagggccgtaatccctccctgtggttacataaggaaaataaaaatagcagcagtgtttctggaagctccaagcctcgcagcagagcatgcgctcagacctccctttggtaggaattgtgttcagcagttaacttagacctctctcagtccctggtggagcaagggtcccagcagccactctcccgacatttacagaaatacagagctggagtgtcactggaggctggttccggctttgccccgggaccctccactgtgggcatttgtaaatactcattcagggattgagtgactgacagctcaagccccagaagccctgctgagcacagacaggtggctgagtggccgccggggccgggctttatgtgcaggggtacagcggggggaggacactggaggccgtggagcacggctcctgccctctgcaagctcagaggccactgttggaaatgaagctgacagctgtaggttaatgaggaggccctgggccaccctgcatgcaggatgctgtcacagccgtaacggctccggggggcctgatctgcggcttggctgttgggagcaagtcaatttatgctgaaacctttgctctgtgtttatttaatggggtgggattggtgctggtgagaaggggttttgttttgttttattatttttatcgaaagagaacacacacattaaagtacacagatcatgagtgaatgggttgctgaagtttcacaaactgaactcacccaggtaacctgcacctggatcaagaaacagaaccccagctgggcgtggtggctcacacctgtaatcctagcactctaggaggttgaggtgggagggtcgcttgagcccaggagttcgagaccagcctgggcaacatggagagaccctgttgctacaaaaaaattttaaaaattagctgggcatggtggtgtgtgcctgtagtcccagctactgggtggagatggaaagattgcttgagcccaggaagttgaagctgcagtgagccatgtgtgcgccagtgcattgcagcctgggtgacagagtaagaccctgtctaaaaaaaaaaataaaggaaaataaaggaaaaaagaaaggaaacagaaccccatctctaccccagaagtccgtcatgtgtgctagtcgttgctgaaaagtgtttttatttctattcatgctcatgcctcttcagcaggagtaatattccaccccttctagaaggcatcttctggggaagcctgagttcactggtcttcctatttagtctcctgagatcctgctgccccttacgggtggtgtcccaggcggcctggctgtcggctcctctggttacttctacaaccagtgcatcctggagatgctggaggggcctgctgtagcagggaggtgggggaaaatggtcctccctggctcaggcatggagggtaacaacccctgctccctggtgtggccaacctgcagagccgagcttgggcacgatgctcacaaagtcaccgtctcctctctgccgaggtgaccaccttctgtcctcctagtcagcaggtgtcaggatggggtcattgcctcagaagggcatgaggggaaagaggaagggttggccaacttcggtggtagcaactgtccccttcttacatggatcatgcggccctaatggccactgtgcacagtgcccgcccgcctgcctgccaagcatgctttgcacactggaattcactgctttagcccttccagcccagagggaggggctgtcattaaccccattttacagaaaagggtctggaggctggaaaggtgggcagtgcaaggggagtgtgagcacgatctggggaaaaatcaggaggggaaacggctccttggacatgggctcctcggggttgaggtgctctgtgcccagccctgtgctgcccacccctccccctgcactagcaccctccccttgctgcaggtcctccaacgctggctgtccaggccaagtgtgatctctgcttgtccagtccgtgccagaaccagggcacctgccacaacgacccccttgaggtgtacaggtgcgcctgccccagcggctataaggtgagtggaggcagaggccggggaggaggagggctcttcgtgtacactgcagggctgtccccagggcccagagcactgcctgactcagagcagatgcttgagtgaacctgtaattaatgacttaacatatgaatgaatgaatgaatgaatgaatgaatgaatgaagtggacgaatgaatgaatgaaaacaagtaactcctgggacagggagaggctgagctgctgagggtctggctggctgttggctcatactaactcctgggtctccctggggtccccatcactgactttccccccagggtcgagactgtgaggtgtccctggacagctgttccagtggcccctgtgaaaatgggggcacctgccatgcacaggagggcgaggatgccccgttcacgtgagttacctggaggggcaggagcctggtgagtgctgatgggcccagcacctgtgcctcagggccctcctctccatcagggatggcccaggcctcctgtgccctgtggggaggtggaggcgcactgtcgggggcaggcatgtactccaaatcatagccagagggctctccaagcccaccaggccaagcccttccttgcgcagatgcagtgggagcacagagagaccagtggatacctaagccgcacagctccccagctccagggttgagcagggcttggagtgggctctgctgcctcctgctccaggccttcttcctgctcctgccaggtgccatgggggcctttttgaaggcactcggattccatggccaaagcatatacagtgcagtgccaaggaccacagcaggggtgtttgaaattcctataaatttccattcaggccgtgctcggtggctcactcctgtaatcccaacactttgggaggccgaggtgggcagatcacgaggtcaggagtttgagaccagcctggccaacatagtgaaaccccatctctaataaaaatacaaaaattagctgggtgtggtggcacgcgcctgtaatcccagctactccggaggctgaggcaggagaatcgcttgaaactggaaggcggaggttgcagtgagccaagatcattccactgcactccagcctgagcaacaagagcgaaactctgtctcaaaaaaaaaaaaaaaaagaaaagaaaatttccattcaccccaaagcctccaatctccctcgaagagcctgctcctgacagtgctgcctgcagacagggccctggccagcctcctcaagctgccccctgagcccctgagacacagctggggctgccactgggtgggtgaggcctgcccagaggtgggagccaaggcctgtttgctttctctggggtccccccatctcatgagtcacactgggcactgtgggaggggatagccctccggccctgccctgagcagcccattttctgctattcagtgaaggggccagccctaatgaccccatctcttaagtccttccagagctgacatcacaacgcaagcgccctcccactggctgctccccacaggaccgcccaatgagccccaccctcccagagcttttctgaggaatacatagtatttagttgctgaaaataaattgctggcgcaatacattggctcttccgaaaatgatgttgaatctgggggcagaaatggctgagcctgcctctgcatacccaaattaccagatgtaaaaatgaatcactaaatggcctctcttcccctggttgccttggaaacggcgtccttacactctgcacccagcctcctcggggcttcggtgagcaactccctgggcgcgccctcctcattcctgagacgccccagctgggggctgaaaggacacccccttcaccctgagatggggagatggggcagccccctcacctcactgccttacagaatgcgggctgcgggagtgggctctccaggtggaaagggggtgcctccacgagttacccctcaaccccaaggctctctggggcacctgttatcccctgacctgtgtctactcccgctaccctgccccagctcgtaccacaggccactttctgaaatgtgaaactgaccctgtcaccccagcttaaaaccctgctgctggtcccctccagccttcagggaaaacagttaaccacagaccatttcctgcaatggtgatttgaattctttttactcacagactccccagatacattctaaaaactatacactccctcacacatccttagattgacagctaaaattttcattttaagtttttcattgcaaaggaggtaatttttccagatattataaatattattaacatttaagaataaaactatcactttatttgggaggctaaggtggaagggccttaagacaagtagttggagactagcctgggcaacatggcaaaatccccatggcaaaacccatctctacagacaattaaaaattaaccaggtgtaatggtgaatgcctatagtcccagcttctcaggaggctgaggagggaggatcacttgagctcaggaagttgaggctgcagtaagctgtgatcataccactgcactccagtctgggcaacacagtgaaactgtctctaaaataaaaaaataaattaagctttaaaaatatgacattaaatcactcttttatcattctccaatgcaatctaaacagcacatcattttgacacttttttttttttgagacagagtctcgctctgtcacccaggctggagtgcagtggcgagatctcgactcactgcaacctctgcctcctgggttcaagcaattctcctgcctcagcctcccgagtagctgggactacaggcatgcaccaccacacccggctaatttttgtatttttagtagagacggggtttcaccatgttggccaggctggtctcaaactcctgacctcaagggatccacccaccttggcctcccaaagtgctgggattacaggcatgtgccaccccacgtggccaattggataccattttaaaatgacacgaacaagttcttctttaacagttaaacattttaccttgttcttttttctcctctaactagtatttccattttactccttaccctcctgtcttttttttctaaccaaatatatttttatgctagactcttttcttgagtactctgccatgcgtctctgtccccaacatgggtacacgtaagttaaaacttaaagtttttttcttatttctcatcaccataagcctctgatttaaagtttcttttgcagcgagttatccctacaataattcgaaacaacataactgtattatagaattggattgaaaattattacacatagaaggaaaattttattggactgtatctctcttaatgagatggatgggtgcttttttgttcttttcttctctcagttggtttatgggtgaatgttgcagaatgagagaggacacagcgtttgatcttttcctgttttgtttttatagatataaatgctgggaagtttgttcatgtaaataaactggtgagattaggagttttattatagccatgtcacttaattctttgaaagccctcccagtttttatgccaaatctccacagtgacctgtcatcaagattatttttaatgttctatcagctgacagttctatgaggccttccttcaattacttccagtgcacagaactggaaacctcttgacttagattgcatttattcattcactttctaaacatcaggattcctaactgcccatttatttggcacctggaagcatgcccacctttctacctggagggcttgtcccatcaccccccagtctgtaagggctggggctgggacagatgccacctttttagagttctgagctgggtcaatttagggaagagctcgtgcagatatttgaagatctggaaattaatttcttggacctctctctgatccacacaccccttggaaaaccttgggtgccccaggggaaggtgtatcttggtttgaaagtcactgatccccagggcccctcatgaccaggctcctgctcaccgcagccctttgctcactgtgctcctgaagtattggactgtgtggatgggcagggcccctatagaagactagctgtggggttcccttccactctaggctttttttttttttttgagacagagtcttgctgtgtcacccaggctggagtgcagtggcatgatcttggctaactataacctccacctcacaggttcaagcgattctcctgcctcagcctcccgagtagttgggattacaggcacatgccaccatgcccagctaatttttgtattttaatagagacagcgtttccccatgttggccaggctggtctccaactcctgacctcaggtgatccacctgccttggcctcccaaagtgctgggattacaggcatgagccaccgcacctggccactccaggcttttacacacacctctgccccagtcaccttcctcccattcccgctctcccttgtcaaggtccttggttaattcatcacctcctccaggaagcctgcccttatcactttgtgccaaggaggagccaggtgtctcctgcccctctgtgcccgctccctggcttcagtgcttacaccatcctggtcctcactacctctcccctcgccatccatctccttttagcctccccactagactgtgagtgaatcccatgagggcatggtcagtcttggtcacctctaaccctacccagcacctggcaagggcctggccgggattagggaccctaactccgtggaatggtgatattaaccggcagccacaggcttccaccagtgttccaagagggctgtctctccatcctccccttccccgcacaggtgctcctgtcccaccggctttgaaggaccaacctgtggggtgaacacagatgactgtgtggatcatgcctgtgccaatgggggcgtctgtgtggatggtgtgggcaactacacctgccagtgccccctgcagtatgagggtaagtgcgtcagggcagcagtgtctgggggaggtggggaacagagacagccctgagcccccatgctcgggagtggaaggggatccctgcctcagtgtctgcaggaggatttctgtgggtctggctgcccggcagagcacaggagagcagcttctctcctgccccttgctcgttctttccccaggaaaggcctgtgagcagctggtggacttgtgctctccggatctgaacccatgtcaacacgaggcccagtgtgtgggcaccccggatgggcccaggtgagtgttgcccctttccagggccagggaggagctcaggcccctgagtcagactggattccagtctgggctccgtgccccaccctcattccctcatttgtccaatgggtttggtctcagctctacagggttcctgagaatccatgcggggttgtgggtggaggggtgatgtgcacagctttgtggccacagagacctgggtttgcagcatgaccctgaatgtgtcacttgcctgctctgagcttgttttctcatctgtaaactgggcacaacagtagcttcctcctggggtgattgcaagggtaagatgagaaaatgcatggaaagcacttagctcccggtctggcatctgttaagtgctccaggctattattccagatctaccatttcttatccccagttacaaaatccacaaaactcgggaaagcatcccatctcatggccagatctgatctgaggtggacgtatttggtaataaaagctgccccgcactggtgtgagattgctttttgttgttattcatcccacgtaatgtgaatatgtatagattttgtggcagaaatgtgaataagtctgattacggggctgcctcagctcctaccagcaggttgtataatatgcattgtctgaccttacgaaaatctaaaaagtgttgaattccaaaacctatctggtcccaggaggtttgggtaaaagttgttggtctgtattttcatcatggttgttattggcatatgtgaaaatgtttgttacttgaagactgctttatgaaggttacgcagttttaaaataatgcttccaactgcagttgtgcaaacgtagtctcatttctgggacctccccattccaccagtcaggccagcaaggggtggtcagggcagagcttcctggggcttgtggctgagggacccaagcctagggactcagatggagtcccccaggagccccctgtctagctggagcagcctgaggcccatgacaggaagcaagagcccaggattgttgaggcctggttccacggtaaatgggcccacaagagcctccatccaaatggtagacggacgctgtactcctgtgggggctcccaggggtggggcttggcaggcagaccaatcagcagtggcagattgggcagcatgcgccctccttggagggtggaataaggcaggactgcacgttgtccagcctggagctgctagcacagcccctcaatcacgaagggcaagcattgtgcttagctccggacccggggttgtggcacacagtggagcgttgagtgcgtgttctctcaactgcctgtcctggtggaaagatggaactgacatgttcagctgtgcctggcattacctggaacccaagatatatatccagtatatagtcattaaatggatgaataagtggtggcttagctactgtaacatttttcagactgtaactccagactcattagtagactgtgatcaattggatataaagggagccccagcccctgtttaatattaatgtcaagattaacattaaaagatgaaacaaagtatcagacagcaacatgccatcttatataataaggataatcagtattgttgtatgaatctggtttcgaatgtgtgcgtgtgtgtgtgtgtgtgtgtgtgtgtgtgtgtgtgtgtgtgtgtgtgtgtgtgtactgggcttgaaagtatttcttatagcccgaaaaacactggacaaggaaatgagtaaaaatcccaggcaagagcacccatctgccaggttgcatggttgagcttcagagttaggagtttagaaggcgatcagacaaggggactgctcagtgagggctggagtgctctccagaggcttcctggaggaggtgaggtattgggctggctggaccatgcaggcagacaggagacggtattctggaatccacaggtgtgaaggcagggaagtgcttggtgaggtgggcttggtgtcaggggagcaggaggtctgtaggacagacagcaaggccattactagaaagggctacaggagtgcatcctttatttatttgataggcagacaggagcccaaagggagtgttttgggccagcagtgaggcatggtggcagctgggaagctgggggcttacctgaggtcaaggcacccactgagcagggggcactagccctgctgaggactgggaggctggagaaagaggagtgggggagcctgtggaactcagtcacatggtagtgggtcctgggagaacagggagggtgcagctgagctgctggggaggtggggaaggggctgacagttggccttggatgtgctgttgctggtgaaggtgggtcctccatgacaagactccatctgcccctgctactggggtccactcttccagccccaggcccctacctcaagtccacatgagctctcttctactaggaaagggtcccaggatgggctaggggcccttttagatccagagctctgtgtgacctcctggagatccccacagcctcaatggaacttgaggttctccctcacatgtacagactgtgtgggggatccctggtgcgctcccctggcctcccagactctgtgtggctgaccccccaactacccctgccccccacccactaggtgtgagtgcatgccaggttatgcaggtgacaactgcagtgagaaccaggatgactgcagggaccaccgctgccagaatggggcccagtgtatggatgaagtcaacagctactcctgcctctgtgctgagggctacaggtgagcagcccctggacacactaggagtgactccttgtggctgtcagcccctgggctggcaggagcctccagccatggcgaaggaaaggggtgtgggtcagagcctggaagttggatgctggggttttaaccgtggctctgccagtcaccagctgtgcagccttgggaaagtcatgtaactgcccagggcctaggcagaggacccctaacctgtttggtggagggcatgagaggtgggtgcagatgacagggcagtgtgctgtcacttacctgcctacctgagcctctgaagacatgtcttgccccaaagattatctaccagcccactgggctcccctgggaggttggagggcccaccctccctctggccacccacgtcccatgctctgctcactcatttgttaaaaaatagctttattgagatataattcatgtaccatacagtttacacagttacatgtaaaattccatgacttttagtttattcccagagttgtgtatccatcaccacaaccaattttgaacatgttgatttccccttaaaaaaccccataccctttatctgtcacaccagcccctcttctatcccagctccaggcaactactaatctcctaatatttgtgtctataaatttgcctgttctggggatttcctataagtcgaatcgtacagtctgttgtcctttgtgactggctgctttcactcagcatcatgttttgaggttcatccgtgtggtaacatgtgtcggcacttcattccttcttatggctaaacagtgttctgccgtatggacataccacattttgtttacccactcatcagttgataggcatttaggttgttgccactttttggctataatgaagactgatcttatcgacatttttgtacaggtttttgtgtagacatacatttttcagtctcttgggtatatgcgtaggagtggattttctgagtcgtatgttaactgtatgtttaactgtttgaggaactaccaaactgttttttcctaatggctgcacaattcccaccactattgtatgagggtgtgaagtggtagctcactgtggttttgatttgcatttcctcagtggccaataatgttgagcatcttttcatgtgcttattagccatttaaaaatatcttctttggaaaaaatttttattcaagttctttgctcattttcaaattaaggtatttgtctttttgttgttgagttgtaaaggctttttatatattctagacaagtcccttatcagatatatgttggcaagtattttctcccattttgttggttatcttttcttgataatgcacaaaaatgtttaatttgggtatatctagtttaataatttgggcatatctagtttattttttattttgttgcttgtgctgtgggtatcctaagaaaccattgcctaatccaaggttatgaagatttatacctatgttgtcttctaagacttttatagttttagctcttatatttaggtcattgatccattttgagttaatttttatatatgggtagagggcccaacttcattcttttgcatgcagatatacagttgtactagcactatttgtcaaaaagataattctttccaattgaatggtcatggcactcttgtcaaaatcagctaactttaaatgtaaggatatttctggacttcaagttctattccattaatctgtatgactatctggatgctagtgccacactttcttggttactgtagtttttgtaatatattttgaaattgggaagtgtgagtcctcccagtttgtttttctttttaaagattgttttggctggctgggcgcggtggctcacacctgtaatcccagcactttgggaggccgaggcaggcggatcacaaggtcaggagatcgagaccatcctggctaacacagtgaaaccccacctctattaaaatacaaaaattaaccaggcatggcagcagtcacctgtagtcccagctgctggggaggctgaggcaggagaatggcatgaacccgggaggcagagcttgcagtgagccgagatcgtgccactgcactccagcctgggtgacagagtgagacgccatctcaaaaaataataataataaataaataaataaataataaaaaataaaaaaagattgttttggctgttctgggccccttgaatttctgtatgaattttaggatcagcatgttgagttctgcaaagaagtcaactgggattttgataaagattctgttgaatctgtagatcaatttaggtagtattcccttttttttttttttttgagacagagttttgctcttgtttcccaagctggagtgcaatgtcacaatcttggctcactgcaacctccacctcccgggttcaagcaattctcctgcctcagcctccagagtagctgggattataggcatgtgccaccacgcctggctaattttttgtatttttagtagaaactggttttcaccatgttagccaggctggtcttgaactcctgacctcaggtgatccacccacctcggcctcccaaagtgctgggattacaggtgtgagccaccatgcctggcccagtattgccattttaacaatattaagcatactgatccatgaacatgaatgcctttccatttatttagatcttctttaatttctttcaacattttgtagttttcaaagtataagttttgcacttaaaaaatttattcttacgtattttattctgtttgatgctattgtaaaggaattgttttcttaatttcattttttgtttgatttttgtgcattaatctggtattctacaatcttgctgaattatttcattaattctaatagcattttactggaatctgtaggattttcttatataagatcatgtcttctggatgcattttatttatctttcctttcctccttcccttgcttgccttccttcctgcctgcctgcctgctttccttcttgccttcctgccttccccctctccctccctccctccctccttccttcattccttttctttcctttccctttttcctaactgccatggctagaacttccagtaaaatattgaatagaaattgtgagagcaaatatccttgtgttgttcctaatcttaggaggaaaaaattcagtctctcattattaagtatgatgtcagttgtgtgttttttgtaggtgccctttatcaggttgatgtagttcacttctattcctagtttgtggagtgtttctgtcatgaaggaatgttgaagtttgtcaaatgctttttctgcatctattgagatgaactttttttttttgctttttcatctatcaatatcatgtattccattaattgaatttcagaggtcaaaccagccttgcattcctggcgtaaatctcacttggtcattgtatataatcctttttatgctgtacttgattagctagtaatttgttgaggattttggtgacaatatttataatagatattggtctgtagttttttgtgatatcttttgttgtgatgtctttggttttggtattggggtaatgctggtctcatagaatgagttagaaagtgttccctcattttttattttttggacaagtttgtgaagaattggtatttattgtttttaaatgtttggtagaattcaccagttaaaccatctgggcctgggaagttttctgattactaattcctttactagttataggtctattcatattttctatttttttcttggttcagttttggtagtttgcatatttctaggaatttgtgcatttcatctgttttctagtttgttggtatattgttgttcatagtattcctttataattcactgtatttctatgaggttggtagtaatgtcccttcttttatttcttattttagtaacttgactcttccctctttatgcttgtgtcttaagtctcagttttcttttctataaaatgggtatagtaaaatctgccttgcagagttattgacattgtcagtaatcaccttggatcttgttaaaaagcagattcagtgggtttgccatttctatcaagtgtccaggtaatgttgacgctgctggaccagggaccatacttgtatcctggtatccttctggctctcagctctctcatgaaaagtgtttattaggagcatcttctgtcgctttaagaatccattttcccaagatgtttagtgaatttctctccagggctgtgggagaggaagatactcccttcctccttggccctctctgacttatgtcctttcctctcagtggacagctctgtgagatccctccccatctgcctgcccccaagagcccctgtgaggggactgagtgccagaatggggccaactgtgtggaccagggcaacaggcctgtgtgccagtgcctcccaggcttcggtggccctgagtgtgagaagttgctcagtgtcaactttgtggatcgggacacttacctgcagttcactgacctgcaaaactggccacgggccaacatcacgttgcaggtgcgtgccagggggcttggtcacagaggggagtcagggagcaggcgaccctggcttaggccagagcatcaggatacatccctgcatggtgcctggggaactggaaggactctgtgtaatcaaaacgttttgcatatgggtatcaaaatctcagcttgaactagtttaagcacaattagaaaggttatagtgtcacaaaaccagggcaggggtggacatggtctcatgggtaactgaatccagaaaaccaggcttgccatcatcccttcccaccatttcttgtcccagctactcctcagtgtctgcctccagtgctgcagacaggctttctatgtgtgcctggaatgtggccagatttaactttgggcttatacctttaaccaaatgtccctagggtcccttaactcatccttttcatgccttcagttccatctcagaacatcttcatgttgaggggaaaataaagcaattcccacttcagcagcattgatgaaatatatcaatattttgctaaacacttcttttgggggatggagaggagagtggtttatattgcacagcacatgataaagaatgttaaactcctctgtagtcatctttctctttcccccgaattccattccctgtcacaaatgccacatctttcttccctctcttttgtcctcttttccttttttctcagaactcttcagcctctcaaacatgcgcattctgctctcttcccctacgtcacctctccaacatcctatccacttacatagtctacatggcaagacaacagctagcctaaccgccaaaaataaaattcaccaaaaccctaaccagccattgcctcgggcacatccttggtttatcctcatcttttaccagacattgatttacaaaggctcttccttgccagctctaattcggtcagctcaaggaagatctctgattggcctggcgttagtcacatgcccatctctgaaccagctgctgagtccaaggagatggggcagtgtgactggacagcttgggtcatatgcccagctccacagaccagggggctcagggtctttaccagaagaaacggagggagcaggacaaggcagggaaaaatgatcatggctcctacagcatcttagagggatctccctcctgaggcaaagatctcacttttgcttgcacagttccagcgacagacactaccttctgagtggctccttccactaggcttggatgactctggctgtcagagagccttcctgaacttgtcctctctgtagttcccaccctgagcagttagctccccaaggcccacagggcaaggctacccacacccagcagacaggggtcccagtctaattttcctctctgggaagattgtcctgaggtctcctggctgctcttcctggcacagagtttccaggcctcagggacccatcaccctcccctgcctggacctggccaggctggcagtggatggggcttgaaccagaggctgcagcccctattggtgccccctggaggaatggccttggggaggctggccaggtgggggaagagcgctctgcacagagcatctctcttccaatcttgggtgccctctctgccccatctgctagcctgtgccgctgctgcatggggtggggtgggagagaaagtgccactgcccatcaggtctccacggcagaggacaatgggatccttctgtacaacggggacaacgaccacattgcagttgagctgtaccagggccatgtgcgtgtcagctacgacccaggcagctaccccagctctgccatctacaggtagggcttccttatgccccccagctgccctcaggggtacgggactgccagggcgaggtctcctgggccaaaagcaggtggttatcgagacctctagaaacctgggctgcctgagtttgaaggacacttgaaccatctgggttagccccagcttggggctgaggtctctgaggcctgtgcagtggccccatccttccccatcccaccaccaccttagaggaggctccttaatggggagggggagacttgtaagtttgagacccctgcctcaaacctctcagccttccccagggagtcaaagaaggggagtgaaagggatcatgcgatagacccttgagcccccacagtccttttccttagatatttggtctcctgggaagcagctactggtgtttctggggaagtgcccaggcagggatggtccagactgatgcccactccctggaacggggaaccccctcttcctccagtgctgagacgatcaacgatgggcaattccacaccgttgagctggttgcctttgaccagatggtgaatctctccattgatggcgggagccccatgaccatggacaactttggcaaacattacacgctcaacagcgaggcgccactctatgtgggaggtgaggacctggccctggcggggcctcttttgctgtctggcctgaggccagccaggagagctggtgcctagggactgcactgtgggaaatgccaagtgggaagatgatcctggtggtggccaagctgcaggtggactggcctcgctgcctggagcccagctgctctctgcctagcccagactgaccaaggaggatggatgcttgggttgggtgcaaggtctggcttaggggaggccctgggactgtccgagctatctgcaacaccttgggcacatttcctcttggttttgggctagaaggggcttttcaatggcttcaggtccattcccagtcttggggccctctgagacccagaaccactgcaagagactcaggcacagagtccctgtatcaaccagggactgcctcggctggccttagaggctttgcaggctagatgaccccgtctaccacctgcaagcatttctcggtattgatgagcaggctgctggatgcagtggggccatctccaccctgtgggaggcgtgctgaggctggggcagaggtgagggatggccctgggcctcagcccagctccgcagcttactccttgtgcagcttcaggccagtcatgagcatctgtcaaatggggcttagcaagccctacttcagagggctgctgagaagggacagccacaaaagcagtgacctagcgccacacgtgatgtctcggtcctgcccctttgctacggctggggtctctgggaggtaaaagctagcgtcccagggagagaaggcgccttggcgagggaagccagactttaggaacaggcacctcagagccacacgcagcagctggccaccaccaggcctgatgccccagctccaatcacagaggaagcagcttttccctttcttctgggcaaggagcctgggccctccaaggtggcaaaggaccttggatcagggttgcagagatgaaggacagaggccgcaggcaagagggaaggccatggagctgcccagacctcaggggtgggtgcccggcatagcccgagctttactcagcccagctctgctccctcccctaccccagggatgcccgtggatgtcaactcagctgccttccgcctgtggcagatcctcaacggcaccggcttccacggttgcatccgaaacctgtacatcaacaacgagctgcaggacttcaccaagacgcagatgaagccaggcgtggtgccaggctgcgaaccctgccgcaagctctactgcctgcatggcatctgccagcccaatgccaccccagggcccatgtgccactgcgaggctggctgggtgggcctgcactgtgaccagcccgctgacggcccctgccatggccacaagtgagcctggggcactgggggagcccttgcccctgcctacctgttccttccccatgggaagggctgcctcacagttttccaacccatattagaacatgtagcctaagccagggttttattacttttatctggctttcactttttattaataggacaaggcctatagggacacacacatagtcgcatgcaactccctttgtttcagttttgggaacagattaaagacctgtgaagtcagggctgggtggggtgggctgtgtcaggtggggcgggctgtgtcaggtggggcttggctgggtttgtcctcacagcgccttttctctgtctcctccaggtgtgtccatgggcaatgcgtgcccctcgacgctctttcctacagctgccagtgccaggatgggtactcgggggcactgtgcaaccaggccggggccctggcagagccctgcagaggcctgcagtgcctgcatggccactgccaggcctcaggcaccaagggggcacactgtgtgtgtgaccccggcttttcgggcgagctgtgtgagcaaggtcaggggcccccctcctgacgtgccctccccagggtcccccacaaattgctttagcaatttgactcttcctcccagtctcggcagcccttctgtcccttcccagccctgtaccatgggctactatggggctttcagagtccctccaccctctgggcactgctcccaatctctcctggcccagtttgccctgcagctcccttattcagggtatgcgcctcttctggctggggtctctccttgcagaagagaccacccagggtaacagctcctggcccaacctctgcctcttggccccatcacctcatgacctgggagcggcagcaggaagtccgagggttggggactccttcccaggccctccctggcctgcttgaccaagatggcttctgctggaatccggactgctaaggctgggcagggagaagctggagaaacccagaactcaggcaccttaagggtcccctaggctatcccctccccagcatgaatccttttcataatgttattgcccccggggcctccagcctctcttgcacgcctctagcaatggggaccccccctccctccagcagttcagtctgtcctggagggccctgacgctaggaccagactgtaggccctgggaggaagcttgtgcatgtcagtgggaggcggaagtatgctggggacagaggtggggtctgagagccaaaggatccaccccacagatgctgccctcctcctcctcttcctcctgcctccctggaggcagcagctcacccatgggtgtgccctgaggctttctcttggtgtctgtcccatccagagtccgagtgccggggggaccctgtccgggactttcaccaggtccagaggggctatgccatctgccagaccacgcgccccctgtcatgggtggagtgccggggctcgtgcccaggccagggctgctgccagggccttcggctgaagcggaggaagttcacctttgagtgcagcgatgggacctcttttgccgaggaggtggaaaagcccaccaagtgtggctgtgccctctgcgcatagcgctgggcgtggacaggccggtgagggcgggcaaggggccccagccgctgcagcagcggagacagtcgccagcagctgggctggggtgcaggtcatcacaggacggctcctgggcagctgggccctcctgggtggggtggtgccagagcagccttttaaaagcaaattgcgccatagctgggggcagcgggggtgggcgaggcctgagctgcgggctgccctctccggaagtgccttgcacaaataggcgcttaataaatatttgttgagtgaatgtgtgcgtgaggtcaggccaagaagtgcagaacgatgacacccctccttacctgctatctgaatctggagaagaaaaatgacagccttccaaaccaacccttccctttggcctgtggcccaggctggcttggaactgggtctgtggccccagaagcctcttacccctctgcgggcaaccatgaagtactgtcagcctccccgggaagccagcctggttcattctgctgctacagaatctgctggtggtaggccaggctctggagcgggggtgccgcctcctgctggccagggagggtcggacccttgccccctgggctgactggcagctctgcagccacggcttgggaacgaggctgtgggtggaggtggttcttaggaccaggcctctgaatcctaaagttctagcatgactactgtagctgcgagggcttatgtggaggaaacagtcacaggggctgctcagggtggcagaccccactaaagagggcagagggttctttgctctagataaacaaacatcatctgcctccagacactggccacagtaggagtattggtcctgggcttccccagccaccagtcagccacaagctgtcggtgacctattggtagagggactgggtgtgagggtctgggccagggtgcttgacctgggagcagctggttcagagtccttcacaccgcaggccagtagggagcagtggaagggacagtgctccaggcattgggaagtccctgctggctctatcactcggggcaaacttctccccacctgggccttgggttcttcagctataaaatggccagaggtggggggcgggatgactaaaggaacagtgcagactcccccactgtggtcttgggaggccagaggagttagaagacctatctatctatctatctatctacattgatcacatcaaaagtatttatgtgcctaacccggggctggggattgtggacgttctggcctaatggacagatgtgaactcatcccagagcatcgcaggaatgaccaggatgcccgggaagagttgagctgagtgggggctccagccacagacagcggcccaggccagggagttgctggcaacgaaggagccagtggtggaagaagaagaggccctgaatatacgattgcctgcccacgttgtcttctcttccatacacagtgaaaatgtagaaagatggtttgtgaggccaaactgtgaatgggctaaagggaggcaaagttgcactctccttccccagagggctcaccaagagggcacacccccgggggttctggtgggcaacgggggtgagcatgtccctgccctggctccctccatctgtgaccaggaggcatggctgggtgtatgttcaggtgaggctcagagtggcattgtgtccctgtcccctgcccagggcagtgaggggagcccttgatgctgattagaaggctagaactggggtagaggtgcctggcatgtctcatgccatggggactcaatctagcaactgtgagtcctggggtccctgtgatgggaagagggcagtgccctgcccaatgtggcaggtgtcctcatggcaggatctgcccctcaccagggggctgggatctacttgcttggagctctgagcaaggccacaatgcccgcccccacccccaagtagactgcagcctgggcctcatggggcttctcccaggcccacatggcatccctctctgagtttccaggccaccgtgggaccctgcagagcatctgcaccgggctggatagggcagaaaagctcaagggcagctagcttgcctcttccctggaagaaaggtgctctgggactcaccaaccctgagaaagatagctttcctggccaccaccattccccaccaccctggagaagccaattcccaggcttgaagggcactggctggcaggaggcctcttcattctgcaggaggtggaaaggacacctgtagacaggtgatgctcacccctcacctggcgccatggggctgggaggtgagcggctggcatgtttgttcctagggagcaccatgtgagcttaaggctcccctgaccggccccaccacatggcccagcctcctagcacagcagcgctgacctcagtgcagtctgaggattggaatccaccatgagatgatgtgagagctgtgtgccccaggatcaactttttctccaacttggccatcagccagcgagttgctaaggacctgagtcagcactcacgttgcctattcacactccgcttgaaagtccggaaggtggctactgcaaaatcacccctctgagaagtcctctctccacatcttgtccccctttgtgaagacccctagttcgctctgcattttaggcatgaagagatacagcagggtgcgtccggagggagctgtggccttgcaacaccactggcaacagggccggggctcccggtgaaggtgtcaggaagtggaaaaggctggactttgtctcctctttgcctgctggtagcctaaccgcaaaagtatctctttatacagaatacttacagattctaatatatatttgtatttcattttgttacagtatttttatatgttaaagtcaacatccagcgtcttgttttgcctttcagatgctatgtggtcgtggcacgttttgttgggggtttctgtagtcgtcttgtttggatcaactcctagaggctggtttagaacaggcccatgagggagctgcacctgccctggaagtattgttttagactatgtcgatattgtctgttgtcttccatgtgaacatgacattgagtcactctgc

SEQ ID NO: 753 - DNA, 79109 bp, Homo sapiens
cgggcgcagggagccgccgccggggctgtaggcgccaaggccatgtccgactcgtgggtcccgaactccgcctcgggccaggacccagggggccgccggagggcctgggccgagctgctgggtaggtgggcgcggcaggccgcgggagtgggcggcgtccggcccgggacggtttcgccggttccccgatcccttcccgccagagcctccgccggtcggatccccggacgccgcgcccggggggctgtgcggggtgggcgcccggctggggcggcgcggctgcctcggacccggcccctcctgcgcctgggcggacgcccccagccgccgcccgcggggcgctcccttctttcccgaacgccgcccccgccggccgccctgtcaggcgggcctggggtgcgcggcctggggctcccctcagcgcagaggccgcccctcgccagccgtccccgggctcccctgcctcgggccctcctgggccgtcttccccggcgtccgcggtggggccgtctccgttagtttcccgagacctgcgccctggggaggagccccggcccctcttcgggagggtgtcgctggtgggtttctccgcggcgtccacctgcgcgtcgggccggggaccccgtgtgtgaattgtgctgtgatggtttcgaaccgacttctctccgtagcgggaagggtcaagagggaaaaatataatcctgaaagggcacagaaattaaaggaatcagctgtgcgcctcctgcgaagccatcaggacctgaatgcccttttgcttgaggtaagaggaagctggtgtccgtctgcgggcagatttaggttcggggtttttgagtccagccaccgcacagctttcctaagaaaacacccgaggcggcgggcgcggtggcctggcccgcagaggggagggtcgcctgagcccgggagttctggaccaacctgggcaacggggtgagaccccgcctcttttattaaaaacaaaacaacaacaacaaaaaaacaggccgggcgccgtggctcagggctgtaatcccagcttttggggaggccaaggcgggtggatcactcagggtcaggagttcgagaccagcctggccaacatagtgaaacccggtctctactgaaaatacaaaaattagctgggtgtggtggcgcacgcctttaatcccagctactcgggagcctgaggcaggagaattgcttgaacctggacccgggaggcagaaattgcagtgagccgagatcacgccccttgcaatccagtctggattacagagtgagactgtctcacaaaaaaaaaaaaaaaaaaaaaaaaaaaaaaagccgggcgtggtggctcacgcctgtaatcctagccctttgggaggccgaagtgggtagatcacttgaggttaggagttcgagaccagcctgaccaacatggtgaaaccccgtcactacttaaaatacaaaaattagccgggtatggtagcaggtgtctgtaatcccagctgctcaggaggctgaggcaggagaatcgcttgaacctgggaggtggaggtcgccgtgagtgagatcccgccattgcactccagcctggacgacagtgagactccctctcaaaaaagaaaaaaaggaaaatagcccagtagggaagcattacttacacacaggttgtgtttatgcacagatcttgaattttttttatttttattttttattttcatttattttttttgagacaaagtctcacactgtagcctgggctggtatgcagtggggtgatctcggctcactgcagcctccacctcccgggtttaagtgattctcccgtctcagcctcccgagtggctgggactacaggcacgcgccaccatgccctcctaatttttgtatttttagtagagacagggtttcactatgttggccaggctggtctcgaactcttgacctcgtgatctgcccatctcggcctcccaaagtactgggattacaggcgtgagccactacgcctggcctggagcttgaattttttaaatggagtttgttgtgttttggattctaggtagaaggtccactgtgtaaaaaattgtctctcagcaaagtgattgactgtgacagttctgaggcctatgctaatcattctagttcatttataggtaagttatagcttcattttctctattttgaattgcagaagggtttttatatagtaaccatagtttgctaaattaagtagaaatgtaaattttctcaggcgatgggtttccactggtgtgtgtagtcgcaaattctatgggatgtttgtgtgacttgctcttgggcttcttacgatgctgtgtttaaaaacagcgtctgattcaacctgcgactcagaagcagtaggacccagagtgtcccttggaaaaacatgggacatagcaacagcagggatgtgccccttgctcatggaagtagtgagacaggctgtggtgtgcccaggagagcagacgggagaacaattttctaggtacctccttctccccccagtttgagagtgggagatagggtaagttctgggtcaacaacagtaagttattttctgatccttcacgtccttatgtgatgacttgtttctgttaaaataaccttcagtaatagcgctcccttgacaactggtcactgaatgtcattggcaaatgatacagattttcactgccatgattgtatttgaatttcacaaattgcatattatcattccaaggaaccaagctcagccacacagataaacctttaattcattaatttttgagtttgtttttttctgctaaagatatagttagtacatgcacgcacgtgcacacggacacacacacacacacacacacacacagtaaaagacttgtagataaaaaaactttcctatggagacacattggaaacaaatgactagaaattggcattgttggcctggcacagtggctcacgcctataatcgcagcactttgggaggctgaggtgtgcggatcacctgaggtcaggattcgagacgagcctggccaacatggtgaaaccctgtctctactaaaaaacacaaaaattagccgggtgtggtggtgggtgcctgtagtcccagctattcaggaggctgaggcaggagaattgcttgaacgtgggaggcagaggttgcattgagccgagacccctccattgcactccagcctgggcaataagagcaaaactctgtctcagaacagaaaatggcattgtctacttttttttttttttttaacagacagggtctcactctgttgcctggactggagagccgtggtgcaatcacggctcactgcagtcttgacctcctggcctcaagtgatcctcccaccccagcatcttgagtagctgggactacaggtgtgcgccaccatgcctggctaattttttcatagagacagggttttgccatattgcccaggctggtctcaaactcctgagctcaagcaatcagtttacctcagccacccaaggtgttgggattgcaggcatgagccactgtgccccatctgtctacttttctaccgagaatttcaccagcagctgatgatttctcgtactataattttaagcttctagaactattgtaaaattttttttttttttttttgagacgaagtgttgctctgtcgcccaggctggagtgcaatggcgccatctcggctcactacaaactctgcctcctgggttcaagcaattctcctgcctcagcctcccgaatagctgggattataggtgcccgccgccgcacccagctaatttttgtatttttagtagaggcggggtttcaccatcttggccaggctggtctcaaactcctgacctcgtgatcgacccgcctcggcctcctgcagtgttgggattacaggcatgagccaccgcaaccagcctgtaaatgtttttacttatgtattgataatgtgtttttagagccagtacattacaataacaggttcgtactgcagttaacagttttttttttttttttttttttttgagacggagtattgctcttgttacccaggctggagtgcaatggtgtgatctcgactcaccgcaacctctgcctccctagttaaagtgattctcctgcctcagcctcctgagtagctggtattacaggcatgcaccaccacgcctggctaattttgtatttttagtagagatagggtttcaccatgttggtcaggctggtctcaaactcccgacctcaggtgatccacccgcctcggcctcccaaagtgctgggattacaggagggacccactgagcctggcctccagtttttttttgttttgtttttttgagatgaagtctggctctgtcgcccagactgcagtgtagtggcgtgatctcggctcactgcaaactccgcctcctgggttcacgccattcttcgcctcagcctcctgagtagctgggactacaggctcccgtcaccaaacctggctaattttgtttttgtgtctttagtagagacagggtttcaccgtgttagccaggatggtctcgatctcctgaccttgtaatccgcccgcctcggcctcccaaagtgctgggattacaggcgtgagccaccgtgcccggcccggtttctttaaacaattaattttggctcacgtggtggctcacacctgtaatcccagcagtatgggaggccgaggcgggcggattaatgaggttgggaattggagacgagcctagccaacatagtgaaaccccatctctactaaaaatacaaaaaattaactgggcgtagtgacgcgtgcctgtaatcccagctacttgggaggctgaggcaggagaatcgcttgaacctgagaggcggaggttgcagtgagctgagatggcgccgttgcacttcagtccaggcggcagtgtaagacaccattgcaaaaaaataaaacaaaaaaaaattaattttggaagacaaataaattagaaaatgatttcttggcattgcctgcttccaggttgcccaccgtttctcactttattgaatgcagaccagtggctggttgctcaggagaatggtggctgcctgcaggctgttagtgaggttccacttggtggcctgcggactgagcacagctgtgactgcacctgcccaccaggtgcatggcagaatgttgggaaatccctgcctaattttatcacaaccatcaatgtgagtcaacaggggcaggcttatctctgaagtaattagaaaaacaatgtaattgaaagagcctgctgcagttctcaatttattgtgctcctttgtaaaaagatgataaagttcttggtcagaatatatttctttatcttgctccttttgtgtcatgggaaacgtaacaaataccaatgtataactctgggttcaggtgttgccaccagttttattgtgagctgcttggatcatcaaattctcatttttatctcatgtttttccctttgcatctattctccccgtttaaaaggcaattttttttgtgctgcatcttaaaataaggcattttaaacagcaagtctttggttttagattttgtctcatgtgttaagagaaagctatggttttgttttgtgtttaaggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagagtaagacaccagcaaagatgaggaaacctgcccgttgttacttttaagctggttgggaaaataggacatagctttagtattgtttcaggtaatttgttttttaaaaaatgtaatctctcttttcagaagaagctgtcttccctgttagagtttgctcagtatttattggcacacagtatgttctcccgtctttccttctgtcaagaattatggaaaatacaggtaaatttgagattgcaaatctgactctccagtgttccaggcaatgttctgttgatctggatggaggcaacagagtacctgggttttcttgggaattctccaagcttctcattaattacagagagtggatgaaaaagggtttagaaatcatctgtggattggaaagaagtaccttcaattgccattttttgtccctattcacctatcattagtaatatttattagactagaatatattgaaaaacacgtttagccttgggtatattagtatggagaattttccagggtagtatagtaaactattaaaaaaaaatgtatgtaatttttttttccagagacagggtctcgccttgttgcccaggctggtcttttttttttttttttgagacgaagtctcgctctgtcgcacaggctggagtgcagtggcgtgatcttggctcactgcaagccccacctcccaggttcacgccattctcctgcctcagcctcccgagtagctgggactacaggtgactgccaccacgcccagctaattttttgtattttttagcagagacggggtttcaccgtgttagccaggatggtctcgatctcctgacctcgtgatctgcccacctcggcctcccaaagtgctgggattacaagtgtgagccaccgcgcctggcatttatttttatttttgagacagaatattgctctgccgcccaggctggagtgcagtggcgcaatcttggctcactgcaacgtctgcctcccaggttcaagcgattgtcctgcctcagccaccttagtagctgggattacaggcgcgtgccaccatgcccagttaatttttgtatctttttttttttttgagatggagttttgctcttgttgcccaggctggagtgcaatggtgctatcttggcttatcgcaacgtccgcctcccgggttcacgccattctcccgcctcagcctcccgagtagctgggattacaggcatgcgccaccatgcctggctaattttttttgtatttttagtagagacggggtttctccatgttggtcaggctggtctcaaactcctgacctcagatgatctgcccacctcggcctcccaaagtgccgggattacaggtgtgagtcaccgcgccctgcccaatttttgtatctttagtagagatgaggtttcaccatgttggccaggctggtcttcaattcctgacctcaggtgatctgcccatcttggcctcccaagtgctgggattacaggtgtgagccactgcgtccggcctttcccattcttttatccagcatacattatagaattcattagatttttcagttattgctttggtccctgccctcattatcacgtagcttgggaaacaagccactaaatccacaagaagtgcgatgattcatgtgctcacagatttgcgaagaagatgttggacatgcatatcagattggagagttaggaaagccttcctgcacggactgtgaagagtgcgagttaggggccgggcccagtggctcacacctgtaatcccagcactttgggaggccgaggcaggtggatcatgaggtcaggagatcgagcccatcctggctaacacggtgaaaccccgtctctactaaaaaatagaaaaaattagccgggtgtggtggcaggcacctgtagtcccagctactcaggaggctgaggcaggagaatggcgtgaacccgggaggcagagcttacagtgacccgagatggcgccactgcactccagcctgggtgacagagcgcgactctgtctcaaaaaaaaaaaaatagagtgtgagttagggggatgagaaggggaggctgcagggagatcagggcagtgtgacaggcacagtgttcacagtgagtggctaaagcagatcctgttttatcaaatgggagagggttgagtgagaaagacaagggacatgcacagggcacactgaagcctgacctttgtcctggcagcttcgaggagccagtgaaggcttctgaaggagagactgtcatgtcagtgtgtgtaatactgtgttggctgtagtgtggagaaagggttagaagtaggctacagtgcgtaggaagagagaaggaagagaagcaagtgttgggcaacggtgtgtgggtgcccaaaggccagggagtttgaaaaccagtacagctttgtaaaaaaagatgtgtttcaggctctaagtttttgcttgaggttaattttcaatacggcatggttaagaacctaagttgaacattttgtaggaaaatgcattcataaaggactcagaatgctgggggtttttttgtttttgtttttgtttgttttgttttgtttttcagagttctttgttgcttgaagcggtgtggcatcttcacgtacaaggcattgtgagcctgcaagagctgctggaaaggtagcgtgctaatgatgattcagtgttactgtttttgcagtctagtctagtataaattatatttcaaagcccagaatcagacgggtttgatttctggctttgacatataatttgtactagactagattgcattgcatatttatactagactagacctggaggaactattgctttattatttcaagagaacgtttatggtgttttggttttgtttgctttttgtctgttttttttttgagacggagtctcgctctgtggcccaggtgggagtgcagtggcacgatttcagctcactacaacctccacctccagggttcaagcaattctcctgcctcagcctcccaagtcgctgggattacaggcgcccgccaccacacgcagctaatttttgttatgtatttattttttttagggacagagtctcgttctgtcacccaggctggagtgcagtgacgtgatgtcggctcactgcaggctccacctcccgggttcacgccattctcctgcctcagcttcccgagtagctgggactacaggcgtccgccaccacgcctggctaatttttgtatttttagtagagactgggtttcaccatgttagccaggatgggctccatctcctgacttcaggatctgcccgcctctgcctcccaaagcgctgggattacaggcatgaaccactgtgcctggcaatttttgttatttttagtagagatgtggtttcgccatgttagccaggctggtgtcaaactcctaacctcaggtgattcccctgcctcggcctcccaaagtgctgggattacaggcatgagccacctcgcgcggcctttttttttctttttgagacagagacctgctatgtcgccaggctggagtgcagtggtgagatctgggctcgctgcaacctccgcttcccggattcaagcaattctgcccctgcctcctcagtagctgggactacaggcgcgtgccaccacacccggctaatttttgtatgtttagtagagatggggtttcaccatgttggctaggctggtctcgaactcctgatcttgtgatcctcccgcctcggcctagagcagaatttcatctcaaaaaaaaaaaaaaaaagaaaaacctgcttcctaggatatacacatcttatctcagcaccaaaatctatgaagcaaaaatggccagaattaaagggagaagtagacatttcagcaataatcattagaggtttcaatactcccctttcagtaatgggtagaacaagttagattaagaatgatatagaacagccgccccgtccgggagggaggtgggggagtcagccccccgcccggccagccgccctgtccaggaggtgaggggcgcctctgcccggccgcccatactgggaagtgaggagcccctctacccggccaccaccccgtctgggaggtgtacccaacagctcattgagaacgggccatgatgacaatggcggttttatggaatacaaaggggggaagggtggggaaaagattgcgaaatcagatggttgctgtgtctgtgtagaaagaagtagacacgggagacttttcattttgttctgtactaagagaaattcttctgccttgggatcctgttgatctgtgaccttgcccccaaccctgtgctctctgaaacatgtgctgtgtccactcagggttaaatggattaagggcggtgcaagatatgctttgttaaacagatgcttgaaggcagcatgctcgttaagagtcatcaccactccctaatctcaagtacccagggacacaaacactgcagaaggcctcagggtcctctgcctaggaaaaccagagacctttgttcacttgtttatctgctgaccttccctccaccattgtcctatgaccctgccaaatccccctctgcgagaaacacccaagaatgatcaattaaaaaaaaaaaaaaaaaaaagaatgatatagaagttgaatgctgcaaaccagctgacctgactgactgtggagcactctacccagtagtagcagagtgtgtattcgtaagtccaaatggaacagtccccaggatacagcataaggttcaggccaaggccaggtgcggtggctcacacctgtaatcccagcactttgggaggctgaggcgggcagatcacctgaggtcaggagttcaagaccagcctgtccaacgtggtgaaaccctgtctctactaaaattacaaaaattagctgggcaaggtggcaggtgcctgtaatcccagccgttgtggaggctgaggcaggagaatcgcttgaacttgggaggcggaggttgtagtgagctgagattgtgccattgcactccagcctggatgacaagagcaaaactgtttcaagagaaaaaaaaaaggttcaggccataaaacaaagaggaataaatttagaagggctgaaatcattcaaaatatgttctctaaccacaaatgaatttaattagaataaacaacagaagggaattgggaaaatccacaatatttgaaagttaacataatgagtcaaagaagtcacaagggaaattagaaaataacttgagactgggcacagtgccacaccagtcatcccagcactttgggagggcaaggtgggagattgttttgagcccgggagtttgagtccagcctgggcaaagtagtaagacctccagctgggcgtggtggtatgcgcctgttgtcccaactactcaggaggctgaggtggaaggattgcttgagcctgggaggtcgagggtgcagtgactgattgcgccactgcactccagcctcagtgacagcaaaaaactgtctcaaaaaaaaaattgggacatatggctcaactcaatcccctgatgatgggatttagttgagccttacgtctgcctctgtgtgtgtctccagccatcccgacatgcatgctgtgggatcgtggctcttcaggaatctgtgctgcctttgtgaacagatggaagcatcctgccagcatgctgacgtcgccagggccatgctttctggtgcgttcatgacaagatgcgggttcttgggtaaaactcattttgatctgtgataatgccttctgctctcaagagctctgcgaggcagaacagcctgtctctccgtggccgtgggaacctggcatgacagactcccagtctcagcctgttgtggggttgcattttacttgactgatgtggaaatactagtaagtcggccttgacatgagtttaagtgtttccattcacctttcccatagagtgaccgcagctgcttccttctgtcgcccaggctggagtacagtggcgcgatctcagctcactgcaacctccgcctcctgggttcaagtgattctctgcctcaacctccttagtagctgggactgcaggcacgtggcaccatgcccggctaattttttttttgtatttttagtagagacggggtttcattaggttggccaggctgctcttgaactcctgacctcgtgatgcacccccctcggcctcccaaagtgctgggattataggcgtgagccactatgcctggccttcctgaggaatgatattatgagaaaaacttgggactgtaatgtccccccacaaactaagaaggtgctgagagaccagaggatggctcagactagggaccaacccagtttgaggagtagttgggtttgtcagaagatggcttggaccagagtccagcttgaggagtagttgggcttgtcagaggatggctcggaccagagtccagcttgaggagtagttgggcttgtcagagaatggcttggaccaatccagcttgaggagtagttgggtttgtcaggacttatattcagcgcactcctggacggcggcaggacagctctagagaaccgccccaccacctgtctctaaggtgcattgaagctcgttttctggctctttgcctgctgtgtttgagtgatgagactcttttccttggtgagttctcagatcctctctgggatatttgggttctgaggaacacctgctgggagacccatcccactacaagtgacacctacaaataaaaattagatgagaaactgatctgtacagtagcttgtgggttttttcctttttcctaaagctttttggtggcatgagcgacttagcattcctgagctactataacctggtaccagataggttaaatttaaatcaaagttagaaaatcttgtggatttcagtcctcttggtcttattttttaaaaagctaagaatgcctttcctcccccatcacattcctcagaataggatgcttctgggtccctctagaccctctggtattggagattggcaggcaagacaatccataagacctcccttggaaaccacttttatttaagagaaaaaaattgggctgggtggggtgactcatgccagtaatcccagcactttgggaggccaaggcaggtggatcatgaggtcaggagttcaagaccaacctggccaagatggtgaaaccccatctctactaaaaatacaaaaattagctgggtgtggtggcggcgcctatattcccagctactggtgaggctgaggcagagaattgcttgaacctgggaggcggaggttgcagtgagcgagatcataccattgcactcaagcccaggcgacagagcaagcctccgtctcacaaaaaaaaaaaaaaagaaaaaaatctgactataaacttgttccctttcaaatagaagtgcaagaggaaaaaatctggttcatctaagggtcctgattgggtttggtgaacgctagtgtagctgtggtcaggtgagcagtaacttctgcagcgttcctcaggttaggagcagctcacaggggtcctggtgggcccaagccatatgctcacccgcccctctgaagtggatggtctgtgccattcacagttgcttggagaccatgatgtccataaataactttggttttatggtttttcagattttgttcaaatgtttgttttgaggggatttcagaaaaactcagatctgagaagaactgtggagcctgaaaaaatgccgcaggtaggaggaaaagtcaagtgaagagtttagcggaaggagccgtccttattccaagtgttgaaatgtatttacgtgtctctctattgaaacgtgctgtttgtacctatttacggggtacatgtgatacttgttttgtgcatagagtgtaatgatcaagtcagggtgtttagagtctccgtcacctccagtatgtatcatttctgtgtgttggcaacatttcacatgttgcagttactttgaaatatacaatctgttgttaactatagccgcctcactctgctgtggaacattagaacttacttcttctgtctagctgtatgtttgtacccattaaccaactctcttcgttcccccactgcatatacccttctcatctctggtatctctcgttctactctctacctccacaagagccactttttagctcccacatatttgtgataacatgcaatatttgtccttctgtgcctggcttatttcacttaacataatggccttcagttgcattcctgttgctgtgaatgacaggatttcactttaaaaaaaaagaatagctggccgggcatggtggctcatgcctgtaatcccagcactttgggaggacgaggcgggcggatcacaaggtcaggagatcgagaccatcctggctaacatggtaaaatcccgtctctactaaaaaaatagaaaaaattagccgggcctggtggcaggcacctgtggacccagccactcaggaggctgaggcaggagaatggcgtgaaacctggaggcggagcttgcagtgagcccagatcgtgtcactgtattccagcctaggcgacagagactccatctcagaaaaagaaaaaaatagctgaggttgggctcaatggctcatgcctataatccagcactttgggaggctgagactggtggatcccctgaggtcaggagttcaagaccagcctgaccaacatggtgaaaccctgtctctagtaaaaaaaaaaaaaaaatagccgggcgtggtggcacatgcctgtagtcccagctacaggcgtggaggcaggagaattgcttgaacccaggaggcggaggttgcagtgagccaagattgcgccttgcactctagcctgggtgacagagcgagactccgttaaagctgaccagtattccgttgtgtgtatataccacgttttctgtatccggtcatctcttgttgggcacacaggttgatttcatatcttggctattgttaatagtgccacaataaatgtaggagtacagatgtctcttcagctggctgatttcctttcctttggctgtaagcccagtaatgggattgctggatcatatggcagttctggttttttttttgtttttttgtgtttttttgagacggtgtctctctctgttgctcaggctagagtgcagtggcgcgatttcggctcactgcaacctctgcctcccaggttcaaccgattctcctgcctcagcctcccgaatagctgggattacaggcatgcaccaccatgcccagctaatttttgtatttttagtagaggtgaggtttcactctgttggctaggatggtctcgatctcttgacctcatgatctgcctgccttggcctcctgaagtgctgggattacagatgtgatccaccatgcctggtgaaagtgagaccctctgggctggtagttctgtttttagaactacccaactatttagaaatctccatactattttccataatggctgtattaatttacattctcactgatagcatataagagttctgtttgcattctcaccagcatttgttattttttgttttcttgataatgataattctaactggagtgaaataatagctcattgtggctttgacttgtatttccctgatgattagtgacattggcttttttttttttttttttgagacagagtcttgctctgtcgcccgggctggagtgcagtggcgcgatctcggctcactgcaagctccgcctccggggttcacgccattctcctgcctcagcctcctgaatagctgggactacaggcgcccaccaccactcccggctagtttttctatttttagtagagatgggctttcacagtgttggtcaggctggtctcgaacttctgatctcatgacccgcccaccttggcctctcaaagtgttgggattataggcgtgggctaccgtgcctggcctttttttttcttttttcttttttttttttttgagatggagtcttgctctgtctcccaggctggagtgcagtggtgccatcttggttcactgcaagctccgcctaccgggttcaagctattctcctgcctcagtctcccgagtagctgggactatagacacccgccaccgcacctagctaatttttttgtatttttagtagagacagggtttcaccttgttggtcaggctggtctagaactcctgacctcaggtgatccacccacctcgacttccgaaagtgctgggattacaggcgtgggccacagttcccggcctgtttctgggttctctatcctgttccgttggtctgtgtgtatgtttatatcaacctcatgctgttttcatttctgtagcctcgtagtatattttgacctcaggcagtgtgatttctatattctatagctttgttctttttcctcaggattgctttgcttatctgtgttctattttggttccatgtgaattttagaatctttttttctatttctgggaagaacgttattggtattttgatagggattgcattgaatctgtagatagttttggatacgtcccaaatttttattcccttttggaggttcctgagccagtggctcccattttgcctacactgcagtctgtgggctttgtttgaggaagtctgttttattgttaccatgagttgctctctgagtagtggtatgctttaagcccaggagatgtgaagaagggaaatggacaatggtaccttctcaccgtcttctggctccagaggcatcaagggtgaaagtccttagttccacagcccagattcaaggcctgagctttcctctcttcactgaagtacttcagcaaaactctgcgtgcaaaagtgtcctgcccagccctaggctcatggcctcaggccatgctgagagcagtcttagggtaattccagaaagttcagccttttcactctgtctaggtcccttcggtactggagtaatttctaggtctatgagggtttttaaagttgatctctttgtaaagtccatttctttttcttttttccgagacggagtctggctctttcgcccgggccggactgcagtggcactatctcagctcactggaagctctgcctcccgggttcacgccattctcctgcctcagcctcccgagtagctgagactacagggcgtccgccactgcgcccggctaattttttgtatttttagtagagacggggtttcaccatgttagccaggatggtctcgatctcctgacctcgtgatccgcccgcctcggcctcctgaagtgccgtttctttactttagagtaacaagtaataattctcttgtgtgatgcaggtatcacacaaattacagaagattaccaagatggtaactcacattctattttgacaggtcacggttgatgtactgcagagaatgctgatttgtaagttaattgcactgcagcccagactgtaaatgacttagtttgcttattagcaattgtatcagttttctgcctttccatttgaggtatttctcctctgtatgtttcactgtgcagagtcctggtactggaatgcccttgttttggcattttcagagctgtgaagggatacctcatgaatctgtgggtcacagggaagcattttcttgtctgtgtgttttgattaaggcctacagattgtagaagtcttgatggatgtgggccctctggggggttgaagtggatctgttgtctgaaagcgcctggggattgtttctggtgggctgccgccgtgtgctgacatctgttttctgttcctggctctgtcttcagttgcacttgacgctttggctgctggagtacaggaggagtcctccactcacaagatcgtgaggtgctggtatgttcctgagggtggcctgcctgagtgtgcagcagggaggtgtctgccaaattaaagagccaagatattttaaacacttccagagcttcagcagcccgctcctgagcacacttcctctgccagttacgataacgtgcgtgaggaggaggcgaccatgggaaagcccggggaacgctctggtcagccttttcctgtgaggatgaggtcggaaggtgcgcccactgcagtatcctgttccgcctctggaagtcctgcaccaatgtttgtcccactcactgtgacctcctcctgtgtggagtctccccttgctcctccttccctgggtgtgattcaggctctagagctggccctgcctctcagccccccacatttctagaacacactgtagctgtgcctctacagactcccgctgcctggcctccacagatcctgctcagattcaccagtaggcaaagcttggccctattagctttttctctccatggctctgtggagatgtgcggagacccttacaggtcgggaggcggaagctgaggagtgggggctgggtggaaggtggacatcggggtttggtggaaatggggctctggggtttgcttccctctagtgtgggcaggggaccttgaagtgaagtcttgagaaaccagtagaatttgccactgtttccaggccttgtcaaccttttcattctttattttgctcctcatttcccatccctcacagtaactgtttaactgctcaattaaatgtgttgtaccgttcggtacttttactgaaacagtgaataaagcactgtgtgatttcctgaatgtttacatgtgcatcagttagcttgggctgctgtaacaaagtgccagagactgcggtgtggacggcagatgtgttctcacagcagtggaggctggaagttggaggtcagggtgcccctagggttgggttctggtgaggaccctcttcctggcttgcaggagacctactttttctgtgtcttcatgaggtagagaggggagagcaagccctctggtgtcttctccgggcagtcatctcatcatcacctcagccttatcaacaccccaccttgagaggctgggcttcaacagaggaactttgtggggatacagtttagtctgtggcaagggcttttttttataatctgtgtgataagattactcacactgatgtcctgagagtcaggtaacaaccactgacctgccgatttttatattttgtaattagttgccaattatttatttatttatttatttttgagacagagttttattcttgttgcccaggctggagtgcagtggtgagatctctgctcactgcaacctctgcctcccaggttcaatcaattcttctgcctcagcctcctgagtagctgggattacaggcatgcaccaccacacctggcacaagcctatagttttgtattttctatttttaagtagacatggggtttcactatattggtcaggctggtctcgaactcctgacctcaagtgataacacccacctcagcctcccaaagtactgggattacaggcgtgagccaccgcacctggcctgccaataatttaaaatcagacatcctccaacagtcttggtggccagcttcccttgcacactgggggctgtggtgtcccaaagccctgccctgtgaggaaggacagcagggctgagaagtgaatctccacgatgtcccacaccctgttgtgtgagtgtcttgagtttgcacagagccgacgtggcctcgttgggtgtgtgaccctggggcagttcactgaaccgccaggacccttgattttctttctttctttctttatttttttgagacagagtctcactgtgtcgcccaggctggagtgcagtggcacgatctcggtttactacaacctatgcctcctgggttcaagcgattctcctgcctcagcctcccacatagctgggactataggtgtgtgccaccatgcctggctaattttttttatttttctttttttgagacagaatttcgctctgtcgcccatgctggagtgcagtggtgcgatctctgctcactgcaagctccgctccctgggttcacaccattctcctgcctcagtctcccgagtagctggaactacaggtgcccaccaccatgcccggctaattttttctatttttttagtagagatggggtttcgttgggttggccgggatggtctcgagctcctgaccttgtcatctgccccccttggcctcccaaagtgctgggattacaggtgtgagccaatgcgcctggcctaatattttggtatttttagtgtagatggggtttcaccatgttagccagggtagtcttgatctcctgaccttgtgatctgcccgcctcagcctcccagagtgctgggattacaggcatgagccaccgtgcccggctggacccttgattttcttacctggggaatcggcataaagtgccgcttgctggttgcaggttgtaagcctcacgagagggtctgggtttggtttggtggtctgtataggcctgctgggatgtggcaggctaacagacctcaagtgctcttgccacctggctctgtgaccccattcacccccagaacatcgtgttctctcacacagatggcccaggaaaccttagtcccttccattccttcctcatcttcatggacagagctggcctcagtccctgttgtgactgtttgaggccctggtgtgctgggctcttctctcaggcttggcacgaccctctgggggagttccgtgtcacagagggtgccgctgaggccccgtcgggttggctcccggggctccactcccgggtgcggcgcggcctgcccttcccaacctgtttccttctgctccactcccgggtgtggcgcggcctgcccttccccacctgtttccttctgctccttcgcttctctgctccgtgggtttcgccgttgccttgccccctttctcgttgaactgccacctccttggattcagtttcaagtctgtggttatagtggcctggccaagaaagccccttccttgcttaaagaagggatgagcctgagccacagtttgtgctgggattggtgggtggcgtgcaaggcaccctccctttcctgacccctctttctgctgcattggcaggttcggagtgttcagtggacacacgcttggcagtgtaatttccacagatcctctgaagaggttcttcagtcataccctgactcagatactcactcacagccctgtgctgaaaggtaggcccagtgtggaggctgctcagttgctacccattttggggattgctgttgccttgttgccttggtaacgctgactggagatgccaggaattctaggacctcttttacgtctgtcttgaaccagagactgggtcctcagatgcctgagattgttactaaatatccttttacctgaaagcaacagatttttataagaaaattcagaattatgagtggacaaaataattgtcattaaaatagaaatatcttttttgtttgtttgtttgagtcagagtctcactcacttgcccatgctggagtgcagtggcgtgatctcagctcactgcaacctctgcctcccaggttcaagcaattctcgtgtctcagcctctcaagtagctgggactacaggcgccaaccaccacacccggttaattttttgtatttttagtagagactgggtttcaccatgttggccaggctggcctcgaactcctgaccttcggtgctccacctgccttggcttcccagagtgtcgaagtgttgggattacaggtgtgagccaccgcacccagcgtaaaatagaaatatctttattttatttatttatttatttatttatttatttatttatttattggagatggagtcttgctctgttgccaggttggagtacagtggcgtgatttgggctcactgcaacctccacctcccgggttcaaaccattctcctgcctcagcctccacagtagctgggattacgggcatgtgccaccatgcccggctaatttttgtatttttagtagagacgggctttcaccatgttggccaggctggtctcgaactcctaatctcaggtaatccgcccgtctcggcctcccaaaatactgggattacaggcgtgtgccgctgtgcccagccgctgtctagtcttttaaaacttggtgtttgagcatgcacattctccttctggaatacctgatcacccagcacaactcacgttatctttctgctggctacccttgccttgctgtgactgtgtcatggttctcagctagactcggtggcgtgtttgatggcccaggcatcgtctgcccagtgggtgtcctgttacccatgtatgacagactgtacccaagatatcagtcttacgaataaggccacgatgaacactttgagctttttctgtatctagcatatccccagggtagatgctcaggcaggaaactggtgggagatgagggatacacagatggctcccaacaggtgctgtgaggtgctcaggagtttatcatcacttgactgagctgagcttcctttgaacagcatccccaccatgattggtttattcccagtttatcttattttatgtatttatttatttttttgagacagagtcttactctgttgcccaggctggagtgtggtggtgcgatctcagctcactgcaacctctgccgcctgggttcaagctattccctgccaagcttgaattacaggcgcctgccaccatgcccagctactttttgtattttgagtagagacagggtttcaccatcttggccaggctggtctagaactcctgaccttgtgatccacccacttcggcctcccaaagtggtgggattacaggcgtgagccacctagcctgaccttactgacagtttaaaagcaggaaaattgaaatgcagttggtacattggaaaatatttattgtgaatatgacaaagcattacaagtaagtaaccgggcctgagaaacagaattgatgatatagcaaataggcaacaaacagggagatggtgaactttaataactgaaaaagtacatattaagatctgtcttcacactgaagctttgaaacacaactttttggccaggagcagtggctcacgcctgtaatcccagcattttgggaggctgagacgggcaggtcacgaggtcagaagttcgagaccagcctggccaaaagagtgaaaccccatctctactaaaaaatacaaaaattagccgggcgtggtggtgggcgcctgtagtcccagctactcgggaggctgaggcaggagaatcgcttgaacccgagaggcagagcttgcagtgagccgagattgtaccactgcactccagcctgggtgacagagtgagactcagcatcaaaaaaataaaaatacaaaaagtatctgggtatggtggcacacgcctgtggtcgcagctacttgggagactgaggcaggtggattgcttgagccagggaggtcgaggctgtggtgagcactgcactccagcctgggtgatagtgagaccctgtccaaaaacaaaacctgtgggcggcaagccacccaggcaccaaggcaagagaccgaggacacgagctgttctagtataataaaatataaaacaagaatagttataccagatatagatcttagatatgattacatatgaatatcattaatcattagttggtagtaattactgtttattgcaatattataataatcctcgctctataatcataacctaggaaaagccaggccatacagagacaggagctgaggggacatggtgagaagtgaccataagacaagagtgtgagccttctgttatgcccggacagggccaccagagggctccttggtctagcggtgacggcagcgtctgggaagacgcccgtcaccaagcggatcgtggtccagcggtagcaaaaggtgtcaaggaacaccactcactacttagaccgggaaagggactctccctttccccccgggagtttagagaagactctgctcctccacctcttgtggagggcctgacatcagtcaggctcacccacagttatccggaggcctaaccgtctccctgtgatgctgtgcttcagtggtcacgctcctagtccaccttcatgttccatcctgtacacctggctctgccttctagatagcagtagtaaattagtgaaagtactaaaagtctctgatatgcagaaataatggcataagctgtctttgtctctatctcctctccctctctgcctcggcttccaggcagggaagggccccctatccagtggacacgtgaccttacctatcattggagatgactcacactctttaccctgccccttttgctttgtatccaataaataacagcacaaccagacattcagggccactaccggtctccgcgcattgatggtagtggtcccccgggcccagctgtcttgtcttttatctctttgtcttgtatctttctttctacactctctcgtcgccgcacacggggagagacccaccgaccctgtggggctggtccttaacaaaaacccacaactttttgatctctgacttgaagtttttgtctgtttctccccctgcagcatctgatgctgttcagatgcagagagagtggagctttgcgcggacacaccctctgctcacctcactgtaccgcagggtgagtggatgtggtattatacctgcttctgagctcgtggcggggggattaagatctgcctagtacttgtcatgctgcctgccgtggacggcacatcgagaggttcagggatgtctggtgagatgtggctgtcctcatcaaggccaccactcaggtcaggagactgaacttgtcccttgggccgagcccctcctccttgagatagggagaattctctccaagcaggtgctggccactgtgaggggagagacgccacggtgtgagctgtcacagctccatgtgttacctttgcagtgggaagtgagggggctgcggtggccaccggctgggaggaaggtgaggggtcatctgtcgcacattggtttgcttggatattgaagggagcggatgcttttatttcagctctttgtgatgctgagtgcagaggagttggttggccatttgcaagaagttctggaaacgcaggaggttcactggcagagagtgctctcctttgtgtctgccctggttgtctgctttccagaagcgcagcagctgcttgaaggtgagcttttacgcgagcccggtggtgctggtcaagagtgtgtgtaggggggtgtcagcagagtcccagctgactgtgggtgagcctctcagtgaagcccttccctacctgcccggaacctgcagtgcctcctgtcgatggaacattctttgtcagacgcttccataagcactgactgctgctctgagaggccagagtgtccactgctgcttcattcaggtctctagtggtttgcacttgacatgctgtaattgctgtgtagtcttttaaaacttggtgtttgggtgtgcacagtctccttctggaatacttgatcacccagcataactcacgtcatgttcctgctggctgcccttgccttgctgtgactatgtcatggttcttaactagactgggtggcgcgtttgatggcccaggcattcgagagctgccagctggacagcatggtcactgcgttcctggttgtgcgccaggcagcactggagggcccctctgcgttcctgtcatatgcagactggttcaaggtaagtgacctgccaatcggctacctaatacctgatcttcccagaaggcctgggagtggggaccatgctgtccccacctgattctctgtcatgtgagtgagcaaccttgctgtcagctttgccgagtggccttggcagatcttcctctgcgtgtgccgaggagcctgggttctccctgtcggggcctcagcggatcttcctctgcatgttccgaggagcctgggttctccctgtcggggcctcagctccttcccctggtttctgtctcacttagttgacggagcctcctgctgtcttttataagaaaattagcgaaatcaagcctggacaccatagtgaaacctcatctccaccaaaaaaaaaaaaaaaaaaaaaaaaacacacacacacacacacaaaacaaaaactacgcaggtgtggtggcagacacctgtagtcctcgttactcgggaggctgagacgcaaggattacttgagcctgggagatcaaggctgcagtgagctgtgattgcaccactgtacgccagcctgggtgacagaaggagactccatcccaaaaagaaaaaaaagaaaatgagtgaaatcaggaaagaggggacacagaagtggatgctgctttttgcagagtatacaatgtctcttattttccctttttttttttttgagatggagtcttcctctgtcgcccaggctagagtgcagtggtacagaaagctcaccttctcggctcactgcaaactccgctgccccgtttcaagctattctcctgcctcagcctcctgagtagctgggattacaggtgtgcactaccatacccagttcatttttgtatttttagtagagacggggtttcaccatgttggtcaggctggtctctaactcctgacctcatgatccgcccgtcttgtcctcccaaagtgctgggattacaggcatgagccagcgcacctggcctttcctttttatttatttatttatttattttatttatttacttatttatttttttgaggtggagtctcattctatcactcatactggagtgcactggtgcgacctcggctcactgcaacctcctcctcctgggttcaagcaattctcctgcctccgcctcccgagtagctggggttacaggcgttcgccaccacacctggctaatttttagtagagacagggtttcatcatgttggtcaggctggtctcaaaatcctgaccttaagtggtccgcctccctcggcctcccaaagtgcagggattacaggcatgagccaccgtgcccagccttgcgtctctaattttcacgtaagtcctgaaacaagtacttcatttcttcagccgtatcacatattcttcctttttctttggaacacacacagtgtgctctctgacagaagtttatgcagctgttcctgaacctaagtgggcattagactcgcctggagggggctttggaaataaagatccagggcccatttgagactactgagtctgagctcctgagacctcagggatccctgggcaacccctgtgaaaacccccagttcatgtggggagttgggtgtatttgagatatcagctttgaaggaccgccatggtttctcttttagtgcttgtgagtaaagtttccatttgaagagctaatttttgtagaagttttgggttcgggccaggtacagtggctcatgcctgtaatctcagcagtttgggaggcctaggcaggaggattgcttgagcccaggggttcaagatcagcctgggcagcacagtgagaccccggtctctacagaatgtaacaattagctgggtgtggtggtaagcacctgtggtcctggctacttaccggctgaggcaggatgattacttaagccgaggaggttgaggctgcattgagctgggattgcattactacgctccagcctgggagacagagcaagactctgtctcaaaaaaaaaaaaaaaaaaaaaagtattgagttttcctgccatcaccacctcggtgaagtagttgcctctttgtaggagtctcagctccctgaaattttcaagggctgcggtgcctgcatcgccatcgtggctgcggtgcctgctccccccccaggccttctgaggagctgaggctgcacaggaggctgagccgcatctgcttgtgttgggagaaggtggtgactggtgcagtgtcagtgtcaactcacttctattccttaaagttccttctcacctgccctcaggctctccccagctctgcccagttagcctggggcttccactaaactaagaggagaggtgtttgttctgtccttttagtgaggcgctgagagatttgtgccagaatccacctggtgctcttgggtcaggagttgatgggtctccccgagccgcggctcaggtgtctccctgggctgctttttcttcggttccagaggcgacagttgggagaggaatactctgaagtgctgtgttggtggtggtgttttggttttgtttgcttttcttttaccttttcaaatcaactttatcaaaatatagtttaaatgaaataatgaaaggtatccaatttaagtgtaccattaaatgaggttttttgtttttttctgtttgtgttttcttttaagagactgagtgttgcccaggctggagtgcagtggcatgatcatagctcactgcagcctttacctcctggggtcaagcagtcctcctgcctccgcttccagagtaactgggactataggtgtgtgccaccacacccagctaattaaaaaaaatttttttgtaaatacaatgtcataccgtgttgctcaggctggtctcagattcctggcctcatgcgatccccgcaccttaacccccgaagtactggaattacaggcatgagccaccatgtccagatagttagatgagttttgataaatgtatatatgcatattcagtgtttgaacatctgtttttgttatgttttgttttgtttttgagatggagtccccgtctgtcaccaggctggagtgcaactcccacctcctgggttcaagcgattctcctgtttcagcctcctgagtagctgggactacaggtgcctgccaccacacctggctaatttttgtaattttggtagagatggggtctcaccatgttggccaggatggtctcgatctcttgagtttgtcatccgccccacttagcctcccaaagtgctgggattacaggcatgagccaacgcacttggcctgaacatctgttttaatttttacttttgagggcaaataccagcactgtgggaggacgaggtgggccgattgcttgagcccagtagttcaagaccaccctgggcaacgtggcaaaaccctatctctaccaaaaatacaaaatttagctggtatggtggcaggtgcctgtaatcccagctactcagaaggccgaggcaggagaattccttgaacccggaacgcgcaggttgcagtgagccaagatcagaccactgcactccagcctgggcaatggagcaagaccccgtctcaaaaaaaaaattttttttttttacttttaggaaatgttaatataagtagaccaaatgatcgtgaatttgagccctttggggtaattaatataattctcagcatatcacattatgtagttaaatgtaatttgtggggtttttttgtttgtttttttgaggcaaggtctctgttctgtctcccaggctgggatgtggtggtgtgatcatggctcactgcagtctcaaccttccaggctcaaatgatcctcccacctcaacttcccgagcagctgagtccgcaggtgtatgtcaccacacctggctaattattaaaaaattttttgtggacatagtgtctcactatgttgccctggctggtctttttgtttttttaagatggagttcgctcttgttgcccaggctggagtgcagtggtgcgaccttggctcacggtaaccacctcccgggttcacgccattctcctgccacagcctcctgagtagctgggactacaggcgcctgccaccacacacggctaattttttgtatttttagtagagacagggtttcaccgggttagccaggatggtctcgatctcctgaactcgtgatctgcccgcctcagcctcccaaagtgttgggatcacaggcgctagccaccgcgcccggccgtcctggctggtcttgacctcctgggctgaagtgatcttcctgcctcaacctcccaaagtgttggaattaccggattgagccactgcacccagccattaagtgtaattttttcaaaaatagcaaacagaactgccttttatctcagcaactctaacaatggctgctgtgaccccaggtctggcttgcgcgtgtcacttagatgctttacagaaatgcctttggcgacgggtctggactgttcctgctgcggccagtgatcatctggctcactgttaattgagtgaacgttgccaagagacaggagcagttgtgttgtggatggctgaatggagggtgataagacatggtgtgcttggcgggagaatttcaggttgaaactgggtgctgatgttttgagaagggaacccttgagtggtctcaggttttatttaaatttttaactgacaagtattgagctgctttcctggtatttggcacagacagttcatgtctctgagctttgtttttccgtgactctgtccctctcagagacatttgacaagcgttatcagcattttccgctttttatctaatggctttttgggtctgtctgcatgatgataacattcaaaagaatctacacatggtcaggtgtgatagttcatgcctgtaatcccagcactttggaaggccgaggcaggtggatcacttgaggtcaggagtttgagaccagcctggccaacatggcaaaacctcatctctactaaaaagacaaaaattagctaggtcagacgtggtggctcatgtctgtaatcccagcactttgggaggccaaggtatcacctgaggtcaggagttcaagagtagcctggccaacacgatgaaaccctgtctctactaaaaacacaaaattagccaggcatggtggtgcacacctgtaatcccagctactcaggaggctgaggcaggagaatcgtttgaacctgggaggcggaggttacggtaagccgagattacgccactgcgctccagcctgggtgacagagtgaggctttgtctcagaaaaaaggaaaaaaaaaaccgggcttggtggcacgtgcttgtagtcccagctacttgggaggcagaggtgggagaatcacttgaacccgggaggcagaggttgcagtgagccctgattgcaccgttgcactccagcctggatgacagagtgagactctctctctcaaaaaaaaaaaaaaaaaaatagctgggagtggtagcaaatgcctgtaatctcagctactagggaggcaggagaattgttcaaacctgggtgggcggacgttgcagtgagccaagatggcaccactgcactccagcctgggtgacagagcaagactctgtctccaaaaaaaaaaaaacaaaacacaattttgcacgctttcagaaagaccaaggtgagccttcagttcacgttggagttcaggtttcctgatagatggtaacttgctgaggtttcaccaggatgtcctgtggtctcaagtggggctagggtggcaggagctcgtctggttttgcaggtaagcggttcagtgttcacagaggcccacattctgtctgcaggttcactatgatgcgttcagggccatgcccatttaaaatctccttccttccctgactcactgcagcccccaggactttgctgcagcccccttcgttcctgggagggtttgctcatgttcctcgcttgctctgctagggtcttgcagcttcattgtctgaggggtggccctccttggcctgtgttccttacccacctctcttgcagtgatctgtccactggtggatgaggttagaagttaaagtgtgttcagaagtggcttcatcccacaaaatcaatttgtttgctgtgcacaaacacttcttagggcatttagcaaattgtacccctaaggatcccaaaaggatcccatagttagtgtttgttatagctaatgatttttaactgtttttcttcgaataacttttagatatctcttcagtcaaagcgcagtcgtgacatctgtaaatgtatgaaccacatgactttttggtgtttctcttttttcctttctgtttaggaggccgactacagcagccgcccggacactgcctaggtgggcttcacactcttctctccacacaggacactgcctaggtggtgcagctgcgcctggctgtcctgggcttcacgctcttctctccacacaggacactgcctaggtggtgcagccgcgcctggctgtcctgggcttcacgctcttctctccacacaggcctcctttgggagcacacgaggctaccatggctgcagcaagaaggccctggtcttcctgtttacgttcttgtcagaactcgtgccttttgagtctccccggtacctgcaggtgagaagctggctgccacatccatgatttctggtgcttcgctcacctgctgcatctgaggactgccttggcctccccaagagcctcctgcagatctgctctgagcctctcagccaggcccttccccttccccttccccttccccaagccgtttatggtgaaacaacacaaacattgcaactggaggtgtccacgtggacacacagtgagtgcgtgtgtgccagtcaaggcaactgctaagaaacccttttctcacctaggccaaggaggtgggtagatatattatgtcactgttcagtctccctcaaaacagtgagcaggtctgagtggtgacgtggagagacgttctcagcacccagttacgcaggaagagcgagttgtactgcagtgagggttttaggatctcatgtttgcttttttttttttttttttaatttcatgtgggttttttttttgtttttttgtttttttgggtttttttttttgagacagtctcactctgttgcctaggctagagtgcagtgttgccatcatagctcactgtagcctagacctcccaggtcaagcagttctcccacctcagcgtcctgagtagttgggactacaggcgcatgccagcaaacctggctgttttttctttttttcttttttttagtacagatggggtcttgctgtgttgcccaggctggccttgaactgagctcaagtgatccttccgccttggcctcccaaagttctgggattacaggtgtgagccactgtgcccagcctgaccctcatcttttaagaaaattggccgggcgtggtggctcacacctgtaacccagcacttttggaggctgaggagggcagatcacttgaggtcaggagttcgagaccagcctgaccaatgtggagaaaccccctgtctactgaaaatacaaaattagccgggcgtggtagcgcgcgcgtagtcctagctactcaggaggctgaggcaggagagttgcttgaacccgggaggcggaggttgcagtgagccgagactgcaccattgcactccagcctgggcaataagagcaaaactccctctcaaaagaaaaaaacacgctgtgtcccctctgtcccctttgaccaggaagtcaaaggcatggagctgcaggcggccggggccggttcctgctgccgctgctaggattgcacatccctggttcccccagtgagccgccctggacttgcaggaccagctacattagggtttcttgatttttcacctggggaagcagccttctattgtgttttttttttgttgtttttttttttggaaatgaagtctcactgtgtcacccaggctggagtgcagtggcgcgatctcggctcactgcaaggtccgcctcctgggttcccgccattctcctgcctcagtctcccgagtagctgggactactggtgcccaccaccgcgcccggctaatttttttgtatttttagtagagacagggtttcaccatgttagccaggatggtctccatctcctgacctcgtgatctgcccgcctcagcctcccaaagtgctgggattacaggtgtaagccgctgcgcccggcttgtgttttaattttactaatggtttgctttgcatactcataagtctgactgtaaagggctgtgtttctctactcagcactgtggatgttggaagtgaattgtggcctccctggagtcccaggcagttcccagactaacggtgctgcgctctgctatctatcctcaggtgcacattctccacccacccctggttcccggcaagtaccgctccctcctcacagactacatctcattggccaagacacggctggccgacctcaaggcaagctgtccctccatgcccactcctcacacctgtcccagcagaaactgctttgttttcttgttctcattctgtgtcttccctgaaggtttctatagaaaacatgggactctacgaggatttgtcatcagctggggacattactgaggtaatgttgcttgagccctgcagggtctcagccagtcacgcccaccatgcaaaggtccagtttcttttgactcttgagttgagtttttcagccttcccagtctcatgtctggtcttgcctcgggcgcagctgggggcgaggctctgcgggcctctgtgttgctgtgtcccaccttgtgtgtccccagcattggcagggaaagggttactgtgtggcagagtgaagtgcctcaggctgcaggacatttgtccttttgggagatcttggttcctgtggggttgaatggagaggtggttcgtcatgtttttctctgaatcacagaaaagtgttaactttttttttttttttggagatgcagtcttggtctgtcaccaggcttgagtgcagtggcgcaatctcggctcactgcaacctctgcctcctgggttcacgccattctcctgcctcagcctccagagtagctgggactacaggagccgccaccacgcctggctaatttttttgtatttttaatagagtcagggtttcgccatgttagccagaatggtctcaatctcctgaccttgtgatccgcccgccttggcctctcaaagtgctgggattacaggcgcccgccaccacgcctggctaattttttaattttttttagtagagacgaggtttcaccgtgttagccaggatgatctcgatctcttgacctcgtgatctgcccgccttggcctcccaaagtgctgggattataggtgtgagccactgctcctggccaagtgttaactgtttttatagcagccaaatgtcagatggtcatgtgatatgtgtgggtcactaatgaaaacattcttttttttttttgagatggagtctcgctctgtcgcccaggctggagtgcagtggcgcagtctcggctcactgcaagctctgcctcctgggttcacgccattctcctgcctcagcctcccgagtagcctatagtgggcctacagatgcctgccaccacgcctggctaattttttgtatatttttagtagagatgaggtttcaccacgttagccagtatggtctcgatctcctgacctcgtgatccgcccgtctcggcctctcaaagtgctgggattacaggcgtgagccaccatggccggcctaatgaaaacattctttactttttacttttttttttttttttgagacggagtctcgctctgtcgccctggctggagtgcagtggtgcgatctcagcttactgcaagctccgcctcccgggttcacaccattctcctgcctcagcctctccagtagctcagactacaggcacctgccaccacacccagctaatttttttgtatttttttagtagagatggggtttcaccatgttatccaggatggtctcaatctcctgacctcgtgatctgcccgccttggcctcccaaagtcctgggattacaggcatgagccactgtgcccagcgtattgtttttttttttttttttttttttggaatggagtctcgttctattgcccaggctggagtgcagtggcgcagtctcagctcactgcaagctccgccttccgggttcatgccattctcctgcctcagcctcccgagtagctgggactacaggcacccgccaccacgtcaggctaattttgtgtgtttttagtagagatggggtttcaccgtgttagccaggatggtctcggtctcctgacctcgtgatccgtctgcctcggtctctcaaagtgctgggattacaggcgtgagccactgcgcctggccctccattctttactttttaagacctttttattttaaagttacgagttactgaagaacacttataggtgacattaaagtgttaggtgaaaatatttaatataattttccatttataatttattgctgtttataaattactttttttttttttttgaggtgggatgttgttctgttgaccaggctgaagtatagtaccgtgatcacagttcagtgcagcctcaaactcctaggttgaaacgatcttctcaccttgacctcctgagtaactgggagtacaagtgtgcgccaccatgcctggctggtttctaaaattttttgcagacatagggtctccctgtgtggccgagactggtcttaaactcctgggctcaagtgatccttccgccttggccccccaaaatgctgggattacagatgtgagctgccgcgcctggcctcagaatgtttttttttttttttgatgcagggacttcccctgttgcccaggctgcagtagggtagcatgatgatggcttactggagccatgatttcctgggcacaggcaatccttccacctccacgtcctgagtagctgggaccactggctcatgcctctacacctggctaatgtttttgtatttttttagagatgagatgtcatcatgttgcccaggccgggcttgaactccttgggcttaagcagtctgccccgcttagcctctcaaagcactgcgtttatagacatgagtcatggcacccagccctcgtaatttcttttaatctcaaaaattaagtctctactccttcccacctagaaatctttactttcaactctttcctggaggcaggaaagaggctcacggcaggctctcagcagagctgagctctcgaggagggccgcacatcacggggtctgaaccttgtgtgtgtggaggtggcagtgtcatcctcccctgtcgtgctggtattttgggacattttggagtgctccagggcccctgctgtgcgcacagcatgtgggcctttacctttaatgtgtacagagcctttcaacaaggaagcacaggttgagtgtggccttcactgctcagtcttttctttaaagtcctctgttctttttcctttcctccctgtatgggaaccagccccacagccaagctcttcaggatgttgaaaaggccatcatggtgtttgagcatacggggaacatcccagtcaccgtcatggaggccaggtaggctgggctgccgaaaaggcctctagcagctgcagtgtgtgcagaccgcgctctgatgcctgcagtatgtgcagactctgctctgatgcctgcagggtgtgcagactccgctctgatgcctgccagcgtctggggctctttggagtgtgtcccatttctgcccagagccacatggggcaggttggccactgtctattcagagagagacaggagtcagggctgtgaatcgaggatcctgccgttaagggatacggggtgaggtcaagagctgtgcatttgctgtgaaacattttttcctctgtaaaagcaggtgatgcccctcccgtgctgaagcagccaacaggaactgctgattggggagcttgcactgggagggaaggcagtggggccatgatgtttttttttttatcaatgccttctttgtgaccaatatggagtcagtaacagagagctgaatagcacagctttattgaatttggtatgatctcaaaacatcttgaattctggtggttacacatgtggatgagctgattgcagctcccagggttttgaaatttagctccaaggaaattgccccaaatggaccttacatggtcctcgtggcctcagattgatccaggctccacgttcaagcccagggagcaggccgaatgtggtcctgattcccacggactcagggctgggctagcacggcctgccctacacatgccttgtcccggaactgtgcacaagaagacttcataatgcatcgtggctttggagtgagccctcgcagtccactctctgaaacaccggtcaccgtctgtgggaattgccttctcgctgctctgactgatgcactgtctgcttctctgtgttgcagcatattcaggaggccttactacgtgtcccacttcctccccgccctgctcacacctcgagtggtcagtatgcgtctccatgagtttgtgaccagttgtgtagaaagcaaggactttccttgtcagtctctcacaggtctcttctcttcccacagctccccaaagtccctgactcccgtgtggcgtttatagagtctctgaagaggtatgcagcaacggttagaaggggatgactacttccaggtttcttctgacaatgcgaagaattgtggatcttctgtagagaaatttgttagaccactattgtgttttattggtaaaatattggctccaaaattggttggttacttttttttttttttttttttttttttttttagttggagtctcactctgtcacccaggcttggagtgcagaggcgagatcttggctcactgcaacctccacatcttaggttcaagcgattctcttgcttcagcctcctgagtagctgggattacaagcctgtgcctggctaagtttttttttttttttttttttagatggagtctcgctctgttgcccaggctggagtgcaattgcacaatcttggctcactgcaagctctgcctcctgggttggagcaattgtcctgcctcagcctcctgagtagctgggattataggtatgcaccaccacgccctgctaatttttgtatttttagtacagacagggttttgccatattggccaggcggttctcaaactcctgagctcagaagatgatctacccacctcatcctcacagagtgctgggattacagatgtgagccaccgctcctggcctttttttttttttttttttgagatgaagtctcactctgttgcccaggctggagtgcagtggtgcgatcttggctcactgcaccctccacctcctgggttcaaggaattctcctgcctcagcctcctgagtagctgggattacaggcgcgcaccaccacgcccggctaatttttgtatttttagtagagacggggtttcaccatgttagtcaggctggtcttgaactcctgggctcaagcgatctgcccacctcggcctcccaaagtgctgggattataggcgtgagctaccgcacccggctgcatcattcttcagtgaaagaaaatgtttcagtacataatgattgtgcagagaggagaactgaaggaaaatgaaagagctctgggaaagcctcatgctgcagaacttgagagtagacctggaagttattgtttagaataataaggtatccttggatcacttacattgcaggtttctagtaagaaagttggttggtatcaaccaactttggaagaaataggaaagtataagtcctatattccagcaaaatttataaagttctgggacctgtaagaagataaacacaaagagccttttttttttctttttttgtatttttagtagagacagggtttcactatgttggccagactggtctcaaactcctgatcttgtgatccacccacctcggcctcccaaagtgctgggattacaagcgtgagccaccatgctctgcaaaaataattttttaaatcttaaaataagtttattctctgggatccttactttcatttgttttgagacagggtcccactctgtcacccaggctggaatgcagcggtgcagtcatggcttactacagccttgacctcctgggcttcaacagtccttccctctccgcctcccaagtagctgggtctagaggcgtgctccaccacacccagccagccttgatctcctgggcttcaacaatccttccccctccgcctcccaagtagcagggtctagaggcgcgatccaccacacctggccagccttgacctcctgggtttcaacaatccttccccctctgcctcccaagtagctgggtctagaggcgcgctccaccacacccagccattttgtaaatgctttgaggacacggattttcgctgtgttgcccaggcttctctctctcttggcctcaaataatcctcctgcttcaacttcccaaagtgctgggattacaaatatgagccactgtacctggcttaccctttatcatgttaagaaagttccctcttactaatttgctaaggatttttagcatgaactaatgcgttttatttttttttctttaatttattttttgagtcggagtctcggtttgtcagccagtctgcagtgcagtggcgcaatctcggctcactgcaagctccaccttctgggttcatgccattctcccacctcagcctaccaagtagctgagactgcaggcgcccgccaccacgcccggctaattttgtttttgtatttttagtagacacagggtttcactgtgttagccaggatggtctcaatctcctgacctcctgatctgcctgcctcggcctcccaaagtgctgggattacaggcgggatccaccgcgcctggcccaattttgcatatttttaatgacacgaactaaacgtttttcttagtattaatcattaaaattaacaaagattcatgttttgctgggcgtggtggctcacgcctgtaatcccagcactttgggaggctgaggcaggtgaatcacaaggtcacgagttcgaggccagcctggtgaacatggtgaaactccgtctctactaaaaatacaaaaaattagctgggcctggtggcaggcgcctgtaatcccacctactcgggagggtgaggcaggagaattgcttgaacctgggaggcggaggttgcagtgagccgagatcgcaccactgcactccagtgtgggtgatagtgggagactctgtctcaaaaaaaaaaaaaaaaaaaaaaaaaagaaaaacaaagattcgtgttttgaatttggaaattaccaaaaattgtatgagagaaatagaaataatttataatttcactgcccagggataatcactggtggtattttgtggtctagctccttagatattaatatatgattaatatgatatattttgaaacagtgctttttaaatctatatatattttttaatatttttttgtaaaaacaggctcatactgtacacagtatttataatttatttaaatttaatatgtttttattttataatagatttggggattgtaatcttgaattaatttaagccatagctgacttaattgtattgttttcctgtgatccagagcagataaaatccccccatctctgtactccacctactgccaggcctgctctgctgctgaagagaagccagaaggtaagttcctgggccgcttgtccactctgggacttgtgcttttccattttcctaaccttgagtgtctgttgtgctacaccacccgagtgagctcgggggtggctgtgccagctcaagccggtgctttgggtacagggtccgcccaccatgctgacgcccagtgccagctgtggcacagactcttacctgggggtcctgaagaatcacttagcaccttccggaaaggagtgtgtgcagtgcacagccccactttgtcactcgtcatcttcctgtgggccgcactgaggtgtttgtacaggcttcagactcgggtgctctctcagcggccaccttggggcccacagcgctggctcgagcctgtcgtagggagtgtcatgcagcacttttctgttgcacagtgcaggtaggagtagaagtcaggctcttttggcctgtggggagcagtggtgcagctgtcggtcagacctacgccctcattgggaatccgtgaaaggctgcactcaggcagcagtgggagatgccatcatgaggctggtttttcttgaagtgtgtggctttatctccagtagaagccagcatctccctgtgggagccgctatgagctgaagacatagatctgaggctgctgcttccctgtgggctttttttttttgagacagagtctcgctctgtggctgtggactgcagtggcgcgattttggctcgctgaaacctctgccccctgggttcaagcagttctcctgcctcagcctctgtaatagctgggattataggcacgcactactacgccttgctagtttttgtatttttagtagagatggggtttcgccatgttggacaagctggtctcgaactcctgacctcaactgatccgcctgcctcggcctttcaaagtgctgggattacaggcatgagcaaccgtacccagccccttgtgtgctcttctagatccccttccacctgcagggccagggaggctcgttgagatttttttttttttttttttttttttgagacagagtctcgctctgttgcccaggctggagtgcagtggcgcaatctcagctcgctgtaagctccgcctcccaggttcatgccattctcctgcctcagcctcccgagtggctgggactacaggcgcccgccaccacacccggctaattttttgtgtttttagtagagacagggtttcaccgtgttagccagaatggtctcaatctcctgacctcgtgatccacccgcctcggcctcccacagtgctgggattacaggtgggagcccccatgcccggccgacccaccctgagagcatgacctctcagttgtgctggggatgccacaggggcctcagggctgtgtaccctgcggtgtgaggcgtttgcttctcttgagaggtgtcctccttcccccaggatcctccttcccctggggtccacttgttcgtagcttttggtggcttccagaatggtttctaatcatttgtctgatgaggcttatgcacagactcctagagcctatgatttctagagcctgtgatttctggtttcattttggctgtggctgtgcatagcagtgcattttcatgcttgtgtcttctccagcaaccccagaacttgaaggttttttactttaaaaacatatgcagcgtatcttcctttttatattgaaagtggtggctgggcgcagtggctcatgcccgtaatcccagcactttgagaggccaaggcgggcaaatcatgaggtcaggagatcgagaccatcttggccaacgtggtgaaatcccgtctctactaaaaatacaaaaaattagctggatgtggtggtgcgtgcctgtagtcccagctactcgggaggctgaggcaggatgatttgaacccgggaggcggaggttacagtgagccgagatcgcaccactgcactccagcgtggtgacagagcaagagtccatctcaaaaaaaaaaaaaaaaaagtttgaggaaccaggggactaaatggtcacctatccgtgatcctgtccccaccctcgccagccctcgatcctccttgttttcttccgtgtgtatgcttctcacggtggtggagtggtattgatggtgcacacagaaccgctttttttcttaaacttgtttataaatgtaattttttatgaaactcgtttataattgtaattttcgatgtggcatccagcatcagggaagacacctcatttacctcctcagagactcccagtccctccgtctgccacacacagcagcttggaagttcacagctctgtatttgactgtgtgaagtttctatttttgcagtgaagagtcctgttgagtgtctttccatctggtttcttccttcttctcacagatgcagccctgggagtgagggcagaacccaactctgctgaggagcccctgggacagctcacagctgcactgggagagctgagagcctccatgacagaccccagccagcgtgatggtgaggatggatgggagctcatgctgtgtctcatgtgtgcagcctgtggttggagctctgtggctgggccattttccccatagtgacatcaggctggtgtgtcttcctagtagtccagtagtttaaagattgaccccgggctggcgggtgtggaaccttttttgagacaaggtggaaggctagtcctactgaagctgtcacagacccttggcagaaggtgaatattcggctagttgcatctgagtaggacgaatgatgatagagaagaaaacgcgtgactaggatgcctgttttcccgctcatcctgcctgccggagtcgatgtcacatcagacacacagggtctctgccctgtgatcctgcttccatgtgatggttttctgtaaaatccagagtaagaaatgttcatctgtggattgagaacatgcagtttcttttttcttttttttttttgagacagagtctcactctgtcccccaggctggagtgcagtggcgccatctcggctcactgcaacctccgcctcctgggttcaagcaattctcccgcctcagcctcccaagttgctaggattacaggtgactgcctccatgtctggctaattttttgtattttttagtagagatggggtttcaccatgttggccaggctggttttgaaatcctgacctcaggtgatccacctgtgttggcctcccaaagtgctgggatttcagtgtgagccaccgtgcctggcctacatggaggtgatatatatatatttttttgagacggagtcttgctctgtcacccaggctggagtgcagtggcgtgatctcagctcactgcaagctccgcatggaggcaatgttaacacagcttggttagcgctagctggggctgcagcgccttggcggtcttcactcagaccaagtgcgccagttcctgagtgcagccttccggtgattcaatgatggcttgtgcagaatgtggtacatgggggacatggaggaaaagttccagtgcttaagcaagaggttgatacatgtcaggtgagtcctgtttctaaaagcaaagcggttttcacctttaaatgatgtagttgggctatgtgtggcccatttccctgggccaacatggaacctctggcatgcgcttaggcagatgtggtgtctggagggctggcatgggatttcagatggggaggttcatgttggtgaatgaacatgtccccctctcagccaatcaggaaaaggtagtggatggcgtctggccccatttgccatgacacatgctgcaccacaaggctgcaaatcctgcggggcgaacaaacactggtgttcagcacctggctgggggatgtgtgcagtcagcaggatccgtggaatcgtacttgacgggaggcggagctctctaggccgcagctgtatccctcctttcggggttcttgtcatccctaactagtttcttccttcgcagttatatcggcacaggtggcagtgatttctgaaagactgagggctgtcctgggccacaatgaggatgacagcagcgttgagatatcaaagattcagctcagcatcaacacgccgagactggagccacgggaacacatggtaggtgtaggggctcagaacaaagcagggggtcttcaccattttccattaggcagaggcattagacgcatggagccttctctcaatttctgtttgacttgctcagttagtgtcgtatcagatgttccagggccaggcagcggtgtaccagggtcagctgccacagtctgtttgtgtatgaagagctccttttacattttatttatttatttaattttggagacagggtcttgctttgttgcccaggctggagtgcagtggtgcaatcatggctcactacagctttgacatcctgggctcaagtgatcctcttgtctcagcctcccgagtagctgggactacaggcgtgcatcaccacacccggctaatttctgcattttttgtacagttggggtttctctgtgttgcctcgactggtctagaagtcctgaggtcaagtgatctgtctgcctcagcctcccaaagtgttgggattataggcataagccacggcacttggcctctttttttttttttttttttgactgagtcttctctgttgcccaggctggagtggacgatcttggctcactgcagcctccacctcctgggttcaagcagttctcttgcctcagcttcctgggtagctgggattacaggtgcacaccactacgcccagctaatttttgtatttttagtaaagacagggtttcatcatgttgaccaggttgggctcgactgcctctttagaatatgcgacagaggctgtttctggccccaaaacctaaaatatttttctggccccttacacacaaggtttgccagtcccgcctgctgctgtagaattttgtgattggcgattacttgagggctgctattcccaagattggggaatgggggccctgggcaccagtttgcattgtaacatgccctccaaacaagcctgttttggaggtctttttgcaaagcagaattgcgatgtctgtggcgggagcgctggccggcttccttcctgctgctcccgtccccaggacaccacgctcatgagaactgtgtctctgcaggctgtggacctcctgctgacgtctttctgtcagaacctgatggctgcctccagtgtcgctcccccggagaggtgaaggcgcgggcagctccctgagtggtggggctcctctgggtgccacctcttgctgggccaagtctgcagaccagggactcatgagctcgtctccgcaggagcatgcggcgatgctgagtttcatcaaataggacgcagcagaagttgggaagcactgcagaagatgggttgtcttccagaaagaccactgttttggggaacagcttggctctttcttcggccgctggtggttggattagctgttggagggatgtgcaggactgaatggctagtactgatggtttcacggctgtctctgcaggcagggtccctgggctgccctcttcgtgaggaccatgtgtggacgtgtgctccctgcagtgctcacccggctctgccagctgctccgtcaccaggtgaggctctccttcatgggggccacccttgggggcccactctgagggccaggctgctacttctcaattcgtcttcagtgccctggaaaattccagcttggaagagggcagtctgctctgccaccctcattctcgttgcagggcccgagcctgagtgccccacatgtgctggggttggctgccctggccgtgcacctgggtgagtccaggtctgcgctcccagaggtggatgtgggtcctcctgcacctggtgctggccttcctgtccctgcgctctttgacagcctcctgacctgtaggacgagggattccttgttcttctgcctgaagtgagctcttcttccacagtcgcgtcttctctcctctctctcgaaaagtgacacatgctcgtttgataaaattagaagagacagacatgcagacataccacccaaagataaccactttttagcattttggtatatatccttccagaattttatctgtcatttgtttataatatgcgtgcgtttgtttctttgttcataaaaatgagatcatattatactaaactgctgaaattaatagtagatagtaactgtctatatcgttaagcattctttgatgtcctggtgagagctgctttgttttgtcttggtcccttgtctggcccttggttggaccagctccctctggtcaggttcttcggcaccccatggtgagtagcttcccagtgtgtacacctcgggctgtttctctagggctcagcagatggggccatgtgctgaggtgaggaaggaccctgtggttaagaatggtctgctcagtgcctcaagggctccctgcagctgccacgcacaggcagaagccaggacagaatcccttcagctgccactcagaggcggaagccaggacagagggctgggagactctggtgggagttgctggctggggcttggcttgtagcttctggtctcttgggcagaggtagcccaggtcgggacagagccctgttgcggtgccggagaccctgtgcgggaaaggggagatctgacattatgacagggtctgaataacagagaacttagaagaggcgcaagaaatgtacgtggagcaaggagagggagtcagatggcagctgtgcggatcccacacctcagacatgggcctcggggagcaggcactcggtactccggggatacagagtccctcctaggcgcttggccacaccagacagtccccactcaccccaggccccaaacactgagtactgggtgttggcatgagaggcacacagccaatggagaagttgggagctggtgaggagggaggcatccaggtggcttgggggagacagggccatcctctcttagaaacacagagatgcctcaggatatatatccaggtgaagaaagcaaaatactgaactcggtctcagatgctactttttgcataagaaagggagaatgaaatatatatttggtgtgtgttttgtttttttttttgttttttggtttttggtttttgttttgagacagagtctcactctatcgtccaggctggagtgcagtagcgtgatcttggctcactgtaacctccgcctcccgggttcaagcagttcttgtgcctcagcttcctgagtagctgagactacaggtgtgcaccaccatgcccagctaatttatgtatttttagtagagatggggttttgccatgttggccaggctggtcttgaactcctgacctcaagtgatctgcccacttcagttaggattacaggtgtgagcctccacgcccagctcaaatatgtattagtaaaacagaagtattagaactgtaagaacaccatgacagtgctttgacatctccattgcctcatggaatctcattctgagcttccttggttacaagtgagaatttttcacatgggtattgctgtaggtatgtatgttgagtaaatgacacaggtctcactgtgtcccccaggctgaagtgatcttcccacctcagcctcccagtagctgagaccacaggtgcacacccacacacccagctagtgagagatggggtctcactgtgttgcccaagctggtcttgaacttctgggtttaagtgatcccctgagctgtgattgtgcgactgcactccagcctgggcatcagagtaaggccctgtataaaacaaaaaataaaccgagggctgggccaggcacggtggctaacgctgtaatcccagcactttgagtggctgaggtgggcagatcacttgaggtcagcagttcgagaccagcctgtccaacatggggaaaccccgtctctactaaaaaaaattaaaaactcgactggttgcagtgactcatgcctgtaagcccagcattttgggaggctgaggtgggcggagcacgaagtcaggagatcgagaccatcctcgctaacacggtgaaaccccatctctactaaaaatacaaaaaattagctgggcatggaggctggcacctgtagtcccagctactcgggagactgaggcaggagaattgcttgaacctgggaggtggagggtgcagtgagccgaaatcgcaccactctactccggcttggcaacagagcaagactccctctcaaaaaaaaagcactaacaacaactacaacagaatcagctgggcatggtgggagatgcctgtaatcccagctacctgggaggctgaggcaggagactcgcttgaacccgggaggcagagattgcagtgagcccaggtggtgccactgcactccagcctgggcggcagagcaagactgtctcacaacaaacgaaccaaaaaacgaaggaccaatgctcaggccatccagttcggaatgcactaaattcagttttatgaaattcaaagtaactttttccttcatcccttattttgtatggattacatttatatgttataatttctgttttcagattttgtacagcagcaatttcttactctctctgcaagttttcttcccagtcacgagatactttgtgcagctgcttatctccaggccttattaaaaaggtaggttcactcttttcctatttttccattctgccatacgtttcaggtttacgcagctttcggaccggaaggccgaggtctgctgccgctttgtgcccatctcaggggcagctcctgggtcaggctggctgtcatggggcagctcctgagtcaggctggctgtcatggccacctctgctgtctgcttaggcagcctgactgctgagtgctgcctttccttgtgttctctgagtgtaaagtgaagttgtatgaagacaactacaagtctgtaattgtaatgaaatagatgttggcatttataggatagatgaattaaaagatcagtattcataataagtatctttccctggaaagaagaattcttattcctctcatctagtaaatgttccttacattgttcagacaaaggaatttttttttttttttgagatggagtcttgctctgtcgcccaggctggagtgcagtggtgcgatctcggcccactgcaacctccacctcccgggttcaggcagttctcctgccttagcttcccaagttgctgggattacaggcacgtgccaccatacccggctaattgttttgtatgttttttagtagagatagggtttcaccatgttggccaggctgttttcgaactcctgacctcaagtgatccacccgccttggcctcccaaagtgctgggattacaggcgtgagccgctggtgcccggcccagacaaaggaatttaaagatgagcattggaaaccctgaatgtcaaaagtaaaggtgaaatggcactgcaaaccagtgttgtccttttataggattttaatgaacgtctcgtgtataaaatagtggttttcaggctgggcgtggtggctcatgcctgtaatcccaacactttgggaggccgaggcgggcagatcatgaggtcaagagatcgagaccagcctggccaacatggtgaaacctggtctctactaaaaatacaaaaattagccaggcgtggtggcgcacgcctgtaatcccagctacttgggaggctgaggcaggagaatcgcttgaaccagggaggcaaaggttgcagtgagccgagactgcaccactgcactccagcctgggcaacagagcgagactccacctcaaaaaaaaaaaaaaataaataaataatggttttcaacttcaggcttcacattagaatcaactgagaagcttttgaaactatagattcctggcccctttccagataaattaagtcagaatctgggagcagcccctgaggatccagggtgcacgtatttccagttatttcctctgaggaactttgtccctggtgccaagtttttaaagaaaacatggagtttgagcttaggagagggcagcgtggttcccacccagcatgctgagcagggacgacagtccttggagcaggctggttataaacatgggaggctctcatctcctcgggggcagagatggacacggtcacgcagcaccaatagtgtgtctggcttgtccagttggtgtgcatttttggtgggaacgccattcctggcagaggcctagagatgggctgtttcactgcccgggaccaaaccagccctacccctgggaggcagttttgttcctgcaattctgcttccagacatttagctcaaggaagcagtcagatggcaggaaggtctgcacataggctcttccctggagcactgtgcacagccatgatcgctgaggggctctgcacccttccaggggctggactgaggtcccctgaacgtggggttgtgtgttgtgccctcccaggggctggactgaggtcccctgaacgtggggttgtgtgttgtgccctcccaagggctggactgaggtcccctaaacgtggggttgtgtgttgtgccctcccaggggctggactgaggtcccctgaacgtggggtcgtgtattgcgccctcccaggggctggactgaggtcctctgaatgtggggttgtgtgtgtgggctgttgatggtctgtttccacctgagcatttgctcagccactcacagtgaaacttgcgcaatgaagaaacggccgggtcactctctgtttcagtttcagttcctcatgttcagattgttctcagaggcccgacagcctctttctgaggaggacgtagccagcctttcctggagacccttgcaccttccttctgcagactggcagagagctgccctctctctctggacacacagaaccttccgagaggtgttgaaagaggaagatgttcacgtaggtgaccgttccttctcctgcatcatgccacgtcctgagtctagggtttgtgtgtgctcctcgggcaagaacagcagcacgtaggtgaccgttccttcccctgcatcatgccacgtcccgagtctagggtgtgtgtgtgccgactgtctcctcgtctcgagtctagggtgcgtgtgccgactgtctcctcagaggcaagaacagcagcacttagatggtttgattggaatcttgactaaaatcgttgtggcctcatgtgcagctcttaagaaattatacagatactgggcacggtgctcacacctgtgatcccagcactgtgggaggccaaggcgggttgatcacctgaactcaggagttcaagaccagcccgggcaacatagtgaaaccccatctctacaaagaatgcaaaaattagctgggcacagttgtgtgcacctttggttccagctacttgggaggctgaggcaagagaaatcacttgagcccaggaggtggaggttgcagtgagccaagatcacgccactctattccagccaggatgacacagcaagaccctgtctcaaaaaaatatattaataaatacagagaaaccctgctatactttctcagtttctcccaacacgaacttctttttttatttttactgatatattttttgagacaacgtctcgctgtgctcagtggtgcagtcttggctcactgcagcctctgcctcctgggttcaagcaattctcatgcctcagcctctccagtagctgggactacaggcgcctgccaccacgcccgactaattttggtatctttagtacagacggggtttcaccatgttgtccaggctggtcttaaactcctggcctcaaattacccacacgccttggcctcccaaaatgctggaattacaggcgtgagccattgcgcccgagaacttgttttttgttgttgttgttgttttgttttttttttctggtggagtcttactctggggcacagtggcgcaatcttggctcactgcagcctctgcctctctggttcaagtgattctcctgcctcagcctcccaagtagctgggactacaggcgcgcaccaccacgcctggctaagttttgtatttttagtagagatggggtttcaccatgttaggctggtctcgacctcctgacctcgtgatctgcccgccttggcctcccaaagtgctgggattacaggtgtgagccactgcgctcggcccctgggaacttgttttaaacatgtctgccaggctgtgtggtggtcactcagggtctctgggctcacccatgtgtgcctggttactggagctggcattgctctcaccagtgtgccttggtactgatttatttctgaggatgtttgcctggttgttttggtctttagaaaagaatttcaaggtggctgggcacagtggctcatgcctataatcccagcactttgggaggctgagatgtcaggagattgagaccatcctgggtaacacgatgaagccccatctctactaaaaataggaaaaagtgatccttctgctttggcctgccaatatgttgagattgcaagtgtgagccactgtgccaagccttttgtgaaattattttattatttttaaattattatttttttttttggagatggaatcttcctctgttgcccaggctggagtgcagtggcacaatcttgggtcactgcaacctcagccttctgggttcaagggattctcctgactcggcctcccaagtagctgggaccacaggtgcacgccaccgcgcccagctaactttttgtatttttagtagagatggggtttcactgtgttagccaggatggtctcaatctcctgacctcatcatcctcccgcctcggcctcccaaagtgctgggattacaggtgtgagccaccacgcccaaccctttttttttttttttttcgtatttttagtagaaacagggtttcaccgtgttagctaggatggtctcaatctgctgacctcgtgatctgcctgcctcggcctcccaaagtgctgggattacaggcatgagccaccgtgctcggcctcctaaaaatgtttttaaaaaacttagctggtcatggtgatgtgcacctgcagtcccagccatctgagaggctgagggggagaattctggagttcaggaggcagagtctgcagcgagctacgattgcaccactgcacacactccagcctgggcaacagaacctgtttccaaaaataaatgaaggtatgctactgtgaatagctgtagaatgttgttgttttgttagtttcttttttcttttttttttttttcctttttatagatagttctcactctgttactcactgcagccttgacctcctgggctcaagagatcctcctgcctcagcctcccaagaggctgggaccacacacatgtgccaccacacctggctgatttttaaatcttttgtagagacggggtgtcaccatgttgcctaggctggtgtcaaactcctaggctcaagcaatctgctggcctcagcctcccaaagtgctgggattacaggcatgagccaccgtgcccaggtaatttttaaatgagatgaggtcttactatgttgcccagactaaaatagccgttttatacttagaaagaaggattacagtactaacatctttgtgctagggaaatcctgtaagaaatcattcttgataaaactaaggtttctttcctgtggaactctcagctgcaatttcattataacacagggacatggaggactgcgtatgagatgaaatgacaaactggtttataaacctgtcggtggattgtgtgttctgtcctcattgtattgaattgcttgctctctttctcagttaacttaccaagactggttacacctggagctggaaattcaacctgaagctgatgctctttcagatactgaacggtaagtgttgaaaagagctaccctggccaggcatgatggctcacacctataatcccagcactttgggaggctgaggcaggagatctcttgaatccaggagtttgaggtcagcctgggcaacatggggaaactccatttctacaaaaaatagaaaagaaattagccggacatgcggcacgttccagtcatcacagccacttgggaagctgagcaggagcattgcttgagcctgggaggtagaggctgcagcgagctgagatcacaccactgcactttagcctgtgcaacggagtgagaccctatctcaaaagaaaaaggagcttccctttaaaatgttacacggttttccacattgccttaaagcctatgtttcgtcattttatcctcaatttaatgtttggtttacctgttaatctttgagcacaatttcaattttttttttttcggtggcaagatttattaaagcaaaagcgaaagtaaagcttccacgcggtggcaatttctgtttttctttttttttttttttttctgagacagagtcttgctctgtcacccaggctggaatgcagtggcgcgatctcggctcactgcaacctccacctcccgggttcacgccattctcctggctcagcctcccgagtagctgggactacaggcgcccgccaccatacccagctaattttttgtatttttggtagagacggggtttcaccgtgttaaccagggtggtctcaatctcctgacctcgtgatccacttgccttggcctcccaaagtgctggcattacaggcgtgagccaccgcgcctggccaggttgcccaatttcggttgttattcctttatttaagaaacatttactgagctcctaccatgtggcagacaattctagagtgttctagaagcagggagtatagaggggaataaacaagcctgcccatatggcacctttgtatcaatgagggcagatgtggcacgtataaggcacccacttagacttcaccctaccctggctgggctatggctgctgtccgggagctgtacacctgtgtccaggccctggcaacacacaggtagatacagaagtggattaaaggtaggaatgagccctggagataacagacagggccgtgtgagaggaaatgaccaggcaggagcagaggctggtgtggagcaggtggtgcagactttgaggagtgatgccagccttgacttgggggcaccaagaagtgggtaaatgaagcagtgaacccccatgagtcccagggctgatgactgagaccatttgagactatttgagaggccagatgtgctgttctgggcataggagtagggagcccagaggaccgttgggtttaagggtgtggagtttagggtggaggtcagggagaggggaatgtggtcactgcagatatggagtatcctggtgggtatatgggcctcagggtgcctgccacacctagactcaggagagggttggcaacagccaccctgtgctcctcgtccttccggccatcaggggccttccaggcacatgcagcactgtcgcctgcacctggatcctggtatcagattctggatgaaaccaatggaagtaataggaaaaggaaaacataggggccacaaaaagaaaactcgctgctgcctgcggcaaaacacgtgctgatggttcaggtcgtgccaagcccgctctgcaggcgcttccttcactcacccccgtttctcctcccggctgctctctggggtggagtctaaggaggaggtcagagggaggggcttgtctgctgcatgaggtcatgctgcatcaggtcaccgctgcgtggaagttgtgttgagatgtgttgcgggattttctttcttttctgaattacttaagtgatacttagatacattctgtgccagttccagacagtgtgggtggagcaccccagttccggacagcgtgggtggagcaccccggtcccggacagcgtgggtggagcaccccggtcccgcacagcgtgggtggagcacccaggtcccgcacagcgtgggtggagcaccccagtcccggacagtgtgaggagagcacacactccctagcactcacatttgcagggtcgtgtggagcgttttcctggttgtggctctttctgcataaatggattgcggtattgatggttctgtgcactgcggatttgtttgtttgtttgagacagggtctcactctgttggccaggatggagtacagtgatgcactcacggctcacggcagcttccctctccagagctcgagtgatcctcctgcctcagcctcctgagtagctgggaccacaggtgggcactactatgcccagctaatttttttattttttgtaggaatggggtctccctttgttgctcaggctgatgtcagactcctgggctcaagtgatcctcccaccttggcctcccacagtgctgggattacaggtgtagccactgcagttttgagtcagtgtctccttgagccccttcccatccgtatccacagagtccacagtctggatgcaggttgcttcaccatccccttctggtgggcctgtgagtagctcaggtgccctcaggtgactttccaggctactttttttttttttttttttttttttttttttagacggagtctcgctctgttgcccaagcaggagtgcagtggcatgatctcagctcactgcaagctccacctcccaggttcataccattctcctgcctcagcctcctgagtagctgggactacaggcgcccaccaccacgcccggctaattttttgtattttgagtagagacgaggtttcaccgtgttacccaggatggtctcgatctcctaacctcgtgatccgcccgcctgagcctcccaaagtgctgggattacaggcatgagccactgcacctgccccagcctacatttttgtgcttgcctattctgttcaccaagctcatgtgctgtgtggccagcagttaccccgtgggatgtcatcctgagtggcctttgatccgtggaaggtggggtcacaaaggtcactcctgagaccaggcctttcccacatccccaggcatcccaccctgcagacagtgaggtctcatccctactccaaggtcccgagccgccagtctcaacccagctctcactagtgctgtgtgtcccttactatgggcctattccctggttatggggaaccgctggccacgaagcatttctcagaattgatagcagtgtttgctgttctaggcaggacttccaccagtgggcgatccatgagcactttctccctgagtcctcggcttcagggggctgtgacggagacctgcaggctgcgtgtaccattcttgtcaacgcactgatggatttccaccaaaggttagcagcacacactgtattagggttctctggagggacaggactaataggatatatataaaggggagtttctggccatgctggtgcccatctaattagcttagggtgggtctgcctttcccagcctatacccaaatgtcagtctcctttggcaacaccctcacagacacactcaggatcaatgctttgcatccttcagtccagtcacgttgacactcagtattaaccatcacacaccgatgaggccttacttttaatcatggtagttctaagaatgcatttttctctcagtccaattttggtatgcaaagtacacttgagcctatcacatagcaaatctatgtcaatacaaaataaagccaagcttcctgcatcggttgtttctttatgtgtatagacttgtcagaagcgacaacttcgggctgggcgtggtggctcacacctgtaatcccagcacttcgggaggctgaggtgggtggattacctcaggtcaggagttagagaccagcctggcctacatggtgaaacctccctctctactaaaaatacaaaaattagctgagtgtggtggcgggtgcctgtaatcccagctacttgggaggctgaggcaggaggattgcttgaacctgggaggcagaggttgcagtgagccgactgggcgacagagcaagactctgtctcaaaaaaaagataaaaatagcaacaacgttgtttttctgttctgtcacctggtattcaaggtgagcatgtgtgaagcacggcacaaatggcctagtagatcctgggcatcacagcctctctccatctgagagggattctcaggacagagcagttcctgaggtgttgcatgtgggccagaaggatggacggagtgtacctggggctgtccaggctttgtccccaggggctcttgtttgcagcttcacactgttgtgttacagctgcagcattcagtacagatggcaagtgtgtatgcagcttccccccatgtctcctgcctgcggcaaccacgaatccattttatgttcatggatttgcctgtttgggatgtttaatatcaacagaatcatgtagtatgtggccctttgtgtctggcttctttggctgagcagaatgtttctgaggctcatctgtgttgtagcacatatcagcatacccttccttcttatggctgactgatgctcacagaaggtatggaggctgacgcacctccatcgtgggtgacttcttgttaaccctactccaagaatgcctcctgagatttcccatttatctgctgttaccttaaatcccactcttaggtcaaaacaaccttgaggctgggcgcagtggctcatgcctggaatctcagcactgggaggccaaggcaggcggatcatctgagctcaggagctcgagaccagcctggtgaaaccgtctagacaaaaaaaaaaattagccaggcatggtagtgtgtgcctatggtcccagctactcgtgaggctgaggtgggattgcatgagccggggaggcagaggttgcaatgagctgtgaaaacaccactacattccagcctgtgtgacagagtgagactccatctcaaaacaaaaaagcaaatcttccaccataaatccagcggttagattcacagagcattcttgcctttccctgaggggttgacttcaatagtccttccctgtggtatagaagccctgcctgggggtaacagtgcagggatgcatcgtctctctaggctgcctgagacatggtttctgtctgtaagtccttaaacgtttctgtctgagaaactggattattcagcctctcttcagccttccagcttccccagcctttatgggtaggtttgcacagagctgctcactgcggaacagaaagatcagccatattttgtttatccattcactttgtttgtttgttttttgagatagtcttactttgtcttatttatatttattttgaaactgggtctttctttgtcacccaggctggggtacagtgactgcagcccactgcagcctcgacctcctgggctcaagtgatcctcctgcttcagcccctcaagtagctgggaccacaggcaccaccatacctggcaaatttttgtagttgtagtagagatggggtttcaccatgttggccagactggtcttgaacttctgacctcaggtgatctgcccgcctcggcctcccaaagtgctgggattacaggcgtgaacctctgccaggcctgacttgatggtagccatcctagtgggtattaagtgctatttgatagtggtttcgatttgcacttccctaatgggtagtgattttgaacatctttccattttcttattggccattttagattttttttggagaaatctgttcacatccttagcccatttgaaaactgggtcacattcatgtactgcataagaatgttctggttaacaacgagccacatatatgacagtaatcccacatagccataattttttgtaccttttttttaaactgtgtttttaccgtaccttttctatgtttagatacacaaatactgttgtgttacagttgcggcatgcaatacagttacatgctatgccggtttatagcctgggagcggtgggccgtgccatgtggcctaggtgtgcgggggctctggtctgtttctgcgcggtgggccgtgccgtgtggcctaggtgtgcgggcggctccggtctgtgtctgtgcggtgggccgtgccgtgtggcctaggtgtgcggggggctctggtctgtgtctgtgctcttggatgttcacgtgatgaaaccacctaaagatgtgtttctcagaatggatccttgtcattgagcagttcatgactgtatttgtcttactgagttgtatgagttctttatatattttagataaagttcttatcaaatatatgatttgtaaatattttttcccattctgttaattcttttttcactctcttgatagtatcgtttaatgcacaaaggttttaaatttttataaagtccagatcatttatttttagtttagctctttaggattttgattcattttgatggatcagaaaacattttgggccagccacggtggctcacgcctgtaatcccagcactttgggaggctgaggcgggcagatcacttgatgtcaggagttcgagaccagcctggccaacatggcgaaactaaaaaaatacaaaaactagccaggcatggtggcaggcgcctgtaatcccagctactcgggaggctgaggcggcaggagacttgcttgaacctgggaggcggaggttgcaatgagcccagattgtgccactgcactccagcctgggcgacagagtgagagactgtctcaaaaaaaaaaaaaaaattgttgtgtgaggtcatccagctttattctgttgcttgtggccatgcagttgtcccagcaccatttgttgaaaacacttctttccccactgaatggtcttggcacccttgtcaaaagttagatggctgctcgtgtgagggtttgtttctggctctcattgtgttcccttggtctgtatgtccatatgcactgcgtcattgggatgaagctttgtagtaggttttaaaattgggaagtgtgaggcctccaacttggttcttctttttcaggatggtttggcttttctaggtgctttgtagttgtgtcttaattttgggatgagcttgtcagtttcgacaaaagtagctgggaccctgatacggactgcatgtggggcagtattgccatctcagtgatagcgagtcttctttccttttgaatcatttgttgctaacgtatagaaacaccagtgattcttgtatattcattggctctagtcatttattagttctaagagtgtttttgtatcgattccttagggctttgtatatataagatcgtgtctggccaggcatggtggctcatgcctgtaatcccagcactttgggagggtgaagtgggcggatcatgaggtcaggagttggagaccagcctggccaacatggtgaaaccccatctctactaaaaatacaaaaattagccgggcatcgtggtgggctcctgtaatccgttacttgggaggctgaggcagaagaatcacttgaactcaggaggcagaggttgcagtgagttgagatcatgccactgcaactccagcctgggcgacaagagtgaaactcagtctcaaaacaaaaaaacaaaagaaagatcatataatatgtgaagagagatagtttcactttttcctttcctatctggatgctttttctttttcttgttgaattgccccggcttgaactccccgggcagtgttgttttttttgttgttgttttgttttgtttttttttttctgagacggagtctcgctctgtcacccaggctggagtgcagtggtgcaatctcggcttaccgaaaccttcgcctctcaggttcaagcgattctcctgcctcagcctcccgagtagctgggattacaggcacccgccaccatgcccagctaatttttgtttgtttgtttttgagacagagtgtcgctgtgtgtcccaggctggagtacagtggcactatctcagctgtctgcaacctccgccttccaggttcaggcaattctgctgcctcagcctcccaataggtgggattactggcgtccgctaacacgcccgtctaatttttgtatttttagtagagatagggtttcgccacattggccaggatggtctcgatctcctgacctcagatgatctgcctgcctcggcctcccaaagtgctgggattacaggcgtgagccaccgtgtctgtccccagtgcagtgttgagtagaggcagcgacactgttctgagtgtagagaggacatccttgttgcccctgatcttaggagaacagctttcagtctttcctcattaaatctgacgtttgctgtgggttttcatccatgccaggcactagattgagaagatttcctttgttcctggttgattgagtgtttttatcacaaaaggatgtcacatttcgtcaagtgctttttctacatctattgagataatcttacggtttttgctttttattttattgataactgcgttatattggtttggggatcttaagctatccttgtgtagggaccagccccggagggtcggtgggtctctccctgtgtgcggcgatgagagagtgtagaaataaagacacaagacagagataagagaaaaggcagctgggcccgggggaccactaccaccaatgcgcggagaccggtagtggccccgagtgtcgggctgcgctgttacttattggatacaaggcagaaggggcagggtaaacaatgtgagtcacctccaatgataggtaaggtcacgtgggtcacatgtccactggacagggggcccgtccctgcctggcagctgaggcagagagggagaggagacagagagaaagacagcttacgccattatttctgcatatcagggactattagtattttcactaatttgctactgctatctggaaggcagagccaggtgtacaggatggaacatgaaggtggactaggagcatgaccactgaagcacagcatcacagggagacggtgaggcctccggataactgcgggcgagtctgactgatgtcaggccctccacaagaggtggaggagcagagtcttctctaaactccccgggggaaagggagactccctttcccggtctgctaagtagtgggtgttgttccttgacaccttttgctaccgctggaccacgatccgcttggtgacgggcgtcttcccagacgctggcatcaccgctagaccaaggagccctctggtggccctgtccgggcacaacagaaggctcgcactcttgtcttctggtcacacctcagtatatcccctcagctcctatctctgtatggcctggtttttcctaggctatgattattgagtgaggattatcataatattggaataaaaagtaattgctaccaactaatgattaatgatattcatatgtaatcatatctaagatctatatctggtataactattcttgttttatattttattatactggaacagctcgtgtcctctgtctcttgccttggtgcctgggtggcttgccacccacatccttgcattcttgggataagcctccttggtcatggtacataatttttgtatttcctaggttggggttggtagtattttgtggcagtttttgttgtttattgttgactaatgtgagggtcacactgtcagagaagcacagccatcactcagctccggaggcaggaggagaactgggaacttcagcactattaggcgatactgaggaggattttattgtattttcatttcagctcaaggagttatgaccactcagaaaattctgatttggtctttggtggccgcacaggaaatgaggatattatttccagattgcaggtgagtttgagggtgccacaactcagtgcattcacttcatttaagccgcgtgctattaagatatttattgccaggcgcggtggctcacgcctgtaatcccagaactttgggaggccgaggcaggcggatcacacagtcaggagatcgagaccatgctggctaacacgatgagaccccgtctctactaaaaatacaaaaatttagccgggcgtggtggcgggcacctgtagccccacctactcgggaggctgaggcaggagaatggcatgaacccaggaggcggagcttgcagtgagccgagattgtgccactgcactccagcctgggcgggcgacagagtgagactccgtctcaaaaaaaaaaaaaagatatttattgttggctcaggcttgtaatcccagtactttgggagtccgaggctggtggatcacctgaagtctatacaggtaggcagcatgtacctgtgtgggttcactgtcagtcaacaggcatttactggtgctggccacccgtgcgtcttctgtgccaggcccctgtctctccctccgccagctctggggcctcccaactccttagccagatgctttccctagacccacctggctccttctcagtgagaccatctgctttttcctcttaattgtaatcataattattattattattgggacagggtcttgctctgtcacccaggctagagtacagtggtgcgatcatatctctctgcagccttgacttcctgggctcaagcaatcctgacagcgtgcacctgtgtgcgccaccacacccagctgattttttgtagagacggagttttgccatgttgcccaggcttgtctcgaactcctgggcccaagtgaaccacccatctcggtctccaaaattgttggattacaggcgtgagccactgcacctgatctttattcttctttaaaaaatacagccggccaggcacggtggcttatgcctgtaatcccagcactttgggaggctgaggtggctagatcacttgaggtcaggggctcaagaccagtttggccaacatggtgaaaccccatctctactaaaaatacaaaacactagtcaagcatggtggtgtgtacctatagtcccagctactcaggaagctgacttaggagaatcagctgagctcgagagtcaaggctgccataagccaagactgcactgccgcactccagcctgggcaaccggactgagactgtcctaacaacaacaacaacaacaaaagacttgtgaggcaaaaatgatgtgtggggtaaaatgttagccagaggttaatctgggtgaagggcacatgagtgtcctcctgctgtttttttttgttgttgttttgttttgttttgtctgtttgtttttgagacagagtcttgctctggagtgcagtggcgggatcttggctcactgcagcctctacctcccgggttcaaactattctcctgcctctgcctcctgattagctgggattacaggcgcctgccaccacacccagctaatttttgtatggctaattttgttggccaggctggtcttggactcctgacctcaggtaatccatctgtcttggcctcccaaagttctgggattacaggcgtgagccaccatacctggctgtttttttttgtttgtttttttttgagacggagtctcactctgttgcccagtctgaagtgcagtggtgcgatctgggctcactgcaagctccacctcccgggttcacgccattctcctgcctcagccgcctgagtcgctgggactacaggcacccgccaccatgcccagctaatttttttgtattttttagtagcgacagggtttcaccatgttagccaggatggtctccatctcctgacctcgtgatcctcctgccttggcctcccaaagtgctgggattacaggcatgagccaccacgcccagctgttttttcttaattgataagtagttgataagtagtactgtaactcctgggctcaaggaatctgcctgcctcggcctcccaaagtgctggcattacagacgtgagccacagcacccggcctgcactgttctatatttgcaatttcaaagtgatttccaattgaaatagcttgccccacttgttccttcttgccctgtccactgtggagacctctccctgacccctgacgtctgggtccccgactggctgggcagtgagccccgaggccttcctgtgccagcatactgctctttttcaggagatggtagctgacctggagctgcagcaagacctcatagtgcctctcggccacaccccttcccaggagcacttcctctttgagattttccgcagacggctccaggctctgacaagcgggtggagcgtggctgccagccttcagagacagagggagctgctaatgtacaaacggtaacacctactaccacctgggcagggcagcaccacctgggcagggcagcatctcatgacggtcctagaggttctttgtagtgagtttgtttcccgttacttacttgtctgtgtgtccccaccccaagcctgtccatttctgtggcacatgccacggagaagaggatctggagggttgaaagtacttttgattaaaaccttccagccaagcgaggtggttcatgcctgtaatcctagcattttgggaggctgaggtgagtggatcacctgaggtcaggagtttgagaccagcctgaccaacatggcgaaacgccatgtctactaaaaatacaaaaaaaatacaaaaaaatttagctaggtgtggtggcgggcacctgtaatcccagctactcgggagactgaggcaggagagtggtgtgaacctgggaggcagaggtttcagtgagccgagatcacgccattgcacaccagcctgggcaacagagcgagactctgtctcaacaacaacaacaaaaccttcctgctcagacgtggagggacgtcgcagaaggagctcttgtgaaagtagggaaaagtgttcagaaatgcccacggcggctgcatttataagaagcagcgtggagtcatttaattttacagtcatagggaattgcttcactagacagactggtgcgtcatccacttggttatcgtgtaactgtcagaagttgttggttattatgtaactgttaaaagttgtttgtttggtaacacattttgaatgcagtgggccaaacacagtataggggaggtgggctcagagtgcaggctttggatgggacagagggacacaggccaaggctctggttccaacagtggccctgggtttcagggtggtggttgctgctctgagagtctgagcccttgggaaggagcagagtgtacgctgtgctgtcgccaccaatacagccccttctttccaggatcctcctccgcctgccttcgtctgtcctctgcggcagcagcttccaggcagaacagcccatcactgccagatgcgagcagttcttccacttggtcaactctgagatggtaggtgccccgtgtgcacgtgtccgtccgatctgtcagtgcctgtggcgctaacagcagctcttgcagcctccatgcgtgtactgaccgtgtgaattactgaggaaagggttcaaagtcaaatagggaacagtgtctggaatgccatgtgagggaggaccccacccacagccaggacggcgaccagcacatcaccaaaccagctgtaggttgccttctcccaagtttgagttcctttagtttccctcaagttttaatgattttgacacatggaatcgtacagaccattttgtgtgccacgcacctcggttcatttatttctaatctcaacatgcttcatgtgtaaaaaaagccttgtggtgatctgactaccgctgttgcctgccaggcagcccagttatcttccattttagacactgcccagcgtgagttgcagggtgatcttaaccagcaggctgggtgcggtggctcacgcccgtaatcccagcactctggaaaggtgggggatcacttgagcccaggagttcgagaccagcctgggcaacatgacaaaaccctgtttctacaaaaaatagaaaaattagctgggtatggtggtgcacgcctgtactcccacctacttgagaggctgggtcaggaggagtaattgagcccaggaggcagagttgcactgagccaagatcccaccactacactccagcctgggtgacagagcgaaactcttgtctcaaataaaaagaagtgacactcgctgtggggacgggcagcgtagggacccagttggtcagagctggggagacggataccagcccctcccactctacagagagcagcttctgctcccgaaggcctttttcttgtttttgaagatgcacaaatgtgagagatggaattcaggttccatgccagctgtgcagcattttatatttttatttatttatttatttatttattttttgagacagagtcttgctctgtcgcccaggctggagtgcagcagtgaaatcttggctcaccctgcaacctccgcctcccaggttcaagcgattctcctgcctcagcctcctgagtagctgggactacaggtgcctgccgccatgaccggctaagttttgtatttttagtagagatgacgttttaccatgttggtcagtctggtcttgaactcctgacctcgtgatccacccgccttggcctcccaaagtgctgggattacaggtgtgagcccggccttgtgcagcacttcaaaatgtgacaaggaaagcagaggacgtgagactagcaaaagctttcagaaaatcactatggtctcctttgaattcttatgaatggctgtttttcagaaagctctcagttggcacgtgacagccgacagacaggaaaacaccatagacagcacttggttagtgaagggaccagaggatggttggcccttggtattagtgtcgtcctcaccacagttctacgctccgggtgcgtccccttccctgcggctgcttgtgcctccctggcttcttcctggagcctacaagactgtttgggccagagctggtgggctgcaggatctggccgcccagggaagccgttaagtttcaggacagcacagccagggcgccaggcccggtcagcccaggagcaccatccatggtggccacgccaagccttagcgagtgtttttctcaaaactgaatccacagcagccactctgcatgttggtctcgcctctcttcctgtgggcttttcttacctgccttgaactcttttgcagagaaacttctgctcccacggaggtgccctgacacaggacatcactgcccacttcttcagggtgagatgctccctcagcccctctcgtggccttctcagaacgccgtgggtggatcctcctgtcagcttcctgtgagttccttcactctactagttgtgggtcctcacaaaccgctgacctcctgctgcgttctctcctgcagggcctcctgaacgcctgtctgcggagcagagacccctccctgatggtcgacttcatactggccaagtgccagacgaaatgccccttaattttgacctctgctctggtgggtcagctgtcttgtttggtgttttgttttggggatgagtgggagactccacagctgcctctggcatctctgcagcacgtctccatcacgggtgttaccatctcagggaaaatgcatcaggagacatggaagccacagttaaagatgccagctcatagcagatgagggccgcacatcctgagttcccagaaccgtccctgcccccaccgccgtcaccatggcacccgcaggacttctcccctgtggaccccactcagaccccacgggcaccttcatgtccacaggggtgcagggcttgtttgttcacggtcttgggttgtgcactggctggaggctgtacggtggctgcctgtgccccgtcacgagagcatgactgtggcccacttgcgcctgactatgctttcttgggacttcggagcagagacttcacctcagctcccgccagagctcagcaggctcccctagcagcccagggtcccgagagtgggaggagggcagcatttccctcacttccctggcggctcacttagtcctgaagaccacagctgtcgcccttccttctcggtcatcagggacaggagggcctttttctccgcagcacggcatgttccccagggagctccccaagcaggctgcatttgcaccgagttgtagctcagttggtggaattcgtgagaaatgaactcttcggtgtttagaacgccacctctcagctgagggcatccaaggaccaggcattcccagctcagggcagtgtggtctcttcactgtttcgttcccagctcagaggagtgtggtcccttcactgtttcgttcccagctcagggcagtgtggtcccttcactgttttgttcccagctcagaggagtgtggtcccttcactgttttgttcccagctcagggcagtgtggtcccttcactgttttgttcccagctcagaggagtgtggtcccttcactgtttcgttcccagctcagggcagtgtggtcccttcactgttttgttcccagctcagaggagtgtggtcccttcactgtttcgttcccagctcagggcagtgtggtcccttcactgtttcgttcccagctcagaggagtgtggtcccttcactgttttgttcccagctcagaggagtgtggtcccttcactgttttgttcccagctcagaggagtgtggtcccttcactgtttcattcccagctcaggggactgtggtcccttcactgtttcgttcccagctcaggggagtgtggtcccttcactgttgcgttaggccaggctcttccttctccaaattccacgtcttccatgagtgtgggtaataaatgcctcatggaactgctttgagccttaattgacgtaaaaaatactggctttggagttccagagcgcagggcgagtgtgggcctgtagtggcctgtaggagcactgggggcttgtcatggctggggcagcggaggtgtgtccatctcagccaccctcatctgtgtgctggtgctctctccataggtgtggtggccgagcctggagcctgtgctgctctgccggtggaggagacactgccagagcccgctgccccgggaactgcagaagctacaagaaggccggcagtttgccagcgagtacgtgtgggtggtgagatggggtgtgcccgcccagatgcacttcgggacctgctcaaggtcatctcctaaacaccctggcttgcttgagagaagcggtgtgggcagcctctcgtgtgagcagggagaaaagaaccgagttctcgtggtggtgggcgcctgtaatcccaactactggggaggccgaggcaggagaatcagttgaacccaggaggtggagtttccagtgagccgagatcactccaacggccaatagagcaagactctgtccagaaaaaaaacaaaaaaaaaaacagcctctgccagtgtctcgtctgagtgaggaacggcctctcccaggctcccgtctgagtgaggagctcgagtgattcctttgcacctgctccccttcctcttaaatctaatgtgggctcctagagtgcaccgcgtgctggtagggtcagtgtcatggggacctcagggatgcagattctcagcctaccctgacctgtcgaccccagtcagatattcacgggtccttgcaaaccatcaagctcctggcgcaatccaggctcacacacccttctgaggaccacagagctgacagccactccacctgctgaatgtgggtgccgtgttcttaaggggtcgtcagagggcactgctagtacccatcctgcctccttggagaacaccttactttgtgactagttttgaatcactgatgccacaccgggtcccctcagggtttggctgctcgccgtctgctgaaagaagagaagagggccccggcgcggtggcgcacacctgtaatcccagcactttgggaggccaaggcaggtggatcacctgaggtcaggagtttgagaccagcctggccaacatgtgaaacaatctctactgaaaatacagaaatgagctgggtgtgatagtgtgcgcctgtagtcccagctactcaggaggctgaggcaggagaattgcttgaacccaggaggtggaggttgcagtgagccgagatcatgccattgtagtccagcatgggcaatgagagagaaactccatctcaaaaaaggagaaagcaggtcacacctccagttctaattctacaaacacagatcagattgtctgaagttttgttttttgttttgttttgtttgagacagagtttcactcttgtcacccaccctagagtgagatggcacgatctcggctcaccatgacctccgcctcccaggttcaagcgatcctcctgcctcagtctcctgagtagctgggattacaggcgtgagccaccatgcctggctaattttgtatttttagtagagacagggtttctccacgttggtcaggctggtctcgaactcccgacctcaggtgatctgcctgcctcagcctcccaaagtgctgggattacaggcgtgaaccaccacgccctgcctcgtttttgtttatttgagattgagtctcactgtgttgcccaggcagatctcaaactgctgggcttaagcgatcctcctgaagtgctatgattgcagatgtgaaccgtcatgcccagcttatttaaagtctcttaaaccacagcattgtttcattaatttcctaccaattttttaaccagccagaaaactcagacaccacactggggccagagccaggcagtcctttgttctctgttgtaggagggaatgcctgatccacagggccaggcatgggcaactgaggaaaatgaggcctcttcttccaaaatgtaggcagctggggcccaagagcacagggcaaggtagacaggaccaggccagctgcctgctcagtcagcagctctcagaacgccaggatgctgtgggggcagcaccagcacctgcccacactctcacgtggacctgggggatgcagacctagtttctgatggtcctgaaacccttctctgtcctctgatggaaaggcaggccccaaaggtgacaggtgggaataaggacttggtttctatggcgtggttgtatggttgtaaggccctgcaatgaccccgttctctctgtcccagtttcctctcccctgaggctgcctccccagcacccaacccggactggctctcagctgctgcactgcactttgcgattcaacaagtcagggaagaaaacatcaggaagcagctaaagaagctggactgcgagagagaggaggcaagataggaaattcttttactgatttattttctcgcaagcttggtttcaatcagtgctatttctctgggcttgtctgatgaactgtttttctaaagacaaatatgtggcttggagcaagactttttttttttttttttttttttgtatttttagtagagacggggtttcactgtgttagccaggatggtctcgatctcctgaccccgtgatcctcccgccttggcctcccaaagtgctgggattacaggcgtgagccaccacgcccagctggcttggagtaagactttgactatcaagtttactagtaaaaataataatttcagttttttaaatggttgtatgtagttgagacagggtctcactgtcgcccaggctggagtgcagtggtgcagtcagctcactgcagcctcttctgggctcaagccatcctcttacctcagcctctggagtagctcagactacaggtgtgtgccaccatgcccggctaattttgtaattttttctgagatgggggtctgtagtccaggcatggtggctcatgcctgtaatcccaacacttagggaggccgaggcaggcggatcacttggtgtcaggagtttgagaccagcttgggcaacatggtgaaaccctgtctctactaaaaacacaaaaattagtcgggtgtggtggtgcgcacctacaatcccatagcctgtaaagctactcaggaggctgaggcaggaggatcacttgaacccagggggcagaggctgcagtgagccaagatcacgccactgccctgcagtctgggtgacagagcgagacttgtctcaaaaaaaaaaaatttgtttaaagtaaaaattaaaagagatgggggtctcactgtgttgcccaggcttgaagtgcgtttcttcagcttatttttatcctcatcacagcccagcgtaaatgctgtcagccttcaagtggtgccttctgtgttcatgctgcagtagccttgattcatgtgctgagggacagccccagataagcttgcagtgagacagctcagacctggggtgctggggacaagaggcagcaaggatgggaccgtctgcagccataggcatagggaaaggagtgggagaggctgctcttgaattccaggccagggaccatgttcgactcagacccactgcccacctggttgctgcaccctggaaagcctgactgcccccacaagaccagtgacacccacacagctctctgtgcagggagccaagggtggtgtgtgcagaacaggaacagaaacaagcatcccacaagagagctggaggcagcagccctctgtgcccagcccgagatccgcaacgcataggtgccatgtcagcacacaacttacaccagctcaaagctggatcgacagcagcgcccagggttttggtgattataaccaccctgcaggggttcttctgagtacgtcttcaggtttcttgtgtagttttgttagaagggattttagtggctccagggccttaggaccctagtgtgcagcgaggagtgtccacagagaccctgcccagtcaggccctactttaggctggagcctgtgggcttatcttcaaggattttacaaacacttctgacaggaggccttgcagggagatgatgctgagttgggactgcgcacagccaaggagaccgcagcagtcttctctttctggctcttgtcactttttcaaactgtttctagctttgtttaaaggcaagtgtgaaatgacccagccagtagtaattaattctcaattaagctgtctctctagaagtgattggaaagttttctaagatccacttaaaggatttatggcctagatgtaaaaaatttcaattaaagaggaatgtgtcagccttatttagaatgacagcacaggtaattttaatgtaataataagtgcacgtttttatttacagctattggttttccttttcttcttctccttgatgggcctgctgtcgtcacatctgacctcaaatgtaagtcagaccttaccagccaaggtgtcctctcccactgtgggccaggcaggggcaccaggcagccagcttccaagtcagggtttccagactagctcaggagctccttgtgtttgcggaagtgtgagtgagaactcccaggccgtgggttttttttttttttttttgagatgggggtctcactctgtcacccaggctggagtgcagtggtgtgatctcagctcactgcaacctcagcctcctgggttcaagcaattctcctgcatcagcctcccgagtagctgggattacaggcgtgagtctgtcacacccggctaatttttgtatttttagtagagacggggtttcaccatattgccaggctggtcttgaactggcctcagtgatccgccgacctcggcctcccaaagtgttgggattacaggcatgagccactgcatccggcctgtgggcctttcttttaatgtcttatttgaggacgtggtgcagcagccttggtgtgggtgctcgaagtccctggcctcctacctgagcctcttctgtccagaggcccagtattaccttctataggtaaaactgtcaccagttttaagacttacaataagcaaagaggaaatgccctcttctgtgctgagggctgtaccctcctacccatgggagcaccaggtcggccattctcagggttggtctcctgcggtttacagagcaccacagacctgccaaaggctttccacgtttgtgcagcaatcctcgagtgtttagagaagaggaagatatcctggctggcactctttcagttgacagagagtggtaagaaacacgctgctgaggcacaaatgcggagggccgctcttttcagaggcatcttgcaaatggttaagaacgagccctccttgaggttccttgctaagtaagtttataagctccattttagttgggacagattaagcacaaacttgtttaaagcaataagataatttactggctcactggtcaaccccaggaccaatgggcctatcatggggactgcctctctctgcaccacacccaccctcctgcaagaggtcgacccccccatcctctcccagctgctgacaggtacctgggtatcctcagctcaggctgttcgccccacactatccccacagccaggcctcccagggtacacgtcccgacccccaggggtgtccccagcactgataataggcagagatgtccagagttgcctgagccacttcttggtgttgcagacctcaggctggggcggctcctcctccgtgtggccccggatcagcacaccaggctgctgcctttcgctttttacaggtacctccacccacagggctggtcagggctgggcagtgtttcccagacccccatctcagcacctctgggtcccgccagatgggaagggttgtctgtgcctctgctccacagatgagcagtatcccttggcatcacctgctacctttccagcagtctgtagccatttgtcactatgtctttacctctagtcttctctcctacttccatgaagacgcggccatcagggaagaggccttcctgcatgttgctgtggacatgtacttgaagctggtccagctcttcgtggctggggatacaagcacagtttcacctccagctggcaggagcctggagctcaagggtcaggcaggtgcaagggccagtcccacctccaggggagctccccccagccggaggctccttctgccaaagaatgttccggcacagcatgcagactatgggggacacaccagccctgtttctgtatgtcttctaacctgtgagtttgcctgttttctctctagggcaaccccgtggaactgataacaaaagctcgtctttttctgctgcagttaatacctcggtgcccgaaaaagagcttctcacacgtggcagaggtaacgtcaagatgcccaccttgggccatgtgggggacatgagaattgacagctgcctgggccatgtgcctgcctggctggcaatacaactcgactatttctgccagagcccctcccctgtggtctgaggcctagtgggcggcatgggctgaggacctgctcctctctcacagctgctggctgatcgtggggactgcgacccagaggtgagcgccgccctccagagcagacagcaggctgcccctgacgctgacctgtcccaggagcctcatctcttctgacgggacctgccactgcacaccagcccagctcccgtgtaaataatttattacaagcataacatggagctcttgttgcactaaaaagtggattacaaatctcctcgactgctttagtggggaaaggaatcaattatttatgaactgtccggccccgagtcactcagcgtttgcgggaaaataaaccactggtcccagagcagaggaaggctacttgagccggacaccaagcccgcctccagcaccaagggcgggcagcaccctccgaccctcccatgcgggtgcacacgaagggtgaggctgacacagccactgcggagtccaggctgctagaggtgctcatcctcactgccgtcctcaggtgggttcgggcttcaccgcctggccctctgtggtcacagaggggctcggtggcccaggtggtggttccgcctccaggggcagggccttgtcctgggtctgtgtcagcgggtgcaccatggacatgtgtacattgaggttgtgggccttctcaaaccgccggccacactggtcacaggcaaagtccagctcagtctcagccttgtgtttggtcatgtggtacttgagggatgcccgctgcctgcactggaacccacagacctcacacctgggggacagaggcagataagaaggtgcgagggccacagccctgggagggggtcctgactcacacttactgcaaaggcttggctcccgaatgtcgcatttggtggacgagaaggtgcttccgctgcttgaaggtttgtccacattcgtcacagatatagttccgcacctctgagaggggagagtccagtgagtccaggcccctgatgctccaacctcccggggggacgacgatgacaatgtgaaaccatcacagctgggaagacatttctgcacatggttcaccatgcagtgggcccaagcaaggggcctatgagggcctcgtttattaagatctttaaactgctttatacactgtcacgtggcttcatcagctgtgtgcatttcaggatggtttttaaagaaacctcagaaagctatttccttaa

SEQ ID NO: 754 - DNA, 178454 bp, Homo sapiens
gtgagggccaagcaggaacaggggtcacggggcaaggagcacgtggcagcgcaggaaacaggtacatgggggtagaggacaagggagcagctgaagggcgcgttggtggcgggacgtgaggcaggggaagcagtggtggtgggaggagggggccgggcggggtgctttggggcaggcgggtgggggaagcggcgcatggggggtccgggatgttggggggtgcgggcgtggaggggggcggggccgagccgcgggggttgtgagaggggccgcggaggtggaggtgggggtgagagtgtggggtggcgtgtgggagcggggcccggggtgctcaccgggcgtggcctgcgccagggcggcggcgcagctgcagctctcgcggcgcacggcggcgaaggggtcgagcagggagcagcgcagcgcgcgcagagcgtcgtccaggtggggcgcgagcgcggcgccgcacaggtccacggccaggcccagcagctgcacaagcgccaggcgcagctcctcacaggcctcgggcgggcggcgcgcgggcacggggccggccaagcgcgcggcgagcgcgggcagcaggcgcggcagggcatcgcggggccgcgcggcgcggcgcaggcccagatccagcaggtgcactgccagcgcgcggcagccctcggcggggtcgctcaggcagcgcagcaagcgcggcagcagtaggcgcgcccaggggccctggaaagcggtggggtcggcggcagggcctggctcctccagcgcgcgccgcagggcctccaaggcgcgccgccggcccggcttgctgtcggcctccagccccggcagcaggcggctcagggcgcggctcagctccaccgcctcagccgtctcggccccctcagccgggtgtggggccgccacggcctccgccacccccagcgccgccatcttgcccgcgtcgccggtcactaaggggaacagcgctttcgcgactctcagcgcagattacggcagcacttccggtccgcgctgcgggcggggcgccgggctacttcctccccgccggtgcgcacgtgggcctgtgctcttgtcgtgctcgcccgctgtccccctctgtcgccggaacccccgccagcctgcctgctgggccttgtcctgtccccattgtacagatggggaaggtctcgggagggtgcagctcgcccgggatgcgggtcccgggctataggcctgggcctgcccctagggaagcctgccctgcagcctagggggcttggagaaggaacctgagtggtcccgcctgggaccagggtagccgggaagcccctgtttgagccgcctagagcccctctggctttgggaaggtccgttccaggagggaaggacgctggttctgtggactggatccccctgtggtgtaagacaggtgcctggtctgggcttcacgtgcagcctgtcattagatctcaggcgtagccgcccaataggttcgccttactcgctgcccaggtagagccaatttatcaagacaggggaattgcaatagagagtttaatgcatgcagaaactggctgcatgcagaaactggctgcatgcagaaactggctaaaggacactggagctttattgctcaaaccaggttctgaaaatcctgagatgggtcatctaaggataattaggcaggtagggggccagggagagggcagtgcttattggtcgggttggagatgaaaccatggagagtcaaagttgattctcttgctgtcttctgttcctgggtgggatcacagaactggttgagccagattagtggtgtgggtggtggcacctggtgcatcagaatgcagagcctgaaaaatatcttgagcaccaatcttagagttgatgatagtggtgttatcctaaggagcaactggggaggtttggaatcttgtggcctctagctgcatgactcaaaccacaatttctaatcttgtggctcatgtgttagtcttacaaaagcattctggtccccaggcaagaaggaggttggcttcaggaaagggctgttatcatctttgtttcaaagttaaactataaactaagttcctcctaaagttagcttggcctactcccaagaaataacaaggcagcttggaaattaaaagcaagacagtgtttcacagtagtgaccttgactgtggacttgagtggagacagaggcgcctaaacagcttggagtcggagttgctgtgagcccagcctagaacgcgagtttgacagcactcactgcaaaccaggagtccccaagtctggttagccaggcacttctcatctgtgaccatgcactgagttttctaaaggcagaatgtgtgtaattttaggacagaacttcaagtttgaccttcttttttgttgttgatcttcgtgttgcaaaatggtggtgtttgtcggtacgtcttttttttttttttttgagatggaatcttgctctgtcgcccagcctggagtgcagtggcgcgatctccgctcactgcagactctgcctcccaggttcatgccattctcctgcctcagcctcccaagtagctgggactgcaggtgcccacgaccacgcccagctaattttttgtatttttagtagagacggggtttcactgtgttagccaggatggtctcgatgtcctgacctcgtgatccgcccgcctcagcctcccagagtgctgggattacaggcgtgagccaccacgcccggcccatcagtacttctgaaaagttgttatgtagcatattcagtaaccttcattcattgtttcctccaacaggcatttgtttgaccaggcactgtctgcaacatgtgggacaggatgacaatgatgtagaaactggccatggtccctgctctcccagatcttagggtcttgcaggatgagatagcccttaatggaaggataaattagtatgtgtttaaccgtggtggtcctgagagaatgagtgtcaagggatgttgaactagacttttaaggcttccctgaacaaatggtagcagaggtgaaatatgaagaataagtaaacacagtgtattagtccattttcacgctgctaataaagacatggccgagactgggtaacttatacagggaaaggtttactggactcacagttccacatggctggggaggcctcacaatgatggccgaaggcgggaaggagcaagtcacatcttacatgatggcagcaggcaaagagaaaatgagagagcctgtgcagggaaactcccccttataaaaccgtcagatctcgtgagacttattcaccatcataggaacagcacaggaaagacctgcccccattattcagttacctcccactgggtccttcccacaacacgtgggaattgtgggagctacaattcaagatgagatttgggtggggacacagccaaaccatgtcacatagccaggtgaaagggcggaggtgggagacggggagtgttggagagagaggaaatagcatgagcaaaggcctcatgggagtgttacgggctgaatggcgtctccccaaaattcatatgctgaagtcctaacccccatagttcaggaagtgatcctgtttggagacaaggtctttgcagacgtgattgaggtgagatgaggtcatgaggttgggcactcatccaatatgactgctgtcctcataaaaggagaaattttggagatagacgtgcatacagggagaatgcagtatgagcatgaagagagacctcaagaggagccagcccgtaccctgatcttgagaaatcaaatttgtttcattcagctgcccagcctggtgtgctttgttacggcagcctcaggtagcaaacagggagggaggctgaccctggtcacaggggagcaggcagggagtgagcagatgggtggggccaggccatgggggcctctgtcctaaaacatggcagactgaggatttcaaggtgggagcattggcaagatcgagtctgcatttttcaaggacccctttggcttccgttgaacggattggtcgggagccctgggaaggctgtggcagtgagtgctgaagacgagaaagaataagcgcttgaattacggtggtgggacttcacttttccttgctcctcccattgaaatacaacaaaataccctgcacatagcaggcgacgaggaaaggagcttgagagttgacagacgggctggagacctctggactggaggaatagcaaggtggtgggtcccctgggttttctttttctctcatgtgttcctgcactagtccccagggaagcctgtggcccagaacagccaacaggcacagacagaaattctccaaggaaagcctcctctctctggccaaagccctgggaaaggggacgcccaacagagacctagagggtagctgccaccttcaccccacagtctgctttcagggccgattttaaagctgctgcaggtgcattaacctgtgctgtgcaactggggttcgagtggacagtctgcactgcacaggtagtgtcagaggagcctgaaatctgcccttcctctcttagcacaaagagacccagaacgagcatgttctgtcctgacacagcaaaaggtagcccagtgacaccaggcggcccagggaggtacctttcacccctgcaggcagcacccatgggaaatgagcagcagtcccaggagagccagaagaataaagcagacgaggagggcagtgccagggctctgaagacgaaactgctgttggaatgacagaccacaaaaacaggctgcaatctacaccctggacctgaacagagcaactgcctggtggaatagagtaggacaaggagtctgcaaacatcgtaacccaaatgtccaggatacatctggagatcacttgtcataccaagaacaaggaaagccacaacctgaacatggtaaggtaacggatgtaaattccaagataggtcacatgttggaatcatctgccaagaattttaaagcagagtcataagaaccagctgggcgcggtggctcacgcctgtcatcccagcactttgtgaggccaaggcgggcagatcacctgaggtcaggagtttgaaaccagcctggacaacatggtgaaaccccatctctactaaaaatacaaaaattagccaggcgcggtggctcacgcctgtcatcccagcactttgtgaggccaaggcaggcagatcacctgtggtcaggagtttgaaaccagcctggataacatggtgaaaccccatctctactaaaaatagaaaaattagccaggtgcagtggcttacgcctgtcatcccagcactttgtgaggccgaggcgggcagatcacctgaggtcaggagtttgaaaccagcctggacaacatggtgaaaccccatctctactaaaaatacaaaaattagctgggtgtggtggtgggtacctgtaatcccagctactcggggaggctgaggcacgagaattgcctgaacccaggaggtggaggttgtagtgagccaatatcatgccaccgcactccagcctgggtgacagagcaagactccatctcaaaaaaaaaaaaaaaaaaaaaaggctgaaaactcccccaattcaatgaaaaacataaatccacagattccagaagctcaacaaggcttcataggacaagccctccaaaaaccccatactaagacacatcacaattaaactcctggaaactaaagacagaaggaggaaaagtactaactgacagagagaaataatgccttgcctagagaggaacaccagtttgaatgaaggcagatttcttaaccaaaaccacaaaaggccagaaagaagtgacctgccattgttcaactgtaaaggggaaagagctgttgactgtgagtcctctacccagcaaaactatccttcaggaatggaagaggagtaaagatgttctcagacaggcaaactaatagaatttattgctagcagacctacctttaaggaatgcataaaggataccctgtaaacagaaaggtaattttttttttttttgagacggaatttcgctcttgttgcccaggctggagtgcaatggtatgatctcagctcactgcaacctctgcctcccaggttcaagcaattctcctgcctcagcctctcgagtaactgggattacaggcatgtgccaccatgcccgagtatttttttatttttagtagagacagagtttctccgtgttggtcaggctggtcttgaactcctgacttcaggtgatccacctgcctcaatgccccccaaagtgctgggattacaggcgtgagccaccgtgcccggcccagaaagataattttaacagaagagggctggggcctccagaaagttgagacaatggactggataaaaatagaagtcaatgtcactgaccatctttcacctcatgagtttctttaatcatatttgatgatcgaagcaaaaattacaacactcatgtggtgtgtgatgtatgtggaggaaatatctacagctaggtatttaacagtgagaagggttagggacttaagtggaaggaaggtttgtccactcactcaaggtggaaaatcatagatgccgatagaccgatgggttgcatatgtatatggtgatatcctcaaaaacataacgtggaattctaaaaaacattcaggtatcccacagtaaagcatgagagaacagatgattaaatggcaagcgtaagccctaatatatcactaatttaaatgtaaatggcctaaacacaccaattagaagacagaggttcgccacgtggatacaaaacatgacccaactgtatgatgtctactatatgctgaagctcacttcaaacataataacataggcacattgaaagtaaaaggatggcaaaagagtatcatgtaaacataaattttaaaaagcgggagtggctgttgaaattccttgggaaaaagagggacattacataatgataaaagaacccactgggaagataacagcaatcccaaatgtgtgtacagcaaacaacagaccttcaacatgtataaagcagaaactgatagagctgaaaggaggaagagacaagcctgctgttgcagttgacgacttcagcccccaactcagcagctgctagaataactaggcagatagtcattaaggtatagcagagcaacaccatcaaccaacaggatctaattgacgtttgcagaacacaccactcaacaatcgcagaattcacattattttctagtgtcctcagaacagagaccaagatataccatatcctgggccataaggcaaaccttagcaaatgtagaagacttgcacagagggctgggcgcggtggctcacacctgttatcccagcactttgggaggccgaggcaggcggatcacctgaggtcaggagttcaagaccagcctggccaacatggagaaatcctgtctttactaaaaatgcaaaaaattagctgggtgtggtggcacgcacctgtaatcccagctactctggaggctgaggcaggagaatcacttgaacccaggaggcggaggttgaagtgagccaagattgtgccactgcactccagcctgggcaacaagagtgaaactccctctcaaaaaaaaaaaaaaaaaaaaaaagacttgcacagaacgccttctctgacaataatggaatcacacttaccatcaacagcagatagcaggaaaatcttcacacatggagattagacagttattctactcagaaagaattgctgcacgcaacttggacgaacctctaaaagattatgcagatgaaaaccaatcccaaagggatattttgtggttttgtttgtatgacatccataaagtaacagagatggggaacagatgactgatctcctggggctagggatggggtggcgtgattattaagggtcactaggagggagccttgtggagctggtacagtatagtacctggattgtggtggcaactgcatgaatacccagaggggtcatgacctctcttctttccccagacacactgccagacggaatagctataaactggatgacagaagcagggcagtaggacaggagggccaacacgttacaacaaatgaaacaggccttgggatgctgagacgggagaatcacttgaggccaggcattcacgtccacctgggccaaatagtgacacctcgtcgctacaaagaaatattaaaacttagctggatgcagtgactcacacctgtagtcccaggtacttgggaggctgaggcaggaggattgcttgagcccaagagcttgagaccagcctgggcaacatagtgagacccccatctctacaaaaagaatacaaaattatggccgggcacaatggctcatgcctgtaatcccagcactttgggaggctaaggcgggtggatcacttgagctcaggagtttgagaccagcctggccaagagggtgaaaccgcgtctctactaaaaatacaaaaattagtcgggtgtggtggcaggcacctgtaatcccacctactcgggaggctgagacaggagaattgcttaagcctgggaggcggaggttgcagggagctgagatcaggccactgcactccagcctggtgacagagcaagactccttctcaaaagaaaaagaaaaaataataagctgggtgtgatggggtgcacctgtaatcccagctactcaggaggctggggtgggaggatcacttgggccaggaaggttgaggctgccaagagctatgatcatgccaccgcactccagcctggatgacagagcgagaccttatctcatcaaaaaaaaaaaaaaaaaaaaaaagcctataaaagagatgaagttctgtatgttaccaaaatgaaacaggaacaagaagtatgtaagagaaaaggtcagggatatggagaacagaagcaacaatgctaatatctgttgaatagatgtcccaggaaggcagaagaaaagtgggaagtaggaggtatttgaagggataatgaaggcacattttctagacttaaaaatgggtcaggtcaggtgcagtggctcacgtctataatcccagcactttaagaggctgaggcgggtggatcacctgaggtcaggagttcgagaccagcctggccaacatggtcaaaccccgtctctactaaaaatacaaaaatttgctggaagtggtggtgcccacctgtaatcccagctacttgggaggctgaggcaggagaattgcttgaacccaggagccagaggttgcagtgagctgagattgtgccactgcactccatcctgggtgacagagcaagactctggaaaaaaaaaaaaaggctgaagcaggaggagatatatatatatatatacatacatacatatatatgtatgtatatatgtgtatgtgtgtgtgtgtgtgtgtgtgtgtgtgtgtgtgtgtgtgtatctataaagcttcccccagtgaaggcctggggccggctgtctgtgggtcaggagtccaggcatggctttactgggtcctctgaaggctgcaatccatgctggggctgcattcttatctgaggctcgactgaggaagggaccgttcccaagtgcacttggttgtttccagcattcactttcttagctgtggactggaggccaccctcagctcctggccacggggtcctcttacagccactgatgaaagggcagctggcttcctcaaagccagcaagggagagagtcccctggcaaggcagatgttgccatgaatcatatgtgatgctcactcctcacctttgctgtaccccaccgggcaggggtgagcctcaggacctacacacactcaaggggagggtaccccacaagccatgagcactgggaggtggggaccctgtggccatctgagagtgcctgccacacccaggagccatgtgtagagaagactattgaggtttgtggcaaaatttcccgtgaaattttgcatcccttacctacatagtgaacaatgcaaaacttgaatattagagaacattgtgtgtgtgggtgtgtggttttgaggcaaggtctcactctgttgcccaggctggagtgcagtggcgcaatcatagctcactgcagcctcgaactcttgtgttcaggtgatcctgccaccttagcctcctgaatagctgggactacaggtgtgcaccaccatgcctggctaatttttgtatttttttgtagagacagggtcttgctctgttgcccagatgggtcttgaactcctggactcaagtgatcctcctcttttggccccgcaaagttctgggattgcaggcatgagccacgatgcctggccacattgttattttcttttctcttttcttttctttttcctttctttctttccttctgtctctctctctttctttctttctttttttgagactgggtttcactcctgttgcccaggctggaacggagtggcatgctctcagctcactatgacctctgcctcttgggttcaagtgatcttcctgcctcagcctcccaagtagctgggactacaggcacggcaccacacctggctaatttttgtattttttgtagagatggggtttcaccatgttgcccaggctggtctcgaactcctggcctcaggtgatctgcctgccttggcctcccaaagtgctgggattacaggtgggaggcactgcgcccggctggagaataattattactgttcacggttcttgggctcctactatgtgctgcgtgctccatgctcagcctctcagtcctcattcctcgtatatccacctagatttgaggatgagtggcctctcccatcagccacaatcacatgcagtttctcctctatcctcagctcagggagcatacggacgttgcgcagtgaatgcagctggctggggaaggctcaggaaccgcacccaggaagcccacctacagatcccacctcaaaccacgacatgctgcagcctccccagtggccagagcagcttaacaaagcatctttgtttcctttctgcaccccagaaaatagctgtgttggtctcttcgccatgcagagtgaataaagaataagacaaacaccatccatgcatacttggtgcttttgacctagcaggggagacagcaattaagctggcagccttgccgtcattattcaattgcacgtgtaataagagctaccaaggagaagtcctgggagccccgggccctccagaggcagtgctggcgccttagggaatttccctgtgtaacgttttggttgaatcttggagggtgaattggagctgacagagcaaagtttagaagtgcgaggtatgtggtgattgggaaaagaatgtggcttcggaccgggtgcggtggctcatacctgtagtcccagcactctgggaagctggtgggaggattgttggaggccaggaattcgagactagcctaggcaacatagtgagattttttttttttacaaaaaaaaaaaaaatgtttttaagtaccaggtgtggcggtgtgcacctgtgatcccaactactctggatgttgaagtgggaggatggcttgagcccaggaatttgaggctgcagtgagctatgatcacaccactgcactccagcctgggcgacagagtgagaccctgtctcaaaacaacaacaaaaagatttaaaaaaaaaaatatataaagaatgtggctaggccgggtgcggtggctcacgcctgtaatcccagcactttgggaggccaaggcgggcggatcacgaggtcaggagaccgagaccatcctggctaacacggtgaaaccccatctctactaaaaatacaaaaaattagccgggcgcggtggcgggcgcctgtagtcccagctactcgggaggctgaggcaggagaatggcgtgaacccgggaggcggagcttgcagtgagcagagatcacgccactgcactgcagcctgggtgacagaatgagactctgtctcaaaaaaaaaaaataaaatgtggctctttggttggagttctgcaaagcgtggtcactgtaagtacatttagtcatgatgaatcctacaggcacattctatgggtgaagtaagaccccacagggcttagaaatgtgaatacctttgctgagaaaaataacctaccccagggggtaggtccttccctatgggaagatatgtgatttactgggacttctgaatgggtaacccagtcaccagcagcacattttcagttgagggcatagctgcttgggcacagtgtcacacgtcagggtttgtcaccgtgtggcagggtggcgaccgacctgttgaggtccacgtggtccgatgaccaagcgcagctcctctgagctcaccagacccctctttgtgtcttcatccaggagcatttaatggggttgtcagtgtgtgttttggggggattgtgtcagatcagtggtgtattcacttggatgtcctcagtggcgactaacaaaaagcaaaaagccaacgggctcaggcagtagtacgaggtatttatttattatttatttatttcgagacggagtttcgttcgctcttttgctgcccaggctggagtgcagtggtacgatctgggctcactggagttcaagtgattctcctgcttcagctttctgagtagctggggattacaggcgtgcatgaccatgcccggctaattttgtatttctagtcgagacagggtttcgctatgttgcccaggctggtcttgaactcctgacctccagtgacccacctgcctcggcctcccaaagtgctgggattacaggtgtgaaccaccgcatccggccaaaggtatttattgatgaacataattgggaagtccagatacgggaagggcctcaggtttggtttgaggacggccgtggctccatttctctaggatcctgtttcttcccacttctgtgttgatttcatcctctggcaatgatcagacagtgagcaggacactaaggaagcgtctgtccttggctcaagccagtaaggctgaagcaagagaggcctgggagtcaggcagaaacttgtctgcaggttggggcggtgggggccacgcctcgcactcctaccagagccagtctggagagggagtccttgtgtggggtgggggccactggaacagggatctgagtggcggggaaaagtgtgaaagagagaggcagtgggagctgccgtcgtggcaatgaggagaggagctcagcagacgtcacagctcagtggggccaggggccgcatgtctggctggccacgtgcatgctgccagcccccaaacctgggagatccttgtctcaaaaggacgcaggcaaggaggctcagcctgaggaggtattgcagcagaaggagggcttgtgtgtgcgcctcgggatcagagggctgtcctgtgaggtcagccagagaggtgcctccactctcctctagaggcacggtgtgggggaagtctttacagggagtctccagagaaccccaggacagcccgggagagaagcagccaggcctggagcatctgccccccgaagcgagacgtcgccttggttaggtggcacctgggtcttttttgctgtcctcaccagtctaccctggaggagcaggagtaattggaggaggaggaggagggagtggaggggccgcggggagcacgtgatggtactgctggtcagcagcagctccaggcaggccagggctgggagagccagaggtctgagtgggttgtgggatggagttctaattcagagaccaggcctggatccctaagaaagtctcaggacaaatgcaggtctgcctgagacggggctggggccagtgggtgctgagggtgagggctgaggaccaaggaccttcgtgtttgacccccgagggtggcctgcttggtttacgttcaccctggcaggaagaggctgaggcaatgtcagccctgctggggaatgtgctcggcagggctggtgacctgtgtagtgcctgtgcaggcaggtgagtgggagacagctgagcaatgaacaagaaagctggacaggtgagtgtggaccaggtgagcatgggagggctgagtgagagacggtgagtgtgtacaggtgagtgtggaccaggtgagcatgggagggctgactgggagacggtgagtgtgtatacgtgagtgtggaccaggtgagcatgggagggctgagtgggagatggtgtctgtgtacaggtgagtgtggaaaaggtgagcaagagacgggtgagtgggagatggtgtgtacgggtgagtgggagacaggtgaagatggggcagcatagtgggagacaggtgagtaggcaacagggaagccgggcaggtgagtgcaggacccgggggctggacaggcgggtggaggatccgggggctgggcaggtgggtggaggaccccgggggtagacaggtgagtgtgcacagggaggcaggtatcatctccttcacagctggaactgcctacccctctcctggcatttggagcctctggggagggaagatggagtttctgccgccgccaccctggcaggatggggcaacggtgtgcggtaggaggatgaggttgattccctttcctgcagggctgggcttgtgggttaggaccgtcaccaagaggctcctcctaggcctccgtgacctctggatccccaagaaaggtgggaaagaatttaggagggttccgatttcccactgggcatcggggtgaagctggtgcgcctaagcgctgggagtcacctggggaagcggggctgggcccacctggccaccctctctggccgctaaggcagagtgagaccccagggaacgggcgtgcttgctgggtaccgggtgtcctgcagaggcagggatgtgatcccctaggtgtgagcagctcaggcagccgcggtggtcgtgaacggggcgggagtggggggtgcccaggccatcagaggcggccccgcggcctgcaccggctggagtgggcgactcagagtctgagtggagggggcggggggcggcgacagcggggggtcctggcagcgatggcctgaacctgcgccggtgggggatggggcgggggcggggagagccgggggtgggggccggggttgggggccccgcggggaggcggtcggggggagacgggctgcaggcccgcgcgggcggcgttgggggtgcagcagctgcgcgcggcgcgggggcgggcgtggagggcggcgccgctgcagtgcggggacccgctcgctcgctcgccagccgtccccgcgccccgcgtccccgcgcagccgcctcctggcctcgggcgccgcgcatccaggtacgcggggccgggctggggtctgcgccgggagccccgggcctgggaggccccccggggatgcggacatttggaagggttcggccccgccgggagtggggcgcgcggggcggggccgggcctggggctcccggtcaggggtcccgggagggtcctcgccggcgctgaggccgggtttggggcggggggcgcggggtctctgggtgggcgccttcccggcggtctgggcactccgggggcggcgtggcggggggctggggtcctgcgccccgcggtgcggtgccggcctggcctggccatggtgacttcgctgcgcggccgccgcatttgttctcccgcaccccacccccccaccaccgccagcttcccttgtttacctgcgtttctgtcttttcctgtgcagaggccgccccagcccatccacagtctcaccctcatctccccctcccctgaggccgcgcgcaggggcccccagcattcacatttcacataagtgcccccaaaaaggggggatggaggaggacgaggccctggaaccccccggctggaccctcagggcgccgggcccccccactcttcccacccggaatcctcagaactgcagaaggggcttctcagccgcgtgcacccctgtctgcctgagccccctccccccctgcctgagccccctccacccctgccgggggtctgtggggagggaaggctctgggggccgtcacgtttaacacctcacctggccccacagaatgaaagatctttgacaaatgcagaatcagtgactttcttccacgctcctgggagaagcctggttcacgccgcctgcgtttatccggcgcgcagccccgggcagctctcaggcctggggatctgtgtgttttctggacaggaaggaagcagccaccctcgccatggcctccccgcccgcctgcccctcggaggaggacgagagcctgaagggctgtgagctgtacgtgcagctgcacgggatccagcaggtcctcaaagactgtatcgtccacctctgcatctccaagcccgaacgccccatgaagttcctccgggagcacttcgagaagctggagaaggtgagtggcccccgccgcccgctgcttcccttcgcacgtgtcctggggcagaggcggcagccggggaagccttccctctgtcccgtggtcctcgaaggctgggtgccccagagactgtctgccgtcctgcaggtccttccagaagcgcggggagagaggccgacctggggcccaccgtcccttgtttggtctcccgagattcatgcctctaggtggggtcctctgagccacagaattcccccttcggcttccagggggttccaggtcttcagagctctcctggaaggaggttcagggttttaggtccaggtgtttcgctagcttgtggggctcaccgacagttttcagcctagttacagatgctgtcaccacttgggataaaatagctcccacggggtagctcacacctgtcatcccagcactttgggaggccgaggcgggcagatcacttgaggtcaggagttcgagaccagcctggccaacatggcgaaaccccctctctactaaaaatacaaaaattagttgggtgtggtggcggcgcctgtaatcccagctactggggtggttcaggcaggagaattgcttgaaccgggaggtggaggctgcagtgagctgagatcgcaccactgcactccagcctgggcgacagagcgagactccgtctcaaaaaaaaaaaaaaaaaaaaggaaaaagaaaatagctcccatggctaaggtgatgtggggtttgaggtcgaattccacgttgatcttgcagcagtgggagaggaaagtacccttcggcacgtgtggtcggggagaagctcaggcctgctcacggtcttctctccgggaatgatgcctctcacccccttcctggcctcctgcatctgggctcttttcgtagacgtgcgtgcctgggaagtggaggccgggacaggagcccctgtgacacctcctgctgtgtcccctccccctcgccgtgggctcctcctgtccttgttctgggccccaccccaggctgtctgcgtatcacctaatgtttctcctcttggtccttttatcacaacttaactatctcctgtgcccatctctcctggggaccaaatgggaacttgggaagcccagttcaggctaagatctgcctttgagtgcctgtgagccaccaggtccccatccggcggtgtttatgctttcgacaggggcctcctgtgatcacatagtcctaacccaaaggagtgaatataactcttcccttggaagcagtccatgcaaaaacattttaaagtaatgcatatgcctattaagggaaatttgaaaagttcggaagtggaaagaagagataaaaacgctctgtagtcctctccaccgaattccccctcaaatgtttttataaaaacgtagttgtaggccagatacggtggcttatacctgtaatcccagcatttggaaggtcgaggtgggaagatcacttgaggtcaggaattcgaccttgtctctcaaaaacatttaaaaagtttgctgggtgtggtggcacctgcttgtggtcccagctacccaggggctgaggtgggaggatcacttgagcccaggagtttgaggctgtggtgaaccatgatcacaccactgcactccagcctgggcaacagagcgaaaccctgtctcagaaatacatacacacggctgggtgcagtggctcacgcctgtaatcccagcactttgggaggctgaggtgggcagatcacgaggtcaggagatcgagaccatcctggctaacacagtgaaaccgcgtctctactaaaaatacaaaaaattagccgggcgaggtggcaggcgcctgtagtcccagctactcaggaggctgaggcaggagaatggcgtgtacctgggaggtggagcttgcagtgagccaggatggcgccactgcactctagcctgggcgacagcgagactccgtctcaaaaaaaaaaaaaaaaaaagaaatacatacacacacacatgcatacacacatgcatacacacacatacatacatgcatacgtggatacatacgtacataagtcttagttgcagtcacgttatagatgcaattcgtattttgtatttttcattttttatatattctttaaagacctctctttaagtgactgcataatgttatactaaggtttttcaacctttcctccgtgagtgaatggacaattgagttgtttcctttttttttttttttttttttttttttagtattaaatattggggctggtgggtgcggtggctcacacctgtaatcccagcaatttaggaggccgaggcaggtggatcatgaggtcaggagtttgagaccaccttgaccaacacagtgaaaccccgtctctactaaaaatacaaaaattagccgggtgtggtggcacgcacctgtaatcccagctactcaggaggctgaggcaggagaattggcttgaacccgggaggtggaggttgcagtgagcaaagatgcgtcactgcactctggcctgggcgacagagggagactccgtctcagaaaaaaaaaaaaaaaaaattggggccgggcacagtgactcatgcctgtaatcccagcactttgggaggcccaggagggtggatcgcttgcacacaggagttggagaccagcctggccaacgtggtgaaaccccatctctactaaaaatacaaaaattaactgggcgtggtggcatgtgcctgtaatcccaactacttgggaggctgaggcgggagaattgtttgaaccagggaggcggaggttgcagtgagctgattgcaacactgccctccagtctgggcaacagagcgagagtctgtctcaaaaataaataaattttttaaaaaagtatatgggaggatgtgtgtaggttacatgcaaatatgacaccattttatatcagggacttcagcatccatgggttctggttatccttagagattctagaaccatctcccatggataccaggggatgactgtaccacacaccgggcatcttaaacagaaatgtctcctcccacagttctggaggctgaaagtctgagatcaaggtgtattgggatggctccttctgggtctgtgtgggagaaggagatcttaggtggtccaggctggaagtccgagatcgaggtgtattgggatggctccttctgggtccgtgtgggagaaggttctatgtctcccccggctctgggtggttctggcgattttgggtggtccgggctggaagtccgagattgaggtgtattgggatggctaattctgggtccgtgtgggataaggttctgtgtctcccctggctctgggtggtgctggtgatcatcttgggtggtccaggctggaagtctgagatcaaggtgtggtgggatggctccttctgggtccgtgtgggagaaggttctgtgtctcccccggctccaggtggtgctggtgatcatcttgggtggtccaggctggaagtctgagaccaaggtgtggtgggatggctccttctgggtccatgtgggagaaggttctgtgtctcccccagctccgggtggtgctggcgattgtgggtggtccaggctggtagacgcatcgcgggtcctgccttcatcttcacatggtgttctgccccctgacagtgtctgtgtccagatttccccttctcatagggacactagtcatcctggaccaaggccaccccaatgacctcttgtaacttcctcacctccgtcaagaccctgcctccaagtaaggtcaacttctgaggttctgaggttctgaggttctgaggttaggactccagaatgtctatttctggggacacgattcacggatcccagcggccttcttgggcgtgggcagggcaatttttctcaggccttcctccaacagcaagcctttgctgagtgaaaatagcaggttgcaagacaggatctatggtacaattccatttttgtcgaaagggttgccgacaataatgtgttatatgcaaagaaaaaaatctgaggggcgtccgccaaaatgttgaaaagagtggcgtctcagggcacgattgcaggtgatttttgtttgttttctgcagtagctgatagggacaggcattggggagctttagtgaagtctttgaagttgcatgcgtgttctacatgtgggtgcgtttaactgggaagaattcctcttagcttgcgatggattctcaaatggagctgagatccccaaatataaaccagctaacagggccctaaaattccatggagtctcatttcctgctgcgtgttctggaccagtgaggtgctgtggaatgtttacaatagaaccgggaagtgtgcctctgggtagggcggcagccctggtggagagggtgaggtctgggccaccccctcgaggccagccagggctgagtggagggcagaagcccctgatggaggatttttcttcacttgtatcccaagcagggtgcatgtttgtgaggctttcataaagcacctgggataaaacacaggccagcagggatggcccagctcttggagtgccgtccgggctgggcctctggtgctctggccttcgtgagtgagttcttctgtggtggagacttaagcagataaaatattccttatttgggccgggcgcggtggctcatgcctgtaatcccagcactttgggaggctgaggcgggcggatcacgaggtcaggagatcgagaccattctggctaacacagtgaaaccctgtctctactaaaaaaaaaaaaaaaaaaaaattagctgggcatggtggcgggtgcctgtagtcccagtgagaggctgaggtaggagaattgcttgaacccaggaggtagaggttgcagtgagcccagatcgcgccactgcactctagcctgggtgatagagcgagactccgtctcaaaaaaaaaaaaaaaaaaattccttatttgatggcaaaacacagcgtgggagtttccccagcaagatgtgatctttccgaagattatccaaaatgacaccatcaatcttcttttttgagacagggtctggctctgttgtccaggctagagtacagtggtatgatttcagctcactgcaacctccacctctcaggctcaagccatcttcccacctcagcttcctgagtagctgggagtaccggtgcccaccaccatgcctggctaatttttgtattttttgtggagacgggatttcgccatgttgcccaggctggtcttgaactcctgagctcaagcggtcctccccactcggcttcccaaagtgctggggttatagatgtgagccaccacgcccggctcatctgtttttcttttcgagacagagttttactcttgttgcccaggctggagagcagtggcacagtctcagctcactgcaacctctgcctcctgggttcaagcaattctcctgcctcagcctcccgagtagctgggattacaggcgcctgccaccacgcccggctaattttatattttcagtagagacggggtttcagcacgttggtcagtgtggtcttgaactcctgacctcaggtgatccacctgcctcggcctcccagtgtgttgggattagagacgtgagccacagtgcccgcctcatctgtgtttttctgcatcaacaggtcctgcatttttattgccggcagtgttctgttgcatagatggattgcagcttgtctgtcctgtaccctgtctaggaacacttggatcctttccagtttttgccaactacaaataaagctgctataaatattcgtcttacaggtttttaatgtggaagtaggtttttatttcacttgagtaaatatttagtagtgagattcctgggtcatagggtaagtgtatgtttataagaaactgccaaactgttttccagaatgtctgtcctatctcgtgttccaagcagccgtgattcttgttcctcagtatcggcagcctttgatactgtcagttttaaaaaacgtttagccattctaataggtatatggtggcacctaaaatgtttttttttttcttttttcttttttttttttttaattgagacagagtcttgctctgtcacccaggctggagggcaatggcgtgatctcggtttactgcagcctctgctccccgcgttcaggtgattttcaagcgattttcctgcctcagcctcccggatagctaggattacaggcatgtgccaccatgcctagctagtttttgtatttttagtagagatggggtttcaccatgttggccaggttggtcttgaactcctgacctcagatgctccacccgcctcagcctcccaaagtgctgggattacaggcgtgagccactgcgcccggccctaaagtggttttattttacatttcctgatgactaaagttgttgaggatgttttcatacgcttattttccactcaaatatcttctttggtgaagtgtctgttcatgtattttgtccatttttcttattaggttgtctgttttcttactactgagtttcagaattttttataaactgtcagatatttaatttacaaaatattttcttctagtatgtggcttgtttatttatttatttactccgagacagagtcttgctttgttgaccaggctggagtgcagtggtgcgatcttagctcactgcaacccgcccctcctgggttcaagtgattctcctgcctcagcctcccgagtagctgggattacaggcatcgcgcctggctcatttttgtatttttggtggggacgggatttcaccatgttggacaggctgctctcgaactcctgacctcaagtgatccacccgcctcggcctcccaaagcgctgggattacaggcgtgagccaccgcacccggccatagtttgtgtatttcaaggcattgttccgtttcatttaagttgttacatttatcaatatagagtaatattacctcatccttttaatgtctgtagtgtttgtattatttcattcctgaggtggttttctgagatggttttcattcctgagacggtaatttctggcttttcttttttgcttgatcagtctggctagaagtttatcaattttactgatcttttcaaagagttagattttaatttcatcgattttgtctatttttgtttagattttatctgtttctcctcttatttttattatttcatttcttcttcagtctttgggttttatctgttcttcataaaatttcttaaggtgaaattttagatgattaaggctttttatctgatagaaatatataatgctacagatttttctctaaagcactgttctaactatatttcacagattttgatgtgctgtattttcattttctatttagctcaaaatattttccattttaccttgagatttcctctttggttcatcttatttagaaatttgttgtctaatttccaaatatttggggatttttttgatatctctctgttatttatttctagtttaatttcattatggtcagggaacatagcttatatggttttgaatctttattttgttaaggtgtggtttatggctgatcatatgctttatcttggtgaatatcacacgtgcccttagaaacactgtgtgctgctgttgggtgctgtgttctggaaatgttggttaggtctggttgtttgaggggttgttcaggttagggtcttttgcattcctgctgatttttttttttttttttgagacagagtcttgctctgttgcccaggctggagtgcagtgacgtgatctcggctcactccaagctccacctcccgggttcgtgccattctcctgcctcagcctcccaagtagctgggactacaggcgtctgccaccacgcccagctaattttttgtgtgtttttagtagagatggggtttcactgtgttagccacaggagatcgatggtctcgatctcttgacctcgtgatccacccacctcaacctcccaaagtggtgggattacaggcatgagccactgcacctggcccattcttgctgattctttttggccccttgctatacctactaccaaagaacagcattgaaacttccaattataatttgtctgtgtctcctttaattctatcagtttttgctttatgtgttttggagctctgttattagttgcatatacatttgggattgctatgttttcatgtgaataaaccctcttatcattattcgatgtttctctttgttcctggtaattttcattgttctgaagtctgctttatctgatattaatacagccacattattaggatttgtgtgattaatctttttctatcctcttattttagctatatcagtaaagtgtgtgtcttatagatagcatatacttggttttctttttttatatgatttgacagtttctgtcttttaattggtgtgtttagattatccactttttaaaaagaaaatactgtttattactatatatgtagtacatatagtatatatagtatagtatatattatgatgcatctttatttatttatttatgtatttatttatttacttatttttttgagacggagtcttgccccgtttgcccaggctggagtgcagtggcacaatctccgctcactgcgagctccgcctcctgggttcacaccattctcctgcctcagcctcccgagtagctgggactacaggcacctgccaccacacccggcaaattttttgtatttttagtagagacagggtttcaccgtgttagccaggatggtctcgatctcctgacctcgtgatccgcctgcctcggcctcccaaagtgctgagattacaggtgtgagccccacgcccagcctatgatgcatcttaatatgattttctttgagtttgtctggtttccctttgcaaatcttgatgttaatttatgtccttcaagaaatttggcaagttttcaaccattattttttaagatggttacttttatatatcttacctcatgtatagatcatgtacatttaatgtaattattgatatggttggatttaggtctaccatttaattatttttctatttgttttctctgttttttttcctatgtttcttttttccttccttcttttagattatttgattattttttagtacttactgtcttttttactgtttttctttaagtgattgctataggcattataatatacatacataactttacacagactttttagagttgatattttaccatttcaagtaaaacatacaagttttccatcacataggcccatttaccttccccttattatttctggttgttgtacgtatcatctttacacatgttgaactttcccccactcccttgacaatgttataatttttacttttaacactttcacgtattttcagtaatttaagaggggcaaatagtctagaagatgtacctgggtatttcccatttctgtcactcttccgtggttcctgaagtgtttttctttccctctgtgatcatttcccccaccagcctgaagaactcgctttagcattcctcttagagcaggattgctggtgacagattctcagtttccttcatctgagaatctctctggtttgccttcattcctgaaggacaaggacatgtttacagatacaggattctgagtggagagtgattttatttcagcagtttaaagatgtcttcccattgttctttatggtttctgatgacaaatcagccttttgaaccctcatttgctttatgtttcttttctctggcttctttcatgattttccctgtgtatttagtttgtcagagtttgagtacaatgtgtctgagtttgattttctttgagtttctcttgttttcctttgatcttgaatctgaatatttatacctttcaacatatttgagaagttttcaaccatcatgtcttcaaatatatttttctgtaccaatctctttttcctgtctttcagggactccagtgacatgaatgttagattttaaaatattttcccgcaagtccctgaggctctgttaaatctctttctttctttctttttcttttcttttcttctctttcttttctttctttctttctttttctttctttctttctctttctttctttcttttttccttctttctttctttccttccttccttccctccctccttccctccttctctccttccttccttcttttcttttctttttttcagagtctcgctctcttgcccaggctggagtgcagtggtgcgatctcggcttactgtaacctctgcctcctgggttcaggagattctcctgcctcagcctcccgagtagctgggattgcagatgcgcaccaccatgcccagctaatttttgtattttacttagagatggggttcagccatgttggccaggctgctctcgaactcctgacctgaggtgatccatccacctcggcctcccaaagtgctgggattacaggcgtgagccacgatgccctgcccacctgtccttttggtgggatgatttctgttgatctctcttcaaactcacaaggtctttcctctgtcatatccattctgcaaatgatcccatctagtgaatttaagattttctgttactttatttttcagttctaaaatttgtatttatttttcagttctaaatttatttggtagttcctcctcttcctactcctcctcctgttctccttctcctcctttcttcttccttttttttttaaataaatttgatttctttgctgattcccccaccaattccaagagtattcaccttcacttcatggaaaatagttaaaattgctgctttagagtgttaacctgataatcccgtcatctctagcatctgaagcttgtcagccatgggttgtcttttcctttgagaactggccagactttcctagttcttgatatgttgaataatttgtcaaggaactggattatatcctggacattttctatattatgttgtcaagctttgaatcccattaaaatcctatggagagagaatgttgatatttttgtttgttttggcaggaaatcaattgacgaggtccatgctgcaagttctctctcatccttggtgggtgacgatgccaacatgagttccgtttccaagcctttggggtgctgcttgggcgcacccttgtgtgggtcgcttgggggctggtctgggacttggacattgttttgcttgcagctcagtcctcagcaccttttctgtggttctctgtgttctgtgcatacgaaacttggggttgaacctcacactcgtatcagttcatggaattcggggacccccattttgtcctttctcctctggggtttctctcacattctccatgcaagagagatcctacctctggcacacagatatgcctgtttctctccctgccgccccttcccccgcccacgccgctgtcccctcggctgaatgactgcagcagcctctctgcttcccatcgggcctcgagctccattttccatatcagtcacagctggagccatcttccagaaacacaaattgaactgctcccccttcttaaaaccttcccaaacctttccagtgctctcctaacaaatctaagctccttcctgcctcacggggtctggctcctgcttgcctctccactgcagcccatggccacccacgggctccggccagcactgtcctgtcacctggaacttcctccccacccctcctgcagctggccgctcttcagcacttgctttagggccacggctgcttcctcagagagcctctcaccacgaccctgtcttgggtgagctcagaggaggagatctcggcttgagcttcaaccccaagtcccagctctgcagggagggagggtctttagtgtcctctggccctcctagctcactacttggtgagcatgacagtgtgtgatggactgagggggtaactgcccactccttcctccagctgtgacctctgcccttcctaccccggctgttcctgcgttgggaggggccctaaccgtcagtgccttcctgctttgggactcagtgcctcccagtgcaggaacaccgagatatggcacgtggtgctttgcatactttatctcatcgaattctcacgcaggcctggccagatgagatatttacattcccatcttacaaatgagaaaacgggtgcttggagagagaacgtgggttccccaccatcagccagggagagtcatggagctgggcgcaaacccaggcatgcctctgaggccacacccttcccaccttgcctgtgggctctggcccctggcgtgctggggcagggtgcagggttctcctggggttggctttgatggtggaacccccccttctgcttctttctcatcctccgtcctaggaactcaggcttctccgcctttgccctgcaaggctggtgcccctgtgtgtggcaggctggagctggggtgctgccctccaggagggagaggctgaatcaccagctgctgctgctgcgtggggagaggtggggtggggagacagccgccatggtgggtgagggagtgagtgcaagtgtgtgtgagtgacatgtacacacactcgcccagatgcacacacatgcacacacaggcaaggatgtactgttgccaccgaggaggagggtacgtggagtcgtgtgtgcacatgcattaaaacacacgcacttacccagatgcatagctgtgcgcacacctggacatactcagtttactccgagagtggtggatgtaaggggtgtgtttgcatgcatgtgtacacgctcacacatgtacttaactagatgtgcatatggtcacatgcatgtacctctctggatgtgcacacacatgtacttagttggatatgtacatgttcacacatatgtgcacatgctcacgcacgtacttacctagacacacactaacacatacgtacctagatatgcacacacgcacacgtacttacctagacacacatgcacacgtactttcctagatgtgcacacatagagtcatgccatctgcttctgagggtgagcagggctctcgcctgtgctcacaccctcctgtgtacactctgcccctagcctcactgggacttgcatcttcatcttctatttttatttttattttattaatttaatttttaattttcttaatatttttatagagatgaggtctccctatgtgacccaggctggtcttgaactcctggcatcaggtgatccacctgccttggcctcccgaagtgctgggattacaggcatgagccatggtgccctgcccagcctgttaatttctaattcccttccctcccctcccctctgctcccttccctcccctcccctcccttcccttcccttccctcccctcccctcccctccgctcccttccctcccctcccctcccctccactcccctccgctcccttcccttcccttccttcccttcccttccctcccgtcccttcccttccctcccctcccctcccctcccttcccttcccttctcttcccttctcttttctcctttccttcgccttcccttgtttgctatactctctatgtgaggcctggtacacaataggtgctcagtaaatgattgaagacctgcgtttctcttccaaccttgccactgaatggttgggttcccctgaacaaatcctttaccctctctgggcctcagtttccccgcctcatggctggggatgatttgccgctgctaggtgggcttatgggtcctggcctggggttggtaccatgtgagccctctcctggagacccctggtcctcaaatacaactggcgcttgagatttagggtttcacagagtgcagaggggctgtcttagggccgctcatggaactgctcggaggaggtggtccagaaacaccactcatgcctgcccggcacgcagtggatgaccccgtggaagcctagacgccctccgttgaaggcatcaggcggggtggatcagccgcctctcagaaaaccctttcagtgggacggggcaggctgtgtccccacaggagcgagaaccgggccgcaggcaggactgaggaattccatctgcctgtaatccctgcgtgtaggcttctctcgggaggataaacttgggtctaggaaatctctttagattccacccccaccccaggccccgcccagatattttcttttctgggctggacgtctgcacttcatccccctctgtgggacgggataggagcaggacaatccccagggccgggttcctcgattctggggcacattctggccacggagctttctggaaaccctgttcccacagtgttgttacgaagatggctttggcctggaaagcctgtcccggccccacgacctcgaccgtcctgcagctcagacaatgcatcagtatgaaaacaggagacaggaagtgggggctgcaaaatgagaggctttcccggaatcccaagaggggaaggggaagagcagcctggcatgtgcacaggcagagcccgtgagaggtcacccccatgcagccctggggaggggccctgctcgctgtccccctttctcccaaggcctcctgaagcggcctgtgtgtatggaaccacctgtatcctgcctagtctgattcttcacctgccaaagatgggaagtcccgtcgagcctggacaggcaaagctctttcagccaagagactgggaccccaacctcgttccttgaagagaagcggcttctggttcctgcaaagggagagcccagggtccttgccggagccgtgaggccctgggccagtctctcctctatgaagtaaactacttttagcatggatctcaaaagctaagtcccattgaggccgggcgcggtggctcacacctgtcatcccagcactttgggagatggaggcaggtgggtcacctgaggtcaggagtttgagaggtcagccttgccaacatggtgaaaccctgtctgtactaaaaatacaaaaattagccaggtgtggtggctgatgtctgtaatcccagctactcgggaggctgaggcaggagaattgcttgaagccttgaggcggaggctgcagtgagccaagatcgcgacactgcactccagcctgggcaacaagagtgaaactccatctttctttaaaaaaaaaaagttccattggggccgggtgctgtggctcatgcctgtcatcccagcactttgggaggtcaagacaggaggatcgcttgagactagcctgggcaacatagcaagacaccatttctacaaataataataaaaaaatttagccaggcatactggtggtggtgcacctgtggtcccagatactcaggaggctgagatggagggattgcttgagcctgggtggtcgaggctgcagtgagctatggtcacgccactatactccagcctgggtgacagagaaagaccctatctcaaaaaaaaaaaaaaaaaaaaaagggttgggcgcagtggctcacgcctataatcccagcactttgggaggccaagaggggtgaataacgaggtcaggagatcgagaccatcatggctaacacgctgaaaccccatctctactaaaaatacaaaaaaattagccgggcatggtggcaggcacctgtagtcccagctactcgggaagctgaggcaggagaatggcatgaacccgggaggcggagcttgcagtgagctgagatcacgccactacactccagcctgggcgacagagcgagactccgtctcaaaaaaaaaacaaaaaacaaaaaaaacaagccctattgaccccaccggtggctggctgaggcactttatttggtcacaattcctgtagcttgcagactccagtgggctctgtcttgtgacctcgcccatctcacttgaaactgtttctgcctccactgcagtctccatcatggaacacgaggtcatcgtaattcagatggcgcttcacaagtctaggcttgggaaggcagcaccactgaccccttcctgaccggcacggggctctctcttagattccaccccgaccccaggacccgcccagatattttcttttctgggctggacgtctgtacttcatccccgtgtgggacgggacaggaccaggacaatccccagggctgggttactcgattctggggcacattctgggctgcggttggcagagatcatcctgcctttctcgccggccacctctgatcccacgtcttcagccccaaaaccatccctgcacctgccgatcacagagcgactgtgagtagctgagcggtcgtctggtcatgacagtttatatggcgtgaggatgtggggctccgacttctgtcccgactacatttttgttcatttgctcattcatttctcgtttgttcgcttggttcttttttttttttttttgagacggagtcttgctctgtcccccaggctggagtgcagtggcacgagctcactgcaacttccgcctcctgggttcaagcgattctcctgcctcagcctcccgagtagctgggatgacaggtgcccaccaccacgcctggctaatttttgtatttttaatagagatggggtttcaccattttggccaggctggtctcgaacttctgacctcaggtgatccacccaccttggcctcccaaagtgctgggattacaggtgtgagccaccatgcccggcccttcacctggttcttgagtgcacctggcactgtgtctctgagatgggggcagtaacgaactcgtgcaagacatcatcttgggaacacgtgatgtgagctctcacagaggtctgagcagaatgcactggaggtgggtgggggaaggggaaggggacccaaaacttcctatggaggtggcattgaaacaggctttaaagtatatgtaggagttcgccaggcacatcgcctggggcctgggcattaggggaaggaggccccacatccttctctccttggcaagctactctgactccaggctagtctctttggggttggctttgtgggatctgttggagctgagcgtccagacgagacctgatgtcttggtccggggtctaaaccctggagcttgtgtcttggtcccgggtctaaactctagccctctgtgggccattcccaagtccgggtctcactgttttttcttttttttgagatggagtctcgctctctcgcccaggctggagtgcagtggtgcgatttcagctcactgcaagctgtgcctcccgggttcatgtgattctcctgcctcagccccccgagtagctgggactacaggcgcacaccaccaagtccagttaatttttttgtatttttagtagagacagggttttaccgtgttagccaggatggtctccatctcctgacctcgtgatctgcccacctcggcctcccaaagtgctgggattacaggcgtgagccaccacgcccggccgagtccaggtctcgcggttatcgcaaaggcagtacatcccaaacccaatgcatgctgtccatattaaaaacaaaagcaaaaatgaaacataagatggatgttgtgggggtgtgggggacatggaacccttgtgcgctgctgtcgggaatgtgagttggtacagccacagtggaaggaagcttggcatttcccaggaaagttaaacatgcagtgaccacaggacccagcagtgccactcctaggtacacagcccgaagaattgagaacaggtcttcaaacacacgcctctacatgagcgtttggagcagcactgcttacaggagccacgatgtgaaaacctcgcacgtccgtcagctcgagaggacaaacagtgtggcctctccacgcaagggaagtccctcagccacagaaaggagtgaatcacctgacacgcagcacagcgcggacgaacctgggacacgtaatgccagtgaaatgagccagacgcaacaggccaaatgctgcgcaattccgcttctgtgaagtagcaggaacaggcagttgcacagagacaggaagtcgattcggggctgtcgggggctggggcgggtgtcgggggacagctgctgaatggcacagggtctgcaaaggtcctggatctggatggaggtggtggttgcacagcacggtgaatgtgtcgacgtggctgaattgtgcactttaatacagttgattgttaactttaagttatgtgacttttacctcaattaaaaaaaaaaaaaaaagctcgacaggacccactggctctcacctgtaatcccagcaccttgggaggccgaggcaggaggatcacttgaggttaggagttcgagaccagcttggccaacatggggaaaccctgtctctaataaaaatacaaaaattagctgggtgtggtggtgggcgcctgtggtcccagctactcgggaggctgaggcaggagaaaggtgtgaaaccgggaggcggagcttgcagtgagccgagatcgcaccactgccctccagcctgggcaacagagcgagactccatctcaagaaaaaaaaaaagtcccactcacctgctcaaacaaactcctcttctcagccccctccagcctgcagggcatctgggatgaagccccaggttttcctactatggggttgagaacctgcccttccctgtccagggctgtcctgcctcttgccctctccctgactgaacgtgcgttgagtgcccgggtcggtctccggctgtgttcctgcctccccaaccttcaggaggcaatgtgaactgctgaaaaattactctggtatgagcgcagtttggcctgaggtttctgtttctcccgggcgactgcagggcctcagtgttgatataaacaatttgcactgccgtcaggggagcggtcccaaccaacctctctcaactccctggcttcaggttcctgccgactctattattgctactatttctagtaatttctacaaaggcccagagcccctcacttgtgatgcacctgccttctctctcttctcttctcttctcctcttctcttctccttctctctctctctctctgtctctctgtctctctgtttctttttttgagacagagcttcgcccttgttgcccaggctggagtgccatggcgcgatctcagctcactgcaacctccacctcctgggttcaatcgattctcctgcctcagcctcccaagtagctgggattacaggcgtgcgccaccacatgtggctaatttttgtatttttagtagagatggggtttcaccatgttggtcaggctggtctcgaactcctgacctcaggtgatctgcctgccttggcctcccaaagtgctgggatgacaggcatgagccaccatgcctggcccacctgccatttctagtgagacctcctggtttgtgtaggagcagtggatgacgatgtgatgatttccctaagagcgggtcccatacagccgatacctgaggtcgattagaaggatgcaaaggtttgagaaagtatttgcagcgtctcacccttgatttccgtctcccagtgattcagcctggggatggatgtgagcaagggactcgcagctccagggaggcgtctgtgccattctgagagattgtgagatggcccgttgtcatggtgaccggagagtgatgaggtgtttacttggcagggagttcaggggatgcgccgtcctccgcaggaggtgattgccggtgtttgtagagccctgtggtccatcccctcagcaccctggattcccctccccggggttttgtccacgaggagctgcttttgaccgtgtgaggtcacagcactgggtttccaacagctccctggagacctgggcggaggccacatgccattcagcacacggcagggcgtccacctcactttgggctgtccgaaaggactgcgtgtaggcggaagggcgtgtggacatggatccactggtaatgcccagctctcctcttcatttgctctccctggatggctgtggtgcgctggggggccctgcctgcatcttcatccgtgggagtggaggcactccctctccatcaaagccaccctcctgcacccctcctgaccaggcaggggatttggaatctcactgcttttagaggagatatctctgttggcagagaggtcctgatcttggcctggccgagtttccccatcacctgcaggctcatttcacggatggaaacccatttccactggcgagtttgggtgggcgcgggacccttcgggtaggatttgcagtggactggccagtttgagtgggcacaggaccctttgggtaggatttgcagcgcagtggacagtttgggtgggcgcgggacccttcgggtaggatttgcagcggactggccagtgtgggtgggcgtgggacccttcgggtaggatttgcagcggactggccagtgtgggtgggcgtgggaccctgtgggtaggatttgcagcggactggccagtgtgggtgggcgcgggacccttcgggtaggatttgcagcagagccgatgggccgctgggaagaattcccaagtgcaggctgagaggagcctgtggtggctggcagtggagacaccagccgccaggcccgctgaggaggatgcagtggagaccggtcagccttggagctggcacccatttgtgcagctggacacaggactgctgggtgttgtgtttttttgtttttttttacagccccaggcatcaggcctctgagcgtctgagaagcaccagccccttcctgaggagccccgtcttctgggtgtgcagctggtgggggcattccttctgggacttgttatttatttaggtggttttagtggtatttatgtctgcacagtggcacacagtagtttacttttattatgacatagttccttccaatttgtttgtgttgtgttaacattacagcaacatgcacgaagctgaagaaattccaccctgatcccaatagctcagcacttgaaatttgttgttgttgttgttaatggcttcttatttaatttctttttttccaacttttattttaggtttgggggtacgtgtgcaggtttgttacgtggggatgcggcgtgatgctgaggtctagggtatggatggccccagcagctgggtagtgagcatagcacccagccgtcgcttttcagccctcgctcccttcctctctcagctctttttttttttgagacagagtctcactctgtcacccaggctggagtgcaatagcatgatctcagctcactgcaacgtctgcctcctgggttcaagcgattctcctgcctcggcctccagagtagctgggattacaggagcacaccaccacgcctggctaatttttgtattttagtagagacggggtttcaccatgttgcccagggtggtctcgaactcctggcctcaagtgatcctcctgccttggcctcccgaagtgctgggattacagacgtgagcccaccgtgcctggcctccctccctcagctctttaaaaactgtgttctcggccaggcgcggtggctcatgcctgtaatcccagcactttgggaggccgaggcgggcggatcacgaggtcaggagattgagaccatcctggttaacatggtaaaacccagttctctactaaaaatacaaaaaaattagccaggcttggtggtgggtgcctgtagtcccagctactcgagaggctgaggcaggagaatggcgtgaacctgggaggcggagcttgcagtgagctgagattgcaccactgcactccagcctgggcaacagaacgatactctgtctcaaaaaaaaagtcttctctttgggtctttttttatatgcaggctctcctccccctcccctccttatcctccccatctttttcttttgttgcatggttgtagtcaaagtctagataaaatactaagtaagaaaagaaggaaagtgtttacaattttaatgtatcctgggttactctgtgatgtgaatttcaaattttgttttcttcaaaaattgaaataatttttttgtttattattatgtttttggattctagcatttccatttggctttaaaaacattgccaggtgcagtggctcacgcctgtaatcccagcactttgggaggctgaggtgggtggatcacaaggtcaggagatcgagaccatcctggctaatatgatgaagccccgtctctactaaaaatacaaaaaattagccgggtgtggtggtgggcgcctgtagtcccagctacttgggaggctgaggcaggagaatggcatgaacctgggaggcagaggcagagcttgcagtgagccgagatcgcgccactgcactccagcctgggtgacagagcgagactctgcctcaaaaaaaaaaaatttttttttctttttagttctgttccagtgttctcaattttgtcttttatttcctcaaacatactgagcagaattattttaaagtctttgtccacaaattccatgatttgcttcccctggggggatctctttgtattgtctgttgcttctcttgatttttgatcacatgatcttgcctctttgatatttatttaacaaatatgtattaagcatttactgtatgcaggcgctgttttaagcaccagagatttagcagtgaatcaagcccaggcagtattctagtgagggagacagacaataaccatggttaagacgcaaaatacgtcagataggtaactgtgagattgctgctcacagcaatacgtaactgctgagaggaccgcagagctctggagggggaggagaggcgtattgggagggttttcctgcactgagaaggtcacatttcagtggagacttggggagggaagggagggagccctgagacattgaggaaggctgtccttggcagataattgcaagtgaaaggcggaagtgtgtttcgtgtgggaggacagcagagagccctggggcaggtgaggggtatggggctgagggcagatcacgcagggccttgctggctgacataaacaattctgtttcaactcagatcggaggccattggagggttccagtgggcaggggagtgtgcaatctgtcttgtattttttttttttttgagatggagtctcactctgttgcccaggctggagtgcagtggcacaatcttggctcaccgcaacctccacctcccggatcaagcaattctcctgtctcagccccctgggtaactgggattacaggcacatgccaccacgcccagctactttttttgtatttttctagtagagatggggttttgccatgttaaccaggttggtctcgaactcctgacctcaggtgatccgcccgccttggcctcccaaagtgctggggttacaggtgtgagccaccgtgctcagcttttttttttttttttttttttttgaggtggagtgttggtttgtcgcccaggctggagtgcagtggcatgatcttggctcattgcaacctctccctcctgggttcaaatgattctcctgcctgagcctcccgaggagctggaattacaggtgcctgccaccatgcccggctaatttttgtatttttggtagagatgaggtttcatcatattggccaggctggtcttgaactgctgacctcaggtgatccgcctgcctcggcctcccaaagtcctgggattacaggcatgagccaccatgcccggccggtaatgcctttttttctggctgcattttaggttcttctctgtctttagctcctgcggtttaccacgctatgctggtttatcctgtgtgggagtttgtgttcttgttgaatctgtggcctgatgtctttaattagtttaggaaaattcttcatcatgatctcttcaaacgttgcttctgccatattctctcccctccatctggaactcgaattcacataaactggagctttttgccatagtccacatgctcttcagcacttttctgtagctgctttcctttcctgtctttgtactgcagtctggatattttcatctattttccaggttattaatttcttcccttgtgtttctcatctgctgttaaacccatccaccaagttcttagttccaatttttatgtttttttgattctagcatttccacgtgccttatagttttttttcttagtttcgtgccagtgttctcaatttcatcttttatttccttgaacatactgagcataattattttaaagtctatgtccattaactccatgatctgcatcccctgaggggatctttttgtattgtcttttgcttctcctgggttttgattacatgatcttgtctctttgtatctgagttgtttttgattgagttcccaacattacatatgaaaaattaaagagaaaatttgaggctgatatattccttttgagagaatgtataattgctttggaaaaatggctagcctaggggtgctagtaatcctggatcacccttatccaattagggactgagatgatttgagctgagattcagtcccagggaggctggcttaatcccagctcatctttctttctagtgtccacacaaaatcttctgggccaaagcacaaaatctggaggatttactaggatttcttttcctaggcaggccataagttccagttttgatctttcctacctctgcaaatgtgttgaaacctcagcctgtcagcttctcggctgcttgttgtagacacttcttgtggttccaactgctgtgttcatctctctgggtttctgtcttctccttgaaattggccttgtaattaattcttctctgctgtggtagctctctgatgctttcaaaaatatgtttttaacctttcatcaaggttttctagttgatctctccagaaagctcaatctaaacaacctagtcagtcattaacaggagtaaaaacctgatttatactttaataaaatctctaactgcaagaacaaccatgtcaatattctagatgagagatgaatgctggcttgggtcagagtggtagtaaataataactaaaattttcagcaccctctgttgactttgggcaatgccagatgaccccaccttctctctccatcttcccagtatagttgtatcaccattttaaaatcttttactatttcctttctaaaatcctaaattttaaatgatacactaacccctttacaatttcattgtgaactgtattctttaattctccattttttttttttctgagacataatctcgctctgtcgcccaggctggagtgcagtggtacgatttcggctcactgcaagctccacctcccatgttcacaccattcttctgcctcagcctcccgagtagctgggactacaggtgcccaccaccacgcccagctaatttttttgtatttttagtagagacggggtttcactgtgttagccaggatggtctcaatctcctgacctcgtgatccgcccaccttggcctcccaaagtgctgggattacaggtgtgagccaccacacctggccgattctccattttaaaaggcaaaggtcttcacatatccaccctgcttagctttccttttcaaaattttattatgtttttgttatctgaacttttcattttgcattgtccatattgataatatttatatattttttaaaaaactagaattatgccttttatgctttgtaagtaaattctgaaagttaaaaagtattgatcaagtatactggggaaatgcctttgttataactacaaacatgaatgctagtttagctgggtataaaagtctaggttgaaaggaagtttccttcagaatgttggaggcttcgtttcattgtcctctagtatctagtgtttcttttgagaagtttgagccattcttattgtcagtcctttgtaggtgaactgacttttctctatgggagcttttggaaaattcttatccctggaagtacagtgtaagagatccttttactaggactgaaaatcttgtgggctctgtcaaccaagacactcatgttcttcagtttagagaaatttttcttttatttctgacaagtttctattttattttactttctggaactgctgttaatcagatattgagcctcctggaatgtttttggtatatatatacatatatatatatatatgtatgtatatatatatatgtgtatatatatatgtatacatatatatacgtatatatacgtatatatacgtatatatacgtatatatatatgtatacatatatatacgtatatatacgtatatatgtatatataaaacgtgttatatgtgtgtgtatatatatataacatgttatatatatgtatatacagacatggtttttctctgtctttgtctctttttaagatattttcatgttgtatcttcctactgttatgtgtatgttatatgtgtaacatgaattatattaattaatataaaaggttacattcatggacctcccaacatcaccacattgaggatcaaatttcaggagggacaaaccacatccaactcatggcagatggtaatggggattgtggttatgttttaacaagtgtattttagagctagatattgaagtatttaaaatgaaatgctgtatctgagatttgcttccatcctctgtgtgtgtgtgtgtgtgtgtgtgtgtctgtgtgaagtgggtggaggtgaaatgaaataggactggctccattttgataatggttgagggtgggtgatggacgtttggtgattcattgtattactctgtctactcttgtgtagtttgggaatttccactgtaaaagggaagagaaggagcagccacaggacacctgggctcctggccttggggggctgcctggctcccaggcttccgagctcctgtggtcctgggtctggatcttgatgactttcaccacctctgtcctctgctctgtggggctctgcagcagaaccgttccctccgtggatccgggagaacctgcttcacataccccgggctgctgcgtacttcgtctgaatgtcaaattccatgcttcaggtcattgtctgttttccagaaatctcagatagcgttcctgccattctggtcattgtggtagatgtatatatgcatatatttttattttgctgtcattcgagaggtcgctagagggaaaagaggaaacgtgcactttccatctgccattttttttggggaagctccgtcaagatatatttaaatgatcgcataaagcttcacccggcaatccccgtgtactcagcgtcttcccggctgggcaattagcatctgataggtgtttgaggagacagaattggctggcacaggcagaggtgggcattggtgcacgtggaggtgggcattggagcacatggaggtgggcattggtgtacacagaggtgggcatcagcacacacgtagaggtgggcattggtgcacgtggaggtgggcattggagcacatggaggtgggcatcggcatacacagagggcatcagcacacgtgtggaggtgggcattggtgcatgtggaggtaggcgttggcatatgcagaagtgggcattggcacacggagatgggcatcagtgcacgtggaggtgggcattggcacacatggaggtgggcatcagctgcagaagaagtgggggcctctggggaaactgcccttggctgtgattgacagacggccacatcgggctgggtgaggagcgggtgggattgtttctgagggagcaacaagcagctctccaggctgcccttccgtggggagtgggtgccgtgcctggcacgtggcaggtgggccaggagtggggcttgaggccggtattggtcagggcgtctctgtgactgcatcccgctgctccatgtgggtgccggccaggcccactctggtctgtggggacccttcactcatgtccaccacccacaggatggatggcggctggcattcagcaggagctcccacccatgtcccagttttaacaggctggggagacagtcatttgtttactggaggttcctggaacaggaggaatggctacagagtccgcaggaagccagggcgggctggggtctcagactcctctcctgcatcctctaccttggtgtgatctggtgatcacctcacccacctggaccggtgcacctggctgactttaaatggccaattctcagaaatccttgggttcaatatttggaaccaataagcaaaccatttgcttaaagggatggtttttgaaagtcaaggaaggggatacccagacatagggctggtggcaccccggccttggcattcacgtggtgtctgcatctgtcagaccccaggaccccagagctcctgtacccctggagagtgagcatctcagagccgtggtctcagccttgtcacaggtgggcacgtctgggtcttgggatgtcagaaggcattggtagggaacttggcctggttgcccctgaattcctcctccacctcctggtccatgacgcaaggccctgcctgatagggccgccatcttttttcgggaagctcccgagctgtgggggaccaaagccctcagaggaccggcaggaaagccaggggatggatcagggtgaggccgggagggagagcgagggccttgtgtgcctgatctgtgtgaggggttgggggccgcacccacctcgaggctgaatagggcatgagtgaccaaggtgaacactcaggtcatgtgagccagcattgcttctgcacacagagccattcatatctgttaggacaggttgaaatctcttttccttaaaacaatttttttttttttttgagacagagtctcgctctgtcatccaggctggagtgcagtggcacgatctcggctcactgcaagctcactcccgggttcacgccattctcctgcctcagcctccggagtagctgggactacaggtgcctgccaccacacccagctaattttttgtatttttagtagagacagggtttcaccgtgttagccaagatggtctcgatctcctgacctcgtgatccacccatctcggcctcccaaagtgctggggttacaggcgtgaaccaccgtgcctggccaacaaattttttttgagttatggtctcactatgttgcccaggctggtcttgaactcctggggccaaatgatcctccctaagtgctgggattataggcgtgagccaccacacccggccagaagccaccacacccagcctgaagccaccgcacttggcctgaagtctcttcttactacgatgccagggacatgtgtcttcatttcccctcacagatgagtcccggtgaggtcaagcaacttactcagggtcacacagcactctaggaaaggagtgtgctcatctgtggtccctgtgagctacccggtgtggccttaggacgaggactgagctcctgggctctccaggctgcctggccctgctgattcctgacttctcctctccctcctccctgctccctcctcccttcttccttcctccctccctccccttacttcattcacccttttcccaaagaggcagaattgcagtgagaaaggggctcagctcagggcccggtgtgtcctcagaccacagagccccctgcctctggtcctaagcccacctttgagcgtggtggaggtcagtgtttaggctgcaggttatgcaaactcaggtcctccaggtgcaggaggaaaggcacattggccctggtgggattgaaatgcccaggctggctaagaccatgccggatgcatgaggtttagagtggctgaagagctggggacagtggtcgaagcacttgtctgtgggcaggagcaaggtctgcagtggtggtgcatcctgccatccacagctcaaggcagggtgggcttcggagcaaccccagcccacgtggaggacacaaccatggtcgttccacggtgactcggggctcaacttccagtcccctcctcccagcagacctccagatgcttgtcatctcagcctccataaaccccacaccagttcagcctctcactcactttaaaaagcaaattaaagttttaattttgagataattgtggatgtgcaggcagttataaaaattacctggagagcctcacccactttattttttaatgtctcacaaaactggtacatacacagaaatgttgacaggttcttaggaactgcaactttaggtgaacccacttacagctaattctttttttttttttttttatagagacagggtgtattagtccattttcatactgctataaagaaccacccaagactgcgtagtttacagagaggttgaattgactcacagttctgcatggctcggggggcctcaggaaacttatgatcatagcagaaggcagcaggggggaagcagagccgcttcttcacaaggcagcaggaaggagaagtgctgagtgaagggggaggagtcccttggaaacccatcagatcttgtgaaaactccctcactatcacgagaacagcaagggggaaactgccccatgattcagtcgcctccacctggtctctccctggacaagtggggatgatggggatgatggggattacaattcaagatgagatttggtgggggacacaaaatgagatttgagtggggacacaaagtgaaatttgggtggggacagaaaaagagatttgggtggggacacaaagcctaaccgtatgtccaactcctgagttcaagcgatcctcccactagtcctcccacagtgctgggatcacaggcatgggccctgtgcctggccgggacagccaggttcttacttcctttctgtgttttcctctcccacacaggaagaaaacaggcagattttggcgcggcaaaagtcaaactcacagtcggactcccatgatgaggaggtgtcgcccacccccccgaaccctgtggtgaaggcccgccgccggcgaggaggcgtgagtgccgaggtgtacaccgaggaggacgccgtgtcctacgtcaggaaggtgaggctcacgggtcacggggttcctgtccccaggcctcggcacgtggctgtcacctgtgagctccctggaagcccacggggcaccctcatcctcctgggggtctcagtgtcatcctggttggagggaggactatgtgggtgatggcagaggcagttctgggtgggcttggtttgctactgtctttgccagatgagctgagctcaaatttatgggagcagctctgtgtggggtcactgcagccccatggcggccttaggttcctcacaggctcaggaagggaagggactcgctggcatccaggtccttggagtgagcagaggctctgtcctgggctgtgtgcctcccatgctcctgcagcctctctggtctctctctttttttttttttttttttttgaaacagagtcttgctccgtcccccaggctggagtgcagtggtgcgatctcagctcactgcaagctccgcctcccaggttcatgccattctcctgcctcagcctcccgagtagctgggactacaggtgcctaccaccacacccagctaattttttgtatttttagtaaagacggggtttcactgtgttagccaggatggtctcaatctcctgaccttgtgatatgcccgtcttggcctcccaaagtgctggggttacgggcgtgagccaccatgcccagcatctctggtctcttcttatacaggcacaaatcccattattcagggcccttctctcatgaccccatccaaccccagccacctcccaaaggcctctctccaaataccatagcatggctggttagggcttccatatgtgaatttctggggagacacaagtcagtccccagtaccctgttagccatttctgagtgcacagttgagtggcgttaagcacattctcattgttgtggaatcatcaccaccaccatctccagaaccttcttaccttgcagaactgagactctattccctaaacacgcacaccccattcctttccgcagtacttaatacttttataatcagctaattaaagctagcgcaagcattgttaaaaatttattagggcactccacctctggggtcttcctccccaagacccagaacttcagtctaaccacgagaagaacctcaaataaacctaaattgcgggatgctccgcagaatgcctgaccagccctgctcacggcacacgaggagagtgtgaagaactgttgcagaccggaggccacgggggagacaggacggggtcctgggacagaaaaaggccattcaggccaaacaaaggaagaacagattaggtgtggagctcagtgtctgtcatgtatcgacatggcttccccagttgtgataaatgcatcataggatgtaaggtagtaacatcagggaactgcaaggtgcacgagaatgatctttgcaatttctctgtaaatagaaagtatttgaaaacaaaacatttatatatatttttttgagatggagtttcactcttgttgtccaggctggagtgcaatggcatgatctcagctcaccacaacctctgcctcccaggttcctgtgattctcctgtctcagcctcctgactggctgggattacaggtgcctgtcatcatgcctggctaatttttttgtatttttagtagagatggggtttcaccatgttggccaggcgggtcttgaacttctgacctcaggtgatccacctgcctcagcctcccaaagtgctgggattacaggtgtgagccaccacgcccatccaacacttacatttttaaaagtctgttagaactggagtggctttttaggagatttcattgctgtctctcaaagacgtctgcacaggggctctctgcgttacacgcagcacacctaagcctgcgtggtccgcagttgcacctggacagacagggacttcctgggtggcccaggcacaacaggaggtctcactgtggcccgaatgaccttcctgcgtggtttcattttaagcgggggatatcctggcatctgaaatgttcgtagtgcttctcattcatccagagagggagtggggaattgttgatcaaagggtgcagagtttcagacagacagacagacagacgggaggaatgggttttgagatctttgcacggtggggtgactgcagccagtaacagtgtactgcatacaggcacacactacatgaccacgttttggttgttgacagattgcatatatgtggttccgtaagattatgataccatattttttactgtaccttttctctgtgtagatatgtttatttgtttatttttttgagacaaattctccctctgtcactcaggctgaagtgcagtggcatgatcttgcctcatggcaacctccacctcccgggttcaggtgattctcctgcctcagcctcctgagtggctgattacaggtgcccaccacctttcccagctaatttttgtatttttagtagagatggggtttcaccatgttgggcaggctggtctcgaactcttgacctcaggcgatccgcctgcctcggcctctcaaagtgctgggattacaggcgtgagccaccgtgcccggcctgtgtagatatgtttagatacacctagcattgtcttacagctgcctgcagtgttgaggatggccacatcctgtacagatttgtagcctagagcgataggctctatcatgttataacctcagtgcatagttaggctataccagctaggcttgtgtctgttgctctgtgatgttcgcatgatgatgaaattgcctcatgatgaatttctcagaacgcttccccatcattacgtgacacgtgactgcatttcaaaagtaacaagaggctgggtgcggtggctcacacctgtaatcccagcactttgggaggctgagatgggaggattgcttgagctgagatgtttgagaccagcctgggcaacatagtgagacctcatctccactaaaaataaaaaagttagccaagtgtggtggtgcatacctgtggtcccagctacttgggaggctgaagtgggaggagcacctgagcccaggaggttgaggctgcagtgagctgtgatcaagactctgtttagaaaaaaacagtggtgaaatacacattaaacttcaaattgcatatttgtaccattgcctgataacagcaggctgagggtggagtagggagatttcaggccgcgtcacagcatcaggccagggtggctcacacggtgatgtgttggctccgcttcaggtgattcccaaggactacaaaaccatgactgcgctggccaaggccatctccaagaacgtgctcttcgctcacctggatgacaacgagaggaggtaggcagactcgtcccctgccccggcatcaccgccgccctcctcggcctccgggaggtgggcaggtcccgccacttgcctgggcatcactgcctccctccctggcctccaggaggtgggcagcccccgttgctcgcctgggaatcacagctgccttctccggcctccgggaggtgggcaggccccgttgcttgcccaggaatcaccaccgccctccttgccctccgggaggtgggcaggccccattgcttgcccgggagtcaccaccaccctccttgccctccgggaggtgggcaggccccgttgcttgcccgggaatcaccaccgccctccttgccctccgggaggtgggcaggccccgttgcttgcccgggaatcaccaccaccctccttgccctcggggaggtaggcagcccccgttgctctcctgggaatcaccgccgccctccccggcctccagggaggctttgccgtttctctgactcatgggccatggaatacagaacgctcggcgccaggagaagcgtgtcacagctctcaggaaacgtgggctcaccacgcaggggtggcttcccgaaatactatgctgcgtgcacctgccctgctgccgagctgagtccctgctctgggaaggcccggctgccttcctcaaatagggggtctggatctgcggttcccccgcgcgctatacctaggcaggcacaggtggtgtgattaccgtgggcttcgtgttccggcctcttccgcatgcatggatataccttgccgttgctaagctcacagcctcgttggggagatggggccgggatgtacctttcctgcggctcctgcctgtgccgggagctcggaggcctgaggcaggaggtgacagcagatgaggtctgcagggtcgcagtgaggggacagaggaggtcagggttattcagggagagggctgagcgtgaaggggcttggacgccatgtgtggggatgttgatcatagacataattggaaaaattggaaaattttgaaaagattgaaagcaaaaatgtctccatctgatgcctagggatgatccttggggatatttgggggacaggcgttaaggattgcccttgtgcacagatcccgtcggtaacagcatctcattctaccctgttttcccatactcggggcgtcctcaacacctttccatgccagttagcgtgctgcagttgtcttgtgctgtcaatttctatgtgaattagctgttttcctactgcggctgtttgcattttttaaatctctattattattattattttagacagagtcttgctctgttgcccaggctggactgcagtcgtatgatcttggctcacttcaacctccgccacctgggttcaagcgattctcctgcctcagcctcctgagtatctgggattacaggatcccgacaccacgcccggctaatttttgcatttttagtagagatgggttttcaccatgttggccaggctggtctcgaactcctgacctcatgatccacctgcctcggcctcccaaagtgctgggattacaggcgtgagccactgcgcccggcctgcatttttaactttatgaacattgggtggtcatccttgtgttttcatcttggagtacttgttcgtttctttctttgagataaattccttgatgtgatcaaaggatgtgtaacatattgaaaattctctcttttaaaacaattttttgacaaattataattctttattacattaactgagcatattttgatactagtcctatataaaatctaaatgacctccatatgtataaaatacaaagagaaagtgtctttttctccccctcccggagggcaacggtgtggtggtctggtgggggctccagccgccctgtgtgtttgcaggcgtgtgcccgtgagtgcaggtggggaccctgggaacacactagacgcattgttctctgctgtgctcctcgccagtgatggggtgatgggtctaggaagtccttccatataagtacagatctaattgttgtgcgtatctgcacagcgttccattgtaagaatgaatcagagtttatgaactgctgcctttgccaaggtcacgtgggaggcttctgatttctccgtgctccgatgtttccgtgagtagtgatgctgtggttaggcaggagactcctggtattcaggttgctgggtcagagattggcctgtgaagatcccgatgggtgttggtgtgtgtgtttttaacaggcttttgatacattttgctggaatctcactcagaaagggtggcaggggctgtgcagaggagtggccttcaagggtcttggcacccagccactcacatcatgctgaaataccctatcttatccagagcatgtggctggttcaggctggatactttgggtccagggtgcccagttaccccaagcaggaacacctgttgcttctgtggttgagcagtggttagagtagctgaggatggctgggatagctgtgtgtggctggagtatctgggtgtagctagagtagctaggcatggagagagttagctgggcatgacgagtggctagatgtggctagagtagctgggtgtggctggaatagctgggtgttgctggagtagctgggtgtggctagagtagctaggcatggatggagtagctagatgtggccagagtagctgggtgtggctggaatagctgggtttggctggagtagctgggcatggctgcctactcgaatagctgagtgtggctggaatagctgggtttggttggagtagctggacatggctggaatatctgggtgtggctagagtagctaggtatacatggagtagctgggcatgactggagtagttagatgtggctagagtagctgggtgtggctggaatagctgggcatggctggagtatctaagcatggatggagttgctgggcatgactagagtagctggatgtgactagagtagctgggtgtggctggaattcaggattagcctggacatggttggagtagctgggtgtggctggagtagctgggcatggctactccatcctgggaggtgtccaggccccccaggatacccacgacctagtctctgggacctggatgtgtcatcttgagtggcagagagggactttgcagatgtgatgaagtgagattcgaggtgggcgggtggccctgggtttcccaggagggccctgatgccatcacttgtgccttctaaggggaggcaggaggagatgccacacacagaaggggaagaggccatgcaacacaaggcaggagttggtgagatgtggcacacgccgaggagggccgcagccacctgaagaggcgaggaggggcctgcccggggcctctggagggcgtggtcctgtggcaccttgatttccacctgctgatcctggatctggacttctggccccagaactgcagagacgatacgtttctgttgtttcaggacctgctgtacttgctcacagcggccctgggatacgtgcacagaggtgtctgcctggcagtggtgaacctggtcaccaggaggagtcagatactgaagagctgaagactatttttttttttttttgagatggagtctcactctgttgcccaggcttcagtgcagtggggcgatctcggctcactgcaagctctgcctcacaggttcacgtcattctcctgcctcagcctcccaggtagctgggactacaggcgcccgccaccatgcctggctaattttttgtatttttagtagagatggggtttcactgtgttggccaggatggtctcgatctcctgaccttgtgatccactctcctcggcctcccaaagtgctgggattacaggcgtgagccaccgcgcccggctgagctgaagactattttaacttgaatttattttaacttgaatttaaacatcaatttacaatgcaattgaaatgtcgtttttgaacggatattacgttcacccggttgaaaattcagtttggaagatcacgaagggaccctgaggaagagagagccctttctggtcccagctgcgccttgctagagcctctgcagctccctctttgcagacagagtcagccctgaagcgggaggtccctggtccacagctgctggccacacagaccagctgtccattctgtgtgtgtgtgtttttttttttttttttttttttttttttttttaaagacaaggccttactctctcacccaggctggagtgcagtggcaccatcatagctcactgcagcctcggccttccgtgctcaagtgattctcctacctcaacttcctgaataactgggactgcaggtgtgcaccaccatgcctggctaattaaaaaaaaattattttttctttttttgagatggagtttcactcttcttgcccaggcgggagtgcagtcttgcaatcttggctcactgcaatgtccgcctccgggttcaagcgattcccctgcctcagccttccaagtagctgggattataggcatgtgccaccacacccagctaatttttgtatatttagtagagatggggtttcaccatgttggccaggctggtctcgaactcctgacctcaagtgatcctcctgcctcagccccccaaagtgctaggattatagacatgagccatcgcgcctggctattatttttatttctagcaacagtaatgaagaccatccaacgttttctttttctggctcaaatattcccacatgtgggaacagtgcggtgggtggagcacagctttgcacctgaattcaaaattggttcaacaaggccgggtgcggtggctcatgcctgtaatcccaacactctgggaggctgaggtgggcagatcacttgaggccaggagttcaagaccagcctggccaatatggtgaatccccatctctactaaaaatacaaaaattaggctgagcacagttgcgcatgcctgtaatcccagctactcaggagactgaggcgggagaattgcttgaacccgggtggcggagattgcaatgagccgagatcatgccactgcactccagcctgggcgacagagcgagactccatcttaaaaaaaaaaacaaattcggttccacagaatttaagacgacaaatacttccagaggattcattgtgtgccaggctccgtgcagggttctgggaacacagtgggggtagggaacgggtgctgtcctcatggggctggctcttccggggagcaggcagcacacagtcatgaagcacatacatttttagagatggtgtgtggtgaaggacattgagagaggcctgcacgtcatagagtgggatggcttcattcaggatgggcagaaaggtgagagccagcacggctgttccaggcatggcacagctgcagcaaagggcctggggcccgttccaggcatggctggggcaggggagagctggtgaacacatggtaggacagctttgttcatttcagcaggaacctgctgcctgtgggggtgctggggccacagggaacaaggcatcacttggagggtagccaggaaaatggagatctcaatgtcctcctgggattcaaatatgtgtcttaacctgggcaacatagtgagaccccatctcttaaaaaaattacccgggcctggtggtacacgcctataatcccagttactctggaggctgaggtgggaggagtgctcgagctcaggagttcaaggctacagtgagccgagattgtgtcgctacactctagcctgggcaacagagcgagatcctgtctgaaaacaaaagcagaaacaaaaaatcccccaaaaccccacccaaacacccagatatgtgcttggagttcccaggggttctggtgcttcttggaactcacccgtccctctgcatggctcgttcctcttgaagtagccacagtgagaggcaaatgtttgggcgtggggagccccctgagctgttccctccagaggcagcccgtgagcttagagcttatcaaaagcccggctctggccaaatgacatccacgcccaccttcagaatctgaattctgcggagctcgatgaaggcaacggagggacggagaagcggtgggttggggagggtgggtggtgttcagggccctttagaaaccctcaagtcctcaacctgaggaagaaggaggtggacggtcgcttcagctcttgacccatttgtcagacagaaccactcacgcgaaatctgtgtccccatcttctggctgatgagcctggggtcactgagagcgccgaggtcgggaaagctctggctgaagatgggctgggatgtgctgcagccacgatcatctccggtatctggggctgatgccgtgtcctcggtcctgagcccctctgcctgacgccgtggcatgggggagctcggaggctgtcctcggtccggagccccgctgccggatgccacggcgtgggagagctcggaggccgtcttcggtcctgagcccctctgccggatgccgtggcgtgggggagctcgggggccgtcctcggtcctgagtccctctgctggatgctgtggcgtgggggagctcggaggccgtcctgggtcctgagtccctctgctggatgctgtggcgtgggggagctcggaggccgtcctcggtcctgagcccctctgctggatgctgtggcatgggggagctcggaggccgtcctcggtcctgagcccctctgctggatgctgtggcgtcggggagctcagaggccgtcctcggtcctgagcccctctgctggacgctgtggcatgggggagctcagaggcccaggccgcctagctcttgggctcagctatcaacacgggcttccatgttcatggaggcacaggcttgtcaccacctcagcccagaattgtcacatgtcacaggtgagcatgggccatggactggtcccctggcctggcgtggttgcagggatgctgggcagtcattccctgggtgcctagggaggaggaatatgaagtggggtttcatgaacttgtagctccatctcatttccaacatctgtcctccctgcatgtgcaatgtttacatccaaaccctaaaaaaatggcacgtggggctgggcgcggtggctcacgtccataattccagcactttgggaggccgaggcgggtggatcacgaggtcaggagattgagaccatcctggctaacacagtgaaacccagtctctactaaaaatacaaaaaaaaatcagctgggcgtggtggcaggagcctgtagtcccagctgctaaggaggctgaggcaggagaatggcgtgaacctgggaggcggagcttgcagtgagctgagatcgtgccactgcactccagcctgggcgacagagcaagactccgtctcaaaaaaaaaaaaaaaatatggcacgtggacctgcccaccagccttctctctcgctcttgttttcattgtggcaaatatatatcacataaagtttgcaattttaaccttttctttttttttgagatggagtctcactctgtcacccaggctggagtgcagtggcgctatctcggctcactgcaacctccgtctcctgggttcaagtgattctcctgcctcagcctcccgagtagctgagattacaggtgtgcgccaccacacctggctaatttttgtatttttagtagagatggggtttcagcatgttggccaggctggtcttgaactcctgacctcaggtgatccacccacctcagcctcccaaagtgctgggattacaggtgtgagccactgcacccagcccattttagccatttttaagtgtttaattcagtggcattagttacattcacaatggtgtgctgccatcaccactctttgtttccaaaattttcatcattccaaatggaagccccacacttattcagcagtcagtcctatcaccccctcctgggcccctgatagccccaatttactttctctttctatgagcttgcctattctaaatatttcatgtaagtcattatgggacttaaatgaaccatgatatatgacctttcgtgatgggctctttcactgagcacagtgttttcaaggtgcatccacagcatagcatgtatcaatgctctcttcctttttcagggccgagtaatattccactccacggccacaccccatttgtgtatccatttgtctgctgatggacacttgggttgtttccaccttttggttattgtgattagtgctgctgtgaacatgggtgtgcaggtgtctgtttgagtctcctgggcagatgctgatggatggaattgccgggtcatatggtagttccatgtttagctttttgaggaaccacagattgtgcttcccttccagcctgaccgaactcagagcctcccattcctttctgtgccctcttggtggcaactgcgtttcagctaaactcctcaaatcctttctgggctcctccccagctcccaggctctaggtaggttcagtaaagctcttattttagggccagcctggaccctgagtgtgagctgagtcaaatgatatctctgggccatcccagctgtttatgtccagtgctgggtcctgtgcccttggccctgagaatcagaacgacatgcgccctccatctctgacccctctggatccgagagctacgcggacaagaaacagaggaagcagatggttggcttaaaaactcctctttgtaaggctggcttgaaaaggaagcttttgcacagggtgtgtgtgtcggtttcagctcttttgttttgcacacaggaaaactcactttccatatcgaagccccagtgggctcctttttctggccacggtctctaaagaaacaggctgatggctcaggaaaccggttccagagggagtgggcaggggagggattgtctctggacctttcacgtgatgtctcccctgtgcagcatccagatagtttgctttttccagtttactagaagctgagcttcatagctttgcctctgctcagctgtggtttggcgagcaaagccaaattccttccaagtttacagggcgtctggcacacccctgactttgaggctgcctgctcttcttctctctgcttccccgcttaggaagagtgcggcagagaatcctttgcagatgcatccacctgcagggtttgcacacctgctggcctaatgacccctccgtacaagttcaggttcaagacagatatccccatcatcacaggctgtgtgactttgctcttgtcgatccgtaacagtgtgggagatacataaggttgtgcgagagatacgtaagcttggagaagggtagaaattatgtttaagacctttgatttaaaggaagatagtgcaacgtggttgtgagggaggctgcaactcccccagaccgcctgcctgtccttctaggatggtggtattgctagttggccttgatcgaagggtttccctgggcctttgcacaggatctgtgagaggcatagtgtcaacctcacagcctcagtttccttccctgtccttgtccaaggccccacaactcctcaggagcagagctagggtttgagctcgagttcttgggcacctaagcctgtgctccctcccctgtaaggacacatcacctgcacctgccgctaccctgcctgcatggtgaaggaagattgagaatgggtgatttaggcattgccagtgagcggggtccatactgtcctgtagtgaactgcagctgcagggagacagctcaggggtgagacaggaccaggagttcccatcacacaggtgttgggctggagtggtcttattcccaggcacgcctatgcacacagtcatgcacacacaatctcactcagataccacagaatttaaggtgtgtttaaaacatcttttggaaggagagagttgtggatgtcatttataagtaataacattctctgagcctcagtttcctcaggtgtcaaatgaagataataaaacctactttgaggttgttgtgagaatataaagcaagaatatctatgtgtgtactgttatcaccaccatcattatcatcaccatcatagtcatcaccattaccatcatcaccatccccaccatcaccatcatcactgtcatcatcaccatcattatcatcaccatcaccaccaccatcctcatcaccaccattgccatcatcatcgttatcaccaccatcatcatcaccatccccaccatcaccatcatcactgtcatcatcaccatcattatcatcatcaccatcaccaccaccatcctcatcaccaccattgccatcatcatctttatcatcaccatcatcatcatcaccgccatcatcatcactgttgtggtcattgtcatcaccatctttctgtggccctttggctgtgtggcagtggagtccatgaaggtacttcttctggatggtgccttgccccttggaggctggcccggctatccagacagaccccgcagtcaggccccactcagtacttggtctgagaaagaggctggggtagccttgagtcattctctgctccaccctgggcctgagttggtgaataggccgctccgggcctcccagcacccacagtcagcaggaagatccctaggaggccaccttgtccccacctcactgtactgaacagagctctgagacccagtgagagggggccttggcctgttgcactgacccacacagcaattgtccagctggggctggagtggggtgtccttatcccctgggacggcacctgcacagcccctctgcagagttgagtagctcccagggcaggccccagggtggtggtaggtgcagccttctcaccttgtgtcagctattggagcgaagcagattccgcatcctacctggggtgcccggggcagttacgcctcggccagggacctcagcagcctcaggaagcagccccgcgtgctccggagctctctgatgtgccaggaccatgaaggctgtccctggagcgtgtgtcccagggaagcagccccgcatgttccggagctctctgatgtgccaggaccatgaaggctgtccctggagcgtgtgtcccaggccttggggagtgaggtggaggcccttgggttctatcccggtcccttcccggctttccctgattagggcgcctgtagggggagcatcgctgagctcctgggagccgagaaacgtgataattgggtggcaccgtgcgtgtttgtgttgtgcgttgggcctccggcggggacctcattactggagctgccagacgggcacaggcgagggcacctcacccttgaggcggccttcctggcagtggctccagctctctgctgctttaattaaaacaggcctctggcttgagcagcaccgctggcctgcgcagctgtctgttatctgtcgctgtttctcttcctcccacccgcgtatctctgcagtctgtttttccacaaactggctcggatcctcaggtgatgggaaaaacaagcccttctgccgaattcacgggcagctgaagggagctgtctcctggcttctctgagccttcacggccccctctccccattctggcttgggctttgggactttctgcttccctttcgggcaacattaaaaaaacaaaattagcattttggaaaatgcagggcctcatccgaggagatgcttaatggcttgaacatgcaaagaatttgatttccatttgcagaaagcccagctggatctcagcagaggagaccttgaggttagcaaatcaggggccacgtgagcccgggaggctttagaagctgaattcaacggaggctgaagcctggggtttgaagcttgcatcagatgatgtatgcaatggccagtccctgggccatgggcctcgggcatgttgtctttctagagctcccccgtggcccccgaggctgccgtttggcaggggaggcagagagaggttaagcaggctgcgtcgggccacccagcttggagtagaagctgggactttgacctggctgggatgtggctgcttggggctgacttgcccaccgtgaatgcacacacagctcattaacctgccgggaaaagacaacaacctttttaagagaacagtcattttccacacgcctagcgttttccagctaataacaagtctcgtggcctgcgcctggagctgcggggcagttgcagctctccgtggagcctgtttcaaagggtctccagggctggcgctatctaataccacagtgacaacaagccctcttgctttgtctgatttgtgagtggagagaagaacctcaggtctttcttaccacttcccccaggtgatcgtggcctgcgtggatcttgcctgtggtcctggctgtttggtgccctgagatttttgtttttgtttttttgagacacagtcttgctccgttgctcaggctggagtgtagtggcacgatcttggctcactgcagcctcgacttcctgggctcaagtgatcctcctgcctcagcctcccgactagctggggccacaggcgtgcaccaccacacccagctattttttttttttagtttttgtagagacagagtctcgctgtgttgcccaggctggacttgagcctcctgggctcaagcgatcctctggcctcagcctcccatagtgttgggattgcaggcatgagccaccacacccagcagctgctgtaacattttgaaacttgtggaatttggtggtgtgtggtctccggtaccacatcttctgacccctagccagttcacgttttgttgtcactgacaagcccctgcagacctgggggctgagatgctgcacgtggcctctgcctccagcacccagtatgtggatggggacccgaggcccagagaaggtgcaggaaggcccactgccccgggcagggaatggggctgtccttcagatggagggtgccagggcagaggctgtgttcatgcaggcctgaggctaagccctggtgcagcactggccactgtgctgtgtcggggaccacatagcgaccagaaggagggatgcaccagctttcacattccgacggacgccatgggtcctggcatggctccattcttgagccctggtcactaaaaatagccccgtcgcctgccagcgggtgtgaggaattcaccagctggctggggatgggggtctgtggagagaggccaggcgaagggaaggttgcgtggggagggccctccatggaggggaatgtaaccgtcgagctggtcctggccctatggggctccttgtaatacaaagcatcttgtcagcaatttggtgaccctgttcccacttgtcgggggggaccctgaggctcagagacagcggggggcttgcccaggtcacacggtttccgtgggaaagatcagccctcctgagaccaggccctgcacgcccacctgtctgctccctgcagaatgaggaagccactccgattcgggaggcagttgtaactcacgctccctgagttctgcttggggtcaggtgtgtggctgagagctgtgagtgtgctgtctcgctgtcctgatggcagccctgagggcacgtggtaacactgtccccaagttccaggtgaggatctgacacacggagagctgtggccacctgcttcgggccaccgctgctgcccagaccaccacatgcaccctggtttgaccacggtctgtgtagggccaggaccctgggacacagccgtcccctcccctcctgaccgagagccttttcttttctagtagggaccagtattttaaaagtgaatgggccgggcacggtggctcacgcctgtaatcccagcactttgggaggctgaggcagggggattgcttgagcccaggagtttgagaccagcctgggcagcatagcaagaccccatctctaccctcctcctaaaaattaaaaaattagctgggcatggtggcatgcacctgtagttgcagctactcaggaagctgaggtgggaggattgcttgaggctgggaggttgaagctacggtgagctgtgattgcaccactcctctctccagcctgggtgacagggcaagaccctgtctcaaaaagaaaaataagtaaaaataaacacacatcaataaaaagtggattattgtctggttgtctcatgggtgtgatagttgctgctggaccactgaggaagtgactgattcttcccgcgggtgggcccttgttcatcagacctagtgaaacttcagccacatccacaagggattttccaggcaaagaagaggggggactaagttcctgagtgtcttggggcctctttcaggactctgtcctgtctgttcattgaacactcttagatcttttctgggtttcagtctgtttgaaagcatcagaaaatgttaggaaggaagagggtgatgaacagggtggtgcttctggaaggcccctgctgtggccgctccgagggtgagagcctgggccccaggtggtggggggagctttggaggctggggcccaggactcagcattgcttggagggtgtcccaggagacttgctcagactctgctgtgggtgcccgtgggactggaggggagctcaggcatggggagagtaggtatttggatctgttggggtggggacctgtgccactgaggggagagtaggtatttggatctgttggagtggggacctgtggcatggcggggagagtaggtgtttggatctgttggggtggggacttgtgctatgggggggagagtaggtaattgcatctgttggggtggggacctgtgccactgggtggagagtaggtatttggatctgttggggtggggacctgtggcatgggggggagagtaggtatttggacccgttggggtggggaacttgtggcactggggggagagtaggtatttggacccgttgggatggggacctgtgccatggagggaagagtaggtatttggacccgttggggtggggacctgtgccatgggggggagagtaggtatttggacctgttggagtagggacctgtgccttgcgggggagagtaggtatttggacccgttggggtgggggacctgtgccatgtgggggagagtaggtatttggacccgttggggtggggacctgtgccatgggggggagagtaggtatttggatctgttggggtgtggacctgtgccatggagggaaagagtaagtatttggacccactggggtggggacctgtgccatgggggggagagtaggtatttggacccgttggggtggggacctgtgccatgggggggagagtaggtatttggatccgttggggtggggacctgtgccatgtgggggagagtaggtatttggacccgttggggtggggacctgtgccatggaggggaagagtaggtatttggacccgttggggtggggacctgtgccatgggggggagagtaggtatttggacctgttggagtagggacctgtgccttgcgggggagagtaggtatttggacccgttggggtggggacctgtgccatgggggggagagtaggtatttggacctgttggagtagggacctgtgccttgcgggggagagtaggtatttggatccgttggggtggggacctgtgccatgggggggagagtaggtatttgcatctgttggggtggggacctgtgccatgggggggagagtaggtatttggacccgttggggtggggacctgtgccatgggggggagagtaggtatttggacccgttggggtggggacctgtgccatgggggggagagtaggtatttggatctgttggggtggggacctgtgccatggaggggaagagtaagtatttggacccgttgtggtggggaactgtgccatgggggggagagtaggtatttggacccgttggggtggggacctgtgccatggtggggggagagtaggtatttggatctgttggggtggggacctgtgccatggtggggagagtaggtatttggacccgttggcgtggggacctgtgccatgggggggagagtaggtatttggatccgttggggtggggacctgtgccatgggggggagagtaggtatttggacccgttggggtggggacctgtgccatggagggaaagagtaagtatttggacccgttggggtggggacctgtgccatggggggcagagtaggtatttggacccgttggggtggggacctgtcccatgggggggagagtaggtatttggacccgttggggtggggacctgtgccatgggggggagagtaggtatttggatccgttggggtggggacctgtgccatgggggggagagtaggtatttggatctgttggggtggggacctgtgccatggaggggaagagtaagtatttggacccgttgggttggggacctgtgccatggggggagagtaggtatttggacccgttggagtagggacctgtgccatggggggcagagtaggtatttggatctgttgggttggggacctgtgccatgggggggagagtaggtatttgcatctgttggggtggggacctgtgctatggaggggagagtaggtatttggacccgttggggtggggacctgtgccatggaggggagagtaggtatttggatttgttggggtggggacctgtggcatgggggggagagtaggtatttggatctgttggggtggggacttgtgctatgggggggagagtaggtaattgcatctgttggggtggggacctgtgccatgggggggagagtaggtatttggacccgttggggtggggacctgtgccatgggggggagagtaggtatttggatctgttggggtggggacctgtggcattgggggcagagtaggtatttggacccgttggggtggggagcctgtggcactggggggagagtaggtatttggatctgttggggtggggacctgtgccatgggagggattgtaggtatttggacccgttggagcggggcctgtggcacccggggaggtgtcgagaggcagcaggctcacagacttgggccccattgagctatggtagacgggaactcggtgggcccatgtccccggggagactgagcagggaggtgatgccaggcctgggtggaaccagaacccggaacatggagccgggagaaggctgggatgggctcatgggctcctcccctctctgcaggagggaactgtcctggggaggggagtcgcttccccactgactccgagtaggggatggagagcccaaggcggcggcacctctctcctgctgggagagcctagagcctttgtcactaaagggagagaggccactggctcctcgtgcctcaagggctcaaacattttctgctcactggggagatctacaggactgggggcagctcctcctcccccttctcttccttaacattacatttttttattgtaataaaaatctgggaatctgggccaggcacagtagcacaaacctgtggtcccagctactccagaggctgaggtggcaggtcgcttaagcccgggaggtggagactgcagtgagccgagatcgcgccactgcactgggcgacagagcgagactccgtctcaaaaacaaaaacaaaaacaaaagccctcacaaggcccatgcgtctggacgtgcagagctgtggaggaagcagcctcttgctgtcctgccggtgtccatggtcgcggcctggggtttcctccctgggctggtttttgcagccgtcgtcttcttgcctcaccagtgttgttgtttctcctctccccattggctcccagctcccttcctcacagctgcctgcatgcgcagaatattccggctcgggacggcgtgtgcggccaccatgtgggtgccctcctctccccctttcgtggtcacttcggtgcctgtgggctgaatcatatgtggcagttggaagtgctccactaggatggaagctatactcactcattcattcaacaggtgtttagtgagcatctccttcaggccagaccccgcccgaggggttgaagatactgcatgcgcaacacagaccaccccctaccgtacctggctttactgagcttttttctaatggaagagactataagtaaatgaaataaattgttagaatataggatgaggcagtgagacgtgctgaaaagaaacacaaggtggtgcagggggtggggatgcagttttggtagagaccagcgtcttaggattgtgtcatcctcatggtttgtgagccgtcctgcacatctccgcagagtgtctgtgctgtgtgtgtgaggtttttatttgcctggtgtcatgagacccatgttggtgactctttcttagcttacaaatgactgcgagataatatttttttaaaaacattaggccaggcacggtggctcatgtctataaccccagcattttgggaggctgaggtgggtggatcacttgaggccaggagtttgagaccagcctgtccaacatgacaaaaccctgtctctactaaaaatacaaaaattagcctggcatgatggtgggtgcctgtagtcccagctactcaggaggctgaggcaggagaatcacttgaaccagggaggtggaggttgcagtgagctgagaatgcaccactgcactccagcctgggcaacagagtaagactctatctcaaaaaaacccaaaaaacaaaaaacattttatcgtggaaaacttcaaaagtatatgaaagaagagtggctttcgtgagccgccggcttccatagcacaaggtcatgttcaggctgctctcatctctcttccctcccactttctcccgaccctgatctattttgaagcaaacctcagccatcagatcattttgtctgtgaatatttcagtgtaagatgctaactttgtttttttctgagacaaggtctcactctattgcccaggctggagcacagtggtgcagtcataaatcacagcagcccccacctcatgggctccagtgatcctcctgcctcagcctcctagtagctggaactacaggtgtgcaccaccatgcctggctaatttttaattttttttgtagagatgggggtctcgctgtgttgcccaggctggtcttgaactcctgtcctcaagcagtgctccctccttggcatctcaaagtgctgggattacaggtgtgagccaccggaccccgccaagttgctaatttttgatctagtttcttgtcttcataatcacatcactgtggataggtgaggttggggtagcacattcgccgtccatatgctggctcacggagctgctgtctcggcctgtgtttctgacgtgggccttgcttgtcgggtttgcatttctctctgcatttaattgggagcctctttagaaggtgggtctgcttctgagcttctttctgctgctgcaaagctgggctcagtgggaattacgcaagcctcgctggttcatgaggaggtggaggctgtgagaagaaatgaaagcgcccctgagcccagacaattattttcttcttgttttacaagcctgttgctgaagactcgacattttctgctttacgtcttgtgtggtgacagctggttcatgcttgtccttcaaaaaaagcaacagttgctaagagtcccacaaacaaagatgtgctttgactcccaggaacagctgtggaaggacagggtgtcctgtcggctgctatgtccaaatattcagactgcccaaaacggcgcctcagcccctggcgccgctgggtactgcccctcattcctgtccaccacccccatagctttgtattttctaacggtgaaaaaatgccttcttacttcttgaccagagacacgaagtcctctgagttaattgagtctaaatatggggtattgagggagaagaggtcagcatgaatcattcacccattcattcattcatccatccatccatccatccatccatccatgcacacattcattcatgcatcaattccttcattcacccatccacacattcactcatgcatccattcatttgttcactcattcattcatccatccatccatccatccatccatccatccatccgtccgtccattcatccatccattcatttatccatccatgcacacattcactcatgcatcaattccttcattcacccatccacacattcactcatgcatccattcatttgttcactcattcattcattcattcatccatctatccatccatccatccatgcattcactcatgcatcctttcattcattcacccatccatgcattcactcatgcatccattcatttattcactcattcattcattcatccatccatccgtccatccatccatccattcatccatccgtccgtccatccatgcattcactcatgcatccattcattcgttcactcattcattcattcatccatccgtccgtccatccatgcattcactcatgcatccattcatctgttcacccattcattcattcacccatccacacattgactcatgcatccactcattcattcatctatccacacattcactcatgcatccattcctttgttcagacatttatccattcattcattcatccatccatgcatttacacatccatccactcatttgttcacccatttatccatccattcactcatgaatccattaattcattcacccacttattcatccattcactcattcattcattcatctacgcattcacttatgcatccattcctttgttccatttatccattcattcatccatccatccatccatccattccctcactcatccattaattccccccttatccatacatttagtcatccatccacacattcactcatacatccatccagtcatccattcactcatttatccactcattcattcacccacttatccattcatttatctatccattcatacattcatttcttcatctattcatctagtcagtcatccattcattcatgcatccatacattcacccatgcatcatccattcattcacccattcattcattcattagctcatgtatccactcattcatccatccatgcattcacccacccatccactaattcacctatttatccatccattcagtcactcatttatccattcattcatttttccattcattcattcacccctccacacattcactcaggcacccatccattcattcacccatccagtaaatcctggttggatctcctctgtgcccagtgctggaaatcgtgctcacagatgtagacacaagtgggaggagagcccaaggagaaaatgactttctggggaggtggaggtggatctttgtctttcaaaggctcataaatggatttttctgactcagtgagaaacccaaccacttacgcgggggcagaccttgtatcccagagagcagcctcacatgctgtctcatgtaactccccaatggacccaggaagtaggggcgtcatttgctctgtttcacccagagggtaactgaggttggagagactcacttggggcatgctctcatcaatcagggaaccaactctgaatcatatgtggcagttggaggtgctccactaggatggaagctacactcactcattcattcaacaaatgtttagtgaggatctccttcaggccaggccctgcccgaggggctgcagatacaagatgcgcaacacagaccacccctaccatacctggctttactcaactcttttctaatggaagagacaatgagtaaatgaaataaattgttagaatataggatgaggcagtaagaagtgccaaaaagaaacacaagatgatgcaggggatggggatgcagttttggaggggggcctggaaaagccatgctgagaagggaagattgaggaaatacctgggggaaagaggaagtgaaccaggaatttatctggggaaagagcattgccggcagcaggagggcaggtgcaaaggccctgtggtcaggggcatgcctggttgtccaagaattaacaaggaggccagtgaagccagagcagagcctgggaagaggccattgacaggtgatgaaaacacagaggaagaggcgccagatcttgtagggcattctgggtcactgcaaggactttggcttttattctgagatgggaggccctagaaggcatagcatgtcggctcttacatgttttatttagcagggtctgtctggctctccactaagaatagaaggtagggggacaagggcagaagtggaaaacccagttaagaggttgttttgctaattccaggcaggagatgctgatttctgggatcagggcagtaccactggcagtggtaagtggttagttgattctaaagaaaggggccctgtctagcctgagatggttcagctatgaggtttgtttccagtgctgggctcctctcttggttatgagattccttggaggcaacggcaatgataacaatgatgttgatggtggtgatggtgataatgagtgttggtggtgatgatggtggtgatgttaaagttgatggtaatggtgataaaaatggtgatagtgatggtgatgaagatggtgatggtgaaggtgataagaatggtggtgacggtgatgaggatggtgatgatgtagatggtgatgatggtgatggtgaaggtgatgaggatggtgatggtgaagatattgatggtgatgaaaatggcaatgatggtgatgatgaaggtgatgaggatggtgatgatggtgatggtgaaggtggtgaagatggtgatggtgatgtaaatggtgatgatggtgatggtgaaggtgataaggatggtgatgatggtgatgaagatagcagtgatggtgatagtgaggggatgaagatggtgatttggtgatggtagtgatgaagatggtgatgatgatggtgatagtagtgaagatggtgatggtgatgaagatggcaatgatagttattgtgaagaaatgatgatggtaatgacagtgatggagatgaagatggtgatgaggatagtgatgaggatggtgatgatggtgataaagatggtgatgatggtgatggtggtgaagatggtgatgaggatggtgatgatggtgatgaggatggtgatgatggtgatgaagatggtgataatgatggtgatagtggtgaagatggtgatggtgatgaagatggcaatgatagtgattgtgaagaaatgatggtgatgatggtgatggtgatgaagatggtgaggaggatggtgaggatcgtgatgaagatggtgatggtgatgaagatggtgattgtgaagtgataaggatggtgatgatgatggtgacggtggtgaagatagagatggtgatgaagacggcaatgatgatgatcatgaagggatgatgatggtgatgatggtgatggagatgaagatagtggtggtgatggtgaaggtgatggtgatgatggtagtgatggtgatgaaggtgatgatggtgatgttggtgatgatggtgatagtgatgatgataattatcatggtaataagggtgatgagcactagttataacaccacattaagtgtatataacccatttggcctcttgttgtgctttcctagaaatcatctgcaatggatgttggagttgattctccattattcccacccctccccagctatgtagcaccatgtggtttgggaggggattgaatctaccatgagcttttggagtagcccttattttagcccattctggatgagtccatccatcaacgactgtgactggatcaggtaacccaagactaagccaaccagctcaggacagttcctgaggcccctgtccagtggccaggtggccttgcttagcagtggtcccatgagaagcaaagagagtttactaaaggcttctgggaaagggaccttgctccctggggataactacacttctggaagccagccctcactttccttctgaacgatgaggtgggtgaatgggaagcttgggaggcagtgttgggaagaggctgctgctgcaaagtacagaaatggacagaacctgggtctttgaaggcctcgttgaattcctgaattcaacccaccccaaggttccctatggtgtacttgacattggtggcccccaaagagcctcagacactggcctggctccccacttgtgtagttccttctgcgttggctctgggcctggctgtgtggctgggtttggccaatggtacattagcaagtgtgatgccaggagaggctggagaagcacttgtccactgggagcgggtccttcttggcgcccagccaccatgcagtggggaagcccaagcagtcatgtggagggactcctgggggtggagctgggactcctggccagtggcatccctgagtgccaggccggtggccaccaccaaccaccctgtgtggaaatcagccatcccagccaacaccatgggagggaggaggcctgccccatcaacccacagaaccatgaggaagagtgaatttttttgtcaaggcactctgtttgaggtggtttgttatgtaacaataaataaccaaaatacccgagtaccagttattggagccaagaaatccttattgaatgggttgggaattgtctctggctccaaatctctatcccttccagcgaccctggacagcaagctgggaaaacgagacactcccacatcacaaatggtgagcctggactgccagtccctagggcagaacctccagatttacaaaatagtctcctgtgtgagcgtgaactgtcttccaagaggggtttccccaggttcctagcactgcgtgggtatgaactttcttccgagaggggtttccccaggttcctagcactgtgtgggtgtgaactgtcttccgagaggggtttccccaggttcctagcgctgcgtgggtgtgaactgtcttccgagaggggtttccccaggttcctagtgctgcacgggtgtgaactgtcttccgagaggggtttccccaggttcctagctctgtgtgggtgtgaactgtgttccgagaggggtttccccaggttcctagcgctgcgtgggtgtgaactgtcttccgagaggggttttcccaggttcctagcgctgtgtgggtgtgaactgtgttccgagaggggtttccccaggttcctagcgctgtgcgggtgtgaactgtgttccgagaggggttttcccaggttcctagcactgtgtgggtgtgaactgtcttccgagaggggtttccccaggttcctagcgctgtgtgggtgtgaactgtgttccgagaggggtttccccaggttcctagcgttgtgtgggtgtgaactgtgttccgagaggggtttccccaggttcctagctccgtgtgggtgtgaactgtcttccgagaggggtttccccaggttcctagcgctgtgtgggtgtgaactgtgttccgagaggggtttccccaggttcctagcgttgtgtgggtgtgaactgtcttccgagaggggtttccccaggttcctagctccgtgtgggtgtgaactgtcttccgagaggggtttccccaggttcctagcgctgtgtgggtgtgaactgtgttccgagaggggtttccccaggttcctagctccgtgtgggtgtgaactgtcttccgagaggggtttccccaggttcctagcgctgtgtgggtgtgaactgtgttccgagaggggtttccccaggttcctagcgctgtgtgggtgtgaactgtcttctgacagggggtttcccaggttcctagcactgtgtgggtgtgaactgtcttctgacagggggtttcccaggttcctagcgctgcacgggtgtgaactgtcttctgacagggggtttcccaggttcctagtgggagtgttttgttgacacgtgaagtctgtgtgataaataacacagggccctgggagtcagagattgctaaagcctcgtggaagagctctgtaaggcatcatgtgtttcggggtcctttccgaggaacatggaactcgtatgaattttcaggctggctttgtcagtcaacatggatcatgcttcctccatggcacacgtccctataggcatgctacatgcacagcctggtttgccccttgcaatcacccctcatggcaggtccctgcggacttgagggccagaggcccctaggagcctggctgtatgctgggtcctgtctgggtgcctgtaggaggcagagacagggcagagtagatttggcacctgctcttgagcagcccccaaattccagacctgaaggagtttcagcaccaaagcaggaacccggggaagcttccagaaggcagcagggcttgaatggcttggactagcctctgtgcctctgagcttcctggtccagagaggtgatgatgcttaggactgttttgctgcacagaagaagctgagtcagggctctcggtggccggtgagccaggggtgctccaggatgagtcccgcaggcatccgccagcacgggcagggagggaggcagcagctttgcctcagacgcctctgggctcggtcccagcctgctgcctgctggccacgtgaccttggcaaatgacgtgacgtctctgagctgcctgtgggccacgtgacctttgcaaatgacatgacctctctgagcttcaggcctgttccctctgtccttgaagttggcgcagtcaaaggcagaaaaggggctgtccccaggcagagcccccacccaccgccattgcgcctccattccacaggtgccccacgctgttcgggtggcaatggcgggacgtgtgcaggggcgggaggctgtgccagaagtgcaccaggcaggcagtgggtgagggcaccagagccaggaatgactcccagaggagggggtgtttgcagcccagagctggaggttcggaggtgcagccggtgtgaaggctggagggctggaaagagcctttcgtggttggaactgatcaggtggagtgagcagggagggagggaggggctgagttggggtggcagtggctctgggggctgtggttttccagcagggcacacagacccttgggatgcagaccctctagggtccctcagacagggtccacagtcccaggtctgcattctcagaactgccattgaggccacctgtcctcttcatcagagaaggcacactcactcacacacctgggtcctgcctgcacagattgcagtcacctcacaacggcatggccagatgcttcttataaacaaggcactacaggctgggcatgatggctgatgcctgtaatcccagagctctaggaggctgaggcaggaggatcacttgagcataggagtttgagaccagcctgggccgcatagcaagaccctaatctctacaaaaaaaaaaaaaaaaaattagctgggcctggtggctcatgcagctactcaggaggctgaggcaggaggatcacgtgaacatagcctgggcagcatagcaagacctcaagctctacaaaaaaacagaaaattagccaggtgtggtggtgcttgcctgtggtcccagctactcaggaagctgagatggggggatcgcttcagtccaggactttgagagcagcctgggcaacatagcaagacactaatctctgcaaagaacaaaaaattagccaggcctggtggctcatgcagctattcaggaggctgagatgggaggatcgcttgggtctgggagttggaggctgcagtgacccagggtcgtcactgcaatccagcctggacaacagagcaagaccctgtctcaaaaaataaaaataaataaataaataaataaataaggcgctacatataaatcagtgtaaatataaaacacactaaatgatgtatttcgaaaatagctttacttcttcaattgaataattacttaccaaaaatgttaatgtataaacgtttagttaactgtctgctaacactaaaaagaaatcctgaagaaaaatatgatgcttataaccttgtgttcacagggaaaataattccaaacattcaacgcgtcttttacaaggaagcatgatagggagatcaaaaaatattaagatacgttttaaattaaaacatttttacattgggataaattctgtgggaaatgggctagaaatactcattcgaggagaaaaggagcagtggaaacattctaaatgttaaaagcttttaaatttttatttatttatttattttgagacggagtctcactctgtcacccaggctggagtgcagtggcacgatctcagctcactgcaacctccacctcccagattcaaatgatgctcctgcctcagcctcccgagtagctgagattacaggtacccgccaccatgccaggctaatttttgtatttttagcagagaccaggttttaccaggttggctaggctggccttgaacccctgacctcaggcgatccacctgcctcggcctcccaaagtgctgggattacaggtgtgagccaccgtgcctggccaaatgttaaaagttcttaaattttctccgtgatatcttgttttggtgagtgtccaatccctatgggtttatatttcatttatttatttatttattttttcagatggagtcttactcttgtcacccaggctggagtgcaatggtgcagtcttagctcactgcaacctctgccttctgggttcaagtgactcttctgcctcagcttcctgagtagctgggattacaggcactgccaccacgcctggctaatttttttgtttgtttgtttttttgagacggagtctcactctgttgtccaggctggagtgcggtggcgtgatctcggctcactgcaacctccgcctcctgggttcaagtgattctcccgcctcagcctcctgactagctgggattacgggcacgcaccaccatgcccagctaatttttgtatttttgtagagatggagttttgccatgttggccaggctggtctcaaactcctgacctcaggtgatctgcctgcctcagcctcccacagtgctgggatgacagacgtgagccaccatgccctgcctatgggtttatatttcattggctatgtttaaaagagagaagggcagttaaaataccaactttcacaataggccagaaattactcctttttgcaactacctaaacttgtaatgaaacattatagatgctaacttaaaaacaagtgaagaggtacgtagtttaagatttttttttttttaattttggaggtagagtctcgatatgtggcccaggctggagttcagtggtgtgatcatagctcactgcagcctcaacctcccagcctcaagcaatcctcccacctcagcctcccaagtacctgggaccacaggtgcgcaccaccacacccggctaatttttaaattttttgtagagctggggtcttgatgtgttgctcgagctggtcgcaaacttctggcctcaagcagcgtctcaaagcaccggattacaggtgtgagccaccatgcccggccataatgaagcattttaggtgctaactgaaaaacaacatgcgaggaggttttttttttttttttttttttttttggagacgaagtctcgttgttgcccaggctggagtgcagtggtgcgatctcggctcactgcaggctctgcccccccaggttcatgccattctcctgcctcagcctcctgagtagctgggactacaggcgcctgccacctcgcccggctaattttttgtatttttagtagagacggggtttcactgtgttagccaggatggtctcgatctcctgaccttgtgatccacttgtctcggccccccaaagtgctgggattacaggcatgagccaccgcgcctggcctggaggtacgtgttttaagaaaactctttggatagcaaatgggtggttattcatggttatgggattaaagaccggacggagtgggagctgctggggggtgttgggatcatagagggggcatggatgggagaggacgaggaggctacggggcagcaggagaggccaggagagttgtcccagccacaggtgatgctggcttgggtgggctggagacgggacagtggacagactgggtgatggcccttggttagaccaacgggttttgctgaggacctgacatgggagggtgagaacgggagtgaggaaggctgatccgcaggttgggggttgctggtgcccccaaccccggaggaggtgggcaggcaggctggttttggccacaagagtttgggcgccctgtaggacgtgggagagaggggacaggtggtcggctgtgtggctctggccggccatgttgcgtcccatgcccctttcttccccacctctgggtggcccctttggtgtttcacttttgtggaagctgagcagcctgggccaggagtggggggcagtgtcacccctgccagggcccccggctccctgccaggtgtaccgctgccgccctcagcccagggcccttcgcctgtgatcctgccgggtgtgagctcagctaatggcctttttggatttggaccctcttcctgttatgatcgggcggatggccaatttaagcatttaaatcttggttttaatttagtttggttaacatggcttagtcttaattacctgtgcagtagcggccccgtcgtaggatgctgagcactctgagccatttcatcatcgtgtgatttcatgcatctcattgtgagttcaggggttcagagggagaagcgtgaagccatttctaagtgatgtttttatgggaaacaaggtttaattgtgtggaaatagccatgattctgcacgcagccccattaggaaacgagctccgctcttctttcagttactccagagctgtcattagctcggggccaagaagaaggaggaaccattttctgtgtcttcctgccccaccatcgagctgcttggcacttggaattgcagaagcagaaaagttcatgaatttggatttccccaggtttagaatttatgcaccgtccttctagaatcactgaaattgttctcttaaaacgtagcactcaggccaggcgcggtggctcacgcctgtaatcccagcactttgggagaccaaggcgggaggatcgcttgaatccaggagtttgagaccagcctggggaacataggaagaccctgtctctacagtagattcaaaaatcagctgagcatggtggtgcacctgtggtcccagctacttgggaggccgaggtaggaggattgcttgagcccaggaggttgaggtttcagtgagctatgattgcaccactgcacttcaacctgggaggcagagcaagactctgcctcttaaaaaaaaaaatagcgtgcagttggggttactgagcaacatgttggtgacgaaggagccggaatctcagctgtgggcctcgtggggtcaggtgcacacttggactttgctgtcagctcctgccctttccgggtaccctggcatcactgctctgaaaacagggaccagatcggggctgggccacagagccccagaggggtctgactggcgagtggacggcaacctgcctgtactccctggggctcagggagcacccccgcatgctgacctcacggtcccctcccagtagacgcacatccgggatcccagggtcccctgggagccccaggcctctccccagggcactggaacacaggcctggaggctggagggcttggaactcgtctcactgcctcccaggccctcccagactttattccctgaacagcttcagagaaacagcctgtccgtgacggctgtgggactggctttgagtcttgacctcccaggcttgagtgatcctcccatcttagcctcctgagtagctgggaccacaggggctcgccatcacacccggctaattatttttatttttagtagagacagggtcttgctatgttgcttgggctggtcttgaacccctgggctcaagcaatcctcctgcctcggcctcccaaagtgctgggattacaggcttgagccactgcgcccaagtagactgagtgagattgatctttcttctaagaaatctgcataggtgagatcttagaagcattgcagcctggctcagaaacacctgggtctcgcctgtacctggatccctcctgccgcgtcttcggctctctctgctcctttctgtaggagggagaggaccggacttgggtgctgcaggccgggttctcatgctgtgcctgctgcctgccgagtgaccttgggtgggtgctgccctctctggcctccgcgaggggtgtgaggggaggatgtggtggaggaggcatccctgccagatttctcttccggatttctaaatcagggatctgcagtgaatcacggggccctttgccctcactcgtccacactgcgccttatttatagaggctgaagagacggctcattgcggagaagaggcttgtcttgggtcaccttttcagggtctcacatctccccatcgtgagacggggtggcctgggcggcctctgagcaggcccaggactcagctctgcagcacacgggaccctttggccgacggcactgcccggtccagcctctttggggcccgcttccctggaaggctatgggaggtgtctgggggaagggtctggccctggtgcctgccctctgggagggagagctggggtttgccctttgctgggctgtggtccagccacccaggccctggtgggttgaaagtctccctgtccggaggcctgggggtggacgctcagctgctgaggctgagaacggccctgcattgcttccttccagttgtgggcactcgcatggccagactggtgccccctcagtgctgggagggctccctggcagcggggagtggagggtgggccctcggagggatgctggaccccgggatggcgtccgagtggggcttccctcctgatgcaagagcctgcaggcagagagggcttcccgtggagacccccctcagcctctgcacacccaaggaggagcaaaaccccgttccgaatgtgcgcgcctcagtttccccacctcattgtgtacctccagctcctcacagtgtggggtggagcaggagccgggagtgagtgattccagcaggattttaagagcatcacggacatttcaacgatgccttgaacaggggagtcattctataatatgagggttcatcctgacgcaggttgaacatcccgcctgtcggtgccctgtgctgcctgcctgtgtaggtgagggcacaggagggggtgcatgtggcccgtgacttagcacctctgtttgtctgcaagatgaagacttagggcttagtgtagtgggccgtgtagcagccgcccctagcttcgtagcactgggcagccggcatttcatcatgctcacgggtttgtgggtgggaattcgaatggcacagtgtggatggcttgtccctgccccgcgatgtctgggacctcagctggaaaggctggtgtgacttggggcgacgggagtggctgggggttggataatatggaggtgccactgggcaccctgaaccctgtgcatctgtgtaaggcctcacgggggcttgagctccctcacaacatggccgcctcagctgacagacctcctgcctggcagctctgggctttaatagctggtattccaggaagctgcgacttttttttttttcaagatggagtctcgctctgtcgcccaggctggagtgcagtggcgcaatcttggctcactgcaacctccacctccccagttcaagtgattctcctgcctcagcctcccgagtagctgggattacaggcctgcgccaccatgcccagctaattttgtatttttattagagactgggtttcttcatgttggtcagactggtctcgaactcccaacctctggtgatctgcctgcctcggcctcccaaagtgctgggattacaggcatgagccactgtgcctgtccaaagctatgactttttatgagtgagctgcgaaggatcgtccagttgttctcacgctttcctccctgaaggacgcagggtccaggtcttattcctttagggattccccgtgcctcgcgctgcctaagctcatggttttaaagtgtgtcctgggaggtggaaggtgtgagtaaatcttgcggtatttctcatccaaaattgtaaatgtaaattgtcatgccaatgcagtttgaagatggcatgaaagagtgactgaatatagtatcaggaagtttaaaattaaagactgttgtctttctcttttgcaatggcagagtctgattattttcaaggtaattatagcattcataccaacggccaatgtgctcagcacttgatggaataccggctatgtgccaggctctgccgtacacagaattccaggtactactccacatcccagtgaagtgcggggttagcaccatccatcctttacagaaggggaaactgaggctcagagtggcaaaatcactgctcaagacaaggtggcgggacggggatttgaacccaggacagatgactgcgacccacggtctcactgccccctccacgccctgctgtggtgaaccgagtgtgctgcctgataaaccagctagtttttaggaaatggggttgactggggtcttgcggcagggggcagagtttgtttctttctttttttttttttttttgagacggagtctcgctctgtcgcccaggctggagtgcagtggcgggatctcggctcactggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggccccccaaagtgctgggattacaggcgtgagccaccgcgcccggccgagtttgtttcttaaacagctttacagaggtagaattcatatatgataaaattcacccactgtaagtagcctattcagtgactttgaacgaatttacagaattatgccaccatcatcatgatccaattttagagcgtttccatcatcccagaaagttcccttgtgcctgtttatggttaatcctcacttccacccccgtccaccatgaatctgcctgcattttctggacatttgaaataaacggagtcgggtgggtgcggtggctcatgcctgtcatcctaacattttgggaggctgaggtgggtggatcgcttgagctcaggagttcaagaccagcctagccaacatagcaagacccgatctctacaaaaaatagctgggtgtggtggtgcgtgcctggagtcccagccacttggggaggagggaggagggcggatcccttgaacccgggaggttgaggctgcagtgagctggattgtgccactgtgccctaatctgggtgacagagtgagaccctgtctcaaaaaaagtgacaaaagtaaatacatacataaataaatggagtcattcaatatgtgactctaaaaataaataaaaaatagtgataataaaagtaaataaatacataaataaatggagtcattcaatacgtgactaaaaataacacagtgataataagtaaataaacacataaatagagtcgttcaatacgtggtcttttgtgtctggcttctttcactcagggtgttttttgaggttcatccatattttagcacatttatgtactttcttgacaatatcccattgtatggatctactgtaatttgatcaccgcccgctccctgccatggacctgtgggttgttgtcagtttggagctattatgaacaatacggcgtcatctgggttgttttcagtttggagctattatgaacaatacggcaccatttgggttgttttcgctttggagctattatgaacaatacggcgtcatctgggttgtttgctgttcggagctattatgaacaatgcggcatcatttgtgttgttttctgtttggagctattatgaacaatacggcgtgaacagccttatgcgtgtctgtgtgaacgtacgttttcacttctctggagtagattcctaggagtggaattgctgggtcttttcccggcctttaaagaattctcttttccggccgggcgcggtggctcacgcctgtaatcccagaactttgggaggccgaggcgggcggatcatgaggtcgggagatggagaccatcctggccaacacggtgaaacgccgtctctactaaaaatacaaaaaattagccgggcgtggtggcgggcacctgtagtcccagctactcggaaggcagaggcaggagaatggcgtgaacccgggaggcggagcttgcagggagccagatggcaccactgcactccagcctgggcgacagagtgagactcaaaacaaaaaaaaaagaattgtctcttttccaaagtggctgcaccattttgcatttccaccagcaacgtatgagggttctcatttctccacatccttgctggcatttggtattgtctgtcttttattgtagtcattctagtggatgcaaagtggtatttcatttgtgtctgtgtgtgtgtgtgtgtgtgtgtgtgtgtgtgtgtgtgtgtgtttgagacagagttttgctcttgttgcccaggctggagtgcaatggtgggatctctgctcactgcaacctccaccttctgggttcaggtgattcccctgcctcagcctctcgagtagctgggattacaggcagctgccaccacacccggctaatttttgtatttttagtagagatggggtttcaccatgttagccaggttggtctcgaactcctgacctcaggtggtccacccgcctcggcctcccgaagtgctgggattacaggcgtgagccaccgcgcccagcctctttgtggttttgattcacatttcctgaatgactaatggggttgaacagcttttcaggtgtttcttagccagtcgtttaacttctttggtaaaatgtctgtccgaatcgtatgtctattttaagattgagttcttggtcttattatggagttgtaagtgttctttatatgttctggatacaagtcctttaccagacacagggtttacagatattttccccagtctgtggtttgctgtcttcattttcttaatggtgttttttgaagtgcaaaaatttttattttgatgaagttcaatttatcttttttttttttttcgagacggagtctcgctctgttgcccaggctggagtgcaatagtacgatctcggctcactgcaacctgcgcctcccgggtttaagtgattctccttcctcagcctcctgagtagctgggactacaggcgcatgccaccacgcctggctaacttttttatttttagtagagatggggtttcaccatgttggccaggctggtctcaaactcctgaccttgtgatccgcccaccttgacctcccaaagtgctgggattacaggtgtgagccactgcacccggccagtttttctttctttttttctttttaaggatggattcttgctctgttgcccaggctggagtgcagtggcgcgatgatcatggctcaccgcagcctcgaattcctgggctcgagcagttctctgcctcagcctcctgaatagctgggactacatgcttgcaccaccatgccaggctaattaattttttaatttttttgtagagatggggtcccactctgttgcccaggcaggctgagagctcctggcctcaagccatcctcccgccttggcctctcaaagtgctgggattacaggcgtgagccagtatgcctggcagttttatcttttttcaattatgcttttgcggttacatctaaaatctctttgcttcacccacattaatgaagattttctctgattttgtcttcttttatagtttcagctcttacatttaggactgtcatccattttgagttactttctgtgtgaggagtgagtaagtgtccaagttcattgttcttagtgggtatccagttgtcccagcacgatttgttgaaagcactctttctttccccattgacttgccttggcaccctggttggaaatcagttgaccacaaatgtaagggtggatttctggcctctcagtacaaatccgttttactaataccaccaccgtcttgattacagtggttttgtagtaggttttcagatcaggtagtcaaagtccccctactccgttccttttcaaaactgtctcggctatttccaagtgcccttacatttctgtatgaatttcattttttaaaatttttatttatctttttgagacagagtctcgctctgtcacccaggctggagtacagtggcgcgattttggctcaacacaaccttcacctcccaggctcaagcgattctcctacctcagtctcccgagtagctgggattacaggtgcccaccaccacatctggataatttttgtatttgtaatagagacgggggtttcaccatgttggccaggatggtctcgaactcctgacctcaagtgatccgcccgcttcagcctcccaaagtgctgggactacaggcgtgagcccccgcgcccggccgcatgtgaattttagggtcagcttagcagttgtaagagtgtgtgttgaattgatagatcagtttggtgtcatcttgtcaatattgaatcttctcaataaagattgtatttagatctttaacttctcagcagtatttcgaagtcctgcccgtcttctcgtaaatgtttcccctgcatttcattcctttcaatgtcattacgaggaagacaatgttcttagcagggctggctggcattgaggaagggtcgccagtaggcaagaatgtctgagcctggcgaggagagagccctgtgccccgtgatgtgtctaggagagaccctcggggagaggcaggtggctgagtgcacagaggagttgctgagccgacttcacctgtcccgaggcccccgggggacgatctgtcagccccagtgaagggagctgggggagctctccagactggtttttaattatgtgaggtgtgttcaccaccaacttcagtaggatgcctccgggacctgtttaggggaaaagcaattccacagctaaacattcgttgccctgtttatccgggcatggggctgaaattcaaattaaaatgtgccaagtcgaggagctcacaggggtttctaaagatattttaggctttcagtcccaggctcattccaaggtgtttattaagtgcctgctgggtgcccacgcgggcctgggccaggcacacagacaacgctggtgcttgccagctaggtgggcacagggtcctgccccgcgtcttctccgccggcggggcaggatgagaacacggggcaccataggaagaggacacactcctctatgtcatgcacttcagaggctgcagaagacaatctgggcgtccacacggagctgccccccatgcagggttctcattgtccaacacaagctctgtgctgcctgttttagcccccatcttccctgttatttatttatttatttatttttttagatggagtctctctcttgtcccccaggctggagtgcagtggtgcgatctcggctcactgcaacctccacctcaggttcaagcgattctgctgcctcagcctcctcagtagctgggattacaggcacctgccaccacacccggctaattttttgtatttttagtagagacggagtttcactatgttggccaggctggtctcgatctcctgacctcaggtgatccacccacctcggcctcccaaagtgctgggatcacaggcgtgagccaccgcacccggcccattatttgctcttgattcttttaaaggtgcactgaagatttacaaatatcaggaaatgaacattttattttttccttaggtttaaagactgtataaagcattttaataaacatgatttgtttgtttgtttttttgagacagagtcttactccttcacccaggctggagtgcagtggcgcaatctcggctcattgcaatctccacctccctggttcaagcgattctcccgcctcagcctcccaagtagctgggattacaggtgcgccaccatgcccagctaatttttgtatttttagttagagacgggatttcaccatgtaggctagacctctgcctccgaagctcaagcgatcctcccacctcagcctcccgaggagccgggactacaggtgtgcaccaccacgcccggctaatttttgtatgtttttgtagagatggggtttcgcggtgtggcccaggctggtctcaaagtcctgagctcaaaccgtccacccgccttagcctcccaaagtgctgggattaggtgtgaaccaccacacctcacctccttcaaggtttctgactggtcctggagcttggcctgtcccggcactccccaccccccaccttcagcacctggccccttccctcacggccgttctttcccactcgccgtggtttgcggggtcacagttgttgaggaagttgcagacacctgggagctgctcttgatagcagggagtttggcgtgtgatacccattcctcacccaggagggaggggcgtgcaggtgcagagacagagagatggacccgacccgtcaggtcccgccggccccctccccagcaggcttctacagcacagcctctgtgagggtggaaatgcttctgtctgagctgctgtcctcacagtggccacgggctggggaggtgctggccacctggggtcactgtgttccagcagttgagagaggcagagcattggctgtcagaaaggaccattctgggtggggcaggaggggccccaggaccagccctcattggcagggctggcaggaaaccccccacccctggtgaaggagccccagcatccggtgggcacagtgggcacagtccggtggaggacgtgagggcgcggccggtggaggacgtgtgggcgcggccggtggaggacgtgagggcgcggccggtggaggacgtgtgggcgcggccggtggaggacgtgtgggcgcggccggtggaggacgtgtgggcgcggccggtggaggacgtgagggcgcggccggtggaggacgtgagggcgcggccggtggaggacgtgagggcgcggccggtggaggacgtgtgggcgcggccggtggaggacgtgagggcgcggccggtggaggacgtgtgggcgcggccggtggaggacgtgagggcgcggccggtggaggacgtgtgggcgcggccggtggaggacgtgagggcgcggccggtggaggacgtgagggcgcggccggtggaggacgtgtgggcgcggccggtggaggacgtgtgggcgcggccggtggaggacgtgagggcgcggccggtggaggacgtgagggcgcggccggtggaggacgtgagggcgcggccggtggaggatgtgtgggcgcggtgctggtacttttacaatgcttcgtgaacctgctgtccgtagctctgtttcacagatggggaaactgaggcctggcgattaagtggcctgctgaaatcatccagctagtaagtgtcggagctgtgatttggaccaactcctgcctccaaagctcattcacctccttacctttgcactgagctccagaaaacctgaggcttccccgtctccctcgctgtgccttctctcccctgctcaaagaccgtcctgcagccatcatggagggagaagccctttttcctaagctgttcacaggatagtctgggagggcctgggaggcagcggaggagtcccgagccttccgggctccaggcctgggttccagtgccctggggagaggcctagggctgccaaggggccctcgggtcccagctgtgcgtctgccaggagaggactgtggagtcagtgttggggacgctccctgagccccaggggggtgcaggcaggttgccgtccactccgatccttctgaggctctgtggcccaggcctgctgctctgacccctgttttcagagcagcgatgccacagtctgcctgggcgcgaacatgacatctggcccagatccggaacattcagggccagtctggtcctgagatgtggaagctgccaggggagggctgggccttggggcccacagggacccctgctcagctggtttccagcctgtggaatgtgggtcccagggtgtcagatcttgatttttccagagaagctggaagtccggttttttggtgaaatctcctaattttatttattgttttaaattttaccttgaaaatagttcacacagaaacgttgcaaggagagtatcatgaagccctgtgtaccctttgccactcagcattttgggacgtatttgtgctgcatttgcttcatcagttctgtgttctacattcgcatactgttatttttactctttttattatttggatcatttgagagtaagttgcaggctgggtgcggtggctcacacctgtgatcccagcactttgggaggctgaggtgggcggatcgcttgaggtcaggagttcgaaaccagcctggccaacgtggtgaaaccccgactctactaaaaacacaaaaattagccagacatggtggcgggtgcctgtaatcccagctactcgggaggctgaggcaggggaatcactggaaccctgaaggcaggggttgcagtgagccaagatcgctccattgcactctagcctgggtgaaagagcgagactccaccttaaaaaaaaaaaaaacagtaagttgcagacaccaggaccccacgccttaaatgcttcactgggtgtctcctaagaacaagcaggaaaatcatcacaggcacagcgctcaccctgcacgcagcaccctgagctgagctgacccccacccaaattcaaactctgtcccagttctttttttttggagacagggtcttgctctgttgcccaggctggagtgcagtcatgagatcacagctcactgcatccccaacctgctgggctcaagtgatcctcccgccttagcctcccgagtagctgagccactgcacctggctaagttgaaaaatgtttttttttgggccgggtgcagtggctcacgcctgtaatcccagcactttgggaggctgaggcgggcggatcacaaggtcaggagttcgagaccagcctggccaacacatttgaaaccccgtctctactaaaaatacaaaaattagccgggcatggtggcaggcgcctgtaatcctagctactggggaggctgaggcaggagaatggcgtgaacctgggaggcagaggttgcagtgagctgagatcacaccattgcactgcagcctgggaggcagaactagactccctttaaaaaaacaaaatttatttattttttcttgtacagatggggtctcattatgttgcccaaactcctgggctcaagcagttcccctgcctcagtctcccaaagtgctgcgattacaggtgtgagccactgtgcctggtccaaatccctgaggagcccaggcaggtggtttacaaggtcttgggtctgcctgtttcccgtgattacacacagcctccttacttttgctgggaaggccgtgaacaggagctgtgtcctcgctgctcccctccccgactttttccaaggtgggcagctcctttaaatcacctcaggaacctgggaggccaggcgggcccaacctgcgtcccagcattcagctgccttattaagcacagagtctgagctcaataaaatcaggaccacaggcatgcaccaccacacccagctaattttgaaattttttgtagagatggggtcttgctgtattgccccggctggtcttgaactcctggcctgaagtgatcctcccgcctcggcctcccaaaatgttgggactacaggtgtaagccaccatgcccagcctgtattactttttaaatctgaatttggtttgtataattacatgaaatactaatatggctcccaagtcgtgggatattacagaagtcttgccgccttcctgggtcccgtctcctgtgcacagagccccttcctttcacctgtgggtgactatcttaatattttctgtgtcgatttgcctatgtgtggtttaaataagcaaatacgcacatggagtcacggcccctcctgcctgtgttagatagatgtttgcacacgagacacacttttctccacttggtgtttttcatttgacatcatgtcctggagatcacgtctttgctgtttatagcgatatctgggggaggattttgacagcgtgaagggtttgtttctgagcgtattccagagtcggagcagtggtgggagcagagaatgaattcacacgcatggcgtcggcacgacatgactccatctagctgatctcactacgacccgcgcgcctggcttccctctgcccgtgatttagaggagaaagtggaggcttgccggagccggccgggacctggtgtctgcttcccggacaggcactgtgtggccccaggctcaggagggctgacgggtgccggccgtcgggggctccttgaggctgtggctgggcacacagccccgtagagtcccagacctgttgcgggtgtggcccacggaatcctcctgatggctctgtagcttgtatcacgtgtggctggcagtgccgggggctcaggaacatccggtagagagtgcagcctccgtggcatttctgtgtgaggatgaaccggagtgagctcagcctcgccctgtgccctgcagagcagacacgcagcagcatcatgagggccgcagtgtcctgaaggcctggatccatctgtaccaaggcagccccacccagtgtgctcggaacaagggaatccccacagaagagaatggctcctgggagtaccagtgccatgacccggcagcggggacactggtggtcttcagacgcagtggccgtcctgagctgagccaggggcagtgggaagacccccccggtggagcctgcggctcggggggctgtgttggggggcagtggatgggagagacagcagcaggaggattcgtctcgagtccgggtctctgcgaagccggtgccggcttcggcgaggtgggtggtctccacgccccttgaggttgagaagatgtgcgcccttctgcaggggccgagctgctgggcgtctggcagaatttcacagtgtttaaaaggaatgatttttaatgaggcaacagagacacagggttcacacagacaaggcagagagagataacagaccttggccagcacctgctccccccaggctctgttgcgtgtgcgcaggagggtcacacggagacgctggctcacacgtgagctcggtcttcctgggggctacacacagctgtgccagttgcctttttctctttacggtttctcttggagatttttctagatcgggacacaaggtgctctcctcccgctgcttttttttttgagacagggtcttgctgtgtcgctcaggctggagggcagtggtgccatcacagctctatgcagcctcaatctcctgggctcaagcaatcctcccacctcagcctcccgagtagctgggactacaggtgcatggcatcatgcctggctaatttccaatttttttttttttagagatgggggtctctctatgttggccaggctggtctggaactcctgggctcaagcgaacctctcctcggactcccaaagtgcggggatgacaggcatgaggcaccgcgtctggcatccgccttcttttggagtctcacaggatccccagtgtgctcggaggacagtgggctgggtttgcgtggtgggcctgcacaccgtgccccggcttttccacgcagcacctttgtggggccgtgttttctccccctcgggctgtgtgtgctgggctgtgagactggcttctgtctgggtgctggctgaccctggaactggcctggccaaggtgaccggcttctgcctgttttccttcctgagtcatcccaggttaggtgctgagtggctttgggccggcgaccacccctgtctgggcctgagggtgccgtatctgtaaggtctatggcatgacatggcgagaggtgggccgctgtccacacctggccactgtcaacttccatcttgctgtttgaacaactgctcttgaaaaccagtttgaatcaagctggcacggcggctcacgcctgtcatcccaacactttgggagttcaaggtgggcggatcacttgaggtcaggagtttgagaccagcttggccaacatggtgaaaccttgtctctactaaaaatacaaaaattacccgggattggtgagggtgcctgtaatcccagttactcgggaggctgaggcaggaaaatcgcttgaaccaggaggtggaggttgcagtgagccaagattgtgccactgcactccagcctgggtgacagagcaagactctgtctttaaaaaaaaaaaaaaaaaaatccgaatcagctgcaagccctctgttgaaaccaggcgatggtcagggagcttctgagtttccatcttatctgaaagctggaaggtcacacgtgtgggccctgctccacctgggtgatggtgctccctggagatggtggggggggtgtgctccccatccctgcacctgactgggcctgggggtggctgagtttgcaatccctgtctgtctccctggtcctgagggagcctccagctttggtgatgcagtgcctatggcacatcccctgggcgtctttaacatgagcctggcagtgaggccaggagggaggcatttgatccccccggggccagcctcacccgtatggcctttggaaagctatgtctcttcacttagaacaaaggttcagaccaaattaaaacaataataacaaaatcaagtgcatctgagtttgtacagggagccgtgggacccccagggcaatgggataggccaccccctgggtacccacaggcctcagatgcaggctgaccttgcacccccagccaggaccccaaccgctgcccgctgcctgcctgccacctgccagcacaggcgcagtttgggcctgttttccagctcccggccggccagttttgacaacaggaccacctgcctgggggtttgcctctccgatggggctggccgagccctcaggtacatctcagctgctcacctgctaggagccacggtcaccttcgcctggcctggcccagccccctccacacctttcaagtgccctggtcctggaagggggaggtgggggtgtgcctggctcttccactgcgctccacttccaaggcccggcctgtgctttgaagcagcagccgtggaaagaaaacaagtattgcagcccacagagccctgggaggccgtggtcccgctcctgcagcgttttccagccctggggtggtggcgccctgggaggccgtggccccgctcctgcagcgttttccagccctggggtggtggcgccctgggaggccgtggccccgctcctgcagcgttttccagccctggggtggtggcgccctgggaggccgtggccctgctcctgcagcgttttccagccctggggtggtggcgccctgggaggccgtggccccgctcctgcagcgttttccagccctggggtggtgacgccctcggaggccgtggccccgctcctgcagcgttttccagccctggggtggtggcgccctcggaggccgtggccccgctcctgcagcgttttccagccttggggtggtggcgccctcggaggccgtggccccgctcctgcagcgttttccagccttggggtggtggtgccttcggaggccgtggccccgctcctgcagcgttttccagccctggggtggtggcgccctgggaggccgtggtcccgctcctgcagcgttttccagccctggggtggtggtgccttcggaggccgtggccccgctcctgcagcgttttccagccctggggtggtggcgccctcggaggccgtggccccgctcctgcagcgttttccagccttggggtggtggcgccctcggaggccgtggtcccgcttctgcagcattttccagccttggggtggtggtgccttcggaggccgtggccccgctcctgcagcgttttccagccctggggtggtggcgccctgggaggctgtggccccgctcctgcagcattttccagccctcgcgcttggagccagggtctgagggctacagtggaaccagctgcctggaatcctgtcactgtgccatgagcccggtgcctttcactctggaaaacgtgccctgtcctgggaggtgatggctgaggaaggcagccaggcttgggaatgtctccagggcttctcatcttctgcacggagcgggctctgtcaccatcggctgtaatgtccgacacacaggtggtgtagcaatggcgtcccgcggtggcggagtggcacgggctcacaggacgttgcaagcaccttggcgtcagaacacgagtgcccgccgtgggctgcagagcaggcacctccaccccgtccccgacgaaccctgaggggtccttgagcctgacttggggggtccttgagcctgacttggggggtccttgagcctgacttgggggtgggcgaggaatttcagagggtttcttggaaaaggcgagggagggagatggtcaggggggtgaaatggacaaggccgtgggctttgccaactctacccggggtaggcggggttgccctgcagtgcacctgagacattgaggtctgcagagtgggcctgcttttcccgccatcgcctggccggcctgaccctggtccaatcctgacagcccccagctgtgtggttttcctgggcctgagcgagcgactggtcccatcgagcccctgccggcctttgctcttcctcacacgggcctgggaggagctccagcccggcaacccggtttgatggcagacagctggggctcttttcttcctccaggaatgaaatccttggagaagaaagatcctgcatcccagtctggagagaggcctctggaggggaccccgcctgccctctgctgacctaagcatgccttggctgttggcggctcccgcctcgtgcccgccttcgccttggctccacgtccccgattttgacttgctcggcacagagaggttctgatgaggtttccagctctaggctgggtccagcctgtgggatgcagaggcagatccggtgcccgcagagcccatcgctgagtctggttgagcaaatagcaaaacctgtttgctgccccaggggtgcctgatgtggctgagcacaggaagccgcgtggccgtggatggctggttatgaggcagtacaggtccctttcgcatggtctttggggagatgagttcggggggccttcagtcccactccccccaccgctgtccccctgtgatgaggcctcggcctgtgtttgttccgtgagtgacagtcagaagggccccacccattcgatgttcacccctgttttgctggtgcctttatgagacaggggctgtgtgtgccccatttcccggcaacctggcgcccagcacagacctgcctgtacatagcgggcactcggaaaataccagtgagggccgagtggagttgagcgctggcagtcgtggcctggatcttccaggctgcctgagcctgagtggcgggtgctcacctcctcccccagtgcccggggagggcgggcgtgagctgggcggggggctctggatggagagcgcccgagcccctgcccaccctggggggtgttggtgccctccttaggaagggacaattggaagtgccctctgctgtcaagctcagtactggggtgccccggacggtgtgatatttggccttgcagtcctgatggattgggggggtcagccgtgtagagtgccgggtggcgttggccgtggctgtccgaccgcctgggtccgcacctggctctgccctttgcaaaccctcaggcgtgggggagtcatgagttagtctcggcctcagtgtcccgtctgtaaaatgggtgttgtaaaagttccaggtgagagtgaagtcctcagaaggaccctgtgagctcttagggaaccctggatccctcggcccccaccgctaccctccgccagtgctgattaaaatgttatcttttggggccaggccctgtggctcatgcctggaatcccagcactttgagaggctgaggcgggatggttgcttgagcccaggagtttgagaccagcctgggcaatgcgacgagaccccatctctacaaataaataaataaaaatgcctgtaatccctgcactttgggaggccgaggtgggcggatcacgaggtcaagagattgagaccatcctggccaacatggtgaaaccctgtctctactaaaaatacaaaaagtagttgggcgtggtggcgggtgcctgtagtcccagctattcgggaggctgaggcaagagaatcgcttgaacccgggaggcggagcttgcagtgagccgagatcacgccactgcacagcctgggtgatagagtgagactccatcttaataaataaataaataaaaattagctgagcatggtgctgtacctgtagtcccagctacttgagaggctgaggcgggaggaccgctcgtgtccaggaggtcaaggctgcagtgagctatgatcatgccactggaatccagcttaggtgacagagaccctgtctctaaaaaaaaaaaagttcactttatctttccttttttttttcctccaagatcagattaatttgttttcgtgttaaagctgtcctcatagaattatttaggaagtgtttcatctgcttctattttctgaagctaatgtagagaattggtattatttcttcctaaatatttggtagaattaactagtgaacacatctgtgcttagtccttttttgtttttatttttgttttttgtttctgagagacaaggtctgtctctgtcatccaggctggagtgcagtggaacaatcatagctcactgcaattgccagctcctggactcaagtgattctctggcctcatccttccaagtagttgggactacaggtgtgcaccaccaggcctgattaatttttttaaaatttttagtagagatgaggtattgctatgttgcccaggttgctctcaaatgcctggcctcaagtgatcttcctgcctcagcctctaaaagtgctgggattacaggtgtgagctgctgtgcccagcctgggcttgacgctttttgttttgaaaggttaataattactgattcaacttctttaatagatacaagcttgttcagattatctgttgcttcttgtgtgaattttagtagattgtgtatttcaaggaactggcccattttatctgagttatcaaatgtgtagtcatagagtttttctttctttctttttttttttttttttttgagatggagttttgctcttgtcacccaggctggagtgcaatggcgcgatctcggctcactgcaacctctgcctcctgggttcaagtgattcttctgcctcagcctccccagtagctgggattacaggtgcctgccaccatgcccagctaattttgtgtattttttactagagatggggtttcaccatcttggccaggttgggctcgaactcctgacctcaggtgatctcctgcctcggcctcccaaaatgctgggattacaggcatgagccaccgtgcctggtctcatagagtttttcataatattattttatttttaatgtccataggacctgtagtggtgtcccttgtccataggacctgtagtgatgccccttgtccatgggacctgtagtgatgccccttgtccataggacctgtagcggtgccccttgtccataggacctgtagttatgccccttgtccatgggacctgtagtgatgtctcttgtccatgggacctgtagtgatgtcccttctttcatttctgaagttagagatgctttggctgcatcgattttctttagtattttcctattttcaattccatttatttctgtcttaatttttattcttacttttctttttgttgctttggatttaatttcctcttcttgttgtagtttcccaagatggaagcttaggttgttgattttggatcttttcctaatatatgcattcagtgctatagatttccctctaagtgttgcttttgctacctcctgcatattatgataagctctattttcattttcatttcgttcaaaatatttttcaacttctcttgagccttcttttttgacccatgcattatttagaagtatgttatttaatctccaaatattgtgggatttcctatctatctttctgttactgacttctagtttaattcacttccggtgtgagagcatgcactatatgatttctgttcttttacatttgttcagggatattttatggcccagaatgttttctctcttggtaaatgtttcatgtgagcttgagaagaatgtgtagtctgctcttgtttgatgaagtctgtaaatgtcaattatttcctgttaactgatggtgccattcagttaatctatgttcttactgattctctttttttatttcctgtgtataatttttcaaactagattactgattttctgcctgctggatctgtcaataactagctgaggggcgttaaagtcttaaactataatggtgcatttgtctgtttctccttgcagtttgatcagattttgccttatgacccatttttaaatttaataggcctatagtgaccatcatccagtctccgtggatgtgtctccacatcactgttttttaatacctccttgtgttccattctgtaacttaattaaccaatcaccaactattgcatatttcaaaccttcatggctacaagcagctctgtgataaacagcctgctagccacatcttatatattttaaaaattgcttctatagaggaaatgctaggggaaagaaaaacccattcaaagagcatgcactttttttttttctttttgagatggagtcttgctctgttgcccaggctggagtgcagtggcacgatctcactcaatgcaacccccaccttctggattcaagcgattctcctgcctcagtctcctgaatagctgggattacaggcacatgtcaccaagcctggctaatgtttgtatttttagtagagatggggtttccccatgttggccaggctggtctcgaactcctgacctcaggtgatccgcctgcctcagcctcccaaagtgctgagattacaggtgtgagccaccatgcttggtcagcatgcatatttttaagataaaagtttgctgtcaccaacctaaacctgcgggtgctggtcttcatccaaagtggattctgattcagaagctcagggctggcgtgggtatctggggatactgtgaacatccagggctggacgccatggccagtggcatggactagcaattctggttggaagcccaagaatgtacagaaggaatttgccatcctccacctccttccctagatccacagggtagagcggacacttggcttgtacctcccttctgggactccataggttcattccataccctgaaccctggccattcacgcgcttctctctccaatgccaagaaaacgttattcagtgacgtgtgttaaagcatggcatggaagacttcattctggaccattgcactaggtacagggatcactgcaatggggtcttgcggtggaggaaggagcttgggcttgcctccgaatatgagatgagaacgtgagaatttccacctaagtggcagtggatggaaaatgaccgagaggaaacaccaggggctggggggttctggcttcactgacctaacaggattgttgctgaagagaggccagggtgaccagacatcccccatggggtggtgggtgtgaggagcctgatcagacactgaggatgatcagatatcaaagatgatcacatattgattatggtgggtgatcggttctggctgaactgatttggcaggattattttacaaggaagtacagatgggcctagaagaaggttctggaacctgactaaagtttggccagagagagaattgttgttaccacatgtttgtggttaggaaccagacccacagtcaagagtgtggccgagggtcccaggggatttgagaacaccgtgctgttggcaccccagccgggagcaggagctctgctttccatgatgccaggactgagttattgctatttagagagaattttttggaaacttgtagtcaacagagtcacggaacaagccttcacctaaacagtggaagaggctaaacacaagccaggatgctgtgtctggggcgctgggatcccagcagatgggaaccctgggtcttgggctgggacagaagagataggaccgtgatgccagcacccagggtctgcccaagggtttaggccacttcctttccttaaataacattgacctaaggtttaaatccgcaatggagagaggttcttccccagcgagggcagcatgtctaggtctttcagaaccacttctaaaggaggacagactgagcaggccactctttccccctggatagcgtcatgttgaaaaacataagaagtcagaaaaacatattagtatgcgctggaacaagtgttctgccttcagcggggtcctttttggtaaatgttctgttttcttcactcatcattcccgtctgctccttgtcaatacacatatgcacattctctgcagacctactgttggtgcatatgtgcctctgtgtgttctgctctttgacatcatgggagggggaataacaacccgtgtcctgactctgacatcccccttccatccctaggaaggttcaaagattttcaaaatagagagttgaaaaaaactaaagatcagacatgttggaagtgctaataactcagtttgccttctttattactggatacgatcctagcacattcatgttctcccaggtcaatgtcatgatgcttttgtttaaaagtcacaaaaattctttatttcttttagcctcaggcagacatttctaacatacagaaatgcagattgttggagcgggaggagtgagcgggaggccctgtgtggcgcgggggtccttgctgccacccctcacctcgctgctcttctgaatgcatgcccagccttggcaggcacctggtgctcgggtctgaggtgcagctttgaggggctgtgggtgcccatcctttctgttgtcccccttaggtggcctcggctctgagaactggctgaacctgtttgcttcagcaggtttctttgcatgggtgagggcggggaggtgtttacctgtcaggccacctctggctgcagttccacaatatattagcaatgtaagccaacaaaaaggaataaaaaagccagagtggtgaagagactggctgagatcggggcatgggccgctccatttgcatcactcctgggggattctgggacatgtgtgacccttctagcagcactgggggagcggctgcatggggtttggaaccagcagacactatggcagcagctgctgaccgtgggagccccttattctgctgagtgcttcacaagcctcatgatcactgagtcctccctgctgctttagaggctgagagtgttactgtgcccattttacagatggcttaactcttcagaaactcagtcccctgggtccctccaggcaaggttgggacttgtaccacacatgatgaggtgatggccaggaagcatctgtcatggggatgaccccacctgctgtgacatcaccccacacaagcatctgtcaccactgctcaatagtgagccccttagggaagggttgcaaactcgggatcctgggggttcaggaattaagtggaaaacgtggagtccttgggaattgtggcagattggagatggtcatgctccttccaaagtgggggtgagctgaattcttgctttgggagtacaaggtccctgtgttgtcagacttttctttttattttcttttttcaaaggaaagccaacaatttggattttatgaattttgtaaatttttaaatattgggagatgattttgaaaataccatcaacattggcacatgaataaatagaaaacctgaagagatctagaagcattaagtaagttgaaatggtaaccaaagacctttcctcccaaagggttctttctgatggtttcactggttgagttctttcaaacatcagcaaactgtctattcttacttctcaaattgctacagaaaatagaaaacaagaggaagctgctagatcattgtatgtactgtactgtgatcaggtggagatgatccagaattcaaggatggttcaacctcagaatactctatccatgtaaatcaccatattagtagattgtagagaaagagcatgtgacatgtcacataggtgttggaaaaggttttgacaaagctcaacaactattgcataaattcttagcaaactaagaatagggtcacttcttaacttggtaaaggtcatacatacccaacacagagcaaacatgctaatggagaatctttggctacatgctctttaagggagggaccacaatgaggctctgatggctttcatggtttaactgtgcttgggaggtcccggcaatgctataaagaaagaaaaataagaggagtcctaattggaagggtagagagaagatgaatttgatcatgtctatggaaaccagcatagaatacacagaacaactcttacattcttatgagtgttcagcagggttggtgcaagctcaacttacaaaaatcatcattaagaagcccaaggaatccataaataaatatacacaatttttctttgtcaatttaaagaaaatttaaaaatacggattccttcccatcacaatgaagatattaaatctgtctcaacagaaagaaagagagaaaaaaaagagcccaaggggctgggtgggtgcagggaatgagaaaagagacacagatgaggagtaactggagaatagaatttgaaaggatgccattcatgagggcaacagccactgagaagtggaatgtgcttgacaacagattacagaagactctagggaggaagttttaaacctctataaggacataaaacacgatctgaatagggagaggcggtctgtattcttgggtggaatgactcaacgtgatgatgtcatttctccctcacattaatctctaccttcaaagcagctccacttcaaattgcagctggaatattgtgaggcagtaaacacattcggaaatgtgaatgagctgggtgcggtggcttatgcctgtaatcccagcactttgggaggctgaggtgggaggattgtttgagcccaggagtttgagaccagcctgggcaacacagagaaaccccatctctaaaaaaaaaaaaaaaaaaagtagctgggtatgatggcatgtgcctgtaggcccagctactcaggaggctgaggcaggaggatcacttgagcccaggagttcgaggctacagtgagctatgatcgcaccactgcactctagcctgggtgacagagtgagaccttgtctctaaaaaacaaacaacaaaacaaaaaacaaaacaacagaaagaaaaaggaaaggaaagaataaaaatttgcaaataactaagtcatctttgaaacagaagcacaaagaagagggacttctcctaccaagagctgaggctcagcaggaggccttgatcataaatggagccaggtgccctgcaggaagggacggcagaacaatggcgtggggccgagagctgagaggaggtgcaggcacacatgggagctccatatttaatagatgcaagaggtagtttagtgcagtggttaagacaaggactctggagccagatcacccggttttgaatcccagcaccaccattccttagctgtgtgaccttgggcaggttccttaacctctctgtgcttctgtcctgctcccacttgtatgtgaggataaggggagtgatgatcatatatgccacaaggttgttgtgagaattaaatgagcaactgtgcgtaaaacactgtgttagtttctagggctgccataacagaaggacaaacttggccttaacaacagtgatcaagcgtctcatgcttctggaggccagaagtccaagctcaagatgtgggcagggctggttccccctgagggctgtgtgtggggatctggcctggcctctccttggcttgtaggtgccgtgttgcctccctgctgtgctttcgtccgactcttcgctctgcgtggacactgtgttttccctgtgtgtgtccaagtctcctctttttataaggacaccaatcatattgagttagggccaaccctactccagtaggacctcacttttttcaagacagggtcttgctgccagtctgtggtgctctgtgatggcagcccaggcagacatgtcggagagtatttcattacttggttgtggggaaacactttcttaaacaaaacccacaaagcacaaaccataaagcaaaaaagaggttacatcagatgaaagatgtctacctaattaaggacatcatgaaaaagttaacaggtgactgcgtgtaagaagatagttgcaatatctaaacccgacaagcaaccggtatctaaaacacacaaggaatttctgcaaatcagcaggaaagaaggtaccaacccttctatcaagatgggcacaggatatgaacaggaagtttacagaagaggaaacacaaccagaggagaagcccttgaagagcagctcagagcttagagatcagggaaatggaaatgcaaacaaaacggcagttcaaagccgcagccccaacgtgtcaggcaatgtggtgacgtgggtagatctagagtatgtggactccttgaagaaaaagaagaaacagcatgaaatctgcagcaggataccattttttggttaaatgcacatagcttaagattctatgttttaagagaaaacatacaaacgagaggggagacctcaagtatcttatagcaattgcccacagaccgagagggctatgggaagagaggaataaatgtataggcaaaacaagaacagatcacagagcggcatgaactgagtgctccatatttacatctggggtttaaagaaaagatgttggaataggatgtcccacgaaacacaggtgttgccaaatgcatggtctgtgggcctgtcgggaacggcggggtttgctgccctgtggccccagcaggacccagtctgagtgctgtggctgcctgtgagctgagtgcagggatatgggtgtgcgggctgtgttcctggaccttgccctgcctccacctctcccaccctcactccggcacttaccactggtggggaggagcctgcactggtcctgggtttggtgggggcggtgagggggtcccaggcggagggtgggggaaagtgggtggggcctctgcttccctggaggcctccaggcttggggaaagtgaacacagctcaagagtctgtgttttaagagaaactggaggtgtctgtgcaggggcggggtgtctaggctttcccatacagccctttgcccggatagaggctgcgagttccagctgggtgagtgctacgcggggcccaggaggggtttgctttccgtccgacctgccacgtcctgggctctgctccgggaggggcctagtgcctgctgccaccccttgggttcacaggcccaggctctgcctcctgccaggacgggggaaacagatggaaagctggggccgggagagtatctggaatggaccagggtgacagtcggtgacaaggacccatcacccagtgtgactgttcttaacctacagggctgggtgggacttgaccagctggcctgatgttagtgtgggtctgagcaagtgactaagcaataggttgtgcccaacacatgcatttgcacaccaaaaattagcttgcttttaaaatggcacttcgttagttgggggtggtggttcgggctggtggtcccatctgcttgggaggctaaggcaggaggatcgcttgagctcagaaggtcaaggctgaagtgagctgtgatgctaccactgcactccagcctgggtggcagagtgagactcggtctctttaaaaaaaaaaaaaaaaaaaaggcacttggtcctgcgtggtgcctcacacctgtaatcccagcactttgggaggccaaggcaggtggatcatgaggtcaggagttcgagaccagcctggccaacatggtgaaacccctgtctctactgaaaacacaaaaattagctgggcatggcagtgtgtgcttgtaatcccagctactcgggaggctgaggcaggagaattgcttgaacctgggaggtggaggttgcagtgagctgggatcgtgccattatactccagcctggtcgacagggcgagactctgtctcaaaaaaaaaaaaaaaaaaaagcacttgggtgttggggtttagattttaaaataaacaagaaaaccccaaactttccttgttgtttaaattacccgggatgagcacttggctgttttgattggatggagaataaagggcccgaggcgcttcaccccatttgtactttttttcccaaaaatacatgaggttgggattcatggatggcttttggcttcaagggtcagatcttgtcctgaatgtgtctttgaaaacatcgatgccgcgggcatgactgggaaccacaccttagagctgggtgtggagggaaaaggctgggctgtgaagttgtagccgtcagcagggagggaggccgacggaccctcagccaaagcggtgcgtggcactggggtctggtggccggtgaggagccgctgtgcgatggctgccacagcagaactgggtggagcgtgcttctgggaccacagcctgaggaagccaggcctgcctagcttggatgagccccgccggctggcaggacgcagctccggagagaccctgggctccatcactgtttcccagctggtcccctggtcccccggatcagtgaggacaaagtgagccaggcaggcctggtgggcacaggtggtggctgcgtttggccagaggtggaagcgtgactctgggcaggtggagggggaaggaaggtcccccatctgcggtggtctgtggttgatggagatctctgacctctccaggccctgcgagtctgtccggagtgacctcgttttgtcagtgagagccagggggctgcctccagcacagggggccaggacctggggcgaggacccactacaccagacagggcctgtacctgcagccaagaggggctgagacccacccagtgtgttctgcgtgtgcacccgcgggcagggctgggcctgggagggtctcggcagtggtgagagcacagcccctgcctgggctcagcctcagcctcagctgctttctctctctctctctctctttcttcctttttctttctctctccctctttctctctttctgtttctttttttatttttctttctttctctgcctctttcttcctttttttctctctttctctcttccttttttctctttctctctccctttccctccctccctttcttccttcctttcttgctttctttttttttttttttttgatggagtcttgctctgtagcccaggctggagtgcagtggcgcgatctcggctcactgcaagctctgcctcccgggttcatgccattctcctgcctcagcctcccgagtagctgggactacaggcgcctgccaccacgcccggctaatttttttttgtatttttagtagagatggggtttcataatggtctcgatctcctgacctcgtgatccgcccacctcggcctcccaaagtgctgggattacaggcatgagccaccgcacccggccttctttctttccttctttctctctctctttctttcctttcttccttttttcctttcctttcctttcttttctcttctttctttccttctttctgtcttttttattttttatttttatttatttatctttttgagacggagtctcgctctgtctcccaggctggcgtgcagtggcgcgatctccgctcactgcaagctccgcttcccgggttccagcaatcctcctgcctcagcctcccgggtagctgggattacaggcgcccatcaccatgcccagccaattttttgtatttttagtagagacggggtttcaccatgttagccaggatggtctcgatcttccgaccttgtgatccgcctgccttgggcttccaaagtgctgggattacaagtgtgagccactgcacctggccttctttctctctttctttgtctcactctttctttctgcctctctctctctccttctttctgtttttagagacagggtcttgctctgtcacccaggctggagtgcagtggcacaatctcagctccctgcagcctcaacctcctgggctcaagcaatcctcctgcctcagcctcccgagtagctgggaccacaggtgcatgctaccatgcccagctgaattttttaccttttttgagacaaagtcttgctctgtcacccaggttggagtgcagtggtgcgatctcagctcatggtaacctccgcctcccaggttcaagcaattctcctgcctcagcctcccaagtagctgggattacaggtgtgtgccactacacctcactaatttttgtattttcagtagagacagggtttcaccatgttggtcaggctggtctcgaactcctgacctcaggtgatctgcctgcttcggcctcccaaagtgctgggattataggccgtgagccactgtgcctggccacgcccagccaatttttttactttttatagaaatggggtcttgttatgctgcccaagctggtctcaaactcctgggcccagcgatcctttcacctccttatggtgcccggtctcccaaagtgctgggatgacaggcatgagccacccaccacatctggcccatgtcagcttcctaagcctcagcttccttgtctgtgaagtggggcagtaatggggcctgtggcggtgaagttcagaggaggggatgtaaacggggcgttctctcaggtgaaaggcattcaacccagccttttgtcagaagacctgggtcttagccgtgttccaccatcttggagctgatgaggcaggttgaatctgtcattctgcgcatcctgtcgtatatgctgctgagtgttttgtgtagacagtcctgagtggctgaggttgggcagatgtagccagactatggacagaggcttcctgtgagtccgaagaagtgcccagccctgcgttggcctgtcctggtcgggcgtgcggggcgtggagtctgcaggcgtctgtcatctgggcctggctcccctcccctctgtgggcgccacgcctcccgccctccatgctgacctgaacctcacagtccggttccctgggtggtggacgagtccttgggtgtctcccacccgcttggtggcagccctgcttgcccctgcggggacctcccagcactgcaccctcttggctccgcaggcttccctgtcctggggccgggagaggtctctgcaggctggggaggggtttctggaaacattctcaggtgagctttcccgtgcaagtcccaacctgcgcttgtcttggctcgggaggcccggagcggcgggaggaggaaggaagtggcatttctaggagctgatggtgttttccaggtgggcctggtcgtggctttttcaccctcggtgtaccgtgttggtcggtgggccctcgtagtgggagctggacctgtctctgcaggtattggagcagattcacagtgcggaacgatgggctgagttactcacgttcaaccccgcgtgtgtgatttcaggggctgagcttggcgcgccatctccttgccttttgaaggcgagtttggctgtgaacggagctgctggttctgatcccgtacgcttcctcagacgttgtgggcttggagtctgtgccacactcagaaaagcacatttttgtgttttaaagtctacattttgcctcttttggttgctttaaaaatgttaagagccttaagtctgcccttaagcgtacgtgtcgtgttttctccaatgatgaacggcctcatttttaaaattacacagatttacaatgtaattatagaaaattagaaaatacacgtcagtacaagtaatcaaaaaaaaaaaaacaaaagaaaaagaaaaaaacacatgaaaatgaccccaaccccaccccctctccaccccacagttgctattagccttacggtgcatagcctctaggttatttactttatggttgtgtttttaaattgtacagtttcatcgacaccctattttcactggcaacactgtgaacacctttattccttgttacatgtatctacaccaccatttttaatgaccacacggtgttaggttgttgagaaggactgtgatttatttaataaagcctgtattgctgacagtgcttcggtgaatattattacacacacacatcttttcattgtcgtttatttaataaagcctctgttgctgacagtgcttcggtgaatattattacacacacacatcttttcagtgtcgtttatttaataaagcctctgttgctggcagtgcttcggtgaatattattacaatatttttacatcttttcatagtcatcccgttgtttcttcaagttcctaaatgtggaactgagggtcccaagggtggccactccagcagcttttgatatttgttgcaatgcccttaaagaggcagtgccatccttccattcatccttccaggcatccgttttttcattcacttttcccttccttcctctcctctaatagccacccatccatcatctgtcggtccatccacctgtccatccatccatctatccatccacccacccacttgttcatccacccagctgtccatccatccatctatcatccatccttacatccatccatccatccatccactaatctactcaaatctactcacacacctgttcatccacccacctgtccatccatccatctatccatccacccacccacttgtacatccacccacctgtccatccatccatccattaatctactcaaatctactcacacacctgttcatccacccacctgtccgtccatccatctatccatccatccatccgttgatctactcacccacctgttcatccacccacctgtccatctatccatccatccatccgttgatctactcacccacctgtacatccacccacctgtccatccatccatcatccatccttacatccatccatccatccattaatctactcaaatctactcacacacctgttcatccacccacctgtccgtccatccatccatccatccatccatccgttattctactcacccacctattcatccacccacctgtccgtccatccatctgtccatccatccatccatccatccgttgatctactcacccacctgttcatccacccacctgtccatccatccatccatccgttgatctactcacccacctgttcatccacccacctgtccatccatccatcgattcatctactcacccatttgtccatccatccatccgctcacccacctgttcaatccacccgcctgtccatccatccatccatccatccatccattcattcgtctactcacccacctgtacatccatgtgtccattcactcatccgttcatccacccacccatccaaccatccatattgtgctgaggagcttctgcgtcagacccgggctgggcactagagcctgcaaggaacatgtggtctccatctgagagctcagtcagctgtgggaggcggaagccatccgtggagtgagaagcacaggaactgaggtgttgcaggagggggaggcatcaggatcgggagtggtgtgggcgggggctttcaaaaggtttgtgatctctgagccacaggccaggtaggactggaacccgggacaggccgtttcctggaaactgtcctgacccagcaccactggccagccctgacccaaatagcaggggctccttactggacgcctgcccagagagagctgggggtggccgtcccagacgctcaggccctcaatccccagcttagagaccagtccagggcacagatggagagagagacagagagagggaggggtggacgagagggaggcacatgctctgctcggaggagggctctgcccctatagggaagccagaccgtggaggagcgttcatgataggggcttcagcctgacttcacctcttcctggcttcttgaccttgggtgaagttactttgtgtcttgtttccttatctggaaactggacggaacagcagtgctgacctcataggggcgggtgaggatggagcaagagacagaccaggggctctgccctcggcccccgcaggaagggccggctggaatgtcttcgtgtttttctttctcttaccaggcctgagagctgggggccttccgtgtccccagaacccagcacagcctctgatgcagaagtgcgaagctgtgtttgttgatggggtaggtggggcaacccacatgtgagacgatttaaaatctgagccagcagcttcacgtaaccttccagagtgactgctggatgagaagagaaaactgttttttacagacagaagaggccagggccttttaatgccattaagtgctgagagaaagaggaagccatgggggttttgtgtgaaaggggcagacagtggaaaaagagggtgaagccgtgcgggggggacatggacagagctgacctcacctcggggctgttgcctggagacgtttgtgttcaggcctttgtcggcgatgagctggtgacattcgggcattaacatttcctctgaagaaaaatggggctcccagacctttttggtacacgaggctgggctctctgggctctgctgatcacagagagttggggactgtgttcctccgtccctggggagatgagggacacctgtgtggccaacggagcaacccagtgaggctcatttaagaggcactccaggaggggctgctctgagcggggccacgcccaggcacctgggtgtgtggaaagtcggctttcattgataccaaggactgaacagccccctctggagactgaaacctcccaggaagggtttcagcccacccctgcctttgcttaggctgtggtagaagcacgtgagtggaacgtgagcctcgagtcactggggtgcagccacattgacctgccccctgttcatggggagttctgtcatgtccatcgtggcccagcgtgtgatggcaggaaccagaagcactggaaacgtccatctgggcaggaacaggtgaaggagcgagggttttcatatagagaatgccaggcagggcgggtgcagcggctcatgcctgtaatcccagcactttgggaggccaaggtaggaggattgcttgaggtcaggagttggagaccagcctgggcaacatagcgagacccatcaattaaaaaataaaaaataaaaataagcaggcgtggtggcacgtgcctgtagtcccagctacttgggaggctcaggtgagaggacaccttaaacccaggagttggaggctgcggtgagctgtgatcgcacccctatactccagcctgggcaacaaaatgagaccccatctcttaaaagaaaaaaaagaatactaggcagctgtaaaaggagcaaagaagcttccagatttatgttttcacccaggtgcatttcagaaaatatgggtcaggagggagaatagaattgtgaaagggtatctttctgtcagtgatatgcaaatgatgcagacaccactggaaatgcacgcttttcacgggtgcacacgtgtggtcacggatgcccatgtgtgaagtggagacgcatagcaagggtggtggaggcagcacttgccctccacacctgggcccggaggaggctggagccgcagctgtgatgctggacagttttccaggagagagtggtggaggcagcagggtcctgagctgggtggtggggggtacacagtgtccatttgattacttaaggcatttaatggaatattttaccattataagttgaaatatttttttaaaaaagagggaggaattgtaaaatgatttcttaaaggtctgttcattctgagaacccatactttgtggttttgaagaaatgcagtttagagaacggtgccagggcggctcctgcagatgcgtgcaccagggaggccgtggccaggaaatgtccccaccggggccaggtgcccgggactggggctggggcagcatggccaagccccaccacccatgggcggagagtggagggcccccagctctccctacagccctgccacccactgacccctccccaggtgggaggacagtggaggccccccggccctccctacagccctgccacacactgacccctccccaggtgggaggacagtggaggccccccggccctccctacagccctgccacacactgacccctccccaggtgggaggacagtggaggccccccggccttccctacagccctgccacacactgacccctccccaggtgggaggacagtggaggccccccggccctccctacagccctgccacacactgacccctccccaggtgggaggacagtggaggccccccagccttccctacagccctgccacacactgacccctccccaggtgggaggacggtggaggccccccagccctccctacaaccctgccacacactgatccctccccaggtgggaggacagtggaggccccccagccctccctacagccctgccacacactgacctctcctgcagttctgccttcctcccggaggaaacaggaaactgagttgccagggaagttgggaacaaggactcaaaaaagaagcacttcttaaatagagagaaaacaaccactattttaagaatgacttatttatggaccctggaatcaggagggtcagggctgtctggatctttgatttcatatttgtttcctgggtggctcagcccccatccctgggagtcagggtgcacctgtgggcccgcaaaggtttccaagaatctcctttttaagtaatcagggcaggcaggaggccaccctcggagtgtccccgtgggtgcactccctgcctgggtctctggtttctctgcgtcacattgtgggctgagtgctctttgaggggtctggtctccgaaggtggttattgcatctgttaataagagtgtgacgctggcaccgtgttctggggtaggtgcctctctaccttcctggccgacaggtgcttccccacttgtcccgggtgcctctgccagctcccccatgccccttgggtcctgtctgcatggtccatttcacatccagatttggaacattggacagccaggcttcctggttggcgcagccctgagactcggcctcaccggcttcgagtttgcgtgtcatgaagggtctgtgttttccacagagaggttccgaatgcacatgtcacttctgtgtcaagggtcccaggctccttcgactgaaagtgttctccctgaaaggaaaacaatgcagaaaacatgtcatcaagattgctggttgtattctagtagaattgtatttaccgatgggagaatgttcacaatctattgttacttttgtttttctaaatggagttcaaaatgcatgtatggcatgaccccatttttgtaaaaaccaaaacagcaaactgcgtctgtgcacagaacagaaatggggctgggaggttgtgtgcccagggctggcggtgccatctctggccttcgggtcatgaaggatttcaattttcttctttgaactctcatggattttctcattttccccaatgactgtgaagcgatttacacaagactgtgaaatgaggggaggaagggtttaaatgtccctgtgctgcctgcagccctaatttggcgtgttttgcttttcagtgacatattcgatgccatgttccctgtcactcacatcgctggggagactgttatacagcaaggtacgttctgcctgctcctcggagccaaagtccagaggggaaaaatggactatgcacttaaaaaaaaaatagcataagggcaggcacgatggcccacgcctgtaatcccagcactttgggaggctgaggtgggcagatcacctgaggtcaggggttcgagaccagcctggtggtccaggtgaccagcatggtgaaaccctgtctctactaaaaataaaaattagctgggtgtggtggcgggtgcctgtaatcccagctgctccagaggctgaggcaggagaatcgcttgaacctgggaggcggaggttgcagtgggctgagatcacgccattgcactctagcctaggtgatacagtaagactctgtctcaaatttcaaaaggatatatatagacttgtacatacatacacacatataatatgcatatatgtctacatatatatgcacgtatatgtgcacacatatgtgtgtacatgtatacatatatgtacacatatatacatatgtgtgtgtataaaatagatacatatatgtataaaactaagtaaatataaaatatatacatatgtataaaactaaagtaatataaaattatacacacacacacacacacacacacacacgcataaaattctcattgtgaggccgggcgcggtggctcacgcctgtaatcccagcactttgggaggccgaggcgggtggatcacctgaggtcaggagtttgaaaccagcctggccaacatggtgaaactccatctctactaaaactacaaaaaaattagctgggcgtggtggcaggtgcctgtaatcccaggtactccagaggctgaggcaggagaatcgcttgaacctgggaggtggaggttgcagtgagccgagagcctgactccgtctcaaaaaaaacaaaaaacaaacaaaaagaaaaacacctctcattgtttagagaaagttcactaatgaaacttaagaacaggctctttaacaagttatctcaatgtttgtataatcttgtcattaaaaagaattggtagcacccaggatgttgcttcgagggtctctgcaacagtgttgcgaaagtcgtttgcaagagaaactgtaacttgtatgtctggatgtactttgtatctgttgactttcttcttttgttacagggaatgaaggagacaacttctatgtcgttgatcaaggggaagtggatgtgagtgtcgctaacttgtctttggaaaatagcgcgtctttgcatgtccggtgtgaagacttgccctccaggcagcaccaggcccccaacaaacactgcgctgagtgccgtattcctagtgttttaatccagaaatgcaactgctatctcttggaagagaatatgggaatatgagaaagtgcagagggaaacaagggtgatgctggcaggtgccggcagcggcctcaggttttccagggccgctgtcttccgcttgcccccgggctgcgactgctggggctggccagggcggttctgtttgacccagcgccgtctccagatccgaggccgatgaatacaccaggctcacccaccacatgggatgttaacatctcaaagtgggtgggagagcgacgtgcttagagaccccctaggaccgacgacttcacgatcaaacaacggctgccttttgcgcctgcgtttggctcccagcttggaacgtcccagccgtgagtcgggtctcactgtgtcatcttcccacgcttgtctcaagagcatcttttatgagatgctcccactgttttggaaggagaagcttcccctccgctggagaccccgtctcgtgcccgatggccaggccatgtgtatgtgtatgtataaaatagatacatatatgtataaaactaagtaaataaacacatacacacggcacatgacatcacccctggccccgcagcccagtcttgcccagagcctctggctcccatctcttctgccgtccggtttagagcctgggtgctctggtgtgaaggctttgaggccccctcatcccccgctgggctcctgttctgcaggccgccccccgcacggcagcctgaccttgctggtgcggagctgatggtgcagcctctgggaaaacgcccgctaggagtttgtttccctttgaatcaggcccgagcccctgcggagtcagcgggaaggacctcagtgacatcatcctccctcggttcctggaatccgcctgcactggcggccccagggccttggtgtgtgtcccctgctctgccgggaaccccgttagctcctgcttctccttctgctctctgctaaatgtcacttcccagtgggcatcagcagacatgtcccacgcctccctcgtaggaccctctgcggctcgtggtgatgacatctcatgagaccgtctctttacggcctttctgcacacagactggaagcccccacagtgcaggacgctttggggattctgctacccgagacggtcactgcttcccaggctggctgagtcttctctgggtctgggatgcctgcctgcccttctccttgtccgcctgcccttctccttgtccacctgccccaggaggtggcctccgcactcttccgtgcaggcaacgccacccccggctgcccagcacgagctatttcgaggtctggcctccggtggctgtgcctctgtcccggccacgctattctggggagggcatttactcatttgtttccgtggcagccgcggagtctgtcccccatcgcgctgtgtttctgggaacctgagcaggcccactctgcttccggagctgatagcacaggaaatgactcaggggtcccgcctccccgtggggggcacgtgcctcgggcctggcccgcgcaggcggagaaagagccagtttctcttctccctggtgtgctctgtcctgagccggaacccacgggctgggcccctagacagggcctctggggcagacctttgtgtcagggagtgggggtgctcctgtctcccctagagatggaaactgaggcaggtgccaaaggtcccgggtactgcccggcctcagaggaagtgtggagggggaaggctggagggcggcactggcgggtcaaccctgggctcagctgccaggccgcagagtcatctcctgctggctttgcttcgagtttaaaaaaagcctagcccaggaaatagagaagacagaggaggatgcggccagcatcccagccgggcatcgtcttggggcctgggcccgtcccaggaggtggccccgttgtgcctggtatccagacaccagggcctgatggggggctgcagggaatggggctcagcccccagcagatggggcagggctgatcccagagagaccctggcagcccaggcctgcccagtggtcagcagtgctgaaggcagagccacctctgcgggaggtatgggatgggcagcttcctgactggacccaccgctttatcccagccccaaatctcatgctactacttatagcccctcttctagttcacactctgggtcctggtgtcaccgtgtcacctcctcccccgccctgtccattctgggtcctggtgtcaccatgtcacctcctcccccgccctctccactctgggtcctggtgtcacctcctcccccatcccctccactctgggtcctggtgtcacctcctcccccaccctctccactctggatcctggtgtcacctcctcccccatcccctccactctgggtcctggtgtcaccgtgtcacctcctcccctgccctctccactctgggtcctggtgtcacctcctcccccatcacctccactctgggtcctggagtcatcatgtcgcctcctcccctgccgtctccttcctggatgtttattgagtgcctgctttatgcctggcacttgtgacgaggaggacctggtgcctgctctggtgtgggggaggttgtggcttaatgggggagagggaccaagaacaggaaattagccaatgaatgtcctgactctggttctgcccctcctgtcccctctgctttcattcctgctctgcctcacaaactcctacacatcctacaagaccccgccaggcccagctcatctatctgcggctgggctttgatagatactgacctccgcagatgaccgaggacctgcctccctgcggtgggcctgggagctccataggtccccactgaggcctttcctcccctgtggaatgcttctccctcttctgtgtctgcccatgtcattcaaatcttccagttaaattccaaaggcatcttcaaggtgccggtttgcatcggcagggcttggggttgaggccacccccaggaattctgctttccatgttctttgcttctcctaaatgaacagatgtggaagagacaaaccctttacccagagatcccttgtggagcctgaaaccgacatggggctcccaggttatgttcccgcctaacttgtcgtgtctcgaggagggtggtggacgggtcaggatcgcgtggactcgggactcagaggacccaggctgtgttctttgctggccgtgacctttgcccaggcccttgtgtggctgagccgtgccatttccatattactcagaaaaacgaacagagctcactgctgccgggaagactgagataaccctcctggggttctgctcttggcccctggtgtggaagccattggccgcctggcagctgccccgccccgtctcatgtccccaacacacgcaccgcaagagcctcgtccaccccacagaggaaacgcccaccacccacgccccgggcttgtcctcatcttcagcgcgggtggccaccctcctgccccagcgccaggccccagccggcagcatgctgaggacttcctgggagaggtgagggtgtgaggggccggcggctgggactgctggagggatcaggtccctgtctttccgccgttggcctccaggctcccgggagccccacctgggccaggacctcggcaaaggggccgggaggtgttgctgccccggctgaccttggcgggacctcctcctcctcctcctcatcctcgcagaatccccacccacccctcgacctctggactcagtgaggcatctcccttccctccgtccttccagcaggacagaccccccctccccccgccgccgtctgtaactccttcatacatgacagggtggtgggagaggccggtgccggagccacttcaaagcagggaccgtttcctccagccctgagctcactgggtcccctcccagcccagcccctgccctggcccagttagcgtggggtcggggctgaagcctgagtggaggggagacggttttctctcagacacgacgcgtcgtggcgtcctgcctggcttctcgccaggcccggggacgttgggaggcaattttgagaaaggaaagagtgaggtcaccctcgtgtaactggagttccccaaatatattgtcctggcaaatccctccccttccccctccccatccccctgcccgtccctgcgcctccccctgcccgtccctacccctccccagcccccccgggtcaggcacaaaggcagctttaaggcctctgctggacccggccctccagagccaggatgtctgagccccgtgggtggatgcccacttcctggctacaggctcacgtgggatggccgggccccctgcgggaaccggctgtgacttatggggctgtcccgtgagtcccaggcggctgtgcacgaacaccaagcacctccatcaacttcagattttccagccagggcaggggtgggcgtcagggagtgcccggcggggccgggcggggccgggcgcaggagctgcctgcaggggccctcctgtgatgtgggaggcccttcgcatgcagggtaaatccgcagggcccgtgtgggtgaaggccacatttaagggaatcaaaggatgctcagtaaggaatctggaatgaaaaagtggcatgttgggtagcccgggtgagttatgggcatatgtattataataattactgttattacagcacccgggggaacggccgcatggcagccccaggcagccccatccagctgctgtgtgaaccctgggtgctgcatgttgtttgctggtttctgtaaatcgcctccctggggcaatgggatggatgtaccctgggttcggggctgcaggactacggctacccagggtccgagtgggtttctgaggctagcggttttccctggttttattctgcgtggcgggaagggacggccgtttgccgtgggtatttaactgcgctggccaagtgccggaggcccatcaggaagccgtcccctcaaggacctggccctggccctttaagccagcagagcttggaggtggacgtcacccacttctgcagggtggacgctgccctctgaccagcagcgtccagggggacggccaggtgacaaaatgccaagagcaccaggttcagtttgaattacggttttccagagactccgaaagtgcctgctgccgtccgtgtgttgccaagagctataatccatttttctaagtataaaaatatcttccaatgtattttattcatggaacatagcatttctatttaaaaggacactcagctgctgactttgcaggcctgggaacgtagctcccttccaagccctgtttggggctcgactcttcccctgattgtttttgggcccgttatcccgactccctctttttgctccccgtcccaggcatcacgacgtccccactgacgctggccgttccgggcttccctcggtttcacacaacacgtctgggggaagagctctttctggggggctggggagcaccgccaggcagctgggtgtaccccggagcagggcgcctcagcttggtgatctgatcagatgttattcaggttgtgtcttgtgttctgtgtgtttttaaaattcgttttttaattttttgagatggggtctcgctctgtcgcccaggctgggagtgcggtggcgtgatcatagctcattgcagccttgaactcctgggctcaagcgatcctcccgagaagctgggactaccactgtgcaccaccacgtccagctaattttaaagtttttcatagagacggggtcttgctgtgttgcccaggctggtctcagactcctggcttcaagcaatcctcccgcctgggcttcccaaagtgctgtgatgacaggtatgagccactgccctcggccctactttaattgtagtaaaagacacaccacactgaccattctaaccattttgtgcagttcggtggcattaagaatattcacgttgttttacaaccgtcaccactgtccatttcccaaatgttcttgtcttcttaaactgaagctctgtccacattacacactccctgcccatgcgcctcccccagctcctggcacccctgtcccaccattgacttctaaacacagagggtgagcgagtgaaggtgaatggggggcctgcccgtgcgcctcccccagctcttggcacccctgtcccaccattgacttctaaacacagagggtgagcgagtgaaggtgaatggggggcctgcccgtgtgcctcccccagctcctggcacccctgtcccaccattgacttctaaacacagagggtgagcgagtgaaggtgaatggggggcctgcccatgtgcctcccccagctcctggcacctctgtcccaccattgacttctaaacacagagggtgagcgagtgaaggtgggcagggggcagggcagagccaggtgtgagctcggcgccagagaagctgcagtgatggtggggtgtaaatgctgccccgcgggggacccccattgttttttcttttaaaagaagagaagctgggcgtggtggctcacgcctgtaatcccagcactttgggaggccgaggtgggtggatcacctgaggtcaggagtttgagaccagcctgaccaacatggagaaaccccgtctctactaaaaatacaaaattagccgggcgtggtggcagttgcctgtaatccgggaggctgaggcgggagaatcgcttgaacctgggaggcagaggttgcggtgagccgagatcgcaccattgcactccagcctgaggaacaagagcgaaactccatctcaaaaaaaaaaaagagagaaaacaaaaaaatgaaacacaacaagaagtagcccctttgcgtaccagctggggtggggcccgcactgcgccgggagtggtgacagtggccagtgtcctgagaaggatggcccctttgtcctccgggcggccgagcacagtgtggccctggccgtctgtgggacccgcacaatggcttcctctgaggctgcggagggagctctcggaggccttgggcttctccaggcctcatgggcagcgcgtcctggtccagcttccctgggtcctgcctgcagcggcagcagccacggatccccgctttgagacagaatcccagaaagctgggaggtgcggccgtcccgggctggctctgtggagactcacccttctctgctcccagagcccccatcctctttgccaaggcagggggatgtcctgccacttgcctgggcagccattcgagggggtggtgtcctcattccctgaaggggccaagaggctcactcacctccttgggcacaagatgttacccgcctccctggctctcccatgtcaagcaaacccctcccgacctcagattcacatcttctgagtccacactgctttcgtggctcagcaagaggcccctgcatcggaacagaagtgcagagggtgctggagggagggtgatagtgtttagtgcggagggtgctggagggagggtgatgatgtttagtgtggagggtgatggtgtttggtgcggagggtgctggagggtgatggtatctagtgtggagggtgctggagggtgatggtgtttagtgtggagggtgctggagggtgatggtgtttagtgtggagggtgctggagggagggtgatggtatttagtgtggagggtgctggagggtgatggtgtttagtgtggagggtgctggagggagggtgatggtgtttagtgtggagggtgctggagggagggcgatggtgtttagagcggagggtgctggagtgagggcgatggtgtttagtgtggagggtgctggagggagggcgatggtgtttagtgtggagggtgctggagggagggtgatggtgtttagtgtggagggtgctggagggtgatggtgtttagtgcggagggtgctggagggagggtgatggtgtttagtctggagggtgctggagggtgatggtgtttagtgcagaatgcctcctgaagctgtgccagtggcgactgccaccccaggcgtgcatgtcacgtacagggatgctcctggcagcacgacgtgctgtggaccctggagtccgtcacctgcagcgtggatagacacggtgagacccacagggtgagctccggatccctctggggaagagtcccctgggagtttgtgaggccccgatctgagcgatgtgaaactcactgtgctgcaagagttgggcacgttcctatttgcaagttctgcctccataaactggttttgacaaaaccttaggcaaagtgggagtgtccactgcgaggcggaaggccaggctgtgcccaggccattgcaggccctctccagcttcatcgcccgcaggccaggctgtgccccggccatcgcaggcccttcccccggcttcatcgccagtcctcccctagctctgggtcccctttgagaagcaagaggcagaggttctggagggcattctctgaggtcccctcgcccctaaaacgctggagttgctgcctcctccacgtatccctgcacgcgcgggtgggtactctctggctccgtggaaggacggccgtcttctgattcctggaggggatcactggggggaagctggtgtttcttctgccccgtaatcctgctccagcctccctccaggaactggggagcctggtgggccaggtggagatgatccccacatccccgccaggcagagtctgcctttgcacagcagtcgcccctgtgcctccgaaagttcgtggtcgaccagttctccccagcgctcacttgtacctaattgtggagttacacctgcgtggccttttctttcagatagaagactctgtgcctcagttattatccagataatgagtcattgatttcagtaagaattgattccatgattcattgcaatccattctttcccgatatgcaaccaatgggaactgctttgccaatgggaactattctttaagctcattgacacccagaggggataaagcgtgtattgtgtcaatttatagtaacggaatctgcataatcactgcataataaacaatctgcaccattcttgcacggacccaactgtgatgctcaatgcatagtaggcaccctgtgcgggggcggcggcccacccgggctgaaagggaatcttgtctgggctccttcccaggcgcagctcggccgcagcgcccagccatagggcgcccattcagactccagcccgaggagctcaggcgctgcctgtagggagggaggccctggcaggagaggtctgcacttgaggccgcccggctccttcggggcccagtggtgtgtgctggtggaggtggggacagaggaatggcctggggtggagaggaagcacacaggtccccagagcagagccccgtggggatcacaggctccagctcatcacggtgcagctagggaaactgaggcccagagaggctgagtgagaagttgacggattgaatcagacactgcctgggagtcaggctggggccgctgtgccgcagagcgggggccgggtgcgtccgcctctggtgtggttgtctcattggcactggcggctgggccctcctgctgtggaggtctgatgctgtcccaccgtggctctcagcagggctgggggtggggtgagcactggggtccacaggcccattgctggggaacgcagggctctgcccacaagcgaaagggcttgtgccccgccctgcggggaccctcttctggagagagctaagggggactttctgtatgggatgcagaggaggtcaccctgcctggcccccgtgacacttctctctcttgctccccaaaggtgtacgtgaacggagagtgggtgaccaacatcagcgagggaggcagcttcggggagctggcgctcatctacggcacccccagggctgcgaccgtgaaagccaagacggacctcaagctctgggggatcgaccgggacagctaccggcgcatccttatggtgagttggtgcccaagcacagagaaggccaacacccacccttggccaggcgtccctgggaaccctagctctattcaaggtggggatgcacctggagaaaagacacttccaacctccctgacagatctggcctgtgagaggagtggaaaggggtggagggattctggaagcttcttagaagacaggtggctggggaggccccttcaccgtcctccttttctccttcccactgtctggactgtggttgtgatggctggtgctccagctgccatgttgggccaggaggtgactatgagcgtgaaacccactcaccatggtgatggagcaaagaggtgtgaggagcgtggttccctgccgacacggtggctgctcacccacgggcttcctgtgtgtggggactgactcttgggcttttagctttttttcttatatgtggccagatctactctgagccacgtaccctgtactgtgtgtgttgtgtgcacacgtgggtgtatgcctgtgcttgctgtgggcggcgggggtgctatgggccgattcagctgccacggctggtgtttgtaggggctcctggaggtgagctcgtggggagcccggggaggaccctttccagggagaggagaccctccacgccctccccgcacacaccccacctgccaggccctgttctgggtgcaggtctgtggggaacacaggcagggcagctggagtcttgtcctggtggaggcggccgtgaacacccggccccagagggtgattcctgtggagaaggaccaagccgagaagcaggtggaggcagacggagtggggcgggggggactgctgttccgtggaggggcctcagagacccccctgataaggtggcattgagcagagcctcagggcaggacgcccgggtgccggaagcagcccaggagcgtgagggccgaggaacagcagcacagggctgggccagggctgaggggcctgtgtggatgaggaggccttcccgcgtggggcagtgaggcgctgtccagagagggcggggagggctccaggccgaggacccgcagcttctgcaggaagcaccctgtcagagtgctcaggagccacggtgggagcttgagggcagctgtgaccagatgtggacccagttccctgggccggtttggggccatccagtgagcgtagacagcaccccgtgcggccattcatcctgggaagctctgggtctgccacagtgtctggggtcccttggtggtctggggaccctcatagtttggagtccccttgtggtttgggtggtctcgtcatgatctgggggggactcctcatggtctaggggatcccctcatggtcttggggtcccctcataatttggggtcctctcatggtctgggggagtcccctcatggtctaggggtccccttatggtttgggatttcccttgtggtctggggagtcccctcatggtcttggggtccccttgtggtctagggggtcccctcatggtcttggggttccttcatagtttggaggtgtccccttatggcctcaggtctcctcctcagctccttctgtcccatcgctgggcagaggcctccaggagccagcgcctgtggtttgggtggccgcacccctccactctgtccttacctagccatgaccgctgggccaggggctcctctgagctggttgggggtgacacagcagaacctggtggcggtgggcttgttgccaatgcagccccggacagcgtctgctccgagccctctccttcggggcctggggtcccggggtccagcccggccgaggaggggttgagccaggtgggtgttgccggggtcctcggcctctcctccatcccctgcttgggatggttccctccactccatgcccgaggccagcctggttgctatggcaggaggtgaatggcctggtgtcttctagggggcttggctgactcctggaaggccagcctgggtgggtgtgattcctaaggagggagccacagttccaggacgcccaagggcaggactggggagagtcctgggggatggtttaggatggagccccgtgagctgggagagcaagttcaaccctgggtttccctcttggaagtgcgtcgtctgattggggaacaaggatttgatggccatgggccagctgagagacggtgtcctgctggcgctggcctgtcccggccccacggcgatgccggctcttgtgttttgtggatggcgcgttcgcacagtctttggggcggctgtttcatcagattctgcaccccatgagcttctcatttatgcacctgtggggcattgctggggtgcccaccctgggtctggggctcctgtgctgctggggatactccagtacacagaacagatgatgtgcagcctcctgggaggagttgcacgctccctctcttctgtctgaacccgctcactcctgccttcactgggaggcctctgtcgccgcgtgggaggggtcccctgagacaccctccccctgagaggggctggagcggttttggggcaggaagagggcacagcggttcccatctcctctgggcgcacctggcccggcgttgcataagccgtttccccaccatccttgacgccctgtcgctcccggctgggggatttttgtggctggaaccttatattcagggaagttcccaaaccactgagggagctggcgcttcctctgttttaattttgggtccctgtgcgctaagaatagctggccgcgccgggctggtttggacgggagcatttgcaggatggtgtctgtttctgtattggccccgagctcctcacacagctcctgtttctgccttagtcccgagctgggacgtgctgggacctgggggacgcgggagacccggtctggtgtctccaggaagtagaccaccgcccaaaatgtgaacgctgactccagtttaggatcccagagtgtctgatctgggagactccctgatgcccgtctctttcctccaccgcttcacgttttatccgaggaaggatggggtgaccccacctctaggctcccaggcaggggcccagcccggggccagcactccccagacttgctttttctttcttacctttttgttttttttaatttttttgaaacaatgtctcactgtcacccaggatggagtgcagtggcacaatctcggctcactgtagcctccgcctccccggctcaagccatcctccctcctcagcctcccgagtagctgggactacaggcgtgtgctaccgcgcctgactaattaaaaaattgttttttgtagagacctggtctcactatgccacctaggctggtcttggactcctgggctcaagtgatcctcccgcctcagcctcccacagtgctgggtctataggtgtgaggtgtgagccaccgtatccggcctgatttttctttcttgtaagctttggagtcctctgttcaccctgatccttacccaggacctcagcgtttggaagcaatggatgtagaattctgtggtggaggctgtgctggggtatccagagcccaagacccccttggaacctgagtctttggtggaggttggaccctccccgcccctcagcccccgctgaccagtatccggagtgactcggcacagccagtggggccaggaggggaccagtgtccggagtgactcggcacagccggtggagccgggaagggaccgatgtccggagtgactcggcacagccagtggggccaggaggggaccagtgtccggagtgactccgcacagccaatggggccgggaagggacgcggcttctccatttctcagcacaagcagtttgtcacttgtagcctcgaggacgctgctaaggtcacggagggtccccgagcctcgaccggggcttagtgccctgcagtgtccacgtgaggccacggcagccgggagggcccgtgtgcaccctcactcgggcgggacggtgggctcaggagctctgaggcagccgtgatgtgctgagggtcacacagtgtgcacgtggggaccctgatccatggggggatcagagccgggacctgcctggcaagtccacctcacggaggccctggtgggaggaaaagtgggcaccgttcacagctggcgacccctgctccgcctgcctgggcctctttctcttctcattggccctggggtctgtcacgctgggttccacagcggtgccttcagactgaagttgccaaccccacagccgtgcgtgggagccggggctggctttctggtgggcttcacctcacgactttgggggtgtgtggctgtggtgtgaatctgctcctcctggctttgaagtgtgaggggatgaggccgtgttgcagccatctggggccattgtggggagggtcaggcatcaccagtcatttcaccccactgacagtgcgtctccaggctggagaagtggctgctgtatatatttttcttttcctttttttttctgttaatagaggtgaagtcttgatatgttgcccaagctggtctcaaactcatgagctcaagcgaccctcccgccttggcctcccagagtgctggaattataggcgtgagctgctgcacctggcagccgttatcaacgctccagttttccaggctttctgtgtgtaggtgctggcaagatggggcagagctgaggccgggacccaggccccgtgccccccgagccgactcatgggaagtgggtgggaccggtgttaagaagccacttctagcgcccccgccctccccgtgccgtgggcttgaggaagccctgtacctggaaatgggggtcacctgccttttcccacacaaagccccccttggggatgccggcagacacactgcagagcccccacgtgggggtcccagtgcccaccggccagctcggaggccagctcccagccctgcctcaccgaccgtctcagccacagaaggaacatgatcccaaaaggggcagtctttggggccgggccctcccccgggggcccctggcagccttcagctgtcaccccgccgcgagagatggacgggtgcacgaggctttaatgtctgaggttccccgggcaaaacacgcttgcattcctccggctgggcgtaattgctgggcagtcagtgtgaattataaattatttttcaaaagaagtgctttttttatggctggcagaaatctaaaatggcctgggctgggtcattgcgcctgccactgccccgggcatccggcccgctctccgctctcgggggcagacacgcggcactttctgctgccgacgggcctgggctcggcgtttctgaaaagatcgttgtcactgaggaagcccggttcgttcaggcacccgcagcgggtggagaagtgccgtctgcaccgtcttggtcttgggccaagttcctgaggtttttctggacctgctgggctgtgggcttttgccagaaagaggggaccttggggagggctttggcagaagataggacaccccctggactctaaaattggggcttacagccattttagtgctgctctgacccagagctgatggagaaactgagacctgggtatcggggagggctgggttcccacctgcatctcctgcgtctgcgtctgctgtgacttgcaaggcctggggctgttttctccccggatgctggcctcttgggctccaagtgcccatctctcggggccccgcccccaccctgctggtctcttggtcccctggactgggcacgcgagggccacacgttggagtggcaaggtcagtgccgccaggccaggattccagtggctgcacccagctgtgcccaccaggcctgcagccatgttcagctctgtgctctcagctgcagctcttctcctcaccggtgcgtgccttgggcgacagagtcctgccgtgctgtgctgatgtgcacatactttggagcagagtccccttatggtttcacaccctttgctgggccggtggtgctcagggctgtgggagccacactcctcttggagtgtcctgaagggcgtggggctgcacagcagagtgccagagccccctctgtcttctggtctccaggcaccgggggaggcagggcccagggagccaggccaccgacatttccggttctctctgcgtggtgttgagccccctctccctgcagcagattccgtctgaaagtggccccgtgccattgaacatgtccagagctgccccagctgcctgaccctcacagggccgtgggcttggtgttggcatcatgaaagcaacatccaggggctggatcgtcccggctcctctctctgtcccgggcagcctgggcacgttgcatgctctgagctgcccttctccagtctcacgtgagggtgcagcatgatgacgtggtgccgtgcacacggtaggtgctctgtggatgccacttctgttcttccagagcagataagatgctgagtgtgtgagtggaggttcgggatgaccttgttgtctccaggacagtgtggggcctggccgtgcgagcatccattctggaacaagattgtcccgtttcagttcttggcctcagcacttagcagctcggtgggcataggcaggccacaccgaccctgagcctctgtttcttccatagagtggagataatagtaggctcagctgaaagtgtggatctcgggaggtgcctgattgctggggagcattcagcatagtgagccgtgcttatcgtcatcaccttctgggaggaggaggaatcttggcagtggtgggggctgctgaggacgagggctgggtcagcagctgtttgcaggggtgtctgaccccatttctgagctcaggcacctgacatacccctgctagtcaatgggaagcagacaaggaccaaggtggacatggcacccgtggagcggtggtgaggaatttgggaggacagagaaggagcccaggccagagacacacggaacagctgctcatttcaatcactcttctcatggagaaaccgaagaccagaggggacaagactagtccaagggcatggggagtcatgggtaggctggggttggaattgcaatgtcctgactttccccgtcagcacacttttgtgtacccggtaaaaaccactaccaccatcatcattgccaccatcactaccatcatcagcactataatcatcactaccactatcgtcaccatcatcaccatcacatcgtcatcaccactgtcactatcctcaccaccatcaccaccatcaccaccatctctatccccaccatcaccatcaccaccgtcaccatcaccaccactgtcactatcctcaccaacatcaccaccatcaccatcaccaccattaccatcaccaccatcaccaccatcatcgtgatcaccactgtcactatcctcaccaccatcaccaccatcaccatcaccaccatcaccatcaccatcaccactgtcactatcctcaccaccatcaccaccatcaccatcaccatcaccaccatcaccatcatcgtcatcaccactgtcactatcctcaccaccatcaccaccatcaccatcaccaccatcaccatcaccaccatcaccatcaccaccgtcatcaccactgtcactatcctcaccaacatcaccaccatcaccaccgtcaccaccatcaccaccgtcaccaccatcatcgtgatcaccactgtcactatcctcaccaccatcaccaccatcaccatcaccaccatcaccatcaccatcaccactgtcactatcctcaccaacatcaccaccatcaccattagcagcaacataacatttgttgagaatcagttctcataatgacccagtgaggcagggatttttatggtctcatttcaccaaagcccaatgatgcaggtgacacattcaaacctgtacttgtccacgttgagtggactgcccactgtgtcctccatgctgaggctctggaaggcaggggagggtgggtgtccttagggtccttgtccccatcatggaagttgggctcaagccacaccttcgctgggctcagtcgtctgatctgtgagtgggaagcttggtgcagctccaggagtctgtttctggacactgagggcggcttgggagcgagtggggagggccacgctaccggaaatggcctgtgcccatgggaaaggtcagcctggccaccagggcccagaataagcaactgtggaaacaacccggcctgagccccacacaagtcactgctgtgcctcggggacttgcgcgccattcctcccccatttcactggagcttgcatttttgtcatagttttccagggacaggcgtttaacatcacgtgcctttcctccagcccttcccccttgagctgttttccttccacagcaatccatctcccttccttcatcctctgctccactcctgcagggcctcctgccccagcagctggagtcccgctccatcccagccaggagggctgcacaggagggctgcggactgcctcccctatgctcactcggtgtccccagggctgctctttcccacccccaactgtggaaggggctgtgtggtggtccctcattttcccatgtgatggggccacctttggtgtgctcaaggagtccctttttaagggagacacaagtaagtttgcatctggctgtgggtggcattgagagataggagagggggcagtgggtaggcgcaggccctggaggcggggccagggcagacccccacttcaccacggcagtgggtaacttcagacacacacctccgaagcactcacctccactttctcctcctcctcggccctctgagttgtgacaatgtgatgggcacagccctgagcacagcccccacccctgtccagggcactcagtaaacaccaagtggtgcctgattgcgatctccattcctgtgagtgattggagtggatgggaagatgctttgaacagcacccctcaggagaagaaagtttggggagactgacaggcatttggggggctcctctgagtgtcaggggtcttgcttctcctgtccagtccatctctctttcctgacatctccttcctacatacgttgcttagaaggtgggataaattcctggttaacacagtgaaaccccgtttctactaaaaatacaaaaaacattagctgggcatggtggcgggcgcctgtagtcccagctactccggaggctgaggcaggagaatggcgtgaacccgggagttggagcttgcagtgagccgagatcgcaccactacactccagcctgggcaacagagtgagactgtctcaaaaaaaaaaaaaaaaagaaggtgggataaatgaccctccttcaccattgcccccaggcgttgtggcagctgggagggtccctggcagcagggtgttatgccagccgcctgcaggactcagaagagtttatagttttctatcttaacctaggtttcctagcctatccttacccttaggattaaattttgctggatgtattagttagctgtggctgtgtaacaaattcccctcaaacttagtggcctctgtcaacagtgttacatttgttccatttcctgtgggtcatggaggaagcagctgctcggctctggcctggaaccctcctcgggctggggggatcagaaggtcttatggggcagaggagatttctgtggtggcttccccccaacagggctggagggtggcaggaaggtgctgctcctcctctgagcttctctgcagctgagcgatccaggagagagcagggcaggagccacagtatcttttacaacctggctttgcaaatctcagactcatttccttagcattctctagttggatccgtcagccctattcatcgtggtcttagttgcatccgtcagccctattcatcgtgggacagagcacacagggtgtggacaccaggaggcgagtgaggatcattgggggccggctgcctccatgccaggtgtaacagaaatactcaaaataacagtgtcttaaaccacacggctgtttctcacgctctgggagtctgtctagggtgggtgtgttgttccatggggcccgagaaccagctttctcttactgatgctcctcaggggcccaggatggctgctgcagccccagccatcatctccacatgccagtcagcaggaaggaggagaggggagggacatgttcagaaactgcacatgccactgtgtctgcgtgcccctggtcagcacttggtcagttgcacaggtgggaggcacctggtaaatgctgctcactgtggttttctgtctcagggcattacgggaatttgcaaaacagcatgtcaggaaggggtaaaatacgtccccattcaagttgagaggcgggggcagctttggggcttttagggcccagtctaggctttccttcttggttccgtggttcctatctagggtggtcactcagccctgcggagctgcagtttctgcctctggaaaataaggataaaagtatgttcccctctcagggttatctgttgcgaggtcgatgtgggtcagtgtgtccaagagcccccctccctgacctggagtgggcgttcaacacagcaagttccctcctccctcctttctccacaccccaggggacttatctagggtcacggaaaaacctcatcactagcatgtcgtctctcggtctgactcacatcccggcgtacaccctactcgaacgcgtggcctctgtcagtggatgataccatttgaattttagcaaagtcgagcttgctgctgtccgggtggactctgtgtctctgtttttggaatgtgcagtgctgaatcgtacccaccgtgcggctgctctgtacagttgtggagttcgtgcactgtacaaaggcccaggcagagggttgagaggggctgagacccaggctgctttctgcacaccaggctggagctgactgcctagagcaggggcctcgttcctgtttgcaccagggcccatcagcttgatgggatgtgtgtgcttaaagaaggggtgtgtttttctaattcacatttataatcctagtttctagaatgaattctaatttctaattcacataacgctgacagggccgtgtttgttggtattgtatgattcagcatgcttttcccagggttgagggaagtcaagtatcggcttttaatgggtaacgaggcagcttcaggcacggctggatccagggtcttagctgacgtcagccgcactctcccttctacgtcatgtgcttgagtctctgtgttggcctcagtttctccagatgtgtttatgagctccctgcccttcatggctagaaacccgggttcaggctctggctggctgtgcgctcaccgtgtggaactaccacgggtcctggctgggtggggaactctgctgccagccaggacacttagcaaccatgccgggagcttctccagaagccccccgggaggagggaggtggggggcataggacaccgtggcagctcacgcagactccgagtcgtcgagggctttggggacttggaatgcttggagggtctcatttaaaagttgagagtcatttggggaaatctggaaacgtcaggatgatccaggtatgaagattcaccttcttgtctgttttttactttctcccgaacagggcagcacgctgaggaaacgcaagatgtacgaggagttcctcagcaaggtctccatcctaggtcagtggctgcgcccctgcacggctgtgtgtcccgacatctgggcgcctgctggccaccccggcctcttccccattccctgcgtggctggcagttgagtgttgttggtattatggaggtttggggtgcaacacacaggcatgctcacgcacagacacgtgcacagatgacacacactgtcacttgttggcaaaccccaagagcctgcctcctctctcgtgggcggggctgccctgcttctcaacgtctctgccatcctgtgcgtttcctgtctgcttctccctttgctgtcagagccgcgcccccagccttccctccacaccagtccgtgtagagctgaaagccagtgttggctcccggtacacgtgtgagctgggtcgagctgctttccctgacctgtgctagttcccttctaagcgcagtttctctgggagccgcctctgccctttctacgccgccatcattgctctcagttccgggaaggataacggcaggctggggtttcaggtgtgcccagggccctttcaccttcgggtgagcctgcttaacggcctggcaggaaagacgctgctgaagcctgagttatacgcgatggcgccagctgggccagtgggggctccttgggctagagcaggcagaaccgtgcaggtgtgtgggggtgagtgtgcacatgggggtgtgtgtgcgtgtgtgtgcatgagtgtgcatgtgagtgcacatgggtgtacacgtgagtgtgcatgggtgcgagtgcacatgcatgggtgtgtgcatgtgtgtagaatgcgtgtgaattgcacgtgtgtgagggtgtgagtgcaccgtgtgggttgtgtgtgggtgtgtgcgcatgggtgtgcatgcatgtgagtgtgggggtttgagtgtgcacgtgtgagggggtgtgtgtgcacctgggagtgtgcaagtgtgtgtgcatgggtgtgcacgcatgtgtttggcacgtgtgtgagtgggtgtgtgcacgcgtgtgtgggtgtgtatgggtgtgcacacacgtgtgtgcgtgggtgtgagtgcacgtgtgtgagtgggtgtgagtgtgcactgtgggtgtgtgcgtgtgtgcgtgggtgtgcacacgtgtggggggtgtgagtgtgcacatgtgtgagtgggtgtgtgcgcctgtgtgtgtgcacgtgtgtgtatgcagtgtggctgtgcctgtgttccttcttggggaggactttgacccctgttctctctgaaatccttctgtgaaatgtcgagaaaggagcgtgcgggtctttccattgtggtaaaatgcacgtcacagcacgccgaccgttttgacctttcccggaagcgcatttcagggccgttgagtctacacacgacgttgtcggcaccgctcccatcccagagccccgtcctcacccgagacagagccccgtccctgtgagccgtcaccccccctgccctcccggccctggcagcccccggaccctcctggtctctgtggattatttgcctgctcgggacgtttcgtgggaatggaatcacctgtgtggctttgtgtctggttttaattctagtgccattttgaaaatgtcatacttggaaacacaaaacgagttggtccgccagattttataggggccgagagggggacatttgctccctctgcaaaatcccaaacgcagggcctctgccgcccgtctgggcgtcccgctgcctttcagccagacctgggtggtccggcccctggtgcccaccaggcactgcatagtcagccctgtgcccacagactccttcattcaccagcgctgtcgagacaacggttgctgcaggccatgaagggcgagaccctctccctgctccgggcgagggctggtgaccccccggctggaggtggcttcttgcttcctgcgtcccgggctcttaggggccgtcgcacgccctggccgcgtggcctccgtccgcccatttatgttcctctgattaatgcagcagccagcaatgtgaccggcttctccgtggcctcccagaagagtaaccacaaggcacgattcccttttcctgcccagtcagcatcggcacaaagtcctccaaaaagtggctggcggggcggtgtctccgcaggcagcttggccggagggatggccctggatgagcctgaagccgtgggcttcggcatttctgtccccacaccagaaacctgggaacggcttttgtgcctggatgctcctgggaccccgctttctcctgaacgcgcagggctcggcccctaggacaggagaccccgtagaatcagcatggcccacatgggagctgcaagtctgcagaattccagcacagagcttgacgatgggttcccccctgggcaggtgcacgcagccttacgacgtctcgtcctgtggctgcaggctgcccttgtcaggtgctttttgggacacgtgactgcgtttattctgcagtttacatggtgaatggggatggatcccatctgtgcaaaataaaaaattagctggacatgatggtacatgcctgcagtcccagctacttgggaggctgaggtgggaggatcacttgaggccatgaactccagaccagcctcgataacatagcgagttcctgtctctccaaaaaatttttaaaaagttagccgggtgtggtggctcatgtctgtaattccagcactttgggaggccgaggtgggaggatcgcttgagcccaggagttcaaggctgtggtgagccgtgatcacgccactgcactccaggctgggtgacagagcgagaccctgtctcttgaaaaaaaaaatggggccaaaagtgccatctccctgtggtttcttctgtcagttttcatccaagattaatgtagccaggagataatttttgtttttagaactcagaatactacaggtttcaaatgtaatagagtaagcatttgctaatcaaatatgtggaaatgaacttcctaactgcagctgacttctgaaatgagatgcctcgtattactgtccttgtaaggaaaccagtaaagaaaacactccaaattcatatgctggtctcattctgcaccctgaacacaaaccataattgctctaaaaaatcacctgcatcatttaattgtcaggtgtgcactgatgtgttggcctgcttgggagcacgcctgggttctgaattattcagcagcttctgtctggtacagactttttttttttttttttttttttgagacagagtgttgctctgttgcccaggctggaggtcagtggtgctatctcggctcactgcaagctccgcctcccgggttcacgccattctcctgcctcagcctccggagtagctgggactacaggcgcccgccaccacacccggctaattttttgtatttttagtagagacggcgtttcaccgtgttagccaggatggtctcgatctcctgacctcgtgatccgcccgcctcggcctcccaaagtgctgggattacaggcgtgagccaccgcgcccagctggtacggaccctgtttttaggaagctggtcaaacagctctggttgtggggtcctcgccccccttccctatgctgcagaatctgcccggccctggggttcgtgggaagcattttcctttgcaacctacggcgccgacagggatttttaaggagagaaatctccctcctaacctagatgtaaaataaatgctttgctttttatttttagcttctgacctacataggtagcatctgatttgtataggccaggaaacgtttgtttttttttttttttttttgtcaaaaaagaaatcgttaatcaggtgatcattattttcttataaaatctgacgttagtaaattttttttccttccaagggttagggatgaataaagacagggaagggaagaccttgtgagaagggcggaaagataacattgagtttgcaagcatttaaagataaacttggcatgggaagtaagcattttgacctaaaatagtagaacgtatactgtgccttaatgttgcaacataaatgcagttccatgttgtttgatcagtcccctgatgaacagtgtttcttttcgatgggcagttaccattctgaattattttgttattcatgtattattattattttttttgtattttagtagagatggggttttgccatgttgaccaggctggtctcgaactcctgagctcaggcaatccacccacctcagcctcccaaagtgctgggattacaggcttgagccactgcacccggccagtttttctgtttttttcttttttcttttttttttttttttgagacagggtgttgctctgtctcccaagctggagtgcagtgacgtgatcatagctcactgcagccgcgacctcccgcgctcaagtgatccttttgcctcatcctcctgaggagctgggaccacaggtgtacaccaccacgcctggctaattttttaatttttgtagagacgagatctcactgtgttgcccaggctggtcttgaactctggcctcaagcgatcctcccgccttagcatcctgagtagctgagactacaggtacacaccagcatgcctggctgatttaaaacattttttgtagagatggggtctcattatgtcggcctggctggtcttgaactcctggcctcaagcgatcctcctgcctcagcctcccaaagtcttgggatttataggcgtgagcccactgtgcctggcttctgagttattttaaaccacttagtaggctttgtgcttagctgggactccattgtttgcaaaaatgtaagcagctctattcttttgaagtaacaaaagtattttcatactgagttaacctggagtcagttttcactgctgggtatttacattaagccagggataagtgtcagaatagctccctccgcaactggtgaagagggcacatgagctgcatgcgtctgggacccactgactgcaagaaaacccaggccccctggcacagaggtgctgggggacagcgtcacggcctcatcttatgcagcttactggtcacggagctggtgttgtgattgcttctgaggacacctttcgggaagagcggtggcccttgtcttggactgtggctgtgggggcgtgggccccgggatgacctgtcctcatcctcccccgacagagtccctggagaagtgggagcgtctgaccgtggcggatgcgctggagcccgtccagtttgaagatggagagaaaattgtggtccagggagagcctggggacgacttttacatcatcacggaggtgagacgtgcttcccacgtgggcgctctgggtgtgcactggggcaggggcacttcttaccttctcctcttccactgcccgcctcaccctccctctggagtcagtgctgccctgtgaccgcacgcccgtccggggcctccatggggtgggtggtctgtggcctcacattcctgccactgagattcctcctgccctctagcatcaaaagcctcccttcttagaaaggtaggtggctggtgcctgagctgcacgtgtgataaaactgcatgaaactggccgggcgcggcggctcacgcctgtcatcccagcactgtgggaggctgaggcgggtggatcacctgaggtcaggagttcgagaccagcctggccaacatggtgaaaccccgtctctactaaaaatacaaaaatttgccgggtgtggtggcacatgcctgtaatcccagctacttgggaggctgaagcaggagaatcgcttgaacccgggagatggaggttgcagtgagccaagatcacaccattgcactccagcatggacaacagagtgagattccgtctcaaaaaaaaaaaaaaaaagtaaaataaaaaacctgcacaaaacctgcacacagggcgtgcgagggtgggtagagctgaggagggagtggggtgggggatggcaccgcgtccgcatcccggccatggcgtggcactgtgtgtacacagcaggtcactgttggggacatcgcatacattcagggtacgcaggatctctctatattatttctaacaaccgcactcaaatgtacgatgatggcaaaattaaaagtttaattttaaaaagacggtggcagcttctctatctggatgtgtgtgtgagtcatttttgccgtctcacgccacggccccaccacaggcaggcgacaggtggctccgtggagctcccgggatgtgctggggccgcagtccgtggtggccgcacgcagactgttgggtgggccgagcagctgtcctgaggacacggcaggaattcgcgtgtgaactcccattccgggtgccggcgagggactccgtgcctgagagttagcaggtgggactcgactccagaggtggggctgggacactggacctaattgaggactggctaaaacagggccagggtgcaagccactctccgtaagccacgcccacccgtgcaccattgtcagtttaccgttgccatgacaacacccgggcgctcccgcccctttccatggcaatgtggtctgatgacccggaaaattaccacccttaaccagagagctgtgtataacccaccccttaatgtgcacataatttaaagtgggtataaatgggactgcaaaagcgccctgagctgctaccctcagcgcactgcctagcgggagcggctccgagctgtaacaccaaacactgccacctcagtaaagctgttcattccacctcctgctggcccttgaatcctgtcctgggcaaagtcaagaaccctcgtgggctaagccccactttggggcccacatgcatcacctgtgccccatggttgtttgaactgtggcctgcccggcgatctgaagccccctcccttcggattcatgctgcaggaactgggccggaaccccagggccggcagtgcgtccgtcgtccggaggctctgcctggggcctccctgagaggaaccccctccccaggtggccccgggcaggaatgagtgacctgtccaggctgtgtggtgacctgcccggctctgcagagctacacgtatgctcccgtgtgtctgacatgttccccatgtctccggccctcaagggtgagcaggatctcacgcttgcatgctccctaagcacacgccccaactctgtacctgtcatcgggaaatgcgtgcgtcagggtggcggagtttaaggtcccgtcctcgccgaaacacccgcagctgtgggcagtgacgaggatcattttgggtccagaaggagggcacctctctgccctgggggctgctggaaagaaacaggaggtcagcaaagagctcaagtcccagtggatgtttggcaacttcggcaaattcgggagccagtgtcttggttcgaaacaacagaagcccagcaatgcggctggggccgctgatggagttggacggggccgctgatggcgttggacgaggccgttgatggagttggatgaggccgctgatggcattgggtgaggtgactgatggagttggacggggccgctgatggcgttgggtgaggcgactgatggagttggatgaggccgctgatggcgttggacgaggccgctgatggcgttggaagatgctcaccaccgctggaacacaggccgaaaagcaggaggctggagtaagagcctgcgggaaggaagtgtgtgtttcgctggagacccaggctcgggcccctgcacctgcaaatcctcactacccttccctgaggggcacattcagggcctctcccgcccctcattcccggtgcttcccactgcggctctaccataaggaaagatctggaaggctggggtagagcaggagaaacagcagaggccagagggcaccaggccggctggggcatccgagatgccgggagatttctgctgacctggaagaagcaccaaggcaggtctcgacagggcagccagcttcacggagctccacacggtggatttggggttcccggacctgagtcacttccgtctccacgtcccagaatgctcattgtgtgaatgaattaatgaatgcatgaaggaatgatgcttgtctccaacctaaaagtacagcaggctgcacggacattcacgaagggggtccttgcgggggagccgttatcaggcagtatttccggtcggtagagtagaggactcgttcaacagtgatgcttctttaaaaggagagaaggaggagggaaaggatgaaaccacaggcagcccaagtgattattctggccagcgttgaaggaggctctggcgggccccgagaggggagtgaccccagccgtgattccagcgtgcacacccgcccgtgtgcagaggagaggatgccagcgtgcacgcctgcccatgtgcagaggagaggatgccagcgtgcacgcccgcccgtctgcagaggagaggatgccagcgtgcacgcccgcccgtgtgcagaggagactatgccagcgtgcacgcccacctgtgtgcagaggagaggatgcctgtgtgcacatttgcccgtgtgcagaggagaggatgccagcatgcacacccacccatgtgcagagcagaggatgccagcgtgcacatttgcccatgagcagaggagaggatgccagcgtcatgttcgcccgtgagcagaggagaggattgcaaaccgacagctgaaatctggtgtattaaaggcggctgttgggcacggtggctcatgctgtaatcccagcactttgggaggccaaggtaggaagaggatcactcgagcccaggcattcaagaccagcctgggcaacatagtgagaccccatctctactaaaaatttaaaaattatcagcaccataagacaggtgaaaaaattagctgggtgtggtggtgcacgcctgtagtcccagctacttgggaggcggaggcgggaggatcgcttgagctcaggagttcaaggctacagtgagctatgattgcgccattgcactccagcctgggcaacagagagagaccctgtctcaaaaccaaaaccaaaaccaaaaacaaaaaaagatggcttcaaattcttggctgtctttcctgtggaaaaggggagtctaaccccctccccttgatgctgggctggcttaggtacacacttgacagacagaatgcagtggaatgatgtcgtaggttacccaagactgggtgctccaaagccttacagcttccaccacagcctctgggagccctgctcccgggatgctcttcttggggcccagcagctgtgctctgagacgcatacccagccagcgcagccccagcctcagccagcacagccgtgaatgcccagtgtcaacagctgccatatgactgtgccatcttggacgtcccgccagctgggtcttccgatgaggtcacccctgcctccatctggatgcaaccccaggggagaccccgagtgagaaccgcccggctgagcccctccaacccccgaactgtgaagggtaacaacaaattgtggtttaagtcgctgacttcaggaatggcttctcagttatcaccagttctcgctactgaaattagtacgtcagtagagcccttccttgcctagacaacagagcaatggcggtggctctcccggccgctccaccgccagcaggacgactgcggtgacaggtggaaaggcagatatctttagttgctctaggttttacaaccattgacaagaaactggtgcttacaggctcaatctggcccagagacaaatttgtgttggcctgtgcagtgtttttttaaacatttggattacttgttgatattttatagtcaggagatttcacataaaaatctgggtcgctggccaggcgtggtggctcacgcctataatcccagcactttgggaggctgaggcagatggatcacttgaggtcaggacttcaagatcagcctggccaacatggtgaaaccccatctctactaaaaatacaaaaattagccgggtgtggtagcaggtgcctgtaatcccggctactgggaggctgaggcataagaatcacttgaacccaggaggcagagattgcagtgagctgagatcacgccattgtactccagcctgggccacagagcaagagcctgtctcaaaaaaaaaaaaaaatctggatctgttaattctctttaaaaatctgacatccggccacactggacctgcagccctgtctggccctacccagctggagctgagaggcagatgccccttctggtgtgaaaggcttcccagctttctcagcccctgccctgccctgctctcggcttctcagccgtctctgcaggcactcgggggcttctgagttggcagcctcggctttaatggtcttgaaactgagagaatgggtagctgtggctgattcagacaatcacccattattcactgcagagcaaggcccctcccagctgagcccaaggacccgtgtaggaaaatcatgaaaatgtgtgtggggggcgtggatcgtgggtgcgtcttcacagagagcagatcaaggccgcacgcgcggtgttctcacccctgaacagaggagatggcatcaccgagtcgcgcggcgtgttctgagtgttgagtatgtgccgggcgtcctgggagccccccacgcacaccgcgtgtgacccaaccgcaccccggcggggggattctgccagccacgccctccacatccacgccggggtcatcggctgaggacaggtgtggggaccggcgaggggcagacgctgcctcccgcagctgggaggctctgccagctgtgcctccaccatgggtgtgcccgactccgcgatcccagtcttgcgagcacaacttccagtgttttccgctttctgaccctctgtccactccctggttgacgactcggattttaccttcttgggtgttttgcgggctgtgggagccaggccccgcagtggcacatctgctgaaggccgttacggctgattttcgtgatcttggggggctcacccggctctccggcagtgtggttttgtgttgggaacagctgcttcccggaggttctacaggctctctgcagagtccccaggaggggtgctggggtcagatgctggctgcccctccgcaggagcccccacgcgctcctgcacaggcttcccggaaaggctctgaggaggggcatgtggggaggggcctgctggtgtctgtggggagagcagagcgctgcgcagggtgccctgaccactgacagagtgtgtgggggtcgggaggggaggtgaggggggctgtgcagattcacataaaacagcgccttgcacgtcctccgggacgaaactcaacccgagggaaggtatcgctttcatagcgctgtaaaatgtatttgaaagggtctccttggcaacctggatctttttcacttttcctctgtgatcagccaaatttggtaagtcagtgtgaccccggggtgcagggatcagaggctcggaaccgacgcgcttcgcagcttattgcggtttccagctgtggaccgcacgtccagggcggccaccgacagcatcagacaggtgcggcggggcccggccggtggggcggcttctcggcaggcgctggaggctcagtggctgccctcgtggccgccgtttgtttttcttgaagcagcgcgtggaggagatgccggtccctcgctctccctggggccggcgtcctgccctgtctgctcactgtcattcttcctccagcagtttctaaagcacattgttttgtaaatcacggccttggtgggtcgcagatgccctgtgcatgaggcctcatccctgtagggccacggagctcccgcctcacctttctctcctcccgcctaccctccacctggggcctcctgctcccctcggctctccagggtggacgccagtgagggctggcccagtctgcaatggcagcctgctgtgccttgctcccactccgcccgaagatgtgattgttttgggagctgatttccctcaggtgtggggaccccagccccgcacaggtgtggaaaacagcccctgctcacacctgtgaggcatgaatacctgcaggcctcgggggcaactccactgcagagctgagctgggcgccatggaggcagctgggaaggcagggccaggctgcaggaaccccaactcccgagacccccgcgggtctctctgcaggagcaggcccctcctgggtggaggctgcttttccttgtccccaaccccacggggtcacgcccgctgtctctgaagctgtggggagctgccagcccctcagacacccgatccccacagctgttggaaaatattctcagcagactggagcggtcactcctccgcaggcctgtgggttgtgaaccttgggagctgcagacatggagatggagagctatggtacccaccgcaccctgtgcgtcagcgggagccctgagccccagggcctgggcgtcctgcgtccttgtgaggcctgcacctgccgtcagcctcggggtgaggggagctggatatttctaggggctcttaccaaaggttggggggcagccccaggccccaggagctctaaatggggacagagtcctcggtcctgtggcaatgggagcagaagtgtcatctctgtgccctgcctccggcggacacccggctcgctccccagtgagagtggcgtccagggcctagcggagaggcggcagtgtgtgccagggctgtgcgggctcccggaggcggggacggtccagctgttccgtcacctcaccgcggacgggaaagtggagcggcattcggccggggctgggtggggcggtgcccgcccgggcaccatctcaggttccctgcgcacattcctccatctggggccgcacgcctgcttttccaggcccctggagttcccctcccggagacctccccacagcctgggggcagctggaccccgggagccggttccccgtaaaaatcccgagaccgaaattccccagcttcctcctatacggggcggcagcggcctgggaggtgttgctatgggaatgctagagtggatttatctcctctcttagcaaattaattttatgaatgtccacaacgttgaaacaactgcaaaacaacacgttgcaaagctgcccttgggcctgggaacttttcctggctcatcagagccccgcgcctcctccccgccgacgcctgaaccaggggacggcccattgttcaaaatccacgggtcgctgctggatgcttttaggaaagggacccctgcaaaacagcacccctggaggaccccgtgcacaccccgtcatcgggtggggtcagctgggacccagcctgtaccgcgaggctcctggctggggtctcggacagacccggcctgcgctgcgaggctcctggctggggtcttggacagtgccggtgccacattttgaagcgttgctgcttactcgtggtgctgcttacttgtggtggccctttcagttcctacttgtcgctcttttggggccgccttctggaggaggctctgctggagtgccggagccacaggggcctaagccatacatgtttcccaggcatcagctccggtcccggggctggagagatgccgtgggccgcagacacgccctgtcctctctccggctggcgttctaggggcgtgagatgctttggaaggacatgagggcttggaagagacgtgaagcaggacccgacacagagagtgctgggagtggtgtcgcttgggctgcagggagggtggtgggggccgtggggcaggggcctggataccgggagggagggggctgcaggcagcggtccaaggtgggagagcgggcagggtgagtctggggggctccggttgcagagctctgctgaccggggttggaacgccagcgttactctgggtgtgacggccgcaatggccggagttgggggctgatttgcagaggagggagatagtccagctgctttgccgagggccgtgccacgtggcgaataaaccagacaggagcaggccggccacagcacagggcagtcaccctgaggggacggcgggggatgagggagggctcggggactgctgggcaggcagtggggggacgggtattgaagtaggagtaggagtctgccagatggagggcatcctgacagcctcggggacacaggagcgcgggagggtggggcgaggctacgcaagagcggagctgcaaaccctgggcagggaaggctcccaggccccccgagctccttgacggggggtatgaaagtcgctttataacattctgcctggacaccacagcctcttctgagagccaagtgagaagtgctcagaaccaaatccctggcccacccttggcctcagggccctgccacgagcctgcggtcaaccttccggaggcctaggagtatgtgcctgtgggggaacctgcaccggccgcgcgtcctccctcctctcgcgggtcagggcaggtgagatccgccgaggtgccgggcttggcctctgcccagcggtcactgtgggtgggtgccaagtcttccctgtctgagggaaatctcagcgcatcttgaaagggggcccatttggcctggcctctagcaggaaaataaaaacattccttctgggctggactggaagaaacacttttccagaaccccggggctgggctctgagccctccacctgggccctgtgtggactttgtgcatgcggacatctgcgcggggacagtgacggttccagggccctcggggtctggccctggggtggccctgtccgtggggtctgcgggctcactggccagggtcattacgggtgtgagagcttcctcggtgcttagagggactccggcctcaccctgcctgctgtccaccaggtgccagcatccctcccctgggctgcgagtgcccctgctctgctcagaccctgctggggcaggctcctgagtgctccagcggccacagctgaccgagagggacacacaggtccacccggctctgacccacatccctcttgttgcagggcagcctcgtcatcccaggagcaggggaggggctgcatgccccctggcccccctttgtaggcaaagctcccccagggccttgggcacaacgggctgtgtcccgggcacgtcacggctgccctctcccagtgagctggacgttcggcccagcagcttgggggccggggagagcttcccagcacccggctgaactgtgagatggctccaggggacaactgttttcccaaaggcatgggacgtcttcacttgcctttcagcgtaagtgagtttcgatgtgaattggggcggccggcaggctgttctctgcgtggatagagggccaggtgtgaggctgaggccttggtcagctcacgctcagggtttctgctttgggagacaagaaccttcaaagtaatttcttcaagtaaaatgccgcttgcggactgagacagggacgccgaggcgtcttcagcaaaggatggtcccatttgtgtggttcctttgacaagtgcctttgccttgatattttctctctgatttttttttttgttaatgtaagtaacattatacaaagtttaacaccctctcccccaccaaaaaaaaaaaaataacaactctaaaaagcaccatcttcctccctccctcaaccctcccctcccagagaccgaaccaccccccgcgggccccggctttccattgcagacatttccagatcttgtttcccacccgtatctcggggcaccgccgcgcaggcgttcccagacgagacagatgtggaatgcagtggctggttccaaggtcccggattaccctgaccagattcctggcagcaaagcgaggagacttaagcaccatgcaaagactattgccgtaaagacggatgttttggctgggaacatcctaacagatgcgcagttctggacaaatcgatttgcagcaccccacggtcgtccaccccccgcagcaggggctggccgtggtggctgtggtcctgcaggcagtgggttgtggacattccctcccttgtggggggtggtctgctcccctcctcccagaccttctgatgatgttgagtgaagccggggcccttgagcacttggtccttctgggaagtccgcatgcccggggcgggccagctccaggtggtgaacaatggtctctgggaggaagttgtcctcctgtgttctaaatttggccacgcatgtctctctgattcaacagccaggttctcagtcccacagctgtggcctgctggccctgctgtccctccccagagtcagctgccggaggaacttggtgaaaaggctcctgagggggcagcttccccaggagcaggacacaaggtcacctaccttgtggctcggccatgcctccaggacaggggtgggaaacgtgtggggccagaccgagggggtgcttagcggcacggggggctgtgacctcaccctggccatgacccccgagcatgggtgagactgtgaggcagtatgagctgaggccataggtggagtgagttgaggttccagtggccaggcccttttaaaaatgttttgtttttaaaaattgtgataaaatacagataacgtgaaatttaccatcatgaccatttctaggtgtacagttcagtggcattaagcaggtcattttgctgtgtggctgtcaccaccatcatctccagaatgtttcatcttcccaggctgaagctctgtccccaccaaacacacactccccacccccctctcccagcccttctagaaagtagaaccacccttctcctttctgtctctatgagtttgaactctactgcctgctataagggagatctgacaggatttgtccctctgtgactagcttatttcacttgcatagtgtcctcaagggccatccatgttgtagctagcaggtgtcagaatgtccttccttttcaaggctgaataatattccgttgtttgagtggcccacattgtgtttatccagccaagcctgttttttattttgctgctactgctgctgctgccaccactgatggtgatgatgatggcggtgatggtgatgaaggtgatggtgatgatgatggtgatagtgatgatggtgatggtgatgaaggtgatggtgatgatggtgatggtgatgaaggtgatggtgatgatggtgatagtgatgatggaggtgatggtgatgatgatggtgatgatggtgatgatgatggaggtgatggtgatgatgatggaggtgatggtgatgatgatgaaggtgatgaaggtgatgtgatgacaaatttggacgtagctatgaggtgaggccataagggtggagtgggttgatgtttccatggggccaggtcctttttcaaattgggttggtttttaacaatttggttaaaaaaacagataacgtggaaattatccttcatgaccatttttaggggtacagttcagctggcattcagtaggtcattttgctgtgtggcggttcccatccatgttctccagaatgtttcattctagcaggatgaagctctgtccccaacaaagtcacactccccacccctttctcccagtcgttctagaaagtagaaccacccttctcctttctgtctgtatgagtttgaactctactgcctgctataagggagatctgacaggatttgtccctttgtgagtagattatttcagttgcgtagtgtcctcaagggccattcatgttgtagctagcaggtgtcagaatgtccttccttttcaaggcagaataatattccgttgtttgagtggccctcatagaaattatccagccaagcctgtttgttattatgctgctactgctgctgctgccaccaatgatggtgatgatgatggtggtgatggtgatgatggtgatggtgatgatgatgatgatggtgatgatggtgatgatgatgaaggtgatggtgatgatggtgatggtgatgaaggtgatggtgatgatggtgatcaaggtgctgatgatggtgatgatagtgatgaaggtgatgtgatgacaatggtgatgaaggtaatggtggtaatggtgatgtgaaggtgatgacaatgatggtgatggtggtggccataatgatggtgatgatcatgatggtgatgaaggtgatgatagtgatgatgatgacaatggtcatggtgaagatggtgatgatggttgtggtgatggtgatggtggtgatggtgataatgatggtggaagtggtggtgatggtggtgatgaggtgatgaaatggtgaatatggtgatgatgataatggtgatgatgaaggtgatgagttggtgaatatggtgatgatgatggtgatgatgaaggtgaagatgagttggtgaagatggtgatgatgatgtcatggtgatgatgatagtgatgatgaccatgatggtcatggtgaagatggccatggtggttgtggttatggtgatgatggtgatagtgatgatggtaatggtaatgataaaggtggcagcggtggtgactaacacttttttagcttttactctgtttcaaacatttccatatttaactcatttaatccttacgagtctctgaggtaatgaccattatcctcccaatatgtctgatgagaaaatgcactgagaggaaaattccatgagttcagacctcaccagctgataacccccagccttttgcagaggtaaagcccttggcagtgttccgggggtacccacatccttgcctaaatctccccagaacctggtggattctggataggtttatattattttacagtggggaaactgagacttggagaagtgaggtagcatgtccttagccacccagctgggccaagtctgaagtccagatcctcacggagcctgagctaccccagtcaagcaccgcagctgcgcaggggcccagaaaacgtcccgtgtgcctcatctgtcctgctgagtccttcagaaactccccacaatcaccagaccagttttaaatagcaattcaggcaagataaaaatcaattaatttgcagccacgggatgtttatttcaccttttgctcagctcttctgttggcgacggaaactcttgactgtccggcgtatatttatagcctctctgagcacgagactctccctgggaagatgggcagtgtccaaggagctggtgcggtgttgggcctggtctttgaagggggctgaggcagcaatggattctgccctgaatgcattgcttcatgagggactccagggaggtggcagctggctgtggctgcacccaggtcacctgctctcctttggatccgagggacatattgcttagtagtaagaccagcatttgtgctcctccttggtgtcccagatttccagaaagatctgctggagacatccaagctggacacctttggggtcccaagagcccctaaaggctgccccagaccccagcctgctcttcagcatccaagagtgcgtgtggtccatgagggatggttggagcatctgttggaattattccgatcttattccagtctcctgcgaaaccctgaaggaatgaagtgaagcgtgtggttaggtttaccctccttccactcctggctgtgcaagttccaatcacccctccttgggtggaagcccaggaagtcgccaggcaggtgaatgtgaacacctgtcagttgtcactcctgggttcccagacagtggctcccagaatgggcagctcaataaatctccactcagggatggtggaaaaatacccctgggctcccgtcccagatgcaaggttggggggcatccgcctgcaacacttcctccctccaaagctgatgtgttcgtctcgggagttcactctggaagtgcttttgggggccagtgccctgggccctgggcctgttggtcctggccggccgatcccccctcccctgagctgtgaggatttatagatgcatctgggcactgccggagtcagtgctggcgccctgggcagtttctggggatgctgcgggaagaggcctaggaatgccctccaggctgagggaacatttgtgtgcagaggcacagaggtgtcactgtggctggagtcgagggcctgaatgcggtggggcggggacctgagtgtgtgactgcccacgtggagaggacgtgggcttgcctggaaggcagtgcaaagctccgagccacaggcttgcctggaaggcagtgcaaagcttcgagccacggagacagggccaggattgctgggaacacagagtcctcccagagggagcaagggcggaggttgaggctggcggcggaggttgaggctggccacggagccacgggaggacctgggaggaggcctgaggctggatgggctgacgctgggggcggcggcctgtgtcccaccctggccccacctcccgtccatccagattccaagtctcaggttcccacaggggtgtccaggagccacagctctggctggacccggaggggcccactgggctgagggccaggtccagaatgatgggtggtggctgcgtggggtatggtctctgtggggagactgaacagggagggaggagaccctttgggaacaccaggatcagaacgggaagtggggagcgggcagaggggggctgctgaattgtcaatggaggaggctggagccgggccaggctggaaagtgctttctgcctctttagaacataatcagccagtgtgcacccatgcacaccaacgcacatactcacccatgcacacgtgtgcacacatgcacatatacacacccacaacccatgcacacccacaacccatgcacacacactgatccgtgtgcacatggacacaggcacacctgtgcacacacacgtacacacatgtacatacagacatgcatgcacacctgagcacacacacgtacatacacactccaagcagacccatgcacacacacacatgcacacaccgcacagacatgcatgtatgcacacgtgcacacatgctcacacagacttctgttctggcacacatgcacacacacagtgcatacacatacctgtgcacacaataacacacccatacacacacctgtgcacgcactcacacgtgcacacatgcatgcacacacacacccagcgtgcagaggttgcagaggctgaagcagcttggggccccctggggctgggacattgtgggtcttggcccacccaagccggggggctgttggacgcctgctgagtggacagtgcacagcctgggctctcagcagtggcaccccttcctttcctttcccttctggcctaaggaatggtgtctgcagaggcagcctgtggagggtttttaggctcattggaaaagaaaactggggtatcccgtggagggggtcctggggcggacttgcagcctgacctggcaggtgctctcagaggaccctcagggtgggggccgagggcacggggcatcagctccgggttgggtctaggtgcctgcccacctgcacctgccctggtggctgcctggagggctgggggcatgtttgatcccaggaagcagaagccgtgtcagttccgggcccaggctctcctgggatgagaggtgctggtgtgtggaagggttggggttgctgtgaagtcacagtggagatttcatcagcgcccgttaggtttctggtgtccagcaccctggtcagtacctggaaggactcaatgtctgttcatccaaagattgagacttggctgagaaagcaacagctgaaatggcgggcgagggtcagggcatctctgctggtgtctgggcatctcagctggggtcaggacatcctggccgggggtcagcatggtggagggagtcatggttggggggcatggaccccatggccttgcaaagaagatccagggaggaagagaacagctggagggaagatgaaatgctgctggccgcaaagctatgatgggcagattggttgtgatctgtgtgtgacagagaccctttaagagctctttctggaacctggtgtgaccaggcagatggaggggcagtaatggaggaaagggtgtgagaggccctggaggccggggcttggcccacctgcaggtgatgagtgcaggcctggtggagagggctggaagggacgcgttccaggctctgcagggggcagaatcctcagtgctggtgacccctggttgggaggtgaggccgagggaggtgtctgccgtcgtctgggaggagtcctgtggacagagatgcctaatgggggcagacgaggagttgggctgggcctgtggagctggaggcgacagggccctcactgggacgcttggggttgaagccacacaaaccacaggcagtgagcactcccacccacccaccctgagaggtgcctggggctggagcaggaatggctgcccccacctccccgcctggcaggcagcaggagcctctgtagcctggggcctgtgctcgccctggttccccggaacctgcagagactcccacacagatggccgggagtaactgggccacagaagggcattgagggcaaggcccgggcagccacatgcccctttccttccacgcttctcacctaaccgtggttgctggcgcagccacaggcatctcgtcacccccaccccccggccgcgccgggagcacccaccggagcttccatggcagctgcgtaggtcccgggacggacagtgcctggctgcagagacaaccgaggggataactgggtttgcagaaggaaaggctcgtctcacacggggccaggcctgcctcactctggcatgcaggcgggggcggacgcagccccgcacctgttcccaccccaagccctggcgccgacgtccgcgggaacggcttgtttcccacggaagctgctgggccgtgcctttgccgggccccagacctcatggatgatccattaaacgctggcacaggagctgaccttgggcggctcgcccgctgaagtgtgttttcgctgtcgtcccgaggacagtttgcagcccagggtgtgtgacgtacatcagttccgtctcggccagccgggcctgaggagcgggcaggggatgattgcggggaagtggctcagcctcccgaaacaaacggcagagggacagctcggtcacctccaagacacccggagcctgcacgcagctcaggagcgctccgaggagtcaccgcctgagggagcaggaagggatttgggtggaagggagcttcaggtgaaattgccttccatgtggaaaaaacagttattgcaacggttgcttaaaaaaacataaaaatgcatccatggggcttatttattcaggagaaatcacagagcacctgggagtgctttagaggcaggggctgcttgcatcctctgtggatgtgtgtgtgtgtgtgtgcacaggcgtgtgtgcctgtgtgtttgtgcctaggtgtgtgcgcacaggtttgtgtgcctgtgtgtgcatgtgtgtggggtgtgtgtgcatgtgtgtatgcacgtacccgtgtgtgtgtgcacaggtgtgtgtgtgtgtgtgtttgtgtgcctgtgtgtggggtgtgtgtgcatgtatgcacgtaccagtgtgtgtgtgcgcaggtgtttgcgtgcacaaatatgcatctgtgtgtatgtgtgtgtgttcacacgtgtgtgtgtatgtataggattctgcttctgcctaagtccagaagcacacaggcaggaaatgtgtgcacaggaaacgtaaaggcactggagtgagcctgaattttccaggctctgaggagtctcactggagggaggaacgtgtcgtggcccccgtggccctgagaaggcatttggtgtctgtccactcttacgttcactcatggccgccgccctcatgatgactgtcccgtttgacgtgctggaactcctggagctggggtaatctggcctcaccgccgctctgtagcattggttggcgttgtcccatataacagatgaggcagctgaggctggagcagctatgggccttgcctgagactggctggtgcattgcagagctgaggctggacccagactcttcgactcttggtctgcggcccgattttggtgctgatgacctggcccaaggtgcaggacaggagcctcctcagtcccatttgttcctggccaggtcagggggaagcctgggttaagctcgtgtgttgaacacctttccagctgtgcttaatcttttagttactttttaatttatggaaagtgatagcagtttccatttatggtcgtgatacaaagtttcttttaaaatatatttattattattattattattattattattatttgtattagttcattctaacactgctatgaagaaatgcccgagactgggtaatttataaagaaaagaggtttaatcgcttgtgattctgcctggctggggaggtctcaggaaacttacaatcatggtggaaggtacctcttcacagggcagcaggaaagagaatgaaagctgaacaaagcggggaaagccccttataaaaccgtcaccccatgccatgattcagttaccgccccctgggtccctcccacaacacgtggggattatgggagctacaactcaagatgagatttgggtggggacaccgccaaaccttgtcattattagagacagggtcctgctttgctagccaggctggtctccaactcctgggctgcagtgatcctcctgcctcagcctcctgagtagctgggaccacaggtaccaccacgtccagctaatttactttttgtagagatggggtcttgccatgttgcgcaggctgaccttgaacacctgggctcaaggaatcttccttctttggcctcccaaagtattgggattacaggtgtgagccaccgtgcccagcctaaaatatttatttaagtaaaatgaatatatttgtctcttgtagaacttcacataagggacttggggtgcatgtgccttttcctggcctccctgactccacagcgagcctcgagactccggctcactgcctgcacacgcgtgtggcgtcccgcataggaagagatgggcttcctagtgtgtctcctcccggggggtgtccagacggtctctggtctgggctatgagcacagcgggcctgggctccggtgcttccctggcgtcggccccagatcggggtcccctcgtatcggggagcccttcctgcaccactcggggctcctgccgggcatggggaagtgcgaccaccagccctgagacggagcagatcccttctgactgccctgagcccccgtcctggccctgccccctgctccagcctcttctcccagccgtggcaccagcccctctctcggcctgggatgcggcccccacgtcttctccggctggctcctcctgccctcgaggtctcagctcagaggccactttgctggtggctgggccttcactggccgccccctgaactgattctcggctctcctggcgtcaggcacctgtggccttgtgggttgtgtctgcctcccctctgggtgccgagtcctggtccgggcagggatgtggcctcctcgttcacggccgtagtcctagccctaatgcagtagacgagtgactgaaggcgagcctggaagaataaacagaagggagatgcatcggcagctccgaggaaggcaaatggtctgtgtccatgggaacctggctgggacggggccgccgtccacgcctgtggcaccaggttctccctggagcactggacccaaagggagggaccctgtctccccgtctgcccccagttctgtgatccgactgacctctgagccgaagcgttggaggctcacggccgggcaagggaggctgtgacaagggacaggaagccggggccccttccaaggaagctgatgctaagaccttggctggttttccttcttctttttttttctttttttgagatggactttcgctcttgttgcccaggctggagtgcagtggcgcaatctcggctcactgcaacctccccctctcggttcattcaatcctcctgcctcagcctccccagtagctgggattacaggcgcgcaccacgcctggctaatttttgtatttttagtagagacagagtttcaccatgttggccaggctggcctcgaactactgacctcaggtgatctgcccacctcggcctcccaaaatgctgggattataggagtgagccaccacgcctggcctggttttccttctgatcaaagtcatacctgcccattgtagaaaatcaaaaagttgattttggttttgattttataggaaattttattatttcttcttctcctcctcctcctccttctcctccttcctttttttttttttttttttcctgagacagggtctcgctctgtcacccaggctggagtgcagtggtacaatcatggctcactgcagcctcgacctcctgggctcaagcgatcctcgcacctcagcctcctgagtagctgggaccacaggcacatgccagcacaccccagcatttttgtgttttttttctttttttttttaagagatggggtctcactatgttgcccaggctggtctcaaacttctggcctcaagccgccctcccacctcggcgtcccaaagtgctgggattacaggcgtgagccactacgtctgagctgattttgcaggaaattttaaaaaatcaaaatagtcgcaaggaaaatgaatcctttgtgattcccctgctgcggacaacggccagggcaggacgttctgcggcgtctcctcccaggtttgtgccactgggttatttttagagtcgggttagaatcaatagtgagaaaatttggggagtatgacctagagttttggcaagcatgtttttccagcccaaaaaaacccagactctcaatcctcctgagagcgtctgtgctgcctcgtggcagtctgggaagtggagttggacaggagtgtctatttccagaggtttcgacagcttgagagaccgtggtgcgtctcaagctgggcctcccggaaactgagggtacgtggtggttgcggcggccgcccatgtcgtgggagtgctggattctgccagctggaggtcggcacccctgcccctcctggtccatgtccatcctgtttctccctcctctgctgttccctgtctttctgctgtcggactcaggcatctggcacagatgtccatgggtgcgcaggcacaggacggggactgtcaccaccgtcagtgtgcagggtggtgtatcagctagggagagaggccgagctgctgtaacaaacagtccctgcaacagtgcggtggaaagaacggagaaatgtctccctttcttgagaagtgatggttgtgtgtcaggtgggtgggtgtctgtcccatgtggccctcccgagtcgtggctccaccaggggcctggtcacgggtgtcacgcggctgagacgtgaggaagggattcgaacccaggtctgctgggctctgagggtcctgcctctttccctccttggctgctgatcctggtggagatgggagggcaggaggagggagtcccggggccaccagactccgctgaggagaccgcgctcccctcctcccagttcctccccgactctggttggaaacggaagctgcccggcccaggccgggggtgggaggggccgcacctggttctctgcagctcaggaggtcagaggtgggggtcggctgtgggagggcaaggggcagctgagtggccgcgtctagttcacgtgaacttggtagctttgcacggggactcttcagtaccctgggagccgggggaggcacctgtgtcttttatgacgcagactttcccggccccagggacagaggcagcgtccccctctccattccagaaacatggcatctgagctcaagacacagctctactggggtgtgtttggagaaggtgaaaggatgaacttgaccttaaaggtggagggtcgacgtgccggaggtgcgtggggaactgttcccgatccacaggcaccaaacaccttcctctggcctcggcccctcctgtccagccgcgccacagccccttccgggagggatgaacgcggacgcctcggggaccgacccctttgcctcacgggtggggcccctgccggccgtcttggcagtgactcctaagaatacaaattccaaaagcagaatgactccgtgcggaagactgttccgcgttattgacggtgttttacccctttatgtgactccgttcctggacgtccccagaggcccttctaattatccgaaggccgccggttgcagggttgcattcacatcaggcaaacccacgtcgcagtggaaactcagtgaagctgtgtttgggggtgattggggtcggggtgggtgggtttgctttggtggcctctgggatgcctctgaggggtcggtttccagaagtttcctccgtggcctaaaacggtgcctggcacgtggtgggtgtccagtcactcttggtgggaagcacgaatgcccccacctgagctgtgttctggtcaggggcttcatggtggttctcacaaaggcttcaggggtgcagggtggcctgggggtgcctgggagcttggagacagccaggagccgagcgtccttgaagcaaaattcgtgctggccactcccggggcatatgcaagagggagacaggggcccggaggggccgcactgctgggatgagcataggagggatgaagacggcttgtacctggctgagtccccggagcgggggcatctggtcatgcattgaggtggggggcctggatgcaagcccacgctgcctgggtctgcctcccgggctcccgtctgccaattcgcagcacccctcctgcaacagggcctgtgagccaggtgtgctggccaccaccacgggtgactgcagccttcgggtagggctggatgtcatctgcttgtggaggcagcgggactctgactgtgtggccttggccaagttgctcaacctctctgggcttccatctgcgaagtggagaaattcatgccccccacaacatgctggggccctgaaaaagggggcatgtgaaggtctggggtgcagcagctgcccagacagtggtcagtccctccctggtcgggctggagggaaagacagcagaggtttacaaaacacatctctccagagcctcagaggagggtccagcctgaaggtacctgtgcatcctttcctatcagggcgtgtgaagagtgagaatgcctccaattaaaaaagtcatccgtgtggtaattatgctgccgatttccaaatggcctctaggagatgccaccacttagaaccggattccagagaccaccgagcacggccagtgtgctcttgcatccagacagcgtgactagtgacaaagtgtggtgtgtccgggagcagtcggcacagcagccccgtgggggctccccggacccatccctgccgcttccttgccggcagaatcccaatcctcagcccctccccagagcggggcacgtccagtcccatgggtcatattccccagcaactggtttagggcaagcgtgagaccctctctggccaatgaggagtgaggggatgtttccaggagtttctggaagggtttctcactgctgaggggagaagtgcaggagaaagaggtaggttctgtctttctgctgatggtgtaggggtggcctgtggtgactcccggagccacggcagcctctgtgcccccatgagggacctgattgaggaccttgcacctccccgaggtcccagagcaggaagcaagagcaaggctgggtccctgccacctccgagccatgaaatgggcctgggagccctcccctatcttccggctctgtgggatccgtggcctcccctgtcttccggctctgcaggatccgtggtctcccctgtcttccggctctgtgggatccgtggcctcccctgtcttccggctctgtgggatccgtggcctcccctgtcttccggctctgtgggatccgtggcctcccctgtcttctggctctgtgggatctgtggcctcccctgtcttctggctctgtgggatccgtggcctcccctgtcttccggctctgtgggatccgtggcctcccctgtcttctggctctgtgggatccgtggcctttattagaccttaccagcctcaatttgggttttctgctatttggggtcaaaagcacctgaacattgctccacacccaggtttcaccaagtaatcctgtgaaccagaggccgtcaggttcatcgcctggattctgagagaggaaaataatcccagctgtgaaacagaaagtgttaaaaatggccacaaagggagcatcgatgacgtctgtccgcaaggtcagcgtgatgggctgtccagacaaataacgccgctcacagcggctctcctgtgcgggggcttggcctgctccagaccccagctaaccaaattttctcgcaccgaattctcagagtggccacagctttgaagaccaggaagcagagttctcacctatgggaaggctggggccggtggcttcagagcccaggagtttcaccctccgccatctgcccccacatgggcctcagagcccagagctgtgcccgggtctggcctgagccagtgccaggactgggaggagagctgggagctgttcctgtgggtgggggcccacggagtcttccctctctccagcgcccggggtctgagtctgtgggcacccggctgagggcacgctccctgtctccccctgcccacagtggcggcactcagccgcccggtctgttgtttacacgtcctgctcatccatcagctggattcataaacacggcagaggcctgggagccgagtggccccacggccggatcaggggccagggcagcggtctggctgtcacaggggctgccagttggtgcctggagattctaggcgtggcgggcaccagcagggtctcctgacccacatctctcccagactgatgaggtggggagttactcattaacccaggtacagcctggctggcatttgttgaggctgggtctgggtgagccagggtgaaccgagcccaccttgaaatgaagtgtttgttctccaagagcagctgctctcagagggccgccgtctgccaggccggctggggctgtggggacgtgatccctgggtacccggatggtgccgtctccggaccctggagggccaggctgcaggtgctgccaccttcctgggcctcagcttccccggctgtaaaatgggatggtgacattcctcacgcaggtgctgcacttctgcggcagacgcggggccctgcctccggggactagggaccggtcggagcgtggtgcagagagagctgctcagagtggaattcggggagtgtctgaggccggcggcgtgcagggccggcgacagagctacattcatcaacacctgctgagggtgtttggtgttgaggacagaccgtttccccggctgttcagaggaagcttctctagtgtgtcttcccagcggctctagtgtcagcgggacattcctaggttcccggcaggcggagtctcaggggggacagtgacacggcagccccgtctggccacacagcccacgctttccctgtgccaggccgcggtttccacacctggggccctggagggaccagagtccaggggacattcagctaccccagccccgccgtccgcaggctgcatctgtgcgtagcacgtgctgcggcggtgccctgtgatatgctgcccacggcctctgtgttaatcattgatctgggcaacccgcagacccctccccacttccccgtgtcgggggtcaggagggagcttagtaggcatgtgaccctgagacagcgcccccctcccctttccccggggaggccgggatggctggatgagctcccagtccttgagagttggtccaaggtcagcttggagaccggcagccctgtgacaaagataccgacccccagggaaggtcccagcgcgtcccctcccggctcctccgctcgcctcggcaaaggtgcggggggccagtgagttccatttcgaggagctgtgtgtctgaacaaaaatgggagctgggccaggccggacggtggtctctgggcaggtcccgcggtgctcagatgccctggtcacaggtgccgggaacgggagaagcagcagcattggatgtggtggtggcagtggctctggagaaggacctgggtgggaggtgggggtttgggtggtgacgtggtgatggcagtggctctgcgggaaggacctgggtgggaggtgggggtttgggtggtgacgtggtggtggcagtggctctggagaaggacccgggcgggaggtgggggtttgggtggtgacgtggtggtggcagtggctctgcgggaaggacccgggcgggaggtgggggtttgggtggtgacgtggtgatggcagtagctctggagaaggacctgggtgggaggtgggggtttgggtggtgacgtggtggtggcagtagctctggagaaggacctgggcgggaggtgggggtttgggtggtgacgtggtggtggcagtggctctggagaaggacctgggtgggaggtgggggtttgggtggtgacgtggtggtggcagtggctctggagaaggacctgggtgggaggtgggggtttgggtggtgacgtggtggtggcagtagctctggagaaggacctgggtgggaggtgggggtttgggtggtgacatggtgatggcagtggcgccgagggaaggacccgggcgggaggtgggggtttgggtggtgacgtggtggtggcagtggctctggagaaggacctgggcgggaggtgggggtttgggtggttacatggtggtggcagtggctctgggagaaggacctgggtgggaggtgggggtttgggtggtgacatggtgatggcagtggctccgagggaaggacccgggcgggaggtgggggtttgggtggtgacatggtggtggcagtggctctggagaaggacctgggcaggacatgggggtttgggtggtgatgtggtggtggcagtggctccaggagaaggacctgggtgggaggtgggggtttgggtggtgacgtggtgtcggcagtggctctgggagaaggacctgggtgggaggtgggggtttgggtggtgaccccctgtggggtgacccctcacgtgtgtcccaccctgcacccgcctggctggcactcacgtctgtccacctccacccacagggcaccgcgtccgtgctgcagcgccggtcccccaatgaggagtacgtggaggtggggcgcctgggaccctctgactacttcggtgagtccagtgggcgtcccctccctcgcacggctgtggccatctcatttggggtctcgggaggggcctggaggtgaggagctgctggggggcttccctggggccttgtagtggggcttggctgagccccagtgtggctgcaacagaaggctcagtcctgttcccccaaattgaagtcccagggccaggtctgggtccccaggagcaacgagccctggacgtggggtcccccagagggcatgaccttgggggaggcagcctcctgcttctgggatgagggggcacagtgtagccatcagccaccagcattcctgcagctgggggtgggtgggcttgagggaggcccaggcctacctgggtgcacctgggcattcctgcagctgggggtctgggtcctgagggaggcctgggcacacctgggcattcctgcagctgggggtctgggtcctgagggaggcctgggcacacctgggcattcctgcagctgggggtctgggtcctaagggaggcctgggcacacctgggcattcctgcaggattgcccaaaaaagtgcaggacaatggctagctgaacgtgaatttcagataataaacaattcattagcataagtatatcccaaatagttctcgggctatacttatgctacaagtttgtttgaaattcacgtgtgcctggcacatcctatccttaaaagggagccgcttccagggtcctggacataatctttccctgctgcagcctcaggacccccaggcccagccctgacctctctcttcaacccccaggggagattgcactgctgctgaaccggccccgggcggccactgtcgtggcccgggggcccctcaagtgtgtgaagctggaccggccccgcttcgagcgtgtgctggggccctgctctgagatcctcaagaggaacattcagcgttacaacagcttcatctccctcaccgtctgagcacagctcccgccctgcagccccagctccccagtgtggtggccgtgccctgctcgtctgtgtcgggggcccgggagccgctgtgtgaggtgtgggccgggtggggctgggtcccggcagcgtgaggactgccccttccccggactcactttttggaataaatgatcaccttgtgcatttccaaatcaaaggacaagcggacaaaatgcatcccaagatcaaggaagggacaggccagcttcctccccacacgcctccccggctgcctctgtgggcttctcctggggggcccaccccacccctgccagtctcctggagatgcttgaggatcggtcctccccagaaccaggccaggacgttgcccctggggcctggtgaccctgtgaggtcaggtcccccagattgaggtctgagtgtgggcaagtgtgtcaaaaggggctgccccccaggggagatgaggctgagagcagggagttgaggccgaagaagtcaaggcccctcccgcaaatgtgtacccctgcccgcgccactgcaccccgccgcacccccacctcccccgggggccctgctgcggatgccggagtgggagagtctctgagctgtgagattgatcttgcccctaattggagaggaagccgggcgccaagacacacggggctcctgccttgggagccagggccgcggccgcaggtagaccccagtagggggggccgggctcgaagttcctttgggaggggctggcgggactccagcaggccgtcctcacctttcttagaaagtccacccagggcaagttgatgttgggggaaagcagaagtcaagccagccgcgggccccacacgccccgacccgctcaaccgacttgtcccttaaatgtgtcttggatcccgcagtgatgacgtgagccagccaggcccgaaagggtgaggccagtgcagagaagcttcccaggggattcctgggttcccccgaaagacaagcgaggtcattgcagttcacctgatgttgctcctgtcccgtgcgtcccggggaggctgtccttggtccgaggctgctcgttgcagcccctcccctgctggcggttacgatgcgtggggtccccctccccacccagccccggccacgtcgccgtgtcccgcctgtgcctgtgacgtccctgtggacctgtgagccatccccccccttatctctgctctgaatactgcatgaagcattaaacgtgcaatgaagtac

SEQ ID NO: 755 - DNA, 17926 bp, Homo sapiens
ctgcgcggaacacccatcctcctgggtcctaggctgggacccgggctgtccgccagggctgggagacactggaggaggccggccgatgattacgcgcgatgccaacgacgactgccctacggtggaccgcggctgcccgtgtgcggaggaaagggagaggcggctgggtgctggctgcgctgcggtccgtgagccaggacggagtcccaggctgtacagtgatgggcggagagactcgcagtcctgagaagtattatgggctgtactgggagatttggagagggtggaggaggggcggtctgagggattccgggcggcaccgctaaggcgatgccgcgagcagcatccgcgccctctccttcccgccccagcccgggtttgttcagtcagggctccagcccggcggccgggaggaagaaaaggaagagggaaggagcctttacctggctctgacgcgacgggtcccaggcccccggttccgcttcccactcagagctctcctcccctctcttccccgccacccgtttctacgcagatcggtgccccagtccctggaggagcctccgccgcctccgccaactccgcaggaccccgccgggaagtagagcccacccctttaccaatcaccgcccgttttctatcgaccgatggggcccatagccaataggaagagctgataccgagaggcccggaatgagggggaggagctggcaaaacttggaggtgtgactagcactgccgaggcgtggtcacagattaagctccaccccgggttgttgaaccccgaagtagaactgatgggcgggattaaggtggaaccgacgaccaaacacaaactcttgagctaaggcatggccaattgggccggggtagagaggaggggtgttgcggggaattttaaccaataaagagtagaggccggtggagactgtagtccctcttccaataagaagcgggaagggcgtgtcttgccactttcactagggctaaggcagggtttgccgaaacctcccgaagccggccaatgagatcggaggcggagccaagctcagccgaccagaaagccgaattgatctcagcaccgttactggggcggtgcctacggtcttcaagccactaagctctcgtgaggggaggccccggagccttccaatgagggactggggctaactctagttcttccaatcggtgcgcggcgctggcaattcaaactgataccgggttggagaggcaggaaaagcggaagagggagcgaaaaccaacgtgttcggtgacagaccccagcgccgactgagcctctaaagcgacttcagctctgccccaccaacaccaccgcgcgcccgggaacagccgctccgggaagaaacctgaggggactgcggggggcacgagggacagctgagggaagggaggacgcgagagaaacagcgcaagcacgctgagggccgggggttgccaggagaggggcccgcggacccgcagagcggaggaaggtccgggagaaaaggggcgggacggaggagaatccgggatcgcctggcagaaaaagagaagggagtttctgaatcctgggaagaggaggcgtgggtagggatgcttagcccgagatccgacagcagggaaccggagcgctccgggggaggggcttaatgctggggaagggatgtcttaaaagaggagaagctttaaattagacgatcggagaaggctgagggaattgctatgaaggggcgggagctgaagtgtagaggactcctttagacagcagaaagggaaagccgttgagaagttcccttcaaactccacctgcctcctctccaattcaaactccactcccttctccaaaagttaaaaggaaagccaagtttgccacgctcccctgttcctactcaataaatacttcttctactccgccaccgggaaaacagaaaaaaaaaactaatttccttcccaatattaggacttagaaaagctctaggtcccgcaacttgaattttagcctaggggaatcaaaatagtaggagcattactcttgtttcctttttcaaaatcccacacctcatccttcctgcgacgccatgtctaccaacatttgtagtttcaaggacaggtgcgtgtccatcctgtgttgcaaattctgtaaacaagtgctcagctctaggggaatgaaggctgttttgctggctgatactgaaatagaccttttctctacagacatccctcctaccaagtaagtcatgctagtggcgggcaacggtagcttttaactaaatgggaacacttatggcttggatctgtgggagtcaacaaggaggttatcatttcggtgtttcagccactcccaccagtttgatgatccccttggaatatatctaagtgggcagactgtctggacaaagtctgtggtttagccaaggtggtcagtcctgatgtaatgcttctagttcaattgcagtcatgcgaccacacatctcttaagtttgatccctggttcagtgccctgcccaaccatcctatttcactgaatcaagtccgtggcgtagactttaggtaaattcaggcaaaattttctgtactgttggagaggagaggtcatttaagtttttcatttttatccatgaaattttgcaccaaaaaaaaaaaaatccgttttctatcattatttgcaattggcatcctaaatcagatccgttgttcatcaaattcagttttctttcctcaaaactctctctctctgaaagagatgtaaatagatttttatgggatgaaaaatagagacttagccttaatccttatctccaataaagactattttggacattacacatttgttcccataattgaacccttttaaaatctgtttgttttcagccactaactgcttttgggtgtagagtccttaagaatttgcttcctatttggtaaaatagccattttattttactcaaataaacctctttctagctctaaatggtactttccctttccataatcaacatatatatgccctacatgaatcttcaaaatttagttatttattgaaattttattattaaaaggaaagtaattatccaaaatatgagtggacagttattctctaagtctttggatatagagccagaggaagcaggttaataaccacaattcattttaaatgaatttcatgataatgatagaaactttacaagttttttgatttacccaggtaaagctgtgtactcttcctttcttgaaatcttttctgaattggtctaagtgtaatcatgtctaacagcaaagccaaaggctctcatttattgcagagataaatgtgttattttaaaatctttttaatttttttaaattctaagttaatattttacatttgtgtgtgtgtacatcgtatatgtatttcaaaaaagggaaaacactagaaaataaatcatagaacctactgttacaaagttctgtgattcattgtccactgctttttctttttagtagctcatacacaaatctaaaatattaacccattcatctttgcaatagctatggtaagtaatagggcagtcataaggaaggctaggtgaattgttacaggttagacccaagtctagaatagaatcatgtttttcctattttctacccttctttgtaggggttaaaataataatgaattagcgtgctaagatgtatgtgaatcaatgaacacataaaaatttttttaatggaaaatttgtcagatgtttatgttgagctcacaaatatgaactgactctttaaaaatatactatagttctatgttagctttcagctctttggattgacaaaatttgtgctaaatcaagcgtagaattactatctgatccagcagttctgggtacatatccaaaagaattcaaaactggatcttggaagagatatttgcacacccatgttcattaacagcattattcacaatagccaagaggtggaagcaatccaaatgtccattgattctacagatgaacagataaacaaaatgtggtatagggcgcctatagttccacctactcaggaaactctggtaggagggtcacttaaacccaggagattcattacacagcaatgtgattatatttaacacatctgctctgcacacataaaacttgttaagttggtaaattttgttaattttttgccacaattaaattttttgtaaagtacatctgactgtctttttatacctttctctctccagcgcagtggacttcactggaagatgctatttcaccaaaatctgcaaatgtaaactgaaggacatcgcatgtttaaaatggtaatttgtggcactattctggatagctctgggtttggaagatggatattgacaccaaagcatagagaaaggttcagtgggctgcaacaaggactggtataaagcatgcaatgagccattgaaaaattacttattacttagagctattttttaaaagggttttctgatgcttcacattagtatataattttacagttttcaaagtgtattcacagtatccgcttcaattttcagaacaaggcaatgtaggttaggggggagaaacacctggatttacaataataaaaaccatgtttgaggtctgaccctacccttactctctatgtgatcttgagtgaactcctttagcctctaaactgctgaacctctgttttcttatttaatttctaggttattactcctttctttgtttttagaggggtctcatactgttgctcaggctggagtgcagtggcatgatcatagctcactgtagccttgaactcctgggctcaagtgattctcctacctcagcctcctgagtagctgggactacaggcaggcaccaccaggcctggctaagttttttatttttgtagcaatagggtcttgctctgttgcccaggctgatctcaaactcctggcctcaagtgatcctctctcctcagcttcccaaaaggctgggattacaggtatgagccactgcatcctaccttaatttctttctttctttctttttttgagaaggagtttttgctcttgttgccaaggctggagtgcaatggcgcgatctaagctcaccacaacctccacctcccaggttcaagtgattctcctgcctcagcctcctgagtagctgggattacatgcacgcaccaccatgcccagctaattttttttttttttttttttagtagagacaggatttctccatgttggtcaggctgctcttgaactcccaacctcaggtgatccgcctgcctcggcctgccaaagtgctgggattacaggcatgagccaccccacccagccattctgtcttattaagatagaaatttaataatcttctgtgtttaccttatcaagttattataaagagcaaatatgaatgttaaagtgctcaataaactataaattacaacagctgagagctattactataatcttttgagaagtagacgtgttattattttcattttaggaggataaaagttgaaattttctcatttagatggggtttgtatttagaaggggtttgtattataaatgacaatcctaataatttaaattggcaagctcttcttatgtgctatttgatttcattcctttatttaagctatacttgtattgaggaactagtatgtggtagtcattgttacaagggctggaaatacaacaaaaactagatgaagtcactggcctttggacattattttcttctttcttctttttttttttttttttaagacggagttttgctctgtcgcccaggctagagtgcagtggcacgatctcagcttactgcaacctccgcctcccaggttcaagcgaatctcctgcctcagcctcctgagtagctgagactacaggcacgcaccaccatgcccagctaatttttcatattttagtagagacagggtttcaccgtgttgcccaggctgctctcaaactcctgagctcaggcagaccacctgccttggcctccctaagtgctaggattacaggcgtgagccaccgcacccagcccacacggctaatttttgtatttttagtagagacgggatttcgccatgttagccaggctggtctcaaactcctgacctcaagtaatccacctgcctcggcctcccaaagtgtgagattacaggtgtgagccaccgcacctgggcaacgacattttttttgttttgttttgagacggagtcttgctctgttgcccaggctggagtgcaatggcatgatcttggctcactgcaacctccgtcttctgggttcaagtgattctctcacctctgcctcccgagtagctgggactacaggcacgtgccaccatgcccagttaattttcgtatttttagtagaggtggggtttcgccatgttggccaggctggtctcgaactcctgacctcaagtgatccacccgcctcagcctcccaaagtgctgggattacaggcatgagccaccgcacccgaagaacaacattttcaaaagaaaaccaaaacaggaaagttaattttaatcatatattttgtctaacccaatgtatccaaaatattatttcaacatgtaaccaacataaactactaatgtaatattttatattccattttttggtcttactctttgaaatctggtgtacattttacacttaacagcacatctcaattcaggccagccccactgcaagtgtacaacagccacatgtggctagtggctattattcttgacagcatagatctggaccttggtatggaaaggtttttattttcatttttggctattgaagaggttttaaccagggagcagaatgatctgatgtagcctcgctagactgttagctctgtgagaacaagggctttgttttgtttaccagtgtattcctagcacctagagcagtgcctgaaagatagcagatactcaataaatgttagtttaagtgatgaatcaatggatgaatgaatgaatataggcggtaattaaagtcatggaatttacttttgcaatatagtcttacaaataactggcactcctagtccaaacacaacttttgttttcatttgtttgcctttcaagcaagttataattagaagacatattttaggtggaatggtaccttttacagtaatctttattgggtctcataaaaatgactgactcacaaatctcacagagtaagactaagcttgaataagaatttttacaactcaaggtataaacagttcatgttgctattttttttaaagtactagctaaaacattccctgtaggttcactctatttaatatgtgactagctagttaaaaaaaaaaaaaaaattgtgaaagactgaggtacttataatcagctggataattctgaaaactgtaaaaacttttgcaactttctctggaggctgtagattgctttatttctgagttccttcaaaaacactgagactaaaattagagcagccagattgtatttggtttacagggactcatgctgtcttcctacctctccatctgttgaaacagtttttaggtgctggcatgaaactagaacatgtaagaacccaacttgccacagtcctgggatagcaaaaacctttacccacagaactgagttaatttaatttattttgtctgtacagcacatcaatttgggtggtttataaaacaaatcacaacattatggcatctagaagctaacttctgaagggagaatgcataaaataatactagcaggacaagcatggtggctcatgcctgtaatcccagcactttgggaggccaaggcaggtggatcacctgaggtcaggagttcgagaccagcctggccaacatggtaaaaccgcatctctactaataacacaaaagttagctgggcatggtggcacacgcctgtaatcccagctattctggaggctgaggcaggagaatcacttgaacctgggaggcggaggttgcaggcactccagcctgggtgacaagagcaaaactcagtctcaataataataataataataataataataataataataatagcaaagaaatgtgagaatattttactattattcacttaaagactgctttcccacttgatggtagaactgcacccccatcccatcccaaagatctcagcaatgaaagttgttaggaaatgagatctaaattatatggtctatttatataagcaatatgaaaagacttatctggctagttattacatggtatctagtaacatttactttcttttctagtgggaacattgtaggttatcatgtgattgttccatgtagttcctgtcttccttcctgcaacaacggacacttctggatgtttcacagccaggcagtttatgatattaacagactagactccacaggtaagaaacaattgacttggacattcctgtaacatttctctatcaatacctgagtaaaattcccaatagatcatttcaggattccttttagatcttcttagctggattagctagagtgaaacttcaattcttttttcccagacattcacttatgaaaactattaggcaaaattcattgtcatttctatgttcatccttgtacttaaggcctcaaacttggctgaatttcttggtcttttaaaatgaatattataattgctcttaactgctgccttgatacgtattctgactccagagaatttttgaagattttagatttgatagtctaatgcatgtgtgtgtctgtgtgtgtgtgtaagaaagggagaggccaagcctagggcaatgggagttgagaggaggaggactaagtaacctctgtatttagtgatgcttcagaataaaaacagacatttcgacatctatgttaatacgttatgacagaattttagtcaagggaaatatttgacaccaaagtataaagtatgttgtacaggcacaagtggagatattgtaggttcaattccagaccaccataataaagcaagcaaatatcacaattaaagcaagtcacacaattttttggtttcccagtgtgtataaaagttatgtttacaatatattgtagtctattaagtgtgcaatagcaggacatttaaaaaacaatgtgcataccttaatcaaaaaatacttattcggccgagagcagtggctcatgcctgtaatcccagcactttggtagtccaaggcgggaggatcacttgagcccaggagtttgagaccagcctgggcagcatgctgagacctcatctctacaaaaaaaaatacaaaaattatccaggcatcgtggggcatactatcgtcccagctacccaggaggctgaggtgggaggatcacttgaatttgggaggtagaggctgaagtgagctgtgatcatgccagtgcatttcagcctgggcaacaatatgagaccctgtctcaaaaaagaaaaaaaaatgctttattgctaaaaactgctaatgatcatctgaaccttcagcaagtcataatctttttgctggtggagggtcttgccttgatgttgatgactgcaaactgatcagggtggtggttgctggaggttaggatggctgtggcagtttcttaaaataagacaacaatgaggtttgccgcatggattgactcttcctttcacaaaagatttctctgtagcatgtgatgccatttgatagaattttacacatagtagaacctctttcaaaattggagtcaatcctctcaaattctgctactactttaccaactatgtttatgtaatattctaaatcctttgttttcatttcaacaatatttacagcatcttcatcaagagtagatttcacctcaagaaaccattttctttgctcatccataaaaagcaactcttcatccattaaagtttcatcatgagattgcagcaatgcagtcacgtcttcaggctccatttctaagtgtagttttcttgctatttctaccacatctgcagttacttcctccactgaagtctaaaacctctcaaagttacccatgagggttggaatcaacttctttcaaactcctgttaagactgatattttgacctcctcccatgaatcaggaatgtgcttttccaggttttcaatgtactttgcccagatccatcagaagaattactatctatggcagctatagccttatgaaatctatctcttaaataataagacttgaaagattaaattacttcttgatccatgggctgccaaatagatgttatgttaaggcattaaagcaatatttatctccttgtacaatgccatcagagctcttgagtgactaggtgcattgtcaatgaacagtaatgttttcaaagggatttttctgagcagtaggtcttaacaatgggcttaaaatagttagtaaaacatgctgtaaacagatttgctgtcgtccaggctttgttgtttcattgacagcgcacaggcaaagtatatttggcataattcctaagaaccctagaaatttcagaacagtaaatgagcattggattcaacttaaagtcaccagctgcattatcctctaacaagagattcagcctgtcctttgaagctttgaagccaagtattacttctcctctctagctatgaaagtcctagatggcatctccttccaatagaaggctgttttgtgtatattaaaaatctctgccagatgcagtggttcacgcctataatcccaggactttgggaggccgaggtggatggatcacctgaggtcaagagtttaagaccagcctgaccaatatagtagaactctgcctctactaaaaataaaaaattagctgggcatggtggtacatgcccagctacttgggggactgaggcagaagaatcacttgaacccaggaggtggagtttgaagtgagccgagatcgcaccattgcaccaagagtgaaactccatctgaaaaaaaaaaaaggaataagaggccgggcgcggtggctcacacctgtaatcccagcagtttgggaggccaaggcgggcagatcacctgaggttgggagttcgagaccagcctgaccaacatggagaaaccccgtctctactaaaaatacaaaattagctgggcatggtggcgcatgcctataatcccagctacttgggaggctaaggcaggagaatggcttgaacccgggaggcggaggttgcggtgagccaagatcacgccattgcactccagcctgggcaacaaaagtgaaactccatctcaaaaaaaaaaaaaaagaaaagaaaagaaaaatctgttgtttagtgtagccaccttcatccataatcttagctagattttctggataacttgctgcagcttctacatctgcactttttgcttcacctgaacttgtatgttatagaaatggcttctttccttaaactttataaaccaacctctgctagcttcaaactttcttctacagtttcctcaactttcttgcccttcatagaattgcagagagttaagacctagctctggattaggttttcgcttaagagaatatcatggctggtttaatcctctatctaggtcactaaaactttctccatatcagcaataaggctatttcacttttttattcttgttttcactggagtagcacttcttatgtcctttaagaacttttctttgcagtcacaagttggctaacaattgggcataaaaggcccaactttcagcctgtctcagctttcaatatgtcttcctcactatgcttaatcatttctagcttttgatttacagtgagagacatgccactctctttcacttgaacacttagaggtcattgtagggatattaactggcccaatttcaatattgttgtatcttaggaaatagggaggccccaggaaagagagagagaacagctggtcagtggagcagtcagaacacacaaaatatttatcgattaagtttgcagtcttaagtgggtgtggtcttaagtgggtgtggttcatagcaccctgaaacaattataacagtaacatcaaagatcacagatcaccataatatatataataataatgaaaaaggttgaaatattgagagaattatcaaaatgtaacagacacaaggtaagcatatgctgttagacttactcaatgcaggattgccaaaaccttccatttatataaagcccagtatctatggtgtacaataaactaaagcacaattgaggtatgcctatactaattattttagcaaggccaggcatggtggctcacacctgtaatcccacactttgggaggccaagacagatgatcacttgaggtcaggggttcgagaccagcctggccaatatgatgaaaccccccttgaacctaggaggtggaggttgcagtaagccgaggtggcaccgctgcactccagcctgggcaacagagtgagaccctgtctcaaaaaaaaaaaaaaaaaattattttagtaagaaagtacactaccaattcttttaaaaaaaaaatttctttttccttgtgttaaggtgctgaggcactgaaatactaattctttttttttttttttgagacagagtttcactcttgtttcccaggctgatgtgcaatggtgtcatcttggctcatggcagcctctgcctcccgggttcaagcgattctcgtgcctcagcctcccgagtagcgagattacaggcatacgcccagctaatttttttgtatttttagtagagacagggtttcaccatgttggtcaggctggtcttgaacacctgacctcaggggatccgcctgcctcagcctcccaaagtgctgggattacatgggattacagacgtgagtcaccatgcctggcctgaagtaccttttttttttttttttttttttgagatggagtcattctgtcacccaggctggagagcagtggcgtgatctcggctcaccgcaacctccacctcccgggttcaagtgattctcctgcctcagccttctgagtggctgggattataggtgtgcaccactacacctggctaatttttgtatttttagtagggacggggttttgccatgttgcccaggctggtctcgacctcctgacctcaggtgatctgcccacctcagcctcccaaagtgctgggattacaggtgtgagccactgcaccggccaaagtaccaatttttaaaggggatttatataatactttttatattgcctggagccattgagttttgttataagacacatgttctccatgtctaacatctatttacacaacagaccaagttgattttaaggaactttttttttttttttggagacagggtcttgctctgtcacccaggctggagtgtagtggcacaatcttggctcactgcagcctcgacctcccaggctcaagccattcttccacctcagccttctcaataggtgggaccacaggtgtgtgccaccatccctgtctaattttttgtatttttcgtagagaccagtttttgccattttgcccaggctggtctcgaactcctgtcctcaagtgatctgcccaccttggcctccaaagggctgggattacaggcctgagacacctcgccagccgactttaagtaacttgacaatctaagttgacactagcattcttaggttcctaaatgcatgttttagtctcctttagaacttaaatgtattttttaaatatatgatttgccttcacagaccaaaagatcacgaattgcaagataggttgtcaagggtctttaaatcctccaattatgtttagatttttgtagatttgatttttttatctgggactcaactgtggctctcaatctatcatttatggggtcttaatttaaaactttggtatgttaagaaggccattttcatgtaaggacttatctgaactcccctaagtgggatacagtctcctaatttaagcctccagttttatatttgtgttgcccatgggacacattaaaggaagtttctgctttgatagtatttttcctgctttacagaattcaaaacacagggtggagatttttcaagtttgatttactttttaatattggtcaatttttcaaagataaaagccccacattcttccatttgcactgaatctaatccataagaaacagatgtatcacaggatttccttcctcccttcttaacagagaaaggaaggtgctgcttctgtcagatccaatctcttagtttatttttcctcctttgaaccaattgtgctgagctgcttcatgtctctgagtactgactccaagaatatcaagcttctgctttgtaaccctaatattgtgatttcaagcaagattttctagatgcttggtatcaaagcaagtttctaatggcgccacaactgtccttgaatcacctgaaccagcagtgtcaaaggaatgcatagacaagctttataaattctataatgtttaaactgaaaaggactcctggaggtctgttttctaggctagtcttcatttagagacctgatttcccagaactttctggaggagccttgggaaacctcagctcaaatttcctgaaattggcaaatgccctcagagtcaaaatggcttcagccctccatttacatttatgggttctaattttcactttgatttttgcctcgcaattccttacagctcttcctgtcagctcttccatgacatttacctggagcagaacaccattcattcttagggtgggggtggggatggggtagcgttttctattataaacaattcaaacacaaaaagattatagaaaataataagatacacatctgtatccctaccagcatcagatacatgctaaattcttgccagattagattccagtatctccctcagtcaaggtaaacagttaattatttctactgtttcaacaatgtcacactacacatccctgtgtatgtcgccttgaaccacctatgcaagatgggcagctgaggaagggatgagcaatgggctgtatttgcaacatttttaaaaattcacaaaatggaatactctccagaagtaaaaataaatgagcgaaatctacacaagttaacatggattaacctcaaaaacatgacgagtgaaaaagcaaattagaaaacaatatgtagtgtaataacattctatacaaaatttaaatccactaaacagtaatatatattgtctatgttgcatgcatttgtagtaaaaccatgcatggtgtactagcagtggtgaacactggattcaaaccaaatctccaaatcctggctcattccattccgccatgtggctgctatctcagtgtatatggggtgggtatcctgaattgctggatcctctttgtgtccacactgataactggacagcttaagatttgtttttctggccaagtgtggtggctcacatctgtaatcccagcactttgggaggccgaggcgagggggatcacctgaggtcaggagttcaagaccaccctgaccaacgtggtgaaaccccatctctactaaaaatacaaaaattacccaggcatggtggcatttgcctgtagtcccagctactcgggaggctgaggcatgagaatcacttgaacctgggaggcagaggttgcagtgagccaagattacaccactcgtctccagcctgggcaatagagcgagactccgactcaaaaagaaaaaaaaaaagatttgcttttcttgtgaagttaattggctatcctagaggtcagttattttccatttagtgtttttaactaataatgtaatatatgcccagagtaataaacttgtcattatcctctactgtatgtttagtcatttactgtatacctgtgcttcattcttcaatatgaaatctgactattctttctcagtgaagtttttgattattcttttgtttattatagtgactgctgcaacctggccctaaagttcagtttaaagctctgcctgtggactgaaacccactggtaccaaggattgcagttcatattataactgtctccgaacccttgctttttttctgaatcagaaaaatggcaccagctacttctctgcttattgaagggatgaggaggcttattcaggacttctccctgaaccctccaaagaggcatttaatctaaaaggatcttgtgagatctccattcttaaacatcattaaaatagatcagaaaattatcagtgtatagtgattatgttataatgcagctggaggcagagtttgagtaaatggactcctgagagccttttgagctgtaaaattctagaattcaagcccttgcttaaaaggatttaaagaatgtttatgtcctagccctttaaaaaaaagtgtttgccaggcatggtggctcatgcctgtaatcccaacagtttgggaggtcaaggagagaggattgcttgagcccaggagtttgagactagcctgggcaacatagtgggaacctgtatctacaaaataaaattagccatgtgtggtagtacacgcctgtagtccaagtgacttgggaggctgaggtaggaggatcacttgagccctggaggttcaggctgcagtgatctgtgattgtgaaccgtgatcctgccaggcactccagcctgggcaacacagagagaatttctctcaaaataaataaataaaatttatgtcctagatggataatattaggtaattttatttgcagtacattcttcaatagctactctttttactgctaacactatggtttacataagaatattaacatataaagtttcgtaatttgtgttctgagttataacagtagtaagcattaaagaattttatgattttttattttcaggtgtaaacatcctactttggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctcagtttgattgaagccagtggagttgtgcttttcctctacttctacttcctctcccccacctttttctgcccagtgtaggtgtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaactgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtagtctgtcctaaatcttaaatagaaaaaaaactaaagcgatttgcttaagccattgtacattataaagagctgttttgttttgctttgctttgctttgttttgtttttttaaagctgcattcagagccacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaccattcttcctttaattttttgttatgcccacatattgtatgtaaaaatataaataaatagtacttaaagtata

SEQ ID NO: 756 - DNA, 30418 bp, Homo sapiens
gcgagtctccgttaagaaggtgccgcggcggcgccggaggtaggaggagccgggctgtggggctgggagtcggcacccgggaggcggaggtcctgtcatttcgggccgttctctctttcctaagggagaagagcctttctcgcccgtctccctcgctggctccgtggcctcggcaggcccgcagccccgacggagaggcaggagccgcactcgggtggagaggggccggggcccgcctggagggaggagggtggcggatccggatccccacggtggtctccgtccgggccagtccggggatcggggttctccgtctgactttagagccgttagagtctttggcagcccttttcccagacggggaacccctcagcccctttccgtaggtcgccgggttgggggaagcgggagggtccgccccttaccgatccattcattcatccctcgcctgctgtgagccgtgggctgcggtaggtacgaagcaaggaggcacaagtccccttccctctggaaacctgcaggcttgcaggatccgttatgtcattcagtaaatcttgactgggcacctataggaggagatagactgttgtgaggttcatatcaacagagatgcggagatcaacacagttgtggaggtggaatttgttccagccgctccccgcatccaacaggataaaattcactttgcctagcctgaccttccaggcccttgtgagccaatcctttcctctccccgcagcgttttctcctacacctttctctctactcccattataccgaactctttgcaattcatgaattcaacaagtagttgtggagcacttatttcaagtcaggcaccagatcagccaaagaggttgcaaagtaatagatggatctctaccctcctgaagtgttgagcttaatgggggacagataataagccgatgaataaaaacacaagagcggatagtttcgaaccacacttcctgggtttgatcccagccctgccactgtgaaagctgttcctgaactggctttaggccagttcctcattctgcttgcgcgtgtttccttgccgtaaagacaggatgacaagagattccaccatataggcttcttgtaaggattaaacgagtttgacttggaaagcaattggaacagtgcttggcacacagtaagcattcgatagatattacctgtttcatatgatgataacctatgacagatgccattgtgaaaacagtgggcgatgatagggattaacggggatggagacggtccataaaggattagaggacacttctctaaggggaagacacagaagagaatgcgccagccatacaaagtagattctaggtaggagtattttcagctctggaaaacaaaatgattaattagattccttggacagtggagattgcattattgtatttgaaaggaataactttctgccattgggtcattcagttttgatttttgaaccccacttagctgtgtgccaaagtaaacaaccatgctcacgaggcccagcctttgcacacaggcgacattccagtcatccaggtttggagagccttgctgggttgagaagataagtaaaagtgaccttttctctcctgagtgttcatgagaatataatgtctctttctgtctcttatgttgcagtatttacagaaagagcctctttaacagccaggggtcttagatcagtgtaggagatagttttcctagatttggggatcatcctgtttctgtggtgactgccttttatggggtttgctccctaaatttcagttaagaaaacactctcccaagatgcacatattttaatacctgtggaagaacaacatgctttgacaggtttctaggtccttttgttgtgatgtctgataggacggttagaccatgttaaccaggctggactgagtatttgacagtattgttactccgaagacttttccctcaccccacatgcccttgtccctccctggaagaactggcataaaatgacaatgtctgattacacttacatgcttttggttttccacagatgtgtaattaagtgaaccatatatgtttcatcatcatggagatcttggagaattatctgagcaccaggttcatatgtattcgatctcagaggcatctattggacaacaaaacactctttcagttgtgaactttatttatttattattattattttttgagacagagttttgctcttgttgcccaggttagagtgcagtggcacgatctcggctcactgcaatctccgcctcccaggttcaagcgattctcttgcctctgcctcccgagtagctgggattacaggcatctgctaccacgcctggccaattttttgtattttcagttgaaacgaggtttcaccatattggccaggctggtctcgaacttctgacctcaggtgatccaccccccgcctcgtcctccaaaagagctgggattacaagtgtgagccaccgcgcccggcccagttgtggactttaacagagggaagctttaaacatgtttaaccacaggcccaatttgaacaaagatacttcaatcattatagagaggaaaacagtactttttgttcaattgtgcaaactctccaagtatctaatggagaagtagagaagaaccctaatgaaactgagtgtgaatgaggctcagctaggcttctacttgggttcactttctcatctgtctgcctgtcctgggattgaccctcgctcctctgaagaccagcctgaaagccttaaaactggtcagatgatggatgagtctgatgaggactttaaagaactctgcgctagctttttccaaagggtgaaaaaacatggaatcaaggaagtgtcaggagaaaggaagacacaaaaggctgcctcaaacggcactcagataagaagcaaattgaaaaggaccaaacaaactgctaccaagaccaaaacccttcaaggccctgcagagaagaaacctccgtctggcagccaggcccctaggactaaaaagcaaagggtaaccaaatggcaagcaagtgaaccggcccactctgtgaatggggaggggggtgtgcttgcctctgctccagatccacctgtgctccgggaaacagcacaaaacacccagacgggtaaccagcaagaaccatcgccaaacctttccagagagaaaaccagaggtaatttgtactcttttaaaccaggggctggaaaacttcctggaaagggccagatcgtaaatattttggctttgtaggccacacagactctgtcacaactactcaactctgctgtcatagtgagaaagcaggcgtggacaatatgtaaatgaacaggcatggccatatgccagtaaaactttatttacaaaaacaggcagccagccacatgaccgtagtttgctaacttttggtttgtttttattttttaatttttaagcttaaaaaaaaatttagagctggaggtctcactatgttgcccaggctggtcttgaactcctggactcaagcaatcctcgtgcctcagcctctcagagtgctgggattacaggcgtaagccactgcgcccggctgactcctggtttaaacaacagtcaagaaaaacataacccgtgtgaatttttcacatgattgtgtttggagtcctctgctctttcagaatttcctatgaaattctgttatatgattgacatgagttacacaaacaacacaataatgctgcttctcttgttttcttgaatttattccaaagtgggtaagttggactgggccagccaatttggataggctgctgagagggccgcatgaggactctgtgtgggctcaagtcccaggagaatcttcaggttctttctttctctctctgaagaccttttaatcttttcctttgttattgttattgatttatttacttacttagtttttagagacaggatcttggtctctcacccaggctggagtgcagtggtgctatcatagcttactgcagccttgacctcccaggttcaagcagtcctccctgcctcagcctcccgagtagctgggaccacaggcacccaccaccgtgcctggataattttttaactgtttaaagcagttttcttgccctgctgcccttggtatactgagctatatgcttactacacattcttcatgcaaaactgaaaactacccttgcatatataatacaccatgggctctctgagctcctgagttctgtttctaaatttcctttgccctcacttcctgatcttaataacctctcagtagagtggtggtagagtctcaggtcgcatagactactggaaggcatcagcagtgttgcctcaccaactttactggtctctcgtgctctttgccagtcggatgaaatctatgcatggttcccccaaaacacgtatccatgcgcgtatctgcaaaactggcacacaacttcatggggttcatggatccccactgaagatcatccgtggatcccaagttaaagaagaactgatctaggacataaacctttgtcattaatatttctttaataatagctttattggggtataattgatattccataaaattcaccatttaaaagggtatggttcagtggtttttagtatattcacagacttgtccaaccaccaccactacctaacgttagaacagttttatcatcctaaaaataaaccccatgctcattagcagtcacatcccattcccctcctgttattgatatttatgtctatattgccataaacaaagaggttaccaacaagcaaccagtcctcttcacatttgtgagtcaaacctaaactagttgataaaggactcttgaaacttgcgtctaacctgtatctggtagaaaagtcttttatttctccagctacaacagatggttgtgaatattttcctccttgccagagaatgtgcccaacagcgactcccagcctcctccttcctgtttgacaacagcagtgccaagtccctccaaaccccgcacagcacaattggtcctacagcgaatgcagcagttcaagagagcagaccccgagcgtttgagacacgcttcagaagagtgctccctcgaggctgcgcgggaagaaaatgtcccaaaggatcctcaagaggagatgatggcggggaatggtatgatgagtgtgtttctgtcttccacacagagataagttaatacaactctgaggaagggaggcgggaaggaatcagcatttgttgagtttcttctgtggataggctctctgcttgatgttttacctttgccacttcactggatccagccagagaatgaagagtctctgggatcatttcccacctagcttccttgataaggtaccgttttgtttttttttctgagacagagccttgctctgtcacccaggctggagtgcagtgacatgatctcagctcactgcaacctccgcctcccaggttcaagcaattatcttgccccagccagtgggattacagacgtgtgccaccacacctggccaatttttgtatttttagtagagacagggtttcgccaagttggccaggctggtctcgaactcctgacctcaagtgatctgcctacctcagctccccaaagtgctgggattacaggcgtgaaccattgcacctggccctcttccttttttttttttttttttttttttgagatggagtctcgctccgtcacccaggctggagtgcagtggcacgatattagctcactgcaagctccacctcccaggttcacgccattctcctgcctcagcctcccgagtagctgggactacaggctcccaccaccacgcctggctaattttttgtatttttagtagagacaaggtttcaccttgttagccaggatggtctcgatctcctgacctcgtgatccacccgccttggcctcccaaagtgctgggattacaggcgtgagccactgtgcctggcctcctttttttaaaaattatgactttttattatgaaagctttccctttcagttttttccttttaaaaagataaccctcagtattcacaaagaactcttcctttcagaaaaggtttttttgttgttgttgttttaattacaatgaagccaggcatgatggctcatgcctataatcccaaaactttgggaggccaaggcaggaggactacttgaggtcacaagttcgagaccagcctggacaacatagtgagacccccatctctacaaaaaaattttaggggccaggcgtggtggctcacgcctgtaatgccagcactttgggaggccgaggtgcgcagatcacaaggtcaggagattgagaccatcctggctaacacagtgaaaccccatctctatgaaaaatacaaaaaattagcaaggtatggtggtgggtgcctgtagtcccagctactcgggaggctgaggcaggagaatggcgtgaacctgggagacagagcttgcagtgagccgagattgcaccactgcactccagcctgggcaacagagcaagactctgactcaaaaaaaaatttttttttaattagctgggcatgatggtgcacaactgtagtcccagctactcgggaggctgaggtgggaggattgcttgagcccaggacgttgagctgcagtgagctgtgattgcatcattgcactccagggcaacagagtgagaccctgtctcaaaaaaaaaaaaaaaaaaattacaatgaatcccctaatcccctatacctcaatctagatttaacaaatgttaacatttggccatttgtttatgtctttataaatatacatttttttttttttttgagatggagtcttggtctgtctcccaggttggggtgcagtggcgcaatctcggctcactgcaaactccacctcctgggttcaagccattctcctgcctcagcttccaggaagctgggactacaggcatgcaccaccacgtccagctaatttttgtatttttagtagagttggggtttcaccatgccggccaggctgttctggaactcctgaccttgtgatctgtccacctcagtctcccaaagtgctgggattacagacgtgagccaccgtgcctagccaagcgtacatatttttcttccatattatctgaaggtaaattatagacattaggatcctttacccctagattctgctgcataaccacaataccattagcacgcttaattccataatagtgcctggcgtccagttcaaactcaaatttccctggttgtctcaaggttattttttgtagctggtttcttttttttctgaacaaggattcagtaagttcacacactgcatattgctgtagctcagcagtatcctaaggtctagattctagaatagtcccccatttccttttgttttccatgacactgactttttttttttttttttttgacagaggcttggctagagtgcagtggcacaatctcggttcactgcaacctctgcctcccaggttcaagctattctcgtgcctcggcctcctgagtagctgggattacaagcacccaccaccacacccggctaatttttttgtatttttactagaaatggggtttcaccatgttgcccaggctggtcttgaactcctgagctcaggggatctgccctcctcagcctcccaaagtgctaggattacaggtgtgaaccaccacacccagccctatgacactgagtttttgaagaggctaggctaattgtattataagatttcccactttctggatttatttctttatgggatcgttaactccttcctctaaccattgggttgccccactctgagtagattagaggctcattggctgcaggtgagacagggtggcgacagtgccccatagctgctgtgtacttggtgtggcaccggcccaataagcgtaataatgccaggtgctcctgttctccatccccaaaacaatatggattctcatctctgatgaaaatatacaaaaggaaaagaaataggaagaaaccattatcggcagacctacagctaataagtatgcaggatcttggcattgcattgcagatttcactgcagtagcacggaggagtctcaggccaccccagggtccacagcaggcagtgatttgatgtcctgccgaggcatcagtcctggacgcacatgtgagttgcagaggaggcacccagctggtgtgagctccgcccctgcccagcatttgactcagttctctctgtatcttcacatcacacccagcaagtgctcagaaagagataaaccatttgtttgttaagaaaccaaaccaggctggacgcggtggctcacgcctgtaatcccagcactttggggaggccaaggcgggcagatcacctgaggtcaggaattcaggaccaccctggccaacatggtgaagccctgtctctactaaaaattagccaggtgtggtgggcacctgtaatcccagctactcaggaggctgaggcaggagaatcgcttggacccgggaggcagaggttgcagtgagctgagatcgcgtcgttgcactccagcctggcgacagagtgtgagactccatctcaaaaacaaacaaacaaacaaaacagggcaccaaaatgaaggtgtgctgttttgctggcctcagtggcaggcactggtaggccacagccatgaagaacttggggatttatgaggcgttcagggcatatcccttgtgagtgacaggggtctgctccagcaatatcagatgggccaccctgggagccatctcaagaccagaatcagtccattcttgagtctgatgctaagtaagagatgctgccttttaaacgccaaaggcatttcactctgccctggttttatcatgggcagtaaaaggtcagcaggaaagggtgagttttgaagagaacatctagctttgttggaatatgagccttgtgaacttgcaatgcccgaggtagccaacttcagcagaagtgggaaagtttaggtccttgctactcagagtggtcctgtgctgccagcatcgccaagcctggaggctgctagaaatgcggagagtctcaggctgcacctggaccccttgaatttgaatctgagtgtcgacaagcttcccaggtaatgcatatccatgttaaagttggagacggctgttcccggagtgctgattagtgcccagtctcactggacagtgtccaagtcaccagcctgcagagtggagctgggttctggtttctttgcgttccacctgctccccatggtctgcaggagctgacagagcagaggtctgagggtgagcttgtctttggagtttattctcacggatctttggtgcttctccacagtgtatgggcttgggccccctgccccagagagcgacgctgcggtggccttgaccctgcagcaggagtttgcacgggtaggagcatcggcacatgatgatagcctggaggaaaagggtttgttcttctgccagatttgtcaaaagaacctctcagccatgaacgtgacccgaagggaacagcatgtgaacaggtgggggcagcttgggccgtcgcctctcccgtgtatgtgaccagaatccccaagcaccccagggctggagtgcggatctccacaccttaccatgacaacagcacctcagctttgttgtcaacctacccctttttaaaaataacttcgttgagatacaattcacagaacatatagttcacccatttaaactgaacaaatcactacttttgggatattcacacagttgggcaactgtcaccacaatcacttctggattattttcatcacccccaaaagaatccccacacccattggcagccactccctattgcccctctctcccctgacaaccactaatcaacattctgtctggatggatttgccgattctgaaattgcacagttgtccttttgtgtctgccttctttgacttaatatgttgtttttgaggttcatccatgttgtagcatggagcaggcttcattcctttttatggctgagcagtatctcattgtatggctagactgtgtttttcccattcttagatgaggaatatgaccatggtttatcctttcgtccattggcggacatttggagcatttctaccctttgggattgtggatagagctgccgtgaacatgggtttcatgtatttgtttgggtacctgctttcagttctttggggtctctacttaggagtggaatttctaagtcatcatgtaactgcatttaatctttccttgctttctttagccaactttgctgacagatacctaagtgtagtgtctaggggctgactgccgggagacggagccaggctgtgtagaggggattggctttggggaacttgctttgaccacagcacgtctgtgttgacctggacccacatttgctccaatccacattcctggggagggtggttctcctgtattgactgttttccttcaggtgcttggatgaagctgaaaagacactaagaccttctgtgcctcagatccctgagtgcccgatttgtgggaaaccgtttcttaccttaaagagcagaaccagtcacttgaagcagtgtgctgtgaagatggaggttggcccccagctcctgcttcaggctgtgcggctgcagacagcacagcctgagggtagcagcagcccacccatgttcaggtaagtcgacgaaaaggaagaaaaccaagccaaataatgctgtgtgcactcagggctttttctatttaaaaaagctttttatgggctggacgcagtagttcacacctgtaatcgcagcactttgggaggccaaggtgggcagatcaccttagatcaggagttcgataccagcctggccgacatggtacaatctcgtctctactaaaaatacaaaaattagcatggtggcacatgcctgtagtcccagctacttgggaggctgaggcaggagaatcacttgaacccagaaggtagaggttgcagtgagccaagatcgtaccactgcactccagcctggacagagtgagatcctgtctccaaaaaaaaaaaaaaaaaaaaaaaaaaaaagctttttatagtgttggagggaaaaagagccctctttgattctggaaatgaaacacttagggcggaaatcgggcacagtctagaagggagtgaggaggggacagaatctgcattctggaaggctctggacctgcccctttaggggggtgcagaaatgatcttcgcactgttttcctcaaggtccttcctgagtttccaatcccatgatcccacagtcggtaccctctagtgcaggggtccccaaccccccagcctcggaccagtaccggtctgtggcctgttaggaacctggccacacagcaggaggtgagcagcgggcaggcaagctttactgcctgagctccgcctcctgtcagatcagtggtggcattagactcacaggaacacaaaccctgttgtgagccgcacatgcatggaatctaggttgagctctccttatgaaaatctaaagcctgatgatctgaggtggaatgctttgatgctgaaaccattcccctactcctgtcccatggaaaaattgtcttccatgaaaccagttcctggtaccaaaaaggttggggactactgctttaccacatctaagaatttggtagtcactttactccatccatttcgttgttggacagcatggtttccacctcagcacagtccagttttcacactgttaacataagattactcagcacagttcacagatttggtgattggccaggcacggtagcttacacctgtaatctcaatactttgggaggccagggcggaaggatcacttgagcccaggagttcaaggccagcctggactacatagcaagacccatcactacaaaaaattaaaaaattagctggctgtggtgctgcacacctgtagtcccagctacgtgggaggctgaggcggaaggatcacttgagcctgggaggccaaggttgcaatgagctgtgattgcaccactgcactccagcctgggcgacagggcaagaacctgtcttcataaaacaaacaaaaacaacaacaaagttggtgcaacagaagtgtaggaccctattttttaaaaatcttgcatgaattaatgcttaaaagttaaaatgagttgccttgctcacagccaggaaacaagtcctcagcatgcaaaccacagccacacaagtgccagagggctggccctgctccacgctgccctgctgctgaggacgctagagctgacaccaggttcatagtgaacaaaggcatcttggacctttgactcctccaggtttgagaccgctgtcaggagcaaagggaaggccaaaggcgatagctgtttgtcccgccccctgctttgcacacaggtcatgggcagctgagctggctcggggctgagatggcagagggcagaggggattctcttggtggaggagcgcatctgtatttagcatggcaggggtgcaagccttgaggccttagaatagacgtcatctaagccattgtttctttcttggcaggaccacgccaaaagcacctgctcagataaagtatgtctgcctttagaatacctccaagtactgaaactagatgtatgtggatccgtttagaaggttgtcagagtagaaaactacaggagctggatgccctcatggggtctttgaacccctccctccccaaaggccaagcctgtggtcatcagaacgcatgccccggccagagtgcctcatattctttccccacagcccaaacctggcctgctggggagtgaggagggaacacagtctgtgttcccttcacagaagcagggtcccaggctgcccaggcagctcctttccctctgggaggctgtgattatccacgttcctgggaaggtgaacttgagccatccctggcaccctggagagcatgagcttttgcaaaagccagaggcatgactgcattgcagggaaggtgggcccggtttgtgctaagttcctttgtcacctctgccctcctccttcttgcccagcttattgggagtcacccaggcagcctaggttctctccagccggaaactcctgttcatttcctccaaaccaaacgagctgctgcccgttgaaagtgcagagtcccggggcggctggtataatgttgaccatcggcagcctaagctgggaagcccttccttctggccatggacagaggcactgccgtggagcccttgcaggagggaagggatccttttctgccggtgtggccaggaccgtgtaaggagcatcggaagtattgatgggtgaaggtggtgggagtccagggagcctgctcagagccatcgattgttgactccattggatgggcttggccacatgaggatgtgcaggtaccacagatggctccgtacatctgccatgagcctgctggacagcagcacgtgaaggaacccagaccctcctgtgcctgggccatgttgaacttctggcctggaattgaatgagttcacacaaggcagtggaagtgggggacgcatctgcctggcaggtccacatccgtcacttttctctcaggcccagccctctccagaccagtgtgaccaacctgagaagcgtgcactcctctagccccagtaacttttctctttggctgttttctagcttcagtgatcacagtagaggtctgaaacggagaggacccaccagcaagaaggagccacggaagaggcggaaggtggacgaggcaccgtccgaggacctgctggtggccatggctctgtcccggtcggagatggagccgggtgcggctgtaccagcgctcaggctggaaagtgccttttctgagaggataagaccagaagcaggtttgtgtgatcagaagagtgaccctgggagaggccatcagcaggtcccgggtgagtggaccgactccaccgttgatggtgtcgcttttgtttctctctagagaataaaagtcgcaagaagaaacccccggtatcccccccattgttgttagtccaggactctgaaaccacaggccgacagatagaggaccgtgtggccctgctcctctctgaggaagtggaattgtctagcacgccaccacttcctgccagcaggattttaaaggaagggtgggaaagagcgggccagtgtcctcctccacctgaacgcaagcagagctttctgtgggagggcagcgcactgactggggcctgggccatggaggacttctacacggccaggctggtccctcctctcgtgccccagcggcctgcccaggtgagtccctcccctcaggcacatggataggcttttgggggaggttggcaatcccagaactgcaacactgggtacccacagccaggtgatggaaagtccaggaaggaaaggcagaggcgggaggaggccagaggggcacttggtggctgcagctttcttctctgtccagcaactacatggtactctgggtaggatcagggaggacccttggtgtccaccagagtgtgttcctggagtttgttgaaaatgcagagtcccggccgggcgcagtggctcacgcccgtaatccctgcactttgggaggctgaggtgggcggatcacgaggtcaggagttcgagaccagcctggctaatatggtgaaaccccatctctactaagaatacaaaaattagccaggcatggtggcacacacctgtaatcccagttacttgggagactgaggcagaagaatcgcttgaaccggggaggcggaagttgcagtgagccgagaccgtgccattacactccagcctgggcaacaaagtgagactctgtcttgaaaaaaaaaaaaaaaacagagtcccagggcaactggcaaaatgcctcagatggagcccggaaactggcattcggagcacacactccagacagtcgtgcggcaggtagccctacagtcagtacgcagctgcctgaggcagcttggaggacttcaggagggcggcaggcctgggcccccctggcctctgacaagcctttgtgcaaacagatgccacaggcctggccttggccgtgacagaggaggagcatgttgacatgagtgctggggaaaagcatcccaggactgctccaggctgtggctggagccccggggacagtctgtccccacagcccacatcctgctctgtagttttaggtccagccgtgcataccacatgtgatggcttctgcagtgtgtgcgtcaatgacagtgaccacgtggtcactctccttactggcttctttcagggccttatgcaggagcccgtgccgcctctggtgccacctgagcactcagagctgagcgagcgaaggtcacccgctctccacggcacccccactgcaggctgtggctccaggggcccgtcgccttcggccagccagagggagcaccaggccctgcaggacctcgtggacctggcgagggagggactgagcgccagcccgtggcccggcagtgggggcctggctggctcggaagggactgcaggtgagatgctgggtgggactctagggccagccctgccctcccgggcctcccctccccgcggctgaggctgccatggactggctcttgtgccgccgcgacggcagctctgacctggtgggagaacacgcagcctctgggcgctttcattttttctcaaaggtcaatgtggtgtagacaactctgtcatgattttccttccactttaaccaaagacagagctgtctgcccacagcgagtgaatcctctgggtgaactgtctgttttgctcttctcttacctccctggtggagtggtggtgagacagggtgtgcgggtttgctttgcatgaaggtgtcctcggatagcaagcaccttccgaggcaccgcaggggctggctcagcctgtggtcaacgctgtcttcttggtggtggatgtggctgggctgtgacgttcctttaacctgtgaatcctccactcagggttggacgtggtgcccggcggccttcctctgactgggtttgtggtgccatcgcaggacaagcacccggacaggggcggccgcaccttggtaagaactggctctggcccgcgctctctggtcccggccatcccacttgccatgtgtgtggtggggttggctcaccgctggcctctggcccccaacgcaagtgcagtggcctctcaaggcctctgctttccagaaggctgccacatcctgacatccgtgagcagagccacggacccacagccacctcagcgcccctctgggggctctgccacgagacttctgccttttctgtctgtgactccatggggcaccttggggttgaggccccagagcctgccctgtcctgggtcccaggagtgtagagggaccacagtttctcagcgcggttgccccatccaggcacgctctgctcgttcctcagtagttgggagctcaccaagggcttgctctccctcccctctgtgcgggtcctgggctccagagcacagctgagcagcctggcctggcctccctgtcagtgcgctgtctggggaagaaccggggtgggaactggcttttccctagagtggacctcctcccatttgcatgtcagtgtcaaccaagcacttcatgccaaggccagcctagggacatcatcacagactggacccggctgtcctcttggccaggtccccgagctgcttggactcagggtgcttgtccgtcacaggggatgggtgcacctcctcaaagcccaggtatcccgcagcctgtcccactcagtgcgggagctgccagcactgtgagttcacatctagccccatgtctggcatctccacgggggccagggaacccactggcaagagccagaggaacaagctagtgctttgctcttctgtgctactcagggccttagggtcactcagaggttgaggccatcgtgggaagcgttttggagaggaaaggagaatgcaggtcctggctcccggcccaccctagcgccacctccatgcggggagcttcccactgcccagttagcagagcagaggtggggaggtgacggctcttcctctcctcctgcttcagctctccctcgggctgctggttgctgactttggcgccatggtcaataacccacacctgagtgatgtccagtttcagacggacagcggggaggtgctttacgcccacaagttcgtgctttatgcccgatgcccgctcctcatccagtatgtaagtacgtgggctgccgtgtgccctcctttcctctctctccctctctcctcctgcctttctccaaccaggtcttcccatgtctcaggtgccctttccacccccccactctccctcacttcctgccccaccatgttctcaccttctccctcccaaccatccgtttctgcaacacgtggagaagagataaagacccacgcttgaggttaggagtgggtgtgaggggatggcctcacaactgggaaacatcagtgttttcgttctgttgaatgaaaatccattgtttggccgggcgcggtggctcacgcctgtaattccagcactttgggaggccgaggcgggcagatcacaaggtcaggagatcaagaccatcctaacacagtgaaaccagtctctactaaaaatacaaaaaaattagccgggcatggtggcgggcgcctgtagtcccagctactcgggaggctgaggcaggagaatggcatgaacctgggaggcggagcttccaatgagctgagattgcaccactgcactccagcctgggcgacagagcaagactctgtctcaaaaacaaaacaaaacaaaaagaaaatccattgtttcccagaattgttttctcttttctctatttgcataattacaaaggctcataattgatctcctcagggatgagttgctgatgaacctgccttctgacttgaaagcatttgacttgagtgtgggcaggaactcagggagctattctcagtctttgtcaaagttctggatcccatatgtgtctatcaggaggactcttaacggggtcctggaatatctagtcccaatacgatttgacaaaagaggagtgttaggcctcacctgtaaaattattggccaaaaatctgcataaacagtggctaatgcttttcctggggcatggagctgcttttaagactagggaccaggcacggcggctcatgcctgagatccccgtactttgggagactaaggtgggaggatcgcttgaggccaggagttcaagaccagcctgaacaacacagtgagagcccatctctacaaaaaaatttaaaaattagcctaggggctgggcgcagtggctcacgccagtaatcccagcactttgggaggccgaggagggtggatcacctgaggtcaggagttccaagaccagcctggccaacatagtgaaaccttatctctactgaaactataaaaaattagccgggcatggtggtgggcggctgcaatcccagctactcgggaggctgaggcaggagaatacgctggaaccgaggaggtggaggttgcagtgagccgagatctcaccactgcactccagcctgggcaacagagagagattccaactcaaaataataaaattaattaaaatttaaaattagcctaggagttcaaggctgcagtaagccatgatcacaccactgtactctagcctgggtgacaaggggagacactgtctctaaaaagaaaaataaaaagactagtgacttgcaggacaccccagaccgtctgctttgctccaagttacaactctctgatcagtaaaccctctgtgttgcatttcacctgcaggtgaacaatgaaggcttctccgctgtagaggacggggttctgacccagcgtgtcctgctgggtgacgtgagcaccgaggccgcccgcacgttcctgcactatctctacactgcggacactggccttcctcctggccttagctctgagctgagctccctggcccacaggtctggattgctccccagcttttgaaattaactgacgaggactggcaggttaacagctctggagggttgtgctgcagagggctcggggctgaggccaagagaactaacagtcctgtttataccttttaatcccaagtccatgaccagtgatgaccctgtggaacagggcatgttaggtgaaagtcaggccagaacagacccttgcaggggtgccaagcactggatcaggaggactctattgagtcccgtggtttttaaccccctaggtgtgataagagaatggcccttggctacagcgccccccaacactgctgctcagtgattgttccaccactagacctgaacaacagcagtcctttccagagtcccataaaacaggcatggagagaatgcttaggctgcatcccagatgccacagctctcctggcttgtccagccagcatcttaggagagaggcagcagctcagagggacaagtgttgtgcctctggacagggcctgggccgctgatccgagcctgcgtcctccctccgctgctttcttaggaaaggaacagctcagcctctggagttggaaatatactgacgggccacagagccttcaagcaggtggctggctggcttgcccgttggcctgggctgactcaaggacttggtgtgctgtggattgtgtctgatgccatgtcttttcatttattttttattttttggagagacggagtgtcgctgtgttgcccaggctgttcttgaactcctgacctcaagcaatcctcctgcctccgcctcccaaagtgctgggattatgggcatgagccaccatgcatgaccttttttatccttttagagacagagtctcttgctgttgcccaggctggatggcagtggcatgatcacagctcactgtagccttgaactcctaggctaatttttacatttttttgtagagatggagactttctatgttgtccaggctgatctcaaactcccggccttgagtgatcctcggcttcccaaagtgctggaatttcaggcatgagccacaatgcctggctctgacaccatatcttaagagcctctgaggcagcacagactccccagttttgtagctctgccaatccctgttaccttacattcagtccgacacacccctttatgtctgcagctatagttaggaagccctgctttaagtgttgtcagtccccggtttctggaactaagtggcctgggtgtttctggcaaggagtgtggacaccgtcttcaaagggaagcagggcctgggtcatggtcattcctcctggtgaagactctgctctggtccgccaccccaccggggcacccagagcccatctccacgcagaggggcgatgactgtcgatgtttcgtgttgcaggtttggcgtgagtgagctcgttcacctgtgcgaacaggtgcctattgccactgactcagagggcaaaccatgggaggagaaggaagcagagaattgcgaaagcagggccgagaatttccaggaactcttgaggtcaatgtgggcagatgaagaggaggaagcggagactttgttgaaatccaaggaccacgaagaagatcaagaaaacgtgaatgaagcagaaatggaagaaatttatgaatttgcagctactcagcgaaagcttctccaggaagaaagggcagcgggtgccggcgaggacgctgactggctggagggtggcagtccggtttctgggcaactcctagcaggtgtccaggtgcagaaacagtgggacaaggtggaggagatggagccgttggagccaggaagagatgaggccgccaccacctgggagaagatgggacagtgcgctctcccgccaccccagggccagcactcaggggcacggggagcagaggcccctgagcaggaggcgccagaggaggcgcttggccattccagctgctccagcccttccagggactgccaggcagagagaaaagaaggctctcttccgcactcagatgatgccggggattacgaacagctcttctcatcaactcagggagagatctcagagccgtcccaaataacaagtgagcccgaggaacaaagtggcgctgtcagggaaagggggctggaggtttctcatcgcctggctccctggcaggcatctccaccgcacccgtgccgcttcctattggggcctccccagggcgggagtccccgcgggtctcatcacacaagtgggtcgtccctgtcaacaccccggtcccgtggcggaacttcccaggtgggctccccaaccttgctgtctccagctgtgccatcaaagcagaaaagggacaggagcatcctcacgctgtctaaagagccagggcaccagaaaggcaaagagcgtcggtccgtgctggagtgcagaaataagggggtcctgatgttcccagaaaaatctccgtctattgacctaacccagtcaaatcctgaccattcgagctccagatctcagaaatcttcatccaaactgaacgaagaagatgaggtcatcctcttactggactcggatgaggagctggagctagaacaaaccaaaatgaagtccatttctagtgatcctctggaagaaaagaaagctctagaaattagccctaggtcctgtgagctgttttccatcattgatgttgatgcagatcaggaaccttcccagagcccaccaagaagcgaagctgtgctgcagcaggaggatgagggggcgctgccggagaatcggggctctttgggcaggagaggggctccctggctgttctgtgaccgtgagagcagccccagcgaggccagcaccacagacacctcgtggctggtgcccgccaccccgctggccagcagaagccgtgactgttcttcccagacccaaatcagcagcctcaggagcgggctggccgtgcaggcggtgactcagcacacgcccagggcctcagtaggaaacagggaagggaacgaagtcgcacagaagttttctgtcatcaggccccagacaccaccgccccagacaccgtcctcatgcctcactcccgtctctccaggaacttctgacggcagaaggcaaggccacagaagcccttcccgtccccaccccgggggccacccgcactcctctccgctggctccacatcccatctcaggggaccgcgcccacttcagcaggcggttcctgaaacactcgccgcctgggccaagcttcctgaaccagaccccagcgggtgaagtggtggaagtcggagacagtgacgatgagcaggaggtggcctcccatcaggccaacagaagccccccactggacagtgaccccccaattccaattgacgactgctgctggcacatggagcccctctcgccaattcccattgaccactggaacctggagcggaccggccccctgagcaccagcagccccagccgcaggatgaacgaggccgccgacagccgtgactgtcgctccccgggactcctggacaccacccccatccgaggaagctgcactacccagaggaaattgcaagagaagtcctcgggcgcgggctccctggggaatagcaggccgagctttctgaattcggctctgtgggacgtttgggacggggaagagcagaggcctccagagacccctcctccggcccagatgccaagcgctggtggagctcagaagcccgaagggttagagacacccagtgagtagccaggagagctggggaaggggactgtctttgttactattttacactaagagggtgggaagatcagtcatgagacccaggggctgccctctgaatgcctgctgacctgaggcatgacacttccgctgccttccagactcccctccacagtggaggagagccgggctggttctcatgctacacttctcagccagtaagtcagtgtttcccaaacttgcctggctccagtgctcacctgggcatgtgttaaaaatccacatctgtggacccttctccagaacacggagccggcacctccaaaggccacaactcattcagcaagtatcggcatgccttaagattggaccagggtggttctccagaatgttaaccgtagattgactgcaggacccagcaattccacttttacctgtatatccaaaagaattaaaaacagggactcagacatgcatgttcatagaagcgctgttcacaatcgccaaaagctggaagcaacccaaatgcccgtcaggagatgaacagggaaaccaaacgtggtccatctagaccactagaaaatggaatagtgttcagccacaaagaggagtgaggcactgccacacgctaccgcgtggacgacccagaaaacatgctgccgggtgagagaagccagacatagaaggtcatgtactgtctgcactcatggatatgaaatgtctagaataggcaaatccagagaaaatgcaggttagtggttggcctgggttggagggagggggaatggggagtgactgcttatgggatacagggtgtccttttggggtggtgaaaatgttttgcaaatagatagaggtgatggttgtacaacattgtgaatacttaatgccactgaattattccctttacgatttttttatgtgaatttcacctcaattaaaaaaagaatcaggtgggacaagtgtgagaggctgttaggcctgttcttcctggtcctcccaggtgcagggatgccacctccctgctcatttcagtccccggggagagtcagagccccaggtgtcggccccctcggtgctgctgctcccatccaggcacctccggggagggcaaggacaggccgggctgggctgagcatgactgggagaaaggccaggctgtgagtgagcacctgcctgcggcctgggggcccatttcctcccaaaatccagatgaatgaggccactgatagtgtcctcggccctcaggggcttcagaaacacctggagagcttcttatagcacgcccgtggcccagcctgccccagagccttgcttcgggagggtgactaagaatttgcatttctaaccagttcccaggcagtgctgtgagaacagctgcaggaggctgcacagcagatctgaggtgggcttcaggacgacgctgcggccacaggaagaatcgtgcttttctcaggagacagagcctgccgctttcatcgggggctcaaagggctccatggtcataaaaggcagaagaaccaaagtctgactgtttccaatgtgtcaccaggctggagtgcagtggggctatctcggctcactgcaacctccacctctcgggttcaagggattctcctgcctcagcctcccgagtagctgggattacaggcacccagcaccacgcccagctaatttttgtatttttagtagagtcgggtttcaccatgttgatcaggctggtcttgagctgctgacctcaggtgatccgcccacctcggcctcccaaagtgctgggattacaggcgtgagccacctcgcccagcctattattttttaaagtaacagctttatttagatataattcacataccataatatccacccttttaaaatggacagttcagtgcttctcagtacattcacagtgttgtacaattgtccccactctctaattctagaacattttcatcatctcaaaaatcctgtacccatgagcagtctctcaccttccccttcccccagccctggcaaccaagaacctttctgtctctatggatttgcctgtcctggacatttcatataaacagagccatatataactaatatgtggccttttgtgtctgtgtctggcttctttcagttagcatacagttttcaagattcatacatgttgtagcatggatcagtattttattcctttttattctttttttttttttttgagacggagcctctctctgttgcccaggctagagtgcagtggcacgatctcggctcactgcaacctccacctcctgggtccaagcgattctcccgcctcagcctcccgagtagctgggattacaagcgcccatcgccatgccatgcccggctaatttttttgtatttttagtacagatggggtttcaccatgttggccaagctggtctcgaactcctaacctcaagtgatccacccactttggtctcccacagtgctgggattacaagcctgagccactgtgcctggcctgtttttgagtcaggggtcttgctctgtcacccaggctgaagtgcagtggcgcaattacagctcattgtagcctcgacctcccaggctcaagtgatcctcccacctcaacctcctgagtagctgggactacaggcagctgccaccatgcccagctaattttttttttttagtagagactgggtcttgctatgttgccctggctttgggcatacattcctttgtatgtctaataccccactgatggtatgccacattttgcttatccattcatctactagtggacacacgggttgtttttaatttgtggttattaataatgccacttaggaatattgatgtgcaagttttcgtgtagacatgttttccttcttcttggttctgtacttaggagtggaattgctgggtcatatggcaactgtgtttagcattgtgaggaactgcgagactgttttccaaagtgactgcaccattttaaatctccaccaacacttgttattctgtttttgttgttgttgttattgttttgagacaaggtcttgctctgtcgcccaggctggagtgcagtggcgtgttcatggcttgctgcagcctcaaccttcctggctcaggtgatcctcccacctcagcctcccgagtagctggaaccagccacaaacagctgcccacattggtgacttgggccaccacaccctgctaactttttttgtatttttttttttttttttttgtagagatagggttctgccattttgcccaaaccctctgtgttttttgttatggccatcctagtgggcgtgcagtggtatctcactgtggttttgacttgcatttccctgatgactaatgatgtcgggcaccttttcatgtgcttattggccatttgtagatcttctctggagaaatgtctgttcacatcctttgcccttttttttttttttttttgagacagagtcttgctctgtcgcccaggctggagtgcagtggtgtgatctcggctcactgcaagctccgcctcccaggttcacgccattctcctgcctcagcctcccaagcagctgggactacaggcgcccgccaccacgcccagctaattttttgtatttttaatagagacggggtttcaccgtgttagccaggatggtctcgatctcctgacctcgtgatccgcccacctcggcctcccaaagtgctgggattacaggcgtgagccaccgcgcccggcccctttgcccattttttaactgggtttttttaaattgatgaattatttttaaaaagcaaaactgatgtctaagcctgtttgaagagtatcagtgtggcccattgtctcaagttgtcactgtgggtcagatatttttaagtttacatgcataagttttagtcacgtgccgggctgttgggttcagtggccccaggagctctgttcacccggcacccgtgttatacaaggtgtggtcctcagtgcgtgtcaccgatgctatcattgggaagcccctgctccagacagggaaggggtgaccactgttgctttcatggagcaaaacgatgcttgggttatcttcaagtgcattattcctcttggtcacgctactgggatcagatgtgggaaatccgtgtccctcatgctaaaacgtgtgcttcttttgttttacccagaaggtgctaatcggaagaagaacttgccccccaaagtgcccataacgccgatgccacagtattccattatggagacgccggtgctgaagaaggaactggataggttggcggtcttcaaagcttgttgcccacagtggtcttttccctcccataagtaactgggtttcacacacctgggggcggaagggccccccgtgtggtctctgggtctggtggatgcagctggcctgggcttgggaagaaaggtctgcagtcagctccttagggagcatgtgtgactgctgggtgccggggtgagcctcccagttctctctgcgtaccattccccagggaggcaacacacaggattcgtgcatgtcacccctgggcagcaggtccccatattccatgtagatggaaatggccccctagccagagcagtctgagtgaggaggtctgattttttttttgaaagacagagtcttgctctgtcgcccaggctggagtgcagtggcgcagtcccggctcactgcaacctccacctcccgggttcaagcgattctcctgactcagcctcccgagtagctgggactacaggcacacgccaccacaccaggctaattgttgtatttttagtagagacggggtttcaccatgttggccaggctggtctcgaactcctgaccacgtgatccacccgcctcggcttcccaaaatgctgggattacaggcgtgagccactgtgcccggcggaggcctgattttttttaaaagaacatttaactctcacatccacatgacactgctcttccactcgggcacccggggaagctgctgctgccaccatccctcagaactgggagcagcatatcttttgtttattttttatttttggagacaggatctcactctgttgcccaggctggagtagagtgatgtgatcttggctcactgtagcctcagcctcccgggcttaagcgatcctacctcatcctccctagtagctgggactacaggtgacaccaccacgcctggctaatttttgtattttttgtagaggcggggtcttgctatgttgcccaggctggccttgaactcctgagctcaaactgtcctcctgcctcagcctcccaaagtgctgggattgtaggcgtgagccattgtgcctggctggcaatgtttcttttggaatattcagagtaagcttagttggcgcctagaatagacactaacctctgatgctcacagaagtcaggcatctatggtttgtcacacaagccattcgctgaatgcattgggtatcactctttgctaagatagggaacgtggagtgtggaccagctgtgtgggtgggtcctgagatccacctgttcctccgtcaggtttggagtccgccctctgcctaaacgccagatggttctgaagctgaaggagatattccagtacactcaccagaccctggactcagactccgaggacgagagccagtcctcacagccgctgttgcaggcgcctcactgccagaccctcgcctcccagacctacaagccttcaagggcaggggtccatgcccagcaggaggccaccacaggacctggggcccataggcccaagggacctgctaagaccaagggcccccgacatcaaaggaagcatcatgaaagcatcacacccccaagcaggtcgcccaccaaggaggcacctccaggcctcaatgatgacgcccagatcccagcctctcaagaatccgtggccacctctgtggatggcagtgacagctccttgagctcacagaggtaaccggatggatgcgatggggtcagtggcctcatgtatcctctggcccgtgggcgtgagggttggcacgagtgagacctaatggccaatcttcaaaaacccccgtcaccttctgggtttgacctgtgggaaaaccaggtgggtttagggggctggttccctgaccccagccctgcgcaggcctcctggttcctgccccacatgctagacatttctggctggggcaggatcccgctggcgtagcctgcagggatctctcaggcccgtcctgccttgctggggatcgtgccacaggccaggctccatgggacccgtagacaccttccttcctttaaagaggctcatggtctcaggggctggagagaaaggggttgcacaacgtcctggtctggctcttttcagttcttcctcctgtgagtttggagcggcatttgagtctgcaggtgaagaggagggcgagggggaggtcagtgcctcgcaggcagccgtgcaggcggcggacacagacgaggcgctgaggtgctacatccgctccaagccggccctgtaccagaaggtgctgctgtaccagccctttgagctgcgggagctgcaggcagagctgaggcagaacggcctccgtgtgtcctcgcgcaggctgttggacttcctggacacccactgtatcaccttcaccactgccgccacccgcagggagaagctccagggcaggaggcggcagcctcggggcaagaagaaggtggagcggaactgatggggccatcccgaccccaccccaacctgccatcagcagcccccacccccgccatttgcagggaggacctgggacacccagcgtgggtcaggcctccacaggcatttctgggcctggggaccacatcagctctgcgctgtgatgatgaccacagcccaatccagggcttcctcctctgggctctgctttctagggtggcatttggagcatgtcacccactggatttacagactccagccccttcctctgtccgtgctcacagtgtgtctccctttttggttttctttttttttttctttttgagacagtcgtgctgtgtcacctaggctggagtgcagtggcacaatctcggctcactgcaacctccgcctcccgggttcaagcaattctcctgcctcagcctcccagatagctgggactacaggcacacgctgccacgcccagctgattttttatattttagtagaaacggggtttcaccatgttgctcaggctggtcacaaactccagagctcaggcaatccgcctgctgcggcctcccaaagtgctgggatcacaggcgccagccactgcgcccggcccagtgtgtctcccttaacccaagagggccctcagctgtcccagggggcagtgggccatcaccagctggccagggcatggcctattctgccacatttgccaccctctgagcccaccagtcctgggcacagctgccctacatgtctgtcctgagatggacgtcaggtccagcctgccccggcagcccgggcccgtcctcctcagcactcaggccaaccccagccaccgccagcctgagaccaggtgtcctgaggctccctgcactgccacagcccagatgcagttctcctgacccagccgtgctacccggacacttgtcattgttaccagcagtctccaaactggacagtgcacaagggcccagaacaactctgatgccaccacaaaacaaacatgttcactagcggattccattctttgggttaaagctgcctccagcctcaggagcagtgtggaggaagatgagggccaggaaagaaggaaaccttggtttctccatccttgtgaatgtcctcgtctgtttcaaatacagtgcagtcagttttatatgatgtgcaataaaccaaaaaggctttattaaaa

SEQ ID NO: 757 - DNA, 15462 bp, Homo sapiens
ccaagtttaacgtgtgtgctccactcctccaacctggccaaagggcagtcatcatcactggccactactgaccacagcctttagaaactccccttgaacgtgctgggctgaccttcctctgatcacaggcaaggtaaccatacactcaaggccaatgatcccatctgctgtgggctgggtcatgctcccaatgcttacagaacctgggaggcagaggaaaactctgcccatcccatgggacgttacctgtaagctttgaacaccagaatcttgaggcctatctctttctggaaggctttgtcttcctctaaaccaggaagctggagcaattccaccagattctgtacaacagatgcaacaagaaaattcatgaagagtagatcttaggttgaatttttcacagaagaccttgtaagaacagaaaatggtgagaaaaaaaaaccccgaggtcaatacaatggggaaaagcctgtgaagtgacctggcagcagccacacctgctgtcacctccattcccctctcatcttggaaacagatttgccctttacaactcaactcatagctcacccgccttcagagacttcttggcccatcttagctggaagggatctgttccagcgctgagcttttattttgcttagcatctactcagatgccttgactgtgtgtgtctcacagtcctactgactgacaaactccctgggggccgagatggcatggattcaggtctcagatgctctatggcacctgggagcatcttacacaggtgaagtgctcagtgatgatctggggtcactattctctgcagatcagcatgtctgagaggtaggggctcacagactgtggaactggtgtaagacctttgtcttttcccagctactaacaggtcctgcttgtcacagcccttccatgatacaaagttaagtcattttgtgtctgacacaggcaaaggaaaatgacaggcccttgccttcccggtcctcaagggtcagctgtaagatgatgtcataaagccggatcaggtcctggggccgggggaagcacttgctgtcatcctctggctgctgctgcagcagagccctctgcagacctttggccatgctctcattacgcttgattgccattgacagcttgatgtaagtcaggtaggtggaatgcaccacacgtcagctcaagttatactcagagaagcagaggaactgggaggactgcactacgagttggggctgacccagaggaagtcgggggtgagttggggcaaggccacagcagggccatttggcctgggcttcaagggaccctgtaatcccaactacttggcaggctgaggcaggagaatcacttgaatccgggaggtggaggtttcagtgagccgagatagtgccacttcactgcagcctgggcgacaagagtgaaactccgtctcaaagaaaactaaaataggctgggtgcagtgactcatgcctgtaatcccagcactttgggaggccgagatgggtggatcacctgaggctgggagttcaagaccagcctgaccaacatggagaaaccccatctctactaaaaatacaaaattagctgggcgtggtggctcatgcctgtaatcccagctactcaggaggctgaggcaggagaactgcttgaacctgagaggcggaggttgtagtgagctgggattgctccattgcactccagcctgggcaacaagagcgaacctccgtctcaaaaaataaataaataaataaaataaatacataaaataaataaatacataaataaaatagatatgtatttatgcaaaccatagaaaaatgtttggcaaccatcgcaagatacctgacaatgtgaaatagttttattacaactggcctgaccttcaaaggccttcacagctcctgccttcatgttaccgtctactatgttcctcgtgcaccttccactcagcacaaacaggctgcactgcctccgaaacacatcactggaaccctgcctctgctcctttgtccatctgaatcaccctctccacatttctgaccctgtaatcctgatctcacttcatgaggcagttcgcttctcttttgcatttagctttccccggggtacactgtcaatagcctactgtctgatgtcatcagtcagcacttcatcagaggcaattatgtccacagagcttttggctaattactgtcactcctctttacatgtgtgcatatgcatatcatctttccctaatgagactggaaatcatgattcattccctggagcagtggtttccataagtgaccaacccacagaccagtgcaaactggctgcaaaagagcttcctctgaggaacttattagaatgcagattctttgactgcatgggagaggaggatctcataaatctgggtgtaataggcacagaacgttaggtgtaatatgggcgggactctggactcagcatatccaacaagctgctggctgattccgatgatgccgatgaattgccaggttgggaactgctgcccccagagaacctagcagagagctctgtacgtggtaggtgctcactcccctattgtttgggtgtatgcctcctgataatgaacttgatcgtaacattattgttgcattatgcctgtattgtttccttaggtgaaggaagaatgcttttgagtacctaataggtggcaagctctgtgcctacttacatacatgaactattccttttaataacctttggaaataaagtggcatttccattgggcattagaaatctgaagactttcgtttacagctgttgcaacagcagaactagaattcgacctccgacatttctgctcaccagagggcatgaactgctggtttgtacctggcttgcagataccttctttgggcagcacaatgttcaaaattaaaaaaactaccaacacttctaaactggatactttgtatcaatatctgggtttctggcttctcttcatgggaaacaaacaaacaaaaaaaaaggtttggtgaacaatggggcccacattcctgcagggcaacagtcacatggagactttagatgggcacgtgcccagaacacactagagtccccatcgctccccattctcttacattctgttcccaactaggttcttataggcctgggtttgtgcctgttgcacacttatctactctcttgcttcccactggtcaggaagtctggcaaacttaaaaggcctctttttgttgctctctcctgtatggatctctcatcatagaggtgtgtgcatttctgactttgtgatttcaatactaaggaagctgtcggcacattatcaaggaaaacggggatcgctgctccccaacgtacacattctggtgtgccccagtaaaattctatattcagcctccaaactagctgggaaaaatgtggcaaatcatctacttgctccaattcaatagtgtttagaagtaagaagtcactgtgagcaatgccaccaagtggtggagagactccatgcagaatcgccaccttcagccagagaggctgggaggccgaagacctctctcaatgcacagggccattcagaaactagaaacaaaatgcttgctcatctccctaggccactccttccgaggctttttgagacaaagtctcactgtcacccaggccggagtgcagtggcacaatcaaggctcactgcaacctcaaccttctgggttcaagcgatcctcccacttcagcctttcgagtagctgggatgactacaggcatgggccaccacacccagctgattttttttttttctttttagtagaaatgaggtctcgccatattgctcagactggtcttgaaccaacacatctttagctttttaaaagacagccttggccagccatggcagctcacacttgtaatcactgcactttgggaagctgaggtgggcagatagcttgagccgaggagttcaagaccagcctgggcaacatggtgaaaccccatctctacaaaaaatacaaaaattagctgagtgtgatggtgcacatctgtggtcccagctactggggaggctgaggtgggaggattgcttgagcctgggaggtcgaggctgcagtgagctgtgattacctcactgcattccggcctgggcaacagagaccctgtctctatttaaaaaaaaaaaaagaaagaaagaaacctaaaaacagactggcacttaaaagagttgtgcttcattttttgactttctgtattaattttgtctgttcctttccttaaacaagctgccactgctgctgattcaacatgtttcattttatactttttttttttttttcagacagagtttcgctcttattgcccaggctgcagtgcaatggcatgacctcggctcactgcaacctctgcctcccaggttcaagcaattctcctgcctcagcctcccaagtagctgggtttacaggcatgcaccaccacacccggctattttgtatttttagtagagacggggtttctccatgttggtcaggctggtctggaactctcaaccttaggtgatctgcctgccttggccttccaaagtgctgggattacaggcgtaagctactgggcctggcccattttatacatttttaatgtgtattcttgtttttggaaaatgtgaccagaggactattaaactcttttagcatcagtatagcaaggaggtaaaaaaacaaacaacaaaacaaacaaaaaaaacccattttgtaaaataggattgagtatcgttggattgagcacttaccaagcaactgtgccaggcatttgcgtccttcatttaattcttacaagcctgagtgttcggtattttaattttataggtgaacaaatagaagctgagggtgaaggacctacagctgtcaccttcatctcttctcaacactgccaactgtccccttggatttcccagacagacaacaagggacatctctggtttctcggtgccccctagaaacctcgggtcatttcaaggcattatgcaaatgagaagctttccttctcttcacctcatctcctgatctgcacaaaagtgactgtaggacccagtgtaggtaccgatgtaggcaccaatcctcagtttaccacctgctctctacttgcttccctgccataactttctaaaagggatgtgagccatgtttaaagtcacctggtcactggagggatcttgttctaccccctgtagtagtacctctgtagggtagtacccactgtagggatcttgttctacatcagtggttgccaacctttttggcaccagggactggtgttgtggaagacaattttccacggactggggggctggggggaatggtttcaggataaaactgttccaccttaaatcatcaggcattagattctcataaggagggcacaacctagattgctagcatgcgcagttcacaatagggttcgttctcctgcgagaatggcatgccgctgctgatctaacaggaggcagagctcaggcggtaatgggagcaagggggagcggctataaatacagctcaccactcacctgctgctgtgcagcccggttcctaacaggccatggacggtgctggtctgtagcccaggagttggggaatcctgctctacagagtttccaacctcagagatgaagcatcccctctgtaagtcagaaagaaattattcaagtaggagaattaaaacaggatcacagagagggaggctgaaggatttgacattctgtgtttacttgtatgaggaaaaacagcacatagaggcatccacagtatttaatttgtttggataacagttacagataaacaggtacaccccatatacaattaccaatactttttatacagttcatatttcagtacatcaacactattttatttacactctatttatatacattaacatctttttaaattggaattattgtccatatgttttatattttttattccagtgatttcccttttaggaatttatctgaggggagaatactctgtaattactccataatttgcaggcaaatatcatcatagcattttttaggagagtaaaaagttattaacaacttatatttgtctcacattagaggagtggttaaataaagcatggtgtattcattggataaactataatgcagttgttgaaaatgattaccaggagtttttgctaacatttatgggaacatgcttatgatatgtgaacatttttttaaaaacaagacataaagttgcatatactggaaataataccttcaatattgaaaaaaatactatttaggaaaaaggacagaagaaaatctgccaaaatgttgacagtggttgcctttgtattaagaatataaaaggattccctgcctttttacatttttctctgctttccaaaatttccacatgaatattatacctagtaatcagaaaaaaatacagggacactcactcttatcctttacatttctctcctgtttggacctcagattcctcagtagaaaattaaactagatgccagcctgggcaatatgatgtcactctgtctttacaaaaaatgcacaaattagccaggtgtggtgttgtgcacctatagtcccagctgcttgggaggctgaggttggaggattgcttgagcccaagaaatcaaggctgcagtgagctgtgatctcgccactgcactctagcctgggtaacaaagcaagaccctgtctcacaaaaaaaaaagaaaaaaaaaagaaaaaaagaaaattaaactagacaaattcttaggcctcttttttttttttaatagtcttatatgaagactattacttcatttcctgtgttttgtgttaagatgagctttaaagcaactctgaaaaagaagagggtgcgtataagtaattcatagactgtttaaacaatagtagaggatctaagcatagatcccaagaggtaaagggaatctttatcactttgggaacttttactgataaatagaaattactgtcagtacagtccacaaatatgttgtttatcagccatctttcctccctgtcttcctctagcactgtagcctgtgttccacagaaaatatagtcaataaaattcaacattctttactagcttactctaatttgtggttggccgtaaagtattcctggtagagataatagagataatatttaactggccatgagaaaggaaacactatcgtatatgatacacccctttttctactcattccaacaacgatgatacagcacgtttccttttgaagcacgtgttttttccttgagtgaccagttcaaaagatgatgacagttaatatcttgttactacagaatttgtactcaaaaaagaagtctataacccaagtccaagccagatttccttttctaaaaaaagaattttcctctaagttcccctttttaaatgagctctttagcctgggtaattatgcagtgctagaaccgtaactgcatgatcaaacccaaccttgcttgtttataacagcatttgacagcctcgtgactctcacatagggaaaaagtctcgcctgaaaacccatgctaagctgcgtgtcttgagctgtgccaatttgtattccaggcagcctaaggttcccatcgtgagtttcaggaagggaaattcatggaggaagttcacctctggaagggtgaggagcaataaatagggtgggtgatggacatatgtgacgtttgccacagagaggccgtcagtatgggccttgtggtccgggctctgctttgggacacaaatataaactgtgtgaagtcttatggtagcattcataaccctgatgcttcacccaccttcccatacattagagggacaaacagaaggatcccagctctatggttcttgattgtttgtcaggtagcagccaggcatggagagggaaaaattctttcttttctgctgcactctagatccttccttctctcctccttcttcattctacaccacccccaacacatatccctgcaccccgcccattctttgctctctctcctttcttacacttaactccttcttgctccacagcctaacatgctgattaacaggaccccaaaggtttgggtgggtattaggggccttctcaacaaaagcagcacactcttgagcttgttcttccttttgttgccatctcagataaaaaggccccatgagggaggagacagataagtatagacttggtattctgataactctgtgttacatgggatcagatgtaaatgagttgtaccctgtggtgtttcgtgctctgctgtgttgtcttctcatggtgagcttttctgtgcccttatttcatccagctctggtttctgtgtttcatgttatttctcctagcctctgtaaactctgcagcatactaataatgctctggctttctgattaaagataaatggcttactatcatcacccctggtttgagggccagctcacatgtaatcccttataggattccaaagttgttaaataaatgcagttctttttgtcattttgaagcattcaaaaatttttcaagaaaagctatgatcatataaatagaaattttatccagaatgttacaatgtaacatttgtgaataaatgtgtaggtgctgtatttgctcagactctagtttgggttgtgttttcttttccctttttttttttgagacagggtctctctctgtcatctgggctgcagtgcagtggcgtaatcacagctcactgcaacctctactcccaggctcaagcaatcctcctgagtagctgggactagagacatgcgccacaacgcccagctcatttttaggtttttctttcacatagacagggtctcactctgttggccaggctggtttcgaactcctggactcaagcaatgccccccacctcagcctcctaaagtgctgggattacaggcctgagccaccatacccagccagttatattttctttttccttatatagagtaaaataagggtgagtgaccgagaggttgatgcatagctagatcaccagtttaaatgccttcccacacacccctttcctcctgttccctctacctacaggttgtagatgagcatgagagtgtggagcagagttggcgagtgcaagtcgagcccatcaacctggacagctgtctccgtgctttcaccagtgaggaagagctaggggaagatgagatgtactactgttccaagtgtaagacccactgcttagcaacaaagaagctggatctctggaggcttccacccttcctggtatgttacagtcctgcctctgagagagcaggaatctagcataaaagaaagaagacatgaacaaacaggaggttttgttatttttgagaataagacttttcctgcagcagtgtttaaaacactttctgtacaaggtttttatgttgaatacagagatgaatctttctacaaatatttggtagttccttttcctaaagagcttacaacctagaagaagagctcaatcatgtagaccagtaactgcaattcagtgtgatgtgagaactgccacaaggggtacaacgtggtgaatttgaacttcaggagagggtgaacttctggctctgtggagagaggaagctcaggctagccctttgtggactctagaagagcaactgagcccggagcccccaacacccactgcacatagtcatgtggctgtggcacgctgctgagttgagtgtgtgtgcacaagcacgccagtgcactagggcctgtgtgttcttttagattcaatttacttctgccttctcccttcatggattaggagactgtccttttgtttgtcaggagagtttgaagtgacaaatcttcctattcattaaggtcagtgtaactgtaaggtactggcctattttaatcagatatttatatgtattttctttctttcttttttttttttttttttttggagacagggtctcactgtgtcacccaggctgtagtgcagtgttgtaatctcagctcaccgcaacatctacctcttgggctcaagtgattctcttgcctcagtctcctgagtagctgagattacaggcatgcaccaccaccacctggctaatttttgtacttttagtagagatggggtttcaccatgttggccaggctggtctcgaattcctgacctcaggtgaaccacccaccttggcctcccaaagtgctggaattacaggcatgagccaccatgcccagccgtattttcttactctaatcatgtctctgtcacactactctgtgaagctgaatgtaagtttttcttggaccagaacagcttcccagggaatgatgcacaagaaattaataacactggttgtcagctagctccacagataggaactagagggaaggggcaggcttggggacaaggtgggtggggaggagggggagaccttttttttttttttgagatggaatctcgctctgtcgcccaggctggagtgcagtggcaagatctcagttcactgcaagccccacctcccaggttcacaccattctcctgccttagccccccgagtagctgggactacaggcgcctaccaccacgcctgactaattttttgtgtgttttttatttattttttttagtagagacgaggattcactgtgttagccaggatggtctcgatctcctgacctcgtgatccacccacctcggcctcccaaagtatggggattacaggtgtgagccaccacgcctggccgagggggagaccttttaaaaaaattgaggtataattaacatacaattaaaagcatagatttttaatatccagtttgatgaattttaacaagtatatattttcatataatcatcaaataaaacaagcagagcagtcatgtagcccagtaactgcaattcagtgtgatgtgagaactgccacaaggggtacaacgtggtgaatttgaacttcaggagagggtgaacttctggctctgtggagagtggaagctcaggctagccctttgtggactctagaagagcaactgagcctggaggcaatacccattgcgcagtcaggtggctgtgccacactgctgagttgagtgtgtgcacaagcacgccagtgcattggggcctgtgtagaggcctttaggaaaccatatttttgaagtatttaaaaaataatgaagagcaaatgttctgttatatattcccaaacattcacatgtatttgacttgttttttccatgtaaattttgtatcttcagaacgctttaatgcgatgttttctacctttacttctccagattattcaccttaagtgatttcaatttgtaaatgatcagtggataaaatcacagaaaattgtcaaatttcctcgggaaagttttgatccgagtgcttttttggtaccacgagacccagctctctgccagcatcaaccactcacaccccagggggatgagctctccaagcccaggattctggcaagagaggtgaagaaagtggatgtgcagagtttggctggggaagaggacatgctcctgagcaaaagcccatcctcactcagcgctaacatcagcagcagcccaaaaggtgaggcctgggggccttatgcagttgctttcttgggactcctgtaggctacatatgtttctgtcttctgttctggaacatcaggttggttgggtggaaggaacctatctggaatcagacctatctgtatttgagctatgtaagttttatcaagagattcagcctccctgaatctattttctcatctgtaaaatggagataatgccaggtttacagagttgagagtttgacacatggagagtaaagcacttcacacagtgcctgatgtatggtaaacaggaatggtagctgctgtcttgtccccttatagtgaaagttctgaggttccccatctttcagggggtctagaggatcaaaactctttatttatttatttatttatttatttatttatttattttattttttacttttttgagacaggttctcactctgtcacccaggctggagtgcagtggtgcaacacagatcacagctcactgcagcctcgacctcctggggtcaatcaatcctcccacctcagcctcctgagtagctgggactacaggcacgcaccactgcacctagctaatttttgtattttttgtagagatggtgcttcaccatgtttcccaggctgggctcgaactcctgcacccaagtgaacctcctgcttcggcctcctaaactgctgggattacaggtgtgagccactgtgcctggcccaaaactattttcataaaaatactaagacaatatgtgccttttcgcttttattctctcacagatgtacaatggtgtaagagacgacatggaataatatcgtcactttgacagtgaagtctgtgctaatgtattgtactttttcatgcctcagttttagtttctaatacaggaaatattgatagataaaattcatataaaagttctaaaggttctcaataatttttaaaggtataaaagggggtaggggtaagaggctataaccaaaaagtttaaagccttacaggatttttgtgagacatagaggtaacagtggacagcaagaaattcccagtaccatgcctaacaataggaagtactcagtaaatggtggttgcattttttgtctaattttacaaaggagaggaatatgtatttggaaaactccttactcttaataattagatttttttcaactgaatctgacataaatcatctttccgctattttctgagtccctataacctactttacattttcaggacattgttgcttatagggactcggcattgaagaagacaaaaatgtaacttactggccacacaataggaactaaagggtagccagtcacgactcccctgtctttacctttgtgtgtacatttgtgaagctaacctcagagttagcatttggggctggcttactttgtggcatttggatttgtgaatcttttcttctgtcctgttcacaggttctccttcttcatcaagaaaaagtggaaccagctgtccctccagcaaaaacagcagccctaatagcagcccacggactttggggaggagcaaagggaggctccggctgccccagattggcagcaaaaataaactgtcaagtagtaagaagaacttggatgccagcaaagagaatggggctgggcagatctgtgagctggctgacgccttgagccgagggcatatgcggtgggggcagccaaccagagctggtcactcctcaggaccacgaggtagctttggccaatggattcctttatgagcatgaagcatgtggcaatggctacagcaatggtcagcttggaaaccacagtgaagaagacagcactgatgaccaaagagaagacactcatattaagcctatttataatctatatgcaatttcagtaagtggtttattgtatggttttcggagagtggtctgtgttttgttcacttgttttcatgtattcatcagcaagtatttttcaggtcctgcttatttcctagcattgagcttagtgatagagaaagttaacatagaaatctgggcctgcccaggtgtggtggctcacacctgtaatcccagcactttagaaggctgaggcagaaggatcgcttgagcccaggagtttgagaccagcctgggccccatctctacaaataattttaaaatggagcgaggtatggtggcattgcctgtggtcccagctacttggaaggctgaggcagaaggatcacctgagcccaggaggccaagtctttagagagttgtgatcactcgactgcaccccagcctgggtgatagagcaagcccctgtctcaaaataataataataatagtaattacattataaaatgattgtttatccacacaagacttggagcttatgacttttgtattttgctttttgcttattttggttttagagaaagttagagggttctaaaatattttctcacctactgatcatttacatgatcactgttctcctgctcagatcctagtgctataccctggccatagtacatagtacagttaacaactaacatacatccactctcttatctcttacagtgccattcaggaattctgagtgggggccgttacgtcacttatgcgaaaaacccaaactgcaagtggtactgctacaatggcagcatctgtgaggtaaacattctcaatctttgaatgaaggttagaaacagaatatcaacagaactgggaaacatttgttgaaataatagactatctcttgaataggaaatagatatttctgttagaatcaatatatagatgctgtcagtattaaagaaacaaaagtgatatgcagagtagggaatgaaaacatgagtagtgaggaaaaataaagagttagttgactgggcgcagtggctcatgcctgtaatcccagcactttgggaggctgaggcaggcttaggaggtggatcacttgatgtcaggagttcaagaccagactggccaacatggtgaaaccccatctctgctaaaaatacaaaaattagttgggcatgttggcacatgcctgtaattccagctactcaggaggctgaggcaagagaatggcttgaacctgggaggtggaggttgcagtgagccaagactgcaccactgcactccagcctgggcaacagagcaagactccgtctcaaaaaaaaaaaaaaaaaaaaaggagttagttaatgcaaaaagctcctatcttctagactgttagaatttgatggggttgggccaagtgcagtggctcacgcctgtaatcccagcactttgggaggccaaggtgggcagatgatgaagtcaggagatcgagaccatcctggctaatatggtgaaagcccgtctctactaaaaatacaaaaaattagccaggcgtggtggcacatgcctatagtcccagctactcaggaggctgacgcaggagaatcacttgaacccaggaggcagaggttgcagtgagctgagatcgtgccagtgcacaccagcctggtgacagagcaagactccttctcaaaaaaataaataaatacaaaataaataaatagaatttgatggggttttaggtcattctcttttgacttgtctatggtcaaaatattttctccaaagcaaactttggaaataatggggctcattttaaaggggcaggtgtgagacagccaaactagtgagcttattggaagcaatcaggtttagtaattacagagggttggtcttccctttcctggcaaggatttagagccataatagtgatggctttttgttaaaggtttttcttgccctttcaggaacgtcaccctgatgaaattgacaccgactctgcctacattcttttctatgagcagcagaggatagactacgcacaatttctgccaaagattgatggcaaaaagatggcagacacaagcagtatggatgaagactttgagtctgattacaaaaagtactgtgtgttacag
